United States Patent 11,001,841 (CCCTC-BINDING FACTOR (CTCF) RNA INTERACTOME) - sequence listing, part 24

SEQ ID NO: 59648 - DNA, 1054 bp, Homo sapiens
ctttggtaggatcctggttcaaaaaaaaaatcagctgtttaaaggacatttttgggatatcttggagaatctgaatgtgaactggatgggaaatgacatgggaattagtgattttattaggggtagtaatctgacaggagaatgtccacggtttcaggagattggggtgaagtgtcatgatgtctccaactttctttcaaatggtctagcaaaaaatacaggtgtaagggcaagaagtatggtagaacattaacaataattgaatgtatagaaatgattttcttttaaaaacttttttttgtagattcataataaaggagataggaaggattctatatcctagtaggagggaacaaaactcttatccccaagtatcttttgaaagtgactaagtttactgtaaacctttcacagaaatggagaaaatctcatgtttttgaaaaagctgaaagaaaataatatatgattatagtaataaattaaaaggctgttgttttgagattatggttttctcatatctcaaaggtttgttgcagggaccagaaagaaaatctttgttgcaaacagtgtgaattttaatttgaaacttcagtatgttttccttgtttttgatgattttagagccaaaggacgaaacaaagtacagtcctcgccccagtcattgacctgaagcgaggtggctcctcagatgaccggcaaattgtggacactccaccgcatgtagcagctgggctgaaggtaagcccgcgcctgcctgtgagcttgatacgtgtctctgttcccatgtggcttattttgcatatgagttactcttaacagatggcctccttggtgggcctttgaaaccaagttagtatcattttccacctaatttttacttctgttttgccaattttaaaatgtatctatttgaaattaaatagtttgttgtagaaaaatcagaaactagagatacgcagaaagaaaaacaaattaccttcagtcatacaatccggaagtgaaaaacgtaatatttttccatcctgtgcctactccaccttctgctaacttgctt

SEQ ID NO: 59649 - DNA, 1483 bp, Homo sapiens
tgatgttgaaaatttttttctatgctgatactctgctataggttgactatcccttattcaaaaatccgaaatctgaaatgctccaaaatcttttgaatgccaacatgccgctcaaaggaaatgtgcattgggggattttggcttagggatgctgaactggtaattgtaatgcaaatattccaaaatttgaaacacttctggtcccaggcatttggaataagggattctcaacttgtaaaatcacagctatttaaagtacttgaaatattcttcttaactttactatttttgagccaggtggaatttttaaaaattcatatgcagcttttatttatgtttttgcaaagtacgagtagtaggatgtatttgtagttctttttaaaaatatttagtattatcaaatagttaacatgtattaaatattaatatactgtttcccatttattgaatcatttcatgagtgaaagtgttatagactattgaaatgattgaactattactatgttgataggctttaacattggaagaggtcaatgtcaaggaaccttttttttcatgctggttgctctcgtatacttattggttcaatttatctcttgaatttttctcacttttcatacttttatctactttagtcttttaccagttatgcttcctaccccctctacccctgcaacttcatagttgattgtgacaggatttggatatcttctggtcaagaggaagtcatcccaggttcaggtctctaaattggttcatctgtgatgaacatttatttcctttgttatcacagaaggcgtaaagacagacatgaagcaagtgggtttgcaaggagaccagatccagattctgatgaagatgaagattatgagcgagagaggaggaaaagaagtaaggcatgaacaaatatgtcttaaacatatataaatactggaagtgcaattccactatgtgctttttcttttcagtttgataaatagttcatttgacattgatttgggtaattttctttctggaatcccagcaatacacatttgcgtcacagttttaatttatattgggttttcatatgtattttcctttgagcttcacaaccactttctaacatttatttattggatactttgggactagcttaaaatctattcctgcactgtctttacctgcagcacagtccagttggccgatgctgaatccactctgttgtttctcttaggggggaagcatagttaacattgagtgtgtctgttttgggcattgtgacacatttcatatccgctatcttagttaatccccaaatgtttggtttttattaacttcttttggaattcagtatataggttgaatatttgtaggtctcatttttccagcttataaattgactgccctttttaataaggaggcatgctttccatactaaggacatttgtttttttttcttaaacaccagcaggaactagatagctttgaatgagaagacttt

SEQ ID NO: 59650 - DNA, 2533 bp, Homo sapiens
aagagtgtaagtagatctgtttcttcctcttttattctgatacaggtctttaacccaaccatgggggatctcagcttgggcccccaggtttcctgagcgtagagggaaacggcctgcaagcctgcctggctctgtcacctgaggccgcacctggatctcagaatgcagcgccctcctgcagagagagacctttctacgccaggctctgaggcttggatttcatgcagtgggatccatctcttttttatgcaattcactttgatttcattaacatttcttatttgttgttagattcatttggagttaaaacagcagatcgttacagttttttaactcagaggtttagaggctgttatattcatgatcctccacaaggtggcaatgccttccttgattagattttttcttcccgttccatttcactgcaggtgggtttgcgtgtcattgcgttgccaaaacaccctcacccactgttccttctcgcagtgatctgctctagaatttgggggttgggactggacttctgaatatcatctaggtcattttcccattctctggattggaccatacttaaactatcccaagcagatattctcatttatagtactttttaaaacttgttgaattctttatcttttaaagaagataatttctaagatattatgaaatacctattatgtgaaaacaacagacaaacaataaaccccaattgaaactagtctctgggagtggggctcaggcatctggatggtcttaaagcgtcctactgactttcatctaactagggttgaagccaccgctccagtgcgtagcccctaacctcggacacctttgtgggccatgagctgatgagatagtgaggtcggggtctagacaggtgcacccaagttactgcaggagtcaaaagatggccagattgtatctccttagaacatacagaacatctttccggcaagaatattcattcaagaagattttaaagggtgaataacatttcagtaagatataaaaaagacgtttgaggagatagaaatagcaaaaggaaagttagaatcaggaaagtagcgtcctccctctgtggttttaaaaaaagtcgtataaaggctgtaaaattgatttggtgtttttctctccttgtggtaaaccaaaaagtaggttaaatttgttcaagataaataattgatacaagtgaggtttcagagtgttttctatagtattttggtgagcctactttatttttctccaatagtaccccgagattttccttatgaagaggactcaagacctcgatcacagtcttccaaagcagccattcctcccccagtgtacgaggaacaagacagaccgagatctccaaccggacctagcaactccttcctcgctaacatggggtaatgatttaatgttcttatctaaggacttgagagacagtgtgaagcgttgatagccctttcaatagatgcagcttgtttgaaactgaggacattcaggacccttggtgtgtgcaggtcacacggtacctgcctcaatcgtgtggagcgtgttccagtgtaatgatggggcttgttcaaaacagcaacctcccagtagaagttttgactcattttgatgttgaacattattttcctagacaggcacagaacctgattaatgtttacatttgccttcataacgtttgcaaataaaatagctcatatgaatcagagctgacttactgtctccaaagggcaggtgataccttttttttcctgataaagtgggccatttgctttcaggtcatggttctaaacctttggtctaaaaaactcggggtcattctaactacaagttgacatgtttgccagcatataaaatttgactgtaaggctgacgctcaggtggggcttggggatttttttaaactgtgctgggcttggcaaacattttggttaagaggatattctgtgttgttgactttgatcctgtgagacggctgtcccatgaagcagtatcacatgaaggctttgttctgtgctgtgttgcatctgctggctgctgcctgtagcagaaatgcagccggtgagacagtgagtggggttgaaactcactagtctcctttcaagtgctcagtgaccacatgcaagtggtgacgatgttggatggtgcagacataggacatggccgtggctgcaggaagctttgtgtactggagggttggacagacatgaagctggttttgttttgttttgttttgttttccctgtttatgataaaaactgactttttagcgaatttgcttttaaccaggaattacatctttaacttgtgcttaggaaagatgcaagatggtaccattcagcagtttctggtctttttagccctagaatagcttgttcaaatgaaaatgttaagggaattaaatacaagaagtaatgtaggtgcagttccagttgaagcgggattttgtggcttaagccctaagcagcagtggtcatggggttggggtgcccttcagacccatgctgcgcctcagagcgcagtgtgagagccattt

SEQ ID NO: 59651 - DNA, 3653 bp, Homo sapiens
agtgtggcagtgaatatacctgctatctccatctcagaggtcgtctctacttttcccttttgccctttcagtatagatgtgatttctgattctcttacagattgtttgctttgcgagatctgatgttatgttgcagtctcttggtaaatgatgcctagttggtgttttattttcatttaatttttacagtctgttctgtgttgagggaattcaggaaagagacaaacatatgttagcattttaatcagggaattaagtttgagtcagcctagctgaacttcctttgctaaagaaagaagaaaacttttctggcagccccgttcatgcacagcttaggatacatcacgagcctgacaggtgagtgccagaaaccaacagttgtcccgacttgtgaggttatctgaagtaaggcagccggtggctggattagtaactgcatattcccctgggcccgtgaccttgaacgtttgctccaagtcaactcacctataggaattatcactcacatgccctgtcagccctttgggaagtgagatgagcaaaaattgcaagtaatggtggaggctcaaaacatccagatgctattgtaaaaacatgccaaagcaaagcagaggcttttattgcagataaggctgtgttttcgctcagagaccaattgtgtagatgcctaggacataaatggtggggatcgctattgaaattaaattaattattgtaagtaggactcagttctgtaacacatctaatgatatgctgctcagttctgtaacacatctaatggtatgttttgatacagatgcatccaagaagtcagattcaaatccgctgactgaaatacttaagtgtcctactaaagtggtcttactaagggtaagaagctgaggaaagcaagctctctgcctgcctagatttgtgtgtgtcaccccagcctaccctgctccccctaaaagttaaaactgaaaatgatacttttgcaaataatactttgggcagatcccacgtaaggctgattttagatttttcactaatgtgtaagtctctttgctaagtacagtgtttaagactgcagtgagtaattaaatatttgaaattgctagagcttcagatagtttatacattttggtgcttgcatagatgcttttgtaactctttacaggcttaatatatgttttagtgttttaagaaatactaacttttgggtactttggggatgaaatttttcattatgtcgtttgggattgagaacatttaccatcactaagtcatatttatatacctctgctaggtgtttgtaagttatacttggtacttgaatttgtttatttttgtgtttaaagaacatggttggtgcgggagaggtggatgaagacttggaagttgaaaccaaggaagaatgtgaaaaatatggcaaagttggaaaatgtgtgatatttgaagtaagagtgttttcttttgatgtttataacacaagttgtaattggcacattacaaaacattttctacaaacaggacagggtatgctataagtaacattcttactgcagaaggtgacaggcgttggttatttgtacttctcttgctcaattattacagttttaaacataaagacaatgatttcaagttttatttgatgaagaaacaggaatgcttcatgattgaggatcagtatgatgactgaagaccttgattctagcgtgctcagtagtttagttccttagacatgcctttggtttcagtcatttggtgagtatttagtgcctctcacatgcactgcactgtgcggagagcacttggattacaggaagcatgctctgtactctcagtggtgtgttcagttgaagaaacacataaaataactgaaagatattcagttactagactaggtagtattgactaagttcaggagttgagaaaaggattagatcagtgaaaaaatagactgccttgtgagcaatagcagatatgggctgcgctttgaaacgaacaggtgggatttgcagggaagggtattctgattgggataatggctcgtaggagacagtgaagatcaggactaccaaaatggaatggatgggcctgttggggattagcagaagtgcttaggtgggtggaattacagagggctaggaaagctagacagagctagtcaaaatgagacctgatgtgaaaggccactagggcaccagcctttttaatctgaaagctctgcttcctctgtttctttatcctgttgctgtttgttgaccacataattatttgtttacgtcatcagctggcacagggcctttatgaggtcagagactgcctagccctgtgttcctggcacctaacaatgcctgtcataaaaacaggcattcagtacgtttttgatgatgaacaaattatacttatttccttggtatttgacaactacttgactgtatatgatgataattagaatatccactctgagaaatcatttaaaagagaaaactcattcaatgcaatctcaaatgcctttactcatcacgctctcattttcttccagattcctggtgcccctgatgatgaagcagtacggatatttttagaatttgagagagttgaatcagcaattaaaggttagtggtacagctaaatattaaagaataaaaaagttgaatttacagccttaatctttacaagtaaagttactgtttaattaaagttaaacctttatcttataggatacctgtattaactgtcttttgtttgcctttcagcggttgttgacttgaatgggaggtattttggtggacgggtggtaaaagcatgtttctacaatttggacaaattcagggtcttggatttggcagaacaagtttgattttaagaactagagcacgagtcatctccggtgatccttaaatgaactgcaggctgagaaaagaaggaaaaaggtcacagcctccatggctgttgcataccaagactcttggaaggacttctaagatatatgttgattgatcccttttttattttgtggttttttaatatagtataaaaatccttttaaaaaaacaacaatctgtgtgcctctctggttgtttctcttttttattattactcctgagttgatgacattttttgttagatttcatggtaattctcaagtgcttcaatgatgcagcatttcttgcactaaaaaaaaaaaaaaaaaaaaaactagaaagttttgggacatggggttatattaaattattctttgtttttctttttcttttaataaagcctgcaagttactaaattgtagtttcataaattctgtagtaaagtatcatcttggcagtgtgccaaaggtgaaaatgatgctttctctaacagagaaattcttagtgactccagtcgtagaaaaacgtctttacaacctgaataagattgaagaattgtgaacataccatggcctattggatgaatcatttgccgtaggctaaatcagactgtagggtttgtgatggatttatggagtatgtgggtatagaaatcatgaatctagcatttgttttcagagattcaagcatagtcttaagggtagatcagaaatgacaaatgaattcaaaacctagcaggtgcattgtaaatgtgtgcccagttatgttttggaaatggcagttccttggggtcatgtttctact

SEQ ID NO: 59652 - DNA, 1111 bp, Homo sapiens
tctctaatccctcacctggcttttctgggcaaaggccagcccgcttctcaccacccccttctctcttgcatatgcatccccccaacattcacacagaagcacgcacacacacaccccttgaggtctagactgggggtctgggtgcaggagggtctgagctgggagacctccccactgcagcagcagtgtcacaaacaagttgtcctgcacctaagactaatctggagtggaggctgggaaggaagcggtcctggtgctgccggcagcctttccatcctagggccgagctggctggggagaatgaggggcctttgaagtcccaggccgatcccttcgccagacctcccaggccaggtctccacgccagcactgtgtttcatcacaagtgcaaagcttccagcagagcagtaggtcccgagcgggagtgccgggatgtggcctcgaggcccccgcctgtcattgtctcccagcctcaggccctgttccccttctaggcttgtgccacaccaggctaagaatcagagcctgggtgtgggggcagggggagctggaggagcgggcaggactgcccagtgctttcctggcttagctgggcgaaatccaaatgcagtgaagttcgccttgcagtccagtgtccatggccagggcaggagggcagagggctgagcctctgccagacagagcagtgcccttcccagccccccagggtcttcacttgcttcacagagggtcagctggaaggactatggggccccacagacccacctgtcgccacaggttgagaacatggatggggcggtgcccagcacggtccctggctccaggacacagtgcacagccacagcccatacacgccccagccccaaacctaggagacttggtccttctgtgtcacacctctgttctccctggagttgcaggggattttctctggaaactacctagtagtttagggtcctaagaatttatccaatcttctttcagaagatcacccagttcttcattctcaaaaacaaagcacaaagactttgaacagctgcggaatggcttgtcataagccacacaggagaaaagtccgcaggcccagcaccacgccaactttggggttggc

SEQ ID NO: 59653 - DNA, 1041 bp, Homo sapiens
acacacacacacacacacacacacagctttctgaggaggagtacacagaagggaacacgatccagtctcaacactggcgatgacagaccgtcccattctctcatatgaaccctacacattgatccagcccagcctggaggtttcctaacatctcgtcagcagctagcatcgctgtccaaaacctgcccgttttttttttctttcttcttttttttttttttttttggcttgatttggctctatttttagaatgttttccactgggagaaggaagaaatatgaggggaacagagcagggagaggtgccagctgtggcttgccagcctagggttgctccgtggcatgtgtttacactgcagtcatgggccggccttgcctggcccctgcgggtcacccgggcatgcttcccatacccagcagaacgtgatctgggttccagtttctgttctccctagtcctgggttaggaaactcagttgttttgacattgactcttcccctcacccgtgtgtgtgtgtgtgtgtgtgtgtgtgtgtgtgtgtgtgtgtgtgtgttgggggatgtcactgatctgctggggaaaccaaggggtgaagaccaaatcatagagcagcccagatcagagggaatctattcagacatctggggtgggcttgcacagttacaaaaagtgctcatccagggattggttgacctaatactttatagtttttccaaaagtgcttttgctcatatccagtttggtcttcgtaaggacctcttgaggtagatggggctgctgttctcattctacagatgattttactgtgaatggctgtctgtccacctcagagccctgcaggatttatggaagctgcttccagcttcttatgtgagccagtactcgctcctacttaggattatatattgaggttggacatggtggcttatgcctgtaatcccatcactttgaaaggcaggagatttgcttgaggccaggagtttgagaccagcctgggcagcataatgagaccccctgtctctacaaaaacaaaagatagaa

SEQ ID NO: 59654 - DNA, 1068 bp, Homo sapiens
gggtgtggctggggggctgtggccactagggttgcctggtcccactgtggtacaatgccaggggcttcaggatggggagatgaaatgaaaatttcgatgaatgctgggtgtggtagctatgcctgtaatcccagcactctgggaggattgtttgagaccaggacttcgagaccagcctgggcaacacagcgagaccccatctctacaaagataaaaaattagccagggatggtggtgtacacacttgtagtcccagctattggggaggctaaggccggaggattgtttaagtctagaggtttgaggctgcagtaatcatggtggccaccgtgctcccgcctgggcaacagagtgagaccctgtctcaaaaacatttttggtgaaattcttcagtgttattgttgggtgtggcctctgctcctcttctccggtcacttggttgatgacacacccttcttgcttgtttttccagcctgtgggccaaagctgaccaactcccccaccgtcatcgtcatggtgggcctccccgcccggggcaagacctacatctccaagaagctgactcgctacctcaactggattggcgtccccacaaaaggtgagactgggtctcgaggccggacccctgctcgtgcaaaaacttgaccttccatctcagttgctggtttcacaggcaggaccacccctgggcgcctctgtcccctggtcggggagtctgatcctgcctcccatgcagctgggtccccttcacactgtgtctacaccctttttcttctgttggggttttctcctcactggccattctctttcccactcctctaagtcctgccccgactcagatttcacctccttcaaagccatctccagccacctcagtcctttacattcctgtcgcactcagtcctagctaacattcctctgctgatagccctaagcactgcctaccgtagatcaagggtcttcaacccccaggctgtggactgctatgttgggtggcctgttaggaacctggctgcaggaggtgagtggcagtgagtgcgcattcctgcctgagctccgcctccagtc

SEQ ID NO: 59655 - DNA, 1015 bp, Homo sapiens
acacgggacttttagtttgcgaagggcctagatagggagagaggtaacatgaatctggacagggagggagatactatagaaaggagaacactgcctactttgcaagccagtgacctgccttttgaggggacattggacgggggccgggggcgggggttgggtttgagctacagtcatgaacttttggcgtctactgattcctccaactctccaccccacaaaataacggggaccaatatttttaactttgcctatttgtttttgggtgagtttcccccctccttattctgtcctgagaccacgggcaaagctcttcattttgagagagaagaaaaactgtttggaaccacaccaatgatatttttctttgtaatacttgaaatttatttttttattattttgatagcagatgtgctatttatttatttaatatgtataaggagcctaaacaatagaaagctgtagagattgggtttcattgttaattggtttgggagcctcctatgtgtgacttatgacttctctgtgttctgtgtatttgtctgaattaatgacctgggatataaagctatgctagctttcaaacaggagatgcctttcagaaatttgtatattttgcagttgccagaccaataaaatacctggttgaaatacatggacgaagtaaacctctggtcttttcgtgggggaaagaagagtctttaattgatgtttacggcagatgcgccacggagctgccaactcaccacttcattatcttcctttcaacaggatgttcaagtacagagtgtctagtgcctgcatttggggagaatgagctgtctcaatttttcttctaattgataggcttcatgttttatttttatttttaatttaatttttttcttttttttctttttttttttttgagactgtttctcactctgtcgcccaggctggagtgcagtggcgcgatctcagctcactgcaacctcctcctaccaggttcaagcaattctcgtgccttagcctccct

SEQ ID NO: 59656 - DNA, 1079 bp, Homo sapiens
cctttagaattaagtagcttagataaattttcatcaaaatctttatatagtagggaatagaaaaaagtcaattctgttttatttgaggatgtatgaatatgttaccatttttcagactctgatttaccttccaattattgtttattggggtcattgtaaattagttatcattttttgaatacacattcactgctgacaaagtggtgaagccagaagttatgtttgaccagggaagattatgaccctcaaaggagaaaaattcacagggggtagttgattattggtggaatggagtgagagtgaattccttaaaagtttaaacgaaagcagaactatattcatatcatggagggaacttagtttctaatatgatgaactattgccccaagtcatgacaataccttgctctctggaagagaatgagtgagtttttcatccgccaagatacacactctatatttccaaccatcacatctgccttgcaggctgactgaacccagagcaaatcaatcacaaaagttaatccaaaagacttcccttcagctgctggaaatcagtcatcacatctgtgaaaagagtgctagttataacaaatgagatcacaaatttgaccattttattagacaccctctattagtgttaacagacaaagatgaaggttaagttgaaatcaaattgaaatcttcttccctctgtacagattgcaatatctgataataccctcaactttcttggtgcaaattaattgcctggtactcacagtccagtgttaacaggcaataatggtgtgattccagaggagagtactaggtggcaggaaaataaatgagattagcagtatttgacttggagccataggcatcaattctgctccagctgtcgaccaggttctaaaaacaagactcggagcagcttttgctcttgctagtgatgcagggccaggagagcccccacactctgcatttgcaggtgtccatgaggggaagccactcctgcatttatcctgtgagtggagaagctcagaggaatgaggacattccaacagggtatcagaattctcttttgtttatgctaattga

SEQ ID NO: 59657 - DNA, 1769 bp, Homo sapiens
tgggcatcatgccacttggaacttattggaactggcccgggagactctgcagtctgcgccgtttgaaaaccctgagaaagagatgccacctcaacttgaatcatgacagcccatcgctcagtctcaccctaaactcatggagcttgtttcagctcctcacttcttgactgtatttgtactatgttgaaaaaatatcctgtccacaaagacataagcctaacaacctagaaaaacaacagggtactactggcattacagaacttctttgcctttcaaaacaaaagcaaaacacagtgaacttcaccacggagctgcacagcgtggggaactcatccatcactttcaaaattagagtcatttgatccaagttggagtcagacacagtatttgagctgcacggcttctgggttctcccaccttatttgatcatattcgaaagattatttcctgtgtttgctttgatttgttcctcagtacattaaaatgatccacaccttgaacactgccctctctagaaggttgattttgatcagccttttgaagatgggtgtcgtttccctaacttatctcacagaattttgagtgttgtatttggcaagttctgagatttgccttctgtcttatgccaaacacccctttctaagagctgtccccgcttagttttagaagtactaggggttttcatacttattttatagaacacccatttatatttatttctgtatatagaactaaaaaaaacagtagtgttaaaaatctttgttgtggtttgagcatctttgctgcttttggattgagatggcgaatcaaggcttcacttcctctctcttctgtctttagaaagctgtgatcgtgcgtgcaattatttgaaaggcaacatagtcaattaagaaacctgtagttgttaaggaagaaattgttggcaagatatccatactgcccatatctcgttggtgcaataattaaatagcaaaggaaatctgtattggcaactattataattcaataattcttttgtttactgcccttttctgttcaagaattttctggaaattactccctttcacatggttgaactcttaagttgaccagttctcatagctctatcactagaatggtttgcagataccccaaacatactatgataaaatcaaattgtgctacttttgacccatgtaatttacctaaaagttgtaattgctgacagagtactgccttgaattttggtttaaaacctctctagtttcaatgacaagtaacaactcaaataattccatattgtttgaggaagaggccataatccttctgaattgttggcactaagtaatgggatttggcccagtaagtatgacggtcgtgtcgcctaaccaacgcagagcagtgctttttgtgtggctgaagcgatgtgctgacgaaaaaaggaaaattctaggacaatcgttggctaaaaatcaccttaggatgaaaaatttgaggcaaatttttttaaatgacagaaaaagataatcatctcacttgcttgaaacaggagccagcatgatctctggaagcatcaactatccctcgtcgtgattgttgaaagctctttcactgttttgcattctagtttgaatagtttgtattgaaattggattcctatcttgtgtatgtttttggtgcgtaaaagggaaaaattggtgtcattacttttgaaatttgcaggacgaagggcatgcttttggtttgctgtaagattgtattctgtatatatgttttcatgtaaataaatg

SEQ ID NO: 59658 - DNA, 1024 bp, Homo sapiens
tattttaaaacttttctgcaaaattcaatacagtccacgtacacctaatggacacagatataataaaagtacaaaaatcttagctcccattaaaaccttccctgcctctaaataagccagaaactcgctcccgctccacagtgagaggaagttcattttgcaagtgtttgcactagttttcatgttaccaagtcgatcagagctttttattaaatccagcctgatacaatcaaaacagacatggtgaaacccagctctactgaattgtaaaggcagcatattacctattatatcaaatatgacaaaaagttccatggcaaactcttacacagcaacttctaatgagaaaatgtctgtctgaactgggtttcaactgtgcgagatcatagcagcgtctcaaagcagctgctaatgatgacagctttacagtcagcgggagctctcctgctctgatactgtgtgttgagtcacctcttcccttctgatgtgaaatgacaactttttagatcttgacaactttgctattttctttggtgcaaatgggaggagagagagctggcatcttcccatttagctgaaaggaaggcatgttttctgtcatgaataaattaacgtacaagaggagagactcacattcaagacatttggtccaggccaggcgtggtggctcatgactgtaatccctgcactttgggaagctgaagcagcaaatcgcttgagtccaggaattcaagaccagcctggacaacatagtaagaccctgtctctacaacaaataaaatatttttatatatatatatatgtgtgtgtgtgtgtgtgtgtgtgtgtgtgtgtgtatatatagtatgtatgtatgtgtatatgtatgtatatatatgtcatatatacatatgacattcagtcctcttggttgattatgggagctgttgtacacaattataaagactgttttcaggaagagaggatgtgagattatccctagggcagtgtgattgctctcatttggcatctaggatttctggtt

SEQ ID NO: 59659 - DNA, 1049 bp, Homo sapiens
agaggtttaagggactcacagatccacatggctggggaggcctcacaatcatggcagacggcaaaaggcacgtcttacatggcagcagacgagagaatgggagccaagcaaaaaggggaactccttataaaaccatcagatctcatgagacttattcactaccacgagaacattatgggggaaaccacccctacaattcaattacctcccacaaggttcctcccacaacacatgggaattatgggagctacaattcaaggtgagatttgggtggggtcacagccaaaccatatcagtggaggaagatgagacacctaaggtcctattagtttgggggcaggggcaggctccctgctaccctctctgatcaagcacataatgaactgaactccagtgttttgcaaagcacaataattcagtctaactgtggctagtcatagcagctgtccacttagttattttcattaggtaactataatacatgacattgtcatgtgcacagaaattattcagctcacaattccaaagttttatagagagcttgttgaatttggagacggatgatgtggcatcaagaaaagccaagggaaaaacattcaatatccgatgcttttcataatttaattgctgcctgctcccaggctgaattgaactccagaaggcattttcttttcgcagtcacaaaatgcatctcgatatgcagcaaataacatgcagctctggggttttctcagcgaaacccaatgaaaagaatctgttgaaattttattgtctgttgataaacactgtgtgcgttattgcagtcagtactaattagatttatttttaaactgagtttctgtaaattgtactgacagtaaacaataaaatcagatgattattctaatacagaaaacacaaacgcaacaaaactgccggtaccgccttgtcatggctttttagcaccttggcaagccacattctcttggtgggtggctttgaggcccttggaacatagcaagatgttacccaggcagagaaaaggccgtcgccgggctgaccgcgtagtg

SEQ ID NO: 59660 - DNA, 1037 bp, Homo sapiens
caaagggctcaggtgactctggctcctggtcacctgcagtttgggatctttccagtgggacctggcggtttgggatttggcctcagctgttatttacggtttcgatttctgcccctgtggctgatgcattaagcgatttccctccgtgtttttgtttggggtgtctggttctcacatctggggagtctgtcatgtgctgtttgaatttccccttcattgtggagctctgagcatttgtcctgggctatcactcacaacaacatgtacctaaaaactagaaagctttctggtcggaatcctgaaagtcggctgccccaagcagccttcagtgttcatagacttggtggtaggagaagagctttcattcttcgaagcagtcgtaagtttatcggtaacacccaggggaggaggtgttgagggagtaggaatgacgatctcgtattgaggacttttccatgtgatattggacagagggaatgtcttacccagctgacctcagcgaagtcagtcctcggaatcaaagacagatgcagacaggcctcttgaagatactgtgctgtgtttttgttgctgctgttttcaatttatgctgaacattagttaacccactaagaataatgtgccaggcttacgggtgggtgtgaacttgaacacactcacatggtctggggtgctgagggaaggttggcaaaggaaaagtgcacatttttttttttgcatgtcaggcttttctttattattttctcatagagaagacaagataaatttgatgaactttcttatcatagcataggataagattttgtagcaatgaaaagcaatagcaaatgataactcctgagcctccattcatgtagattatatggcatcaaatacttggagtgaatttattgttaatttttagatgaacagaataatttaatttcagagcccatattgaaattattgaactaattcaaaaaatatctatagagcacctactcttgccagttatggttgtatctgccatggatacagcagcaaacagaatgaagtcc

SEQ ID NO: 59661 - DNA, 1041 bp, Homo sapiens
ccaccccgctaacaaagaccaggggagacaagtattccaaactcatttttcacctgagagatcctaagtctggacctttttgtagtagtaactggaattgaatatcagatagtcaagagtagcgggatcttattgagtatttttcttatttatttttgcttgcatttcttgcacatacattttgctttaaagaggcaaactccaactccaaacctgccagactctagcagctttagaagttttgttggaattaatttatgcttatgttggaagatgtaggattatctgagccaaagttagtagatgccaaaagctttggtctatttttgttaaggtgatctgaatcagttacaaatataaactggaaatgttcttatccaaagaaatcactatttgctcatttatgtcaatatttgaccaggcgtatttgcgagctactggttctccttttgtgaataacatgttttagttgaaatgcatgcctctgacagcaccttgggagtgtgctgtgatagtaacatgatttgcttcatcacaatttttattggaaaaaaatcattccggataactgcttgcaacaattgatctgaacatgtgtgctaatgtgaggtacaacaggtgtactcttttgctttcttaaatgcacatttaaaaataaagtagctagtgtaatgataagattaaatgaacgaagttgtactaagatctgacatctggtgagttaacgtctatcctatgctagaagaaactgataggaaattgtggcatgaatgacgtaacttttcagcatttaaattgctactttaaaatgggtacctctttgctttataacctatttttaaaaatggacttgccccactaacaaagctgattttctttttccgttttgccttttctacagcacaaaagaagagaaagattgcagtcgtgcaaccagagaaacagtacgtgcttttttcccctccagactacactgtataccgataaactgtagtgtctttatggaggatgggaagcatggctgtttttattggagttatc

SEQ ID NO: 59662 - DNA, 2153 bp, Homo sapiens
atgaactttttgcaatcctcaaataatcaaggagaagcattgtggacattcttttaatagattattttgcatgctattgggtctcctgtcttggaaaataattagtctgagtccagccagataaatgtagactcataagcttggtaaagggaaatgaagaacttggtacccattatttagaatgggatttgtttagggtcagaaacactttcccaggtgataaataactgacttttccatcagttcttatttaatagatgccttaatgggatatatttggggtgggagaaggcataattgtaacctttttgagggaaaggtagccgacgcatctgacctcataaatacttgtttaattgaatgggaaagatgatcaaaggattctaaagtatggtaaagacggccctagcaatatactaatgtatacattgtactgaagcgtatgtattaaagccataatacgatgtgatgtttgaattagcagaacattggaagatgaaagttgtaattgaggaaggaataagccataaagttactttttttttttcttttttttttttttgagatggaattttgctcttgttgcccaggctggagcgcagtggcgtgatcttggctcactgcaacctccacctcccaagttcaagtgagtctcctgcctcagcctcccaagtagctgggattacaggcaccctccaccatgcccagctaattttttgtatttttagtagagatgaggttttgccatattgggcaggctggtcttgaactcctgacctcaggtgatccgcccgcctcagcctcccaatataaagttactgttatgcttccttttgaagtactacttttaatgaccttgaaaatgttatttgtagctaaatgtaaatctggaaagataaatatatttagtagaggaatctaacctgttagcaaaatgtttgagtagctaagaaacaaatgctctttgggtctgcggaggagaaaatgaccttgtgtaccaggaacctgcccggggacctgctttattggactctggggaatcaatcccacacccttcaggacgggcagaggcacttccacattggatgcctctggggagagtctctttacgttttgtctgttttgaacatattctttcttgtttgattcctttagcaattaggctaaatgttggtcaagtcttacaatattagacagaaacaatgtctatttatttaaccttgttcaaaaataagccctgtgaaccttctagcattcctttaaattctatattctttaaattacaggggaattaaacatttaaaaagttaagactgacagtggtgataattgatttgagaaccaatcaaaagttcaaaatgatgaatgacaatgatagtatgtgtgtataagcacctgctgtccatgttcagagcacctgagatacaccaatatattggcttaactctaaattgggaccccacgtttagcaagtaaaatactccatcttcaccatgtctacttgacgatgaaaagtcagagccggtggagctcgcaccagatttaggaccattttgtgtttggttgttggcatttagcttcgtgaagttatggttttggtggggagggaggatgtgattcagaattcttcagatgttatgagatgacttggatggtaatggggctcaccaggttattttcttttctctctccttcccttctttccttccttccttcctccctccctccctctttcccctttccttcctccctttccttccttccttccttcctttctctttctttctttttctttctttccttctttccttctttctttctttctttccttctttctttctttcctttctctctttctttctttcttccttccttcctttcttcctttcttgacagtgtcttgctctgtcacttaggccagagtacaatagtgcaatcactgctcactgcaacctcgacctcccagacgtgagcagtcctcccacctcagcctcccaagttgctaggacttacaggtgcctgctaccacgccaggctaattttgtattttttgtagagacaaggtgtcttcatgttggccaggctgatctcaaactcctagactcaagcaatcctcctgcctcggcctcctgagtagctgggactactggtgc

SEQ ID NO: 59663 - DNA, 1974 bp, Homo sapiens
ctgcctgcaggtctggggttgacctggcttttcctgtagcagcaggcaacagctactacatggtgggaattctgcaagaactgtatggggccctaacaggagggagacagttgctagacacataccccccacccagaaataaaaacgaggaaggaaaaagatagccgcccaccccaggtgctttctaaggctctggagctggactgcccaggtttaaatccttcagctgccacttgccggccgctggatttcttccggtgcctcagtttactgatctctgaaatggggatgaaaacaccccgtatctcttagggttgttgtgaggattgaacgcttggaatggagtaagcactgtgtttgctactgtgtgggtctctctcctctctcccctccccacaccccccccatactcgtctaatcccatttctgtcatttccttcagcctgtttcctatgataccttgatcctggccaccagtttcgcccaccgtttttggttttgtttttggttttgttttcccaggccttcggctccagagctgacccagggaggctttgcgcgctgggcttcttgataggcatctgcaaagggaacacgcccagagggcaggtggggcttccagcgtccaggtcttgcttgcgggcactcacaccggctttgcattctgctggtgttttgcctgttcatctcacactcaagcctgtcagcatttgccatgccctttaactttcagtggggacatttattaggcaaggttaacacattcccttaaatacttcttttccttcttctgattccagcctttaactgagctgaagcagttgttccgattttcttcctgaaggaggtggaacccatttgcctcctcatggtgggcttgtagcctccctcgccctgggtccctcctgcctctgctgcccagtggcatctctcaccccaagctcatgcatgctcgcgctctctcctgtgattcgctctgagtgaagtaattacataattttaggagtttgatagaactgtgttcctaggaagacactcaggtgtcctcccaagccataagcatctccctttttcatcctggggctctgggtagcataggtcactgtctcgattacagtcacctgtgtcatcggctgggtggagccgtggtgtgtttgcagtgagagcaccaggtagacctctgtgtcctgctgaaccggggacaagggggtagcaagctgcagaactctttaaggttccaaagggattctcagaaatctgttatgaatttagattgtgagtacggaaagtctttgttctcttagaaacggaaatgttgattgctgtttagttttattttccttcatggtaattggcccctcattaacctgacctctgtggcaataccgtatttatgtataagagtcttactttcttctctgggtgtctatggttgtattgttacaatggtggtgattgtggaggccttggttgcaaaataggtaactcattcacaaaggccaaaaagtcataaaggtttatcttgggtcagattctccctccactcctgtgccccggcctccagccaactggttcctttccctgtggacacccactgtgttagtattttgcatttccttccagatttattttatgcacatatgaatatatgttatttcccccttttaaacagatggtagcatactatatatgcacagtgttctgcaccctgccttttatactcggcagtgcatcttggagatctgtacatctgagtatattaagaggtgtctgattcttttttatagctgcagaatattccttcatatggatatacccagatttacttaagtgctttcccatagatggggaattaagcttcctcatggtttttgagacgaaggttctggataaaaataaacaagtagaatccatactgaccagatgcagcttagccaaagtcaagagattgaacatggtcttgtgttgtttgtc

SEQ ID NO: 59664 - DNA, 1051 bp, Homo sapiens
gtcgttttataaactacagtcatgcattgcttaatgatggggttatgttctgagaaatgcatcatcaggccgcttcattgttgtgtgaatgtcatagagcgtaccttgtacctacacaggcctagatggtatagcctatactacatacagctctgagattcatccatggcctggatggtatagcttataccacatagcctaggttatgtggtataaccatataatcatatgggaccaccattgtatacgcatttcatcattgactgaaacgtcactatgcagtacatgactgtagtttacaaaattatcaataattcttcaatcctaggaactgtgagtagagatatcaattatctctgttttaagaattaggcttaaatgtatagtctactgtgttcaacatgcttttagttaggaaagttaatttatgttaagacaaaaagattatagcctcctcttacttgagatctgtaacaacagtgcaaagcactcgctggtcagagacttgtttgctgagcatgtcttcctggagcttgcggtttcgttgctgccacactgtcattgcactctagacataacaatatgaaaaacgaagcgagaaaggggtggctgcataggcagaagttcaaaagtgagtgcaagtcaaaatcagagtttggaggattcagtaggttgatgactgggtcagctggtacttgtaaatacagaagcacatcagcagcaaggttggaaatcaaggatccttctatgattgaacgaccttgagaagtagctcaaatctcagtcgagttctctccttatctaggctgcttggagcctgcctggcacctgcatgatccggggagcagtcaaaaatctaggcagaatttacacatagaatttgtggttcccagtccgggctctccgcaggattgccaccgaatgatgtcgcctttgcacaagagcggtttctctgtatcttgaagaaccgagtggtgtgtgtttaggtgacagggccagctgcatagccatgcccccatgaggactgcagctggttaactctgaaagcttt

SEQ ID NO: 59665 - DNA, 1005 bp, Homo sapiens
tctggattgatcgaccaatgccttaattaccatttaaaatagggcaaagattctgtgttttcaaataattttttattaatgaaataattttgtgatcattattaaaaacttggaaaaatacaaagaggtcaaagaagaaagtagccaagagtcccaccacccaacaattattgtaatatttattattaaggtttttgtacattttctctggtcttcatctttgcatattttatatgaatctaataattctgtatatgtttatagcagtcttttcatctaaagccatagcagttattttttatgaattttttaaaactacgtgccgtttcatgcctgtgtggcattctacagacttggagaagtctcatctcattttctattactgcacagaaggttatttcattttttttcctccagtgttaccagtcataatgccgtaagtgtcttcatgtataacacctttttcagtttttagggtcatttttatgggataagttcccagaagtgaaatggttgcgtcaaagggtaggagtttttttttaatgccaaatagtttttccaaagaattgtccatttacactgccaataatgatgtgtgcaaatagagctgttttatgtcaattagtttgtatccgagggaaatgggtcatcaacctcttcccttttggacctgtaagggttgaaacttcattcagaataaacactaataaaagcttaaataagtctaatggttgtggttcaacagtctctcagggaagcttgctgcaaagtttaattgcctaaggggttttatttcctttcattttcttctcccctctgctgttttcctccctccctccaggtttaaaatgtgttttcctggccacagttaagccttagtacgtcttgttctgtctttgttgattaatgagtataattgaccctgtcatctctattataccatccacagcaatttgtttttatgtcgcagttattttctgagctgtcacaaaactgccttacaaa

SEQ ID NO: 59666 - DNA, 1063 bp, Homo sapiens
gtaatgttcctccttcttagtaattctagagagtttggggggcctaaagcaacctaattcatgtcagtggaccatggctttacacaattcagatggtcaatatatcaaagcagtcagagaattacaattttagggaataattttacaagggtctgtggttaaaagacagtcatggcttcattcattgactcccttactctcttgtgagagtgcagtatatttatttttgtaattaaactgaatgagcatttagaggaggaggtggtggtggtgattgtggtagtggtgttttacggtttccttttgaggtggttggtttcacatcttgcatctcaacaccaggattaagagtcatattgtagagatgtttcaaagaccattcttcactttatgaaggtatgcaagtagaagcttttttaaaagtaaaaggttattgtgtctaaattaaattcttaggttgacacgtagaatatgtgggatttattgtacatattgccaagtgatttcagatgtttccacatgtgtatgtttcccatgaatgtattgggttgtctaaatttctgttaagaacatggatgctgcctacaattacaatgtgttgcttgacttcaaaaagaggttgggaagcagctgttgaaatgaaagacttccggtggtgtaggagaaatatatgcaaataacacagatattttattgcgttgttttgactctgttcctacttaaaaaaaaaatttgtcctcacaccttagagacaagtgagctagagtggatacgagtttttcagtgtggctttctgtgtagtaaggattttcctggtaagcaaaagttagaatgttggagattttactcaattagtttaaacccaataaacagcaagtcagtttcacaggcactatgaaaagtgatcaacaaataagtagatcacctaagcaaaaatgtgtataggttatcaaccatgactttctattttaaaattatttcattaacctttcttgtgtcacatcaaagattagttgtataattagtggaggaaaagttccacccaggaacttttgtagaaaat

SEQ ID NO: 59667 - DNA, 1847 bp, Homo sapiens
agttcttaaggaatttgtaaatatttagagtggccagttcctttgattgggttttgtcgtatttgaccgcatcctgtcttgttctgattaatgtcctctttggacatggccccagcattcatcatgcatcccccaaaacagagacctttgccgactgccctggggacatgaaaaatgaaagggtccatgcagttctataggcgtttacattctgttaaccttggcaactcggtgcactggtggagagttttataagcagttcttctagtctgatctcctcttggacgctgacggtactgaccagcttttgggggctttggggaaacaggcactgcccgactgggctctgtgcagtcctcagagttggatatagagtggcgtcgttggagtaattaaaaacccactttagatttgcaggtaaaagaaagtaacaggtccccagatatttttgtacttcacacccaattgatgtatttggaaatcgcaggatttatttgcaggtattatttcctcagggacagactgcaaatacattcatttatccactgctgtttatccagactgtgagttatgaggtgacctccatctccgcaagataaattctggtatccagagtccagccaacctcctctattgctgtgtagctgaagtggatattgaaatttgttatcttaggaggcgggaaagccccatctctctcacataaggttgctgtaagcaggttataaaactgccagacccctattaggaatggggtgttgctcacctttattgagtaggagacaggttctaatcgtctgtggggcaggtttggattcttacctgcaggcatctctaagatcatgggatcttgagtacccctacccttactcgtgccggtgagctgtgtgccagcttacttctagtaactggtaagctgtgtgctcttagacacgggaggtggtggcagaccttgggtacaaggtgctgactgaagccctgagatgtgactccagtagcaagagacctggtgttttctgaagacaccctgctgtgttaggatgacagattgcctcccttactctgctgtgcttcagttaatagcaccaaggacgagcaaagcagtgtcatgtgaacttttgcttagtgtaaatttaagcatggccaggaagccttgttgcctctcccttggaaaagcaatttagcctgcagaaaataattaaatccgtggtatctggcaataattagaaattcgaaacagggaaggttaattgtctccataagattttggttgcccaataaaatgctccaggagcgcatccggacagtggctgaggtcatttacaataccgtggctttcaatattttcatctttctccctgcaggatcacgcagatttgcgaagccatttcttcacagttgggatgaagcttgagacagtgaatatgtgcgagcccttttacatctctcctgcgtcggtgactaaggtgggttttcctccctcgctcttcgacccagcccctagagtggatcaaattaagcctttcaactcaaagacgaccagatgacatatgttcgtgcaaggctatcagcaatgccaggcgaagctaaggaagattgccgcccttccagtccagcgctgctttaagctgtttttattactggtggcacagagtgactctaatcagatgccccctcttatcatggatagggtgaattttccttgtcttctgatagttgtccactgacgagttgcaggttgtaatcattacaagagtaatttgttcttcctgcatgggtagtagtaaatatgatctgtttatacttggaaaatacatgaaaatggtgcaaagcaaattctcatctcc

SEQ ID NO: 59668 - DNA, 1014 bp, Homo sapiens
ggcagagcacgtagaggggtttgcaagctctctgtgtttactggcctccacgttggtgtctgggaagggcaaaacagaagctcagactgctgggtggagaagttttgcgccttcccagctcttgcttctttctgtgaagcatgctggcgtcatgtttccatgacagcagttgagttaatgcatttaggggccccctcagcgtccaccacatcctgcctgttgtaaattgtgtggttcaggttgtgatctatgatactacggtcctaaatttctcattactattttttaacttgattgaatgcacagctactagacaaaatcgctctttacctctgtaagtaaaaaatagaaatgcttattagtgttcagcaatagattttaaaattacatttttgttacaaatacttcactggctaaattgaaatcagtgtgatcaaattgaaatgtcataatactattgatttaataaatgctggcctcctaatatctgtttttcaatgaaactagtattacgggagtaattttctaatgaacatctgagcactaggtcattggtaaaacaaaagaagaatgatatcataaatggttctggatggttttttcagcgggacctggcatgctgatacgaatagaggaattaaagcgtagctcattatatattaatttgaatgtaatactaactaaaaccttccattgacttcactgaagcctagtcttagaaattatgcagattaatggaggccttgaaaagaagcacatgcaatatttgagttccctttggaccaaaaaactggcatgttggaactgaaaaaattatatactgtgcagtatttttgtgtaagtacaatacactaaaagattttgttgcttaaaaaaactgggcagggtgaatcctatatctgttttttgtctattttattttatatccaaataagccgaaaggaagaagcaaaggaccgaaggttgacactgagattgctgctgcagagggagaatttcctgcagcttttgatt

SEQ ID NO: 59669 - DNA, 1042 bp, Homo sapiens
ggaggagctggactggggaaagctgtcatatttagggtgtggaaggaggaggatgaaaagaaccgaggccatttctgacattgctcatggctctgttcaccaggcttttctattcacttgccttttctctggacccctttgctgtgtgagataatggatttccttatggtttataccaggtcgagtagggttttctgtctggtctttgtgtgagaaggccctttaatagataaaggcttccttggggaccagtaccatttcaggtgactggtctgcttgtctgtaggttggaaatgattgcttactccttgcaaacagagaacccattgctgccatagtggtagtaggcagtgggttaaggagtacttgagttattgttattgtcctgtgcatgcaaagcacctcttgtaccaccatattgtggtcaccattgtttatggttattgctgtcattcataacagcatctttgaatcttatacactagacattcaaagtggaggcagtgggagggtaacagcagcaccaggtctgcagtgtagactggcagcaccgggtctgcagtgtagactggcacaaatgtaagtgtgaatttccagttcttgctgagacagcatcagagtgagtcaaaattaacagggttggttggcactgctgatcacaccaaggggctgaagggtgggtactagagtgagttaatgctggagacagaggcagagagaatccactgatgctgaggaagctcatcagaagtgtagggggaggagaccacaaggtcaggtgtctcatcagcgatacctgacttctctcttaaccgaatctgaatcagtggtcctcaactcaggggccaggggcatgtgcccttcagtggacatgtggcaaagccaggagacatttcagttgtcccaggtgggggatgcagtcagcatctagtggatagaccccagagatgcagttgcaacatcctacagtggcagaacagccccccaacaaagattctggcccccaaaggccaatagtgttgaggctgaccatccctgtttc

SEQ ID NO: 59670 - DNA, 1084 bp, Homo sapiens
tcaggtgggacacttacattctccaggcatttgccttaagcccatatatagagacagagcttaattttttccccaagtcatttagcagttaatgtttgtgggatacatgatggatatctccttctcatcatgttatccccaaatggctttgaaatagaggctgttggccgggcacggtggctcacacctgtaatcccagcactttgggaaaccaaggcgggtggatcacctgaggtcaggagttcgagaccagcctggctaacatggtgaaaccctgtctctactaaaaatacaaaaatttcctgggcattagtggcacgtgcctgtagtccacctactcgggaggttgaggcaggagaatcacttgaacccgggaggtggagtttgaagtaagctgagatcgcgccattgtactccagcctgggcgacgagggagaaactctgtctcaaaaaagaaaagaaaagaaaagaaaagaaatagaggctgttttgatggtaggtgattttgttagcagactggtgcatgtccctctgtgatctcggtgccattgattgaacttgggaggtttctaccccatggctggagccgggtctgttctctcaggcatccccagtgtctgggcctgaaagcatggttctgcagagtacgtgctcccctacctcctgttgccattcccgtttctttacagacttgaagaggtttgttaaacagaatctctttgggtggaaaaccccagagaagtccagttcgttgaatacccgtccctggcaacatacagaactgcgaggtggggttcatctgtgggatcctttgcctgttctgggtacttgaactgaagcacatgaattccatggcaaaaaaggaccagcggggccatctagtttttatgagtattggagaaaatcttataagagacacactaaagagggcaacattggtcaaacaataaatgtaactataaaaatcgcaaaatccagatctatacagagttcgccatcgcagctgcttgatcactggggcctgagctccgctgtctgcagtccgttagatagcaacttgcttttaatcctaaacgttaagaat

SEQ ID NO: 59671 - DNA, 1694 bp, Homo sapiens
cactcgctcccctgtgcagtgtctccttccgtgcccctccttgctgtaccaggaggtgcacttgttatgtttctgtaacgccctttgtaccttgatatggtttggctctgtgtccccacccaaatctcatcttgtagctcccagaattcccacatgttgtgggagggacccggtgggaaataactgaatcatgggggtgggtctttcccatgctgttctcgtgatagtgaataagtctcacgagatctgatggttttaaaaatgggagtttccctgcagaagctctcttctcttgtctgctgccatgtgagacgtgcctttcattttccactatgattgtgagacctccccagccatgtggagctataagtctaataagcctctttctttagtaaattgcccagtctcgggtacatctttatcagtgaaaatggactaatgcatacctattttgttctgttaaagtcctactcatctttcattttcaaatatagattccccaaaggaatccttccctggacccctgaccctggcccagatgaacttgagcctctgttggtgtccttcagcagcttgttctgtcacagttatgcttaatcatttgtgcagctccttgtataataccggcctctttttgcctaactttgaagctccaggaaggcaaggactgtgtctttcctgtccattcttagaaacatactttcttgaccatagtagcactcattaaatacctgtccaataaatgcgtgaattcatggacatatgtcttcaactccttgaatttaattttttttttttttttttttggaggcaatcttgccctgtcacccaggctggagtgcagtggcatgatctcagcttggccccctgcaacctctgcctcctgggttcaagagattctcctgcctcagcctctcaagtagctgggattacaggcatgcaccaccaggcccagctaatgttttttgtatttttagtagagctggggtttcaccatgttcgccaggctggtcttgaactcctgaactcaagcaatccacccacctcggcctcccaaagtgctggatttataggcgtgagccaccatgcctggcctgaatttaaaatttttgagttcatatatagattaaatggacatgcacacttttttagaggtatgaatactaagactcaaaaggtatacacattaatcattctaatatatttgtaattaaaaattaactaattcattaaacatttattgtctttgcacaaagctattatgtgctgttgacctgattccagagtttaatagtttgttcatattttccaaaatacaattaccttaccttcttccctcactttaatttcttcccataagaattcagactattattttggtagggtatgtgagcattatcatcttattcagtattttgtgcataattaaggagtgctttaagagcagatactgaatattacttttgggcctctcatgaggcagggtgtggggttaggcactttataaatagacattagttgcattgaatattatgtgttcttaaagctggtgagatactttcattaatgttttctcttatttcagttcaatggaagagacacaggaggtttcttaactatattttgtaatgagtgagaatctacacgtttaatttggagggtgtgagaacatcattttcttagtttgcaaaggc

SEQ ID NO: 59672 - DNA, 1023 bp, Homo sapiens
aaatctatcctttgaagatggcctctgaatggaaatgtactctggaaaaatcccttattgatgctgccaaatttcctcttccaatggaagtgtttaaggtaagatgttgattcttagcaatgtatctaccctttttgagaataaaatcatctacaaagttttccggccgggcgcagtggctcatgcctgtaatcccagcactttgagaggctgaggtgggcggatcacgacatcaggagatcgagaccatcctggctaacatggtgaaaccctatttctactaaaaatacaaaaattagccaggcgtgtggtgtgtgcctgtaatcccagctacttgggagtgtgaggtaggagaattgcttgaactggggaggcagaagttacagtgagctgagatcgcaccattgcactccagcctggcaacagagtgagacttaatctccaataaaataaaaagttttccataccaaatccttttccacttgaaaaggcaccttcttaaccagtttccattttaaatgcttaaggttttatctgtttcatgttgctttttaaaaaaataatcttcataatgacccatattacaagatgctgattaaaattgtttaggtttactgactttctttgtagcatattgttatggaaatattttcaccccctcacttcctactacagaaacaaaaggaaatatagcaagtctaattttgacatttagtaaaaatgacagaaaatgactcatctcgtggtggttcagttttcttgatgtcccgaggttctgctaagtaccaggccttccaccaggtgctcccgtgaaaatgaagggcttgtgaaatgcatctccaccaaaacggctaccaagttctttacacttcaaaaattatgcttcacacttacgtgaaatagaatattaggttctggacaaagatggtccattcaggttcatccaaggaaatcataaaacaggcccatggagtgtgggcggcgacccaacaccattggcgtccttggacagttctcaatgtg

SEQ ID NO: 59673 - DNA, 1035 bp, Homo sapiens
atgcacacacgcagaggatgtgtggttgtgaattaccctttgtgtgtctttgtgtaagtaacaatgacttcgggcagtgcaccgatggcttggctagttctggcaggatctgatacttactgtaattatgactgaataaactgcggaaacaggggcttaaagctcaaggtgagttcaaaagctatgaggatcaaaatagatcgcttcatgctaaaaagcagacatgcaagaaattaaaaatacagtcccaaaggtttactgttgctttttaactgtgcttaatttcatattcatatcctaagcgtctgtctgaagtagcctgggttgatatattgaaggcataaacatatctacttccagtgagggcttctgcaaatcctattttgataaggtcttaaatctgttgagatcaggccataaaattctcctgcagtttcagcaataggtaaaaacagtgctcaacgtttttttttttccttttaattttgcattcagactgtgtaacctccatctgtaaatcttgccccccctcccactgcctggggaaaaatatgggcaacatgtggtgtgttaagcaacatttcaagtgtaaatattaaacttggtaaattttaatttaccttttaataattttctgacttacagggactatttttagcagatgagagcttagagatttagtgaaaatatgttgtcataactgcaaatgccagactagagtcgtttgtagtttagaaatgtatcagataataagttcctcatcagtgggcattgctttcctaggtgataggtggaattttggcccatggatgactgaaggtttttgctaatgtgattaataccattaaattacttacagaatgccaactaaatgcatacaaatgttccctgaagaagagctctattaagtttattcttcatttctgacagcagaatcccaagttgctatttaatttcagaaagtcctttcagcaggtggctgctcatggtgggtatggggtgtgaacactcacggtcactgaccgtgctgaggta

SEQ ID NO: 59674 - DNA, 2597 bp, Homo sapiens
taattatacattctgtaaaccaattaccagcttaagtgtagaaataattttacatagtagtctaatttagctgatcattactgtgtgttagacatgtcattgacacacactcatgccttcgtcacataatcaaagtatgagagcattttggtcattagagtagcggccagtagagtaagatgaatgtctgggaaaccgtcatggtgtaaattgaatgctctgtattagaattatctgtctgttggaaaagtagaccgtttgctaccacgttttctaggtccaggcaaatttgggtagaactcttcttaaaagcatactgattgttaacaaaagcaattttatctgggaagggtgatttgtttggtgagaacttagcacaaactgttattttctattgacttgtgatttttttgttgttggatacggaatggggtacatggatgtgtgggagggaggaaagggaaggggtggggcatgggctgggcaaggatggggtggagggaacgccagactgttcgccagtaccttggatgatggtgtgaaaaaatattatcttctgctgtcatctgtttccatgagaaccttaaaataaagtttaaaataaggagttttgcttctgtttaaacagcctctgcgagggaaaggccctatagacctcattacagttggttccttaatagaacttcaggattcccagaacccttttcagtactggatagttagtgtgattgaaaatgttggaggaagattacgccttcgctatgtgggattggaggacactgaatcctatgaccagtggttgttttacttggattacagacttcgaccagttggttggtgtcaagagaataaatacagaatggacccaccttcaggtaagggccaaagcttttgctgctgtaaagtattttagaaaaagatgtgatattttcctggatgtgtttctagaaaatgtatgagctttctggtatcttttatatctgagtatgtgaatattaagcactttaacttcacaatgctttccatagagactaaaacctaagacctcaatcaatagtgttctcaaaggagaaagcaatgttagaggccttagggaaattgatctagttccttgggaatcactggttcagaaaggaaagacacagtagattgagacttgaggatattctccacgtttttctttaggaattttgatagtcttgtaagtaggttccgaaatctctggccatctgtgtacccatctctcagtctgtccattcaccaatccatccacctactcatccacccatctatccatttatctattcatccatccattcatccacctatccatccagcattcatctatttatctgaccatccattcatccatccatctaaatatccaaaccacaatccagtctgaccaagaagcagcattgagtagatagaccatcatgttttctcctggcatgtaagattttagttagcttcaaatgcactgtcaaatggctttgcagaggcttaattggaaagaatcctgccttatgctctctgtcatacctacctagttaaaaatcagcgtatttacaaaataaccattcttgaatgtttactatgtgccaggtgattttacatctggtacattgtttgttttgattctaaaaaaatgctgcatgtttgttgtgaatttcatttcacagtagagaaaattgagactggagttcagctagttgtccaaggtcccctgttttaagggacaggcagtgcaattcagattcccaggtgctgggcccctcccacccctcttaccggcctcctcttaccggcctttgaatgggaaacctcagaacagaaatactggattcttgtagaattagagatgccaaggaggaagtacgtattttttcagaaattggtgaatcttcattccggtgagttttgtagctgtatttggaataaggacatggctctttgctttattaaaatcaccagagaatttcctcccatattagttgccgatgttagtgttgagtacatgaaggagaggagttatatttatcttttctgtcactcagaggctctaattgaaaacacttcctggtcctgtgtcccgtgtgtttgcatttgcattaagtttgacaggcttagagacgcgtaatgtggtattttattagtattattgctgtcaaaatgttgagaagcagccaacacctccatctctatcctgagtaatttttgactctgatgacaaacaaagagcctgtcgtgttgtgaagaaggatgtaagcccgggtttgccctgggattcataacccagcaggaaaaatttactttgtgcgtaaagttgtgtgtatacatctctgcttagtatctaattgctttataaattttaggagcaatatctacttgccagtgtacaaatttacagcaaagcaaaggatgactagtggcttcttatgttctctgtgatgtttctttcctgggaagttatgggactcacgctcacgagcaggaatggaacatgcctccgtggaagcttaggaaatactcgcttatgagctgtctccctctttagataatttggggtctttataatatatgaataaattgtgttt

SEQ ID NO: 59675 - DNA, 1278 bp, Homo sapiens
ctccatttcaccttcagtccacccctcttgttattttgtgcccatttctctgcaaattccttcttcttctgaaactgtataaactgttcatgtaattcggggcctggtttgattttcccacctggaaagcctttctctgatttccctagcctcactggtttctctctccttggaacctcctgaattgtacactttataatttctttgtggtttgtgaaaagtttctaaataggctgtaagacttcggattctttcatctccttggtgcccaagcatgtggtatgtgtcaagttgctacttagagacacattttcagtctcagttttagtatttacttaagcatggtgatgaaagttaagaaaaacattgaaatcaaacctacatggagaaaactgctgtgattttaagttgattggatactttgctgctgtgttgaagtgttttttttgttttgttttgtttttctttctcctttgtcttgccagcaatcaaagagaagtacacagactggacagaatttctcatacgtgacttgactggttcgaggacagcacccgccaacctcctggaaggtgtatgtattgttgttatacatctaatgtatctctgaagcaccccagttacgtgagctcagacctgacagcacctttgcatatatccttcagcagatgcgtgctttctgcagacactgccatccaaatagcctcccttcctcttttgtcctgaattacttaggtgactgatttgaatggcattgatgaaacttcccctgtgatgcaatcagcaaatggaaaatttgctctatgtgaatccaatttttaaatcacaatatgctaggatgtcttcctactgtcctatatctttaagcctctttcctatgtgagtgaatataaatcaaatcctgtagaatcactgttttgaacaggtgacaagatcatgtatgtgctaatatagtctcttggagtacattgataagtcgttccattaaatgttctattttgacgcataaccccaagatttgaacatacacacgttaaccaataattgaattaacttctcttgtaaaaacaagaggagaaatggcagatcgtatttcagtgtagccaaggaaattttaatgtattgaagaaaacatagtttaatctgaaatcttgatggtttatttgaaaataattttatgttgaaacatcttagtatgtatatgtagtatttgtatttgtataatggaacaggaagagaaaggcactgtgtcataagtaattattgaattacctagtc

SEQ ID NO: 59676 - DNA, 1092 bp, Homo sapiens
tctagttagaagtttaaatggtcacactgagcaatgccaattagcttccattgcagtgaattctaaggacttgcaaggcaacttttatttaccagaatttaactgaattaatcagtggttaaggtaactccatggtctaggaattgtaaattggttatacttagtttttattttatagcaatatttattgtaataggtttatggtacatttgaatattagagctttgagagctaaatgttaactgatatagtttttcttataaaattagcaagattcttgagaacgtttcttttctactttttaacctaaagtggtctgtatacgtttatggctttatagatacgtctaccatggagagcaattcatttaggtagtctgtggctcataaaagattgcttgagtcttgtgcagacacatataaaggaaagctataggacctctgggaacttgaggctcgcaagatgtaaatgtcagagccgtccctagagctcccttgctatgactttgaccgtttaaatttcagcattgtgcagtgacttcatagggtgcttgcatattttaaaaattttcacttaactgttaacttggattatacgcatgttagaaacaaccctgtggaaaatagagctttcttcccgtagtggatatagacgtctgtgttaggcacaggaccatttatcgctggattataataattgttcttcttttgtaatgggataggaaatgcatatttatggggtacagttgtatattttgtcctaatcttgaaacttatgtgagtcattttcatattatctccatcatgcctgcattttaaattactgatttatctgtttgcaaaagctttggagaatcagagaatctactggaaagactccatgtgagattgggctctgaacacctgggggcttgaggctgtttctagtttttttttttttttctgagacagtgtctcgctctgtcgcccaggctagagtgcagtggcacgatttcggctcagcctcccgagtagctgggatcacagatagctgccaccacacctggctcatttttctatttctagtggagatgggggggggggtttcaccata

SEQ ID NO: 59677 - DNA, 1039 bp, Homo sapiens
ttcggactggttttaaatctcagtaatttattttattggggttattgaaatactggatatactgacagaaatcatcaagagcttatggttattggataagtgaactctaggttgtggttatatttagtgtctaaataaggccctattttattacaccaccctttctttctctttttctgtctctctgtctctctctctctctctttttagtctcggattaccccatctttccgtggtggaaagaataatggttgcaaagtgagtaggaaatttatttctctgtactcatctggcatgaattgtttgctctacataaattgatgaattactgcttctaaggctgacataatagtttttgttttgttaaacaactataaatttcatctaatacagtcttagtgttaacaggaagaaaaccataagttaatatctgctacatttcattgcttaaaaataattgctagtagtaaagcttcatttttcacaaacataatttgatctcaggtaattgatagaagaagaattcagggaatttgttcagggtctgtttacaactgactttttcaagaactgccacatgcaataatccaaatgcattctggttatgaaataaagcaggcagaacttacagtcagcctcagaatgacttattgacagctacaggtgcagcatttttttttttttaacattgtaacccttttgcaaagtttttattgaaatgttttatgatatagtgtttttgatttgtctatttgaagaatcatagaagacaaaaccttaggaactttacttattctaaatttcctgttctgttattgataagaaagaaaaagagagagagagtgagggagtcagttattcaaatacacctcctttcattcctactggtgcttacaaaccaaatgcagcttgtattttaggcgcggggactcctcagctccacctaaactgaggagggaaaggtatgtcataatttttgttctttctcaacagttttcctttaataacaacctgatttatgatgttgaatcatgatcct

SEQ ID NO: 59678 - DNA, 1049 bp, Homo sapiens
actatcgaagattggtggcattcacctgtactcccagctacttgggaggctgaggtgggcagattgcttgagcctaggaggtcaaggctgcagtgagctgcaatcgtgccatcttatttcactccattgcttctgtgcagtatggatatgtcacataactttttagtcaatgttgaatattatattcgcccctctaggtttttaccatacacagtgcaattgcgttgtagaacaatacaattgagaacaattgtattatatttattatataaataatgttatatgttattatatataatatatattattatgtataacaattgtattattctctctgtattttaaaatttattttcttcatgacttatgggatgtacaggctctgggctcagcatcttgcacggaggtggtggatgctatgaggataacgctgctgggaatactggctgcaggtcatatctgagagcagaactcagtgttttatttagtttatttctcccgaggtggatggagcaccccaatcctctcattacagtcctttggcagagccaaacctggaagcatccccaatcccagaaaatctgtctagtttttactttgaaatgctgtccctctccttctggaattaggttatattgtctgtttacctggtaagtaattaaaatctcagtttcagcactttataattaactaaagggaaaaaataactccagcatgactttctattctggggggttcagtaaacaccattgtgattcgctaacgccccttaggaagatcactaatagctataaacgaaacagaccattaagctgagaacagaggtctccgggcagttgcagtctactgatttgctgattattgctggatgtttatgtgactatgtgcagttcaaacccctgtgagtgggtgaaacatgaggctgtctccggccggttgtccaggatgtgggttctaaggcaaaatttctggattctcgtcattctcttttcctctattttattctgtattttacttctggcctcagcattcctgttcccccaaatctg

SEQ ID NO: 59679 - DNA, 1001 bp, Homo sapiens
ctctgtctctctctctgtgtctctctgtcttcatctctctctgtctctctcagtctctgtgtctctctcagtctctctgtctctctctcttagtctctctctgtctctctgtctctctccctctctgtctccctctgtgtctctctctgtctctctgtcttcctctctgtctctctctgtctctctctcagtctctgtctgtctgtctctccctctctctctctctgtgtctctctctgtctctctctctctgtctctctatcttcctctctctctgtctctttcagtctatctctgtctctcagtctctcagtctttgtctctctctgtctctctctctctctctgtctctctctttggtagcacctagtttaattcctgtagcttacatgctacaaaaagattttacaaaatccagcaataaacaaaatgaaacttcctgatataccataactgatacctgtgactctgggaatttcttaagacatccggaaataagtgtacctttgtacgtgaaggacgtttgttttccccaagatctaggtcaaattaagaacagacttgtgtcccatccagtttgagataggctggttggctttctcagggaccttgtgtttgcagctctgtgacagtattcagttttaaactttggatttctttctcctgaatgagcaaaagtaatgcttttgcagaacgccggggaattaattgctgctaagatttgaagaaagacatgtgcacagttcctagctctgtatttttaccccaggagtactgcgaacttgatgattttggtttagtgacttccttgccagcggacttacgttttttgtttgcatgttgactgctttgcctagaagttctgagggacatagtttaaagatgtcttgcagtgcacctggttaatgaatccacccacggaaactctgcctccgtgtctctgactttgtcttctgcgatccctcgtgtggccctgctccagtgggcttggcttccttccc

SEQ ID NO: 59680 - DNA, 1042 bp, Homo sapiens
ggctaatttttgtattgtttttttcagtagagacagggtttcaccatgttgaccaggctgattttgaactcctgacctcaggtgaaccgcctgccttggcctcccaaagtgctgggattacaggagtgatgcgcacagggtcccatgtgaagcccaagtcatgcttctctgggtgtcagtcacttcatctgtgacttgagtggatgtgactagcttgcaagttctcagtgttgggggcgcaggaagagaggaaggatctttaccaccacagtggacagggcggcagtggtgggtgcaggagacaggtgctcttctgaaaagttctgcatgtggggatgccttttagtctctgatcctctcctgggaagatgcctgggtttaatgaactaaaatgactttccgactctgacatcctgtctttataaggtaaagaccattagattcaagagcataattggatagatatgtttaaaggttgtctttcaggattattgtgctgatcacagttttcacctggctttcctgtcccagtggatagtgagaatgatttccctattaaaaaattacccatcaacagactcctggttagacagtgtgttgagaattaatggtgtgtgccatcgagtgatgaaaggcagagagaaggtcttagcctatgggggaattctgagctagaactcacagtgtaatttttccttctttacaatgacatggtttataatgaagccttggtaggctggaggacttgtgtcagaatacaagtaccaaagaagtcacagaggaatattaactgagaaggcttttaagaaagaagaaaatacctatccttgtgctaggccaggcattgagggagggacagaggcctggctgcatcaaggtgtcctgacctgccttggagctggacagtagctgggcttgaagatgaccgcaaactgctgcctgtcccccttccagggaggacgctaccatgggatggattagacaggggaaaaagcatcagaagtcagatgagagaccttgtctttgttcctctgtttcctga

SEQ ID NO: 59681 - DNA, 1009 bp, Homo sapiens
acaaggggataagagcaaaaattatacagtgtgtattataggatgcatatagtcaaatgtcaggctcaaaattaggccagtagcttctgctgcttggacgttaatcttgaagcaaggaagaatgagggaatttcgggggggtgagggcgacagagttaaggtgttcagtgcttttatttttgtcctacacatggtagcaaccgagtgctctgcgaaatagcagtgacccgttattccagagtcagggactgttcttggcactcgaagtggaatgttgaagtggaagttttgcctcccagaggatttccgttccagctagtgtctgtgtcgctgtgaagacatggaggaagggtgaatgccatttatgcaggagattctagaacactcggttaagaccatctgttgatgggtctggggagaagggaaggacacacttctgtgtttgtggctatttgctgctaggcagcttgttgatactccaactcttctgtagttgtagacttggccatagaatgaagaatgtaaaaaagatatttgggctgggcacggtggctcacgcttgtaatcccagcattttgggaggccaaggtgggtagatcacgaggtcaggagttcgagaccagcctgaccaacatggcaaaaccccgtctttactaaaaatacaaaaattagccgggtgtggtggcacatgcctgtaatcccagctacttgggaggctgaggcaggagaattgctttaacctgtgaggcagaggttgcagtgagtggagatcctgccactgcactctagcctgggtgacagagctagactctgtctcaaaacaacaagtaaaaataaatatttttgtagttattagtttattaaactgtaattttcttatttctgtaggagataattatgtatttagaatggtcttgaagggacatcatgacatctagagaggtcgtttgaagctacaaggtctgggacatggaatttgtcttttataagccctggcaccttctaaggt

SEQ ID NO: 59682 - DNA, 1050 bp, Homo sapiens
ttccagggccatgcagatgttctagggccatgctgatgtctcagggccatgcagatgttcaagagccatgccttcattccagagccaccatgcctccattccagggccaagtagatgttctagcgccatgctgatgtcccagggccatgctgatgttctagagccgtgcctccattccagggccatgcagatgttctagggccatgcagatgttctagaaccatgcctcccttccatggccatacagatgttctcgggccatgcctctgttccagggccatgcaggtgttctagggccatgccggtgttctagggcaatgcctccattccagggccatgcagatgttctagggccatgcagatgttctagggccatgttgatgtcacagggccatgcagatgttctagggccatgcagatgttctagggccatgttgatgtcacagggccatgcagatgttctagggccatgcagatgttccatggccatgcagatgttctagggccatgttgatgtcacagggccatgcaggtgttctagggccatgcaggtgttctagggcagtgcctccattccagggccatgcagatgttctagggccatgttgaggtcacagggccatgcagatgttccagggccatgttgatgtcacagggccatgcagatgttctagggccatggtgatgtcacagggccatgcagatgttctaggcccatgcagatgttctagggccatgttgatgtcactgggccatgcagatgttctagggccatgttgatgtcacagggccatgcaggtgttctagagccatgcctccattcattccggggccatgctgatgtcccagggccatgctgggttccattgggtttcactccagggctgtgccaacattccagagccataccaacggtcgtgcctccaactcgagtccttaggttctgccggtcattagggagagtctgcctttttgagcctggctctcagggaatggttggtttgtgcaaagcttgtctcctgagtctagaatcatgttaaagcttggtga

SEQ ID NO: 59683 - DNA, 1483 bp, Homo sapiens
ccatgttttcttgcatggctcttttaaattaatgtaagctgtgaattaatgcaagccatcattagtctgtgaaatggtacaaggaaggagaaacagcatggcggcagctccaggagatgtcatcactaggggattcccatcagcaggcagagctccattaataaagacgcatttagagacctgggctctgtgaccaatcggccgttcagagcagcgttcctgcttgtgagctaatcagggctaatctttcatattaaaagtattaaggaacatatgacattaaagcgtcacccagtgccgcggaggattatggctcttattagtggagcaaaatgtaaaacgttttggtttagtaaatctataaggcttgatttattcataagcgcatgcaatgcttgcaaggggcagctgccaaataattattgtttatggtgagaatgtatggaaatcatttaatccagtgacgacttcattgttatttattgaaaagcagtgacattacctcttaatgtctggggctggggagctttggagatttagtcggtgcctgccgagcccccaaaaagatgctcgtggaagattgcaggtaagtatgtgtgatgatgtggctccaaataacaccccttggcttgtaaatggagacgtatttatgagtgctttctactgttgccataaaagtgttggaattatagtgccttaggagtcatgctgctaatttttattttccccgttattaaaatttctgtcatttgaattgcgtactctgcagtcttggcagaattactcaatttaccattcaaagttaaatcaaaattagtggagttagttaatatacaactcatttgaataaaggaatgtttattcatgaagtgtgaggagaaagtgtgaagatggccttatgtttatgtgggcagctcctgccaagttttaaagcctggttttaggaacgtttttgggaattgccatttttactgtagttgattgtagaggacaagatgctggcaggtggcacatgggacaggaaagtgactagacaagcaggacttacccagctgtgacatggctcaactgtggactccaaaaagtagaattaggttgtgtttttatgagactgaccctttttaaaatttatattttataatgtaaatgacatttcagtaatattaagggaacttaaacaatcacattattttctttggttatctgacattgtaactggagttccatttgtttatcaataagaaaatttagtatatatgctaaaaactcataatgaatcctaactgggcacccaggcttgagggaagcagagagacactcattaaatattagatagcttagtaataagagagcagaacacattggtataagaaagggtaggattatttgacaagtatgtctgtaaataaaccaaaagtcatagttagatattttattaaaaaatgtttaaatattctaaaagttttaaataaatattttaaaa

SEQ ID NO: 59684 - DNA, 1168 bp, Homo sapiens
tagggccatgttgttcatggaatagcccctatcatgtggtcctgtgagtccttgaaaaccgtgtagtccacattcagatgtgctctgagtgtagaatacacaccaggttttagaggctttattcaaaaagaagacagttggttgtttcattaatgttttttatattgattacatgttgaggtgataatgttttggatatattgggttaaaatatattgttagaattaaatttattcttttttgttcttaacgtggctggctgcaaatgtaaagtttagcattacgtttgtggcttccatagtgtattacttagataaatacatgcctgttttagagcaacaggaatattgtttgtaagtgccatattttttagtggtttttgtcatcttctggatgtattgtgtctagtgtagtaatgggttttctctatttctgattccttaaggttgaaatcagcattcagagcaacttccagccaggaatgaaattggaagtggctaataagaacaacccggacacgtactgggtggccacgatcattaccacgtgcgggcagctgctgcttctgcgctactgcggttacggggaggaccgcagggccgacttctggtgtgacgtagtcatcgcggatttgcaccccgtggggtggtgcacacagaacaacaaggtgttgatgccgccggacggtgagcccctgtttcaaaggcttcgatttacgagccgccatccttcatgacgcctgtaattttgcaaggagcagagagaaccttgcgtagaatccctaatggtcttagtgcaaaggtctcacagttctttcagagtggtttctcaggtttccttagctggagggagatcagtgcattttcagatgtcagagctggtgctgacaatggagccaaacttggcttttcggaactgaaagtatgcctaatccttaaattccttttggagggtaagaaaggaaggctgaaaggacatcaggaattggagggtaagaaaggaaggctgaaaggacatcaggaattggagggtaagaaaggaaggctgaaaggacatcaggagttgaggtcttgtgtttggtgattggccatgttgcttttcttctgctttagcaagtcgacatttgaacagtaacagagtgtcttaagcaggcttctctaataacttt

SEQ ID NO: 59685 - DNA, 1035 bp, Homo sapiens
gggagctgggggatcctggagggtgggaagtggctgattctcggtggccggacactcatccagagcctgatccgtactcgtgttttcttggaagcgccacaactgcggggaaggagtctttagaaaccgtgccagtttcaatatggcgggctaaggtggcttttaaaaactgaaaataaaggttttgaggtgggaaaaaacccagctgaagtttccaccccttagtttcgactctctttggctaccccaggaagcgctttagcgaattaagtggggaaaaaaagaaggaatgggctgtccggttttttttttccgtggttagagtctgtgtgtcaagtccattgctaggggggaaagggatggagaagtgcccctggcccggaccagggcaccgaaacgcaactgtcgtgtgtgcctgtggattagtgtgcaggcctgcgtgtgcgcagtttttttgggtgtgtgtgtcaaagagaaccaccccgaatgtgtgtgtgcgtcttggaaccagaccctgccatgatttgacgtgacaaactgcggacacgtggtgtaaagtacatgagggcagagggagtgatttattttgtctttctaggagacgagctagctctcgccttgtgtgtgctggatcctgcgcgggtagatccccgagtaggtggggcgaggaggtgcttattaaaaggactaactgtcccgggtattgggtgcaatcgggctgcagacgccagccggatttcgtgtgtgcagggggcgcgctgcacttaatagtgggctcctgctttcctccacgccgctctggggtgggaggtgggggaccgggaccgaagcttggagaagaccaaagtggtggtggtggtggtggggtggggcagaagggcgggagcgcgcggctctgggagacaagcacgtagggtcgaggcgaggggttgccttccttacttttgggtttcgcgctctagggaaggtgggggatggggacagcgtttggggaagaaattgtcccttgctcggcttaggaaccctctcggcgca

SEQ ID NO: 59686 - DNA, 1001 bp, Homo sapiens
tgcctctaaatagtataaaccatgttgaatgagccaatattttccagtttaaaaaaataccaggtgtttttttcttcattccttttgccaactaagaaaaaatgtttagcaattttttagtagtgaaaaaatacatgtctgaaaattagaacctgagtctgatagaccatagtcattggtacatagaatgagctccacgaatgtttgcagaattagatcctggctttggcattgacctgaaggtaaactacgtggtgatacgtctccttctctccctttctgtaaatgagagtgatagtatcatgtgcacatttctggaaagatggtatgaaagtcattacagttccattacgttctgagcttcttggaccaaaagggacaatgaagattttgttttttgaaagcaaaggttgtttatgcagcttccgagtgactgacgtgctccacatatccattgtttgcactcctgggtttatttactttgagttttgtcattctgggacaggaggagacatcctgctggggggaagctgcaggggtgagctgcagatgctttgaataagaaggctattttcatcgacttaattttagtgacataagaatccgggggatgctggggcttgcctggagactctcaaactggagaaccctgggggtagaaggaaagatctcaaagtcgttctcatggccaactctgcagctttgccagcttcaacgagccatcccaatgtgaactgtgctcaatattcttaatattgctgaattgagggggtaaaccccaatacggtcagtggcccactccatcccagttttctgctctggtatttcttcacagtatgttataccatattcttttattatcagtcactaaagacaactatcttttcttttttttattgaccaatatatttataaactgccacaccagtgacaactatactttagtaataatttctgacaattctactgcattctagtcttgtttcggtaaacagatggtg

SEQ ID NO: 59687 - DNA, 1593 bp, Homo sapiens
agaacacttgagtgagaggcgagggtgtgcattgtggtttaggaaggctcttgtacataagcatgggagaaacggagagatgtcttgcagtgaaacactttgccttatgaaaaaacaacctcatttgtttgatccttgccatggttccaaaaaggatttgaggccagagttgcaaattgtcttcctttttcccttgactttctatgcttccaaaaaaagaaaaaaaaagtgttttgaaggactttttgctctcaaattttttaaaaatagatttccaagtagattgcaggcatgatccaagccttgcctcattagttaccttaatagtcctctgattataatcccacatttataaacccgcacttgtagagagtggatcctttaaaaacccagtgaattccattaggactgacacatgcaggaacctccaggagttaagggtcactgctggatgtcagctcaaaccttcccagtaactctgctctattggaagaccagagctcagcagcaggagacactcaactttcacttgttgccccgttcagtaaaagcaagatcctaaatgaaaaactgaccaacgtaaatagcaagaaaccagcttcccatccaactcagatgtaagtagcttgatctacatctcaagatggttgaaatgtaagccatgttcctactcttattttataggtcattgtaagtagagagaaacaggagcattgactacactaaagatgactactacatagattagtaaaatgtgatcatgtaaattctgctagttaatgtctagtctttagtaattctccatgatcgcgtacagtaattctacacaattgggtttacatggtgtcatgcaggtaatgctgaaccacaatttaggtttgcattcgcttcctgttcagcctttcatcggctctataagcttgaatgaaggattgaacctcttgcactccaaatttctttgtattaaaaaagagacagaaaaaaactaaagttgccattaggccttataaatctaataatttctatttcactctcctacttagatgctaagtgtcatccaggctcagagatctacagagctattctgatccccttccaattctacctacccccttgccattaaggaaaacattaactatgacatcaacattagcagcgcatgagtccattctcagaaataactcaaagcttcaagagtggagtaagggatttccttccagaaagcagagacacaaaaatgaaattcaaccgggagcatcaaccatagtttatctccaagacccaatctcatcccttccaccatgttcctacctggcaatctatagatgatgctggaggtaaacaaccctcatcccttccagccacgggagacaagagatattatccctttagttcctacatataaaccacaatgcacctctgttccatggagggacacctggggagaaatgactcatttctttagtcattctatgccttttttaaatttcaactttgtaagcatatccgttgcccagatattgaacttctgtaagtattgtctaagaaaataacaagacaattacataaatatgcacgaataagggttttcat

SEQ ID NO: 59688 - DNA, 1034 bp, Homo sapiens
aattaattccaattttagcaagctacattgaagtatcaaaatagcacccggatgaatgtagcggaatcagcccagaggaaggtggaggtggtttggggagaaggtactaatccatgcaataaaagccagcacatcgtttggggctcttatctctgttcggatcatgacataaccattgcctgtcatccagaacactatcacttgcaggccgcgccaagattcaatctccaactccacttttaatagctgttgtcagcttgttgctagagaaattatacttaattacgtgagtaatgtggtgggtgtttgtgtgtgcattttttttaagaagaaatggcttaagcaaactgcatggggcctgggatgggtgcagactgagagggagacgtggtatcgactaggagagggagaacttcctgtgaaaaataggaagtttaatgagacgaaaatagaatgagtgtgataaaaagcggcgcaagggaacggatcagggacagagcgtctcccgtgtctgtgtgtttaagggtgttagggattgccatcaattgagatcgtgtaatgcactgtctacttggacctaatgtccactgtatgcagtgctgagagctacagcaattgaaagataataagaggaaaatgagtaatgaatccgttttattgtatgctgtaaatggcctccattgaaacagtctgtgtttagactggtaataaaaatgagtgatgaaggcagacgtttaacatgggaattggttcaagcaagaaacatattttctcgttgttttttttttaagcctcacaaataatttggtttatgaagtaacttcttgcttggaaactttatgtaactactgcacagtttttataagccttggcaaggggtgtgtgtgtgtgtgtgtgtgtgtgtgtgtttctcattttgtggcttgaaacgttggcaagggctatcacagtagccaaggaagtttgaattttatttgttaatttgtcatatgtggacctttgtctctccactgggcaaacacaggagccccagg

SEQ ID NO: 59689 - DNA, 1101 bp, Homo sapiens
tctttttttctgaaataaataaggctgtggatggatagcagtttctataacaatctccaattctttcagctgagtttcctgaaatcatggtccttcactctacttctttgactgtgccaaccttgctgaaacaagacttccctgttctttggccccgtgtgctgttttgttagctagaaaatgcagccttctaatcggtatgcgctttactggtctccggtgtctactaaacagccaaaagcccctctcgccctagaaagagtagaactcagaaacgcttatggcctgcgggtgagacaagattgactacaggactgcgatttctttggatttcacaacaagacctgtgttgtttcctctaccccagtctacctagaatgggatttcacccacagctgctgccagcacccactcacccctgacgacacacacctgcctggccagccagagatccacggcgctaatgcactgcttttccgaggcgggagaaagataatggaaagattgatagacagaaagaggagttcaacaagacaacagaatgctcagaagtgcacatcctagttccatttctaactgcacctggccttgttatatgcgtgtagcttcttacgctgccatgcatgttgtgtatgtatatatacatgtaaaaatatatattcttttaaaaatatttaacaattgtgggctctgataaaagagactttagtatttttcagatcaagaggctatcgtgtgcctaatcacatattcggttgagagcgggtccagaatttggtcttggttgttctgattctcagccggaagcaagtgctgctgtgtaccatggtgtctcttctgtgtgcctcaatatgaaccatttgcacctgaagtcggctacataaaaaactcaaactctctttttatttatttacttttttttttttttttttttgagatggagccttgctctgtcgcccaggctggagtgcagtggtgctatctcggctcacagcaacctctgcctctgagttcaagcgattctcctgcctcagcatcccaagtagctgagactataggcacccaccaccatgcccggctatttttttgtatttttagtag

SEQ ID NO: 59690 - DNA, 1431 bp, Homo sapiens
tcatagcaacctaaggcccccaaaacagggtggggtttcccaagagcaaggcacagctcgttcctattgctggaactctcccttctctacaaaaatatcgtgtcctcataagtcattcacaccaacttccatttgtcaagataattggggacattttacaatgctgtaacctagatgttatcgtggagactcgccctgtttccaatttgcaatcttcaggaaggtggccatgcgcctgccattcagcagggccacggacccactgccaaaggactcatggcttgcagtgtcactgaccctcaccatcctaagatcatccgaggtgaggcgctgaacacagagcctcaggcagcccctcagttctctcctgcaagtccagacaaggacttgctggtttatttcacttagattcttgcctcttgggggctttgagaacatggagtggtattgacataaccttagggatctatctctgtgaccagctaaatgcaattgtcaccattttgattattcggtgacgtcagacgtcacctggctaagctggctccccactgaaaatgtgactctggttttttgtccttgcgatagtttgctgagaatgatggtttccagcttcatccatgtgggaattgaacaatgagaacacttggacacaggaaggggaacatcacacaccagggcctgttgtggggtggggagatgggggagggagagcattaggagaaatacctaatgtaaatgacgagttaatgggtgcagcacaccaacatggcacatgtatacatatgtaacaaatctgcacgttgtgcacatgtaccctagaacttaaagtataataataaaatatatatatattttatatatatatataatatatatatataaaagaaaagaaaaaagaaaatgtgactctgatacaacgagaatgctttcattgaattttaacttcaaggacaagtgggaaaacttggcttcggtgaaccggctgcaagtgcagtattccatgagtgtggcacgtttcaaaccttaaacacccctccaggctggggggcatagatgataggtgcccagccagcccttcctctactacaatacgtcctctcacttttaggtggtatctttcattttgttttggaaaaattagcttcatgccatgagctgaatggtagtaccgtggggaagggcaaagagagctgattagccgctttgtcaacaataaaatccccttccagccacttctgtagctctaaggagccatcacagcgcattgaatgtggtggagactcattcacagtcagttacattgaagagaataagccatggattgctgtattgtcatagttgcctttttattgtttttggaataaaggtagcccagtactacagccctgaaaaaacaaacagcaaaataagtaattactgtcttaccta

SEQ ID NO: 59691 - DNA, 1050 bp, Homo sapiens
caatttgcaacctctatgggaacttctgtacaaagaggaaagaggctaaaactatggattccaaaccatgtcaaagtaggacaacataaacacgaggtcaaagaaagaaagtggcttcagcttccctcgggacacgtagtttcacgttgattaaagattaaacaatactcagaattatgtgaaggttttatccggctcagtgcagcaattcaggctctttctgaatggagaggccgagaaaccctccctctcctggcgtccagcatttgacgttccccagaacaatgatgaataatgagtccaccaaacatcatatcatttaaccttcaaaaaagacatgtcagtactctcattaagggcattttacccagagagaaacaggctgagagaggattaaccacgtgcagaaggtcaccaaccagcagtggcagagctggaattctaactaggttttctggttcattttcattttccttgtagttaattcataaatgtactttgtctttatccttgttgatgtaccacaggaatagtaagtttatgctgctcatatttcagtaacattctgatttaaacaatgtaaatcacaaatgggacccgtaagcatgttttttgttttttgttttttttgagacggagtctcactctgtcactcaggcttgagtgcagtggtgcgatcccaactcactgcaacctccgcctcccaggttcaagcaattctcctgcctcagcctcccaagtagctgggattacggatgtgtgtgccaccacacccggctaatttttttttttttttttttttttttgtagatatggggtttcaccatgttggccaggctggtcttgaactcctgacctcaggtgatctgcctcccaaagtgctgggattacaggcgtgagccaccacgcccagccagcatgttttcttataaagctgccttggtcgatccccctaaaggttcacatccaatgtcatgggatcgagggtgatttggggtgctcagcacatgatatcctgtagttccacacctctgcctggtctacactgaa

SEQ ID NO: 59692 - DNA, 1054 bp, Homo sapiens
aaaaaagacatgggagagatggtgtttttcctctccaccacctggggatacgatgagaagatggccacctgcaagccaggaagacggccctcaccagacaccatgtctgctggcaccttgatcttggacctcccagcctccagaactgtgagaaataaatgtgttttgtttaagctactcaagtctgtggtattcttgttaaggcagcccaagctgactaagacaccaaatcattcaaaacgttaattctttttctgttctttaagcttcccagaatgtacacaaacaatgctgttattaaaatttaaaggactcttggaactgtaggacatgatccagctaaaataaataacaaataacacagctaagcaaatacttataaatgtagctttaaatatttattttagttttaaataattagtggggtacgagacagttcacattcaagagacattttacttagacaaaaaatttataagagaacgatgcataaaaacaaacaacatattggtctgtttatttttctaagggaaaatggaattggagctgttgagaataaaacttgaagaatctaactgcactgcttgtttgtaggcatttctgaattacacacaatgatatgtaaatggggtagcaacatgggaagaataatgttaacgtaatacaatttattgtagagaacagcaaattcacagcagtgattcctgtgctcttctgaaactgtcaggtacaccggagggtcttaaacctctcagtccattcccgtctggggattctagcatcccaaactttgatcattattgggaccagtacattattgggtactcttttgcacacactttgcccaccgtcttgactgatgctgcttccactgggctcagggtcatttccctcctaggtgccatttctaactcgtggttctggcactcctacctccggttctgagtggttttactggatcgcgtttagatttcggttgagctatattacaagctgaacgggacaacagatgcttagaaccaaaacagacataggacacaaaggaggcatcgct

SEQ ID NO: 59693 - DNA, 1020 bp, Homo sapiens
atttgaggcttaggaaagtgaactactccaagtcctaatagaagtagcctcaaaccctgatctgctcaacaccaaaacctaagctgcctaccatcattctactatacaaagtatagtagcagtgaccgaaggagtgaggagaaggtacagagagttaaagacagcatgggttaaatgctcacacagtgctgataggtacagagagttaaagatagcacgggttaaatgctcacacagtgctgatggttctgtaagagatgtggacagggactccatggttttcactaatctcctgtaaattactatgtcacacatttattctatattgtgaattttgcacatcgtaaagcattcgtctgtgtatggttcttggtaacaagcatggttctcctgttcatcagtactctgggaccgagtgcactgaagacgataggaagttcagcatcagtgaaacgaaaagaatcttcccagagctcaactcagtctaaagaaaagaagaaaaagaaatctgcactggatgaaatcatggaggtacagtttatggattgcgtgtggacaccttagaacccaaggaaaattaaatcatttcaccatttattagattaatagaaaattaggaaaattatcatgtacggactagggaatagtgacctagctacatacagttccccgaactggagttggagcccccctaaataggtttatttatttatttgttttttatttttttgagatggagtctcactctgttgcccaggctggagtgcagtggcacaatctcagctcactgcaacctccgcttcccaggttcaaatgattctcctggctcagcctcccaagtagctgggattgcaggcgcttgccaccatacctggctaatttttgtatttttagtagagatggggtttcaccatgtttgccaggctgatctcaaactcctgacctcaagtcatccacccaccttggactcccaaatgctgggattacaggcatgagccaccatgccccacctaaataggt

SEQ ID NO: 59694 - DNA, 1550 bp, Homo sapiens
acctcagaagcctcacgacccggaccccgggagccccagccccgcgccctcagccccgcgtccaggacctgatcctggattgccaggggccctcctgggaagacggggccactccgggcccactcacctcgtcccggcactgcttctggcacatctggcaataccagcgtagcttctgcagccccttggacttgatcctgttggcgatagccttgggagtaagaaaatccgacttccccatggcgaccacggcagcgatcactttctggaccccagtactcagccagccggaaacggaaccgggctggcggcggtgggcgggacaaatcccagctgagaggcggaaggaggtggggcctgggaagactgggttgcaacggtcgcgagactcccctcgccgtagcgcgaagaaacgagactgaagaagagagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggtatggcagcttgcgggaagatcggcaggaccgcaagggatggaagagcttgggcacggggcagggaggaggagatgggcgcgggggcagatgtggggtcgcagggcctagctgggcccctggcccgtcggaggcgccgggtagcgggggctgcaggaagcggctctgaggtcgggcaaggtgtgcgcagggccgggctccggcggagcaaggtcccgcccggttccctgaggtcggagggccacctgggacctcgggactgcggcctgagtccaaattgacgtctgggcggtcttgagttccctcagctaatcagcacttcctgagcttccacttccactgcaagccaggcccccagtctcagggcctgcaaggtgacgggagcctgagcaatagcccaggggaaggttaagtcgtgctttttgtccttgacgccctttgaaaccctgtagtgctggacagagtgaccctttaagattcgatcgagtcagagagcgcggccgtcgagcacctcccgtgttgcagacgctttgctgggtgctgcaacagcaaaggcgaacatcctagatgcctctgagggtggttttggtgcagaagggaccgtacagatctgtctgagggcggggaagggaaggacacctagcactaccttgaaaccacttgctgaaaccgtaaccctgcaaggtcatgaaattgcccccaggtcctgggggaggagttcggtgggcttttaagtggcatttgttaactgacatgcaactaaagggtgccacgagcctcgagaattttaaacattagttccgggtagggggacctgggctgggggaagtgcatattagaaggcccgggaatgggcaggtaaaagttggtttgtgggtggtgctgttcagttttgaagcttgacggaatctggaagaattccagacacgctgctaaggggattctaggctgtgtcgtagcaattccctgctcttaacag

SEQ ID NO: 59695 - DNA, 1020 bp, Homo sapiens
ttcttgtcttactgcattagctaagacttccagtatgatactgaagaagagtgatgagtggggatttccttgtcttgttcgcaatcttatggggaaagctcctagcctctcccattaaatcagagattttgtgtgttgttttttttttttttagcaggttgaggaagttctctattcctagtttgctgagagactttttcatgactgggtgttagattttgttggatgctttttctgcacctattgattgtatgattttttctttaacctgttgacgtaatagattatattatttgattttttaatattgaaccagctttgcatacctggagtaaatcccacgtagtgatggtgtataattatttttaatacattgttggatttgatttgctaatacactgttgaggatttttgcctctaacctatgctcatgagagatattagtcactgtccaccaaggtcattcaattagagaaaccttagatcattcttactgctttcctttctactacgaatgtacatgtgaagaagttaaatgcttgcaaatctagtctcctattgctttgccagcatcttcatccaggttcttgaggtctctcctgaggctgtggcagcctacatccccatgtcttctgtgttcatcaaaactccaacctcattttacgcttgtcactgccatgtgagatactttgctgaaatactaaactgatttgtgggcttataaacattcatttccctattaacctacaaataagatttaaaccaatttgctttttttgatatttaaaaatattaattatttaaagtaacaaacccaactcatgtgtccagtttccccttctccatttctcactctttcctgatcatgaatgctcttaaaatgacattctgttcccgagaatcccctcctcacatctctactttgtgcacacatttcatcatgctcagttctcctgtgtagctttgcctgcaaacacaggcactttgtatggatttgaaggcagaaagatcatctaatat

SEQ ID NO: 59696 - DNA, 2054 bp, Homo sapiens
tattgagctaaattgaaaaagttaagaatcagtttatataaactacttttacacgtgtagtcatgttcgactatatcattgactctgttactggaagaggttgctgtgaactaaggaaatttttagagtggctggccttgattcgaagtatagttgggcagcttaacaaggggaggggcttttctgtcatggaaacaagataagcaaagatatggaggtgggactagagcatgtgtgagtcaatagagcatgttgacttctgggaaggtggtggtacagacaggccaaataaaaggaggccttcaatacagggatttgcgccactactaagggatttaaatatatgtctattcatatacattctgagtcctgtatttgatagattgtttctttatggggtattctttaaataaatatatattaactgaaagtttttcttgtataatggaactatttttcaaaaaactgaaacatttttaaaacttttatcctcaggattcaagttcgaaatatggcaactttgaaagatagtaagtatgttgtttgtctcaatatgtgaattgagaaaaactaaattttgacaaatacaaatactttcaaaaatatactgctttagcccattgtgtatttgatcaaaactgaccaaatggatttccattgtatgtttgggacattggacttgttctgaaaagaccagtaagaaaggacacctgagacagctatgttctgttgtttgtagaatgatcatgatataactagaaaaaattataccagtgttggtgtaggtgggtgtatgtgtgggaaggggtaaatcatgttatatataaataatgttatggaatatgtggttaaggcaactttcaataccatttaatgttttaaatgtatattattgtcttatgttgccatttgcttgtcctaagtagtagctagttttgccttccttttattagtactatttctattttttttttttggagatggagcctcattctatcacccaggctggagtgcagtggcgccatctcggctcactgcaagctccgcctcccgggttcacgccgttctcctgcctcagcctcccgagtagctgggactacaggcgcccgccaccacgctcggctaattttttgtatttttagtggagacggggtttcaccgtgttagccaagatggtcttgatctcctgacctcgtgatccgcccacctcagcctcccaaagtgctgggattacaggcgtgagccaccgtgcccggctattagtactagttctaatattaagactggtttagcatcgtgctgtttattgtttatctaagcgctcattattctgccttgcacttcagaaaaatatgtcaataaattcacaaggaagttatactgtaattcctttgtcttaacacagtacttctatttttcagtcaccaggagactaaagtccatcaaaaacatccagaaaattaccaagtctatgaaaatggtagcggcagcaaaatatgcccgagctgagagagagctgaaaccagctcgaatatatggattgggatctttaggtaagggaagagtgtaattcacaaattaggaagaactgtttcacacaaggaagactactgatgacttacatttagagcttacagtgatgtcaagcctatctgagcacttgccatgtacttatttttcatctacatccacttgacacgtaatgataacaacccgtgtaggtagtacaggtagggactgttagaatccctgctttccagtgagaaaaactgaagcacacagaagttaagtaacttgcctaagatcacatataaaaggatgaagagcctctgtttggacctatgtggtttggtgtcgagtctgtgtatttgttagccattatacgtgaccatgttaacttttaaaatattctgaaatgttcccagttgttaagtataccatcagaagaacttggaaaccgtgcgttagatgtaagggcttaatttcatcctatgaccttgtagtgtggcattttaggactgcagcgggggcgggtgaggggcagtgcagtggag

SEQ ID NO: 59697 - DNA, 2094 bp, Homo sapiens
tcccgggttcacgccattctcctgcctcagcctcccaagtagctggggctacaggcgcccgccaccacgcctggctaatttttttgtattttttagtagagacggggtttcaccgtggtcttgatatcgtgaccttgtgatccgcccgccttggcctcccaaagtgctgggattacagacgtgagccaccgtgcccagccaatttttatatttttaatagagacgggatttcactacgttggccaggccggtctcaaactcctgacctcaggtgatccgcccacctcggcctcccaaagtgctgggattacaggcgtgagccactgtgcccggcctcagcttacagctgtcctaagaacacctgcttacactaggcagttgccagctaaatttaaatgcgtattttggaaataaccaactgctttgtaaattagagatttattgtatttagtgtattgcatataaaaaaattactgcttttgtttgtttttaagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggtaatttaaatatatattgtttattttcataaagatgtaagcacgaataaatcttctctcaaaagttttgacaaactctcaaaaccttcatcaataacaaggtatattcttcagggccttttttggtatattcacaagggggtgtttgtttcctttttcttttttccaggatatattggaacatttctgttttccttcccctgttttctacctttgcttcttcatccggatcataagttgaatgccatgtgaatatcaaaagctatcagcattaagccaaatgaggcatctgaggagctgttacagcctggaaatgttagcaatagttcattaggattagaaggagaggaataaaggggaaaagaatataaaacagacctcatttttagttcttagttctttgcaggtgctgaaggaaaggaatgatgatagtgtgtggaacaactcaggaaatcaccaccacccataccccaaaagacctgatccatggtgacaatgttttctcctgcctgtcccctgtgctctttcagcagaaatcttattaaactagctatgtgagctcttgcttttcttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggcaagacagatttagaaatcaaagcttttttatgttcatgcttttgttcatattttgaaataacagtttaaaaattattttgagatttacatttgtttttgtcaattctaggtctgtcatctcctataagacagaagaaaagcccatcttttcccttaataccgttgcaagtgctggtaagtagtttttctatgatacatattttttggcatatagaatggagagatttgtacactaaggcagacagtgtcaagatatctggtggtagctatagcaaatgatttggggctgtttcttttttagatggaatcttgctgcctcccaggctggagtgcagtggcaccatctcggctcactgcaagttccgcctcctgggttcacaccattctcctgcctcagcctccctagtacctgggactacaggcacccgccaccaagcctggctaattttttgtatttttagtagagacggggtttcaccatgttagccaggatggtctcaatctcctgacctcgtgatccacccgcctcggcctcccaaagtgctgggattacaggcatgagcccagccttttatttttttattttttattttttgagacggagtctcactgtgtcacccaggctgaagtgcaatggcatgatctcggctcactgcaaccttcgcctcccgg

SEQ ID NO: 59698 - DNA, 1736 bp, Homo sapiens
ttcagattttggagcacttcagattttggactttgggattagggatgctcaacctgtattacactaaattcgtttcaattcattattattcttttttactggaaaaagcattgagtgcttgctggctttgtaacaggcacatgctaatgctgtccagagggcttcataaccacgagatatagtgcagttatttcaaatgttgacctaatttttctaaagttacacatgtggagtagaatatcaaatggtttatttacacattatattttgctaaaaatatgctatcatctgtagtgtggaaatagatgacattattagaacagattcatttaccttatctagcattaatttctgctctgtaattataaaggagttttacactgaaaagctgtttttgatgaattactattccttccatataacttgaaagaaactcatcacttgttttaacagacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttgtaagtacacagtatggacagtgccagcaggagtgcttgtgagcacacagtgaatctcagctgagaggagtccgtggccgagagtagcatcaacaacattaacatgatattcctgtacctgtaagaaagtatatcttgataggtagttgatttgcaagtactgtgaaaaggtatcctatggaagatgtaaaaatatcttcataacattatttgagaggccaattttggtatccaaaaatttcttacttttaaattaagcaacagaagttagttaacaagttattctactctagtttcagattttttatgtagtgtttttgttttgtttgtagctgagatgattgacaaattgacattgacattcaaccgtacccgccaagctgtcatcacaaaagagttgattgaaattatctctggtgctgcagctctgtgagtaattgtagattgtcgccttcagagaattttttttcctcttgctgtgtctgcttgtttggatgcttaaaagtttttcgtttttttcttttgaagttgaaactcattgctgaaacttgcatcctaactcttaggctataaagatgtggtaaaaatgggacctctttgctttatttttattgtttcagctggaaacactcgggcttagttttcggttttctaaaggattaggaatgggatgtggataattcagtatcatttatgaaatctttttttggaatttaaacaattgtaagccaagctttctgagttacagggctagtttcagatttggttttacataaatctataaaccattgcatgttgggaaggtccaggaattttttaatcattatgttttttaatcattatgttttctatatcagtaccaaaagatagtatagccatccctcagtatctgcagtggattggttccagtactcactctcacctcccccaggataccaaaatctgaagatcctcaagtccctgaaataaaatagcacagtactacatataaaaaatgcacatcctctcgtatacttttaatcatctctagttataatgctatgtaaattgttgttgtattggtttttgtttttattattttatcattatttttgtcttttttccaaatattttacatcggctgttgg

SEQ ID NO: 59699 - DNA, 1930 bp, Homo sapiens
ctgaggatacagtggtaacagtatttgccttcagagagctcagtcttcacagtaaaggcagacactaaataagaagtcacagcagaacagaggttgctaaactgtggcctggagctaagaatgggttctgcatttttaaagggatataagaaaaaggagagtgatagcgtgtgacccacagagtgcagaatacttgctgtgtggcccttcaccgaaaaaatttgcctattcttgtgacagtgttatgaggaaaataacaaaatccattctctgttatacactcattctgcagaaacactcgatgtatgtgatcctatattttctggtcaccagcactcttcccagtccagtctcttaccattaccatttctcacgtccttgaacctcagccaccttgatctacttccagatctacagattcgtcactctttctcgcggccagggagtggcatgtgctgcagcctgaaaagccactatttcttcccttgctcccttgattcttcatctgactgcctcctgtgtatccttccttactcagctgggggaatcctttcttccagaaaacactccttccttcagtctgagtgaggcagccttctgcagcatcctgtcttccatttagcttagctcttacagccttgtatgaggaattggctttttatttgtctgtgtgctcctcgaggctaggatgggaccatatcttattcacttttgtgtccccattgcctggtacatacctccttcgtgaatgttgaatgaatgaatgaaatgccatatgtattcagaactggaagttcagaagagggacaaataacattttattgggtgtatgaaaatgtgggtccatggttttaagagtcagggaaaagttcatcactatttaaagtgttccttaagtgttacttttcaagggcagaaactgggcagaatgccagagagacacaactagaactttttgagccaacagagacctttgtgtaagttgttagttggatccatcagcctcgctatcctaagcattcttctcttattttactttctaagcacagctgtgttaggactaacccattcacagcctggtcaccaatgttctatcagcatcacagaatactgtctcatggtgtctagcttgatgaacttggttaggatactctctctgttactcagctttgtcatctgtaacatggggactaatacaaggactaaaaccttctattagccattatccttcttgccatctaccccatgttaaagccaggctgatttgttcttggatcttaagtgtgacaaagcctgcgggaaggaaccacattctgaaggtttgtgggctgtgtgagatccagagaacccaagggggtttttttgctcttgacaaacgaatgttaggtatgacctatgatgatacaacttctgcaaaattgaggaccagcctatttcttcattagaaatgcaggaaacctggccgggcgcaggggctgacgcctgtaatctcagcactttgggaggcagaggtgggcggatcacaaggtcaggagattgagaccatcctggctaactcggtgaaaccccgtctctactaaaaatacaaaaaattagctgggcgtggtggtgggcgcctgtagtcccagctactatggaggctgaggcaggagaatggcatgaacctgggaggcggagcttgcagtgagccgagattgcgccactgcactccagcctgggcaaaagagcaagactccttctcaaaaaaaaaaaaaaaaaaaaaaagaaatgcaggaaacctatttaaaagtaacagaaacagctgggtgcattggctcatgcttgtaatcccagcattttgggagaccgaagcgagtggattgcttgagcccaggagttcaagacaagcctgagcaacatagcaagaccccatctctacaaaaatgaaaaa

SEQ ID NO: 59700 - DNA, 1155 bp, Homo sapiens
tcatagtcttgcctacttgcatgagcatgtttttattgcttctaacctggattgaaatctatgactttttataacagtcattgagtctgtttcaaaggaatcttgtggtaagtatttttgcatgatgtactcaaggtatcaagtttaacaattgactttttttcattggaaagcatatgtgattaactagcatggattgcttcttgacctgcttgttttgtgtttgtctttttcttctaatataataaccagggattaatgaaaatcaagttccatcctcagacaagaggtaaagttcacacattcttcccatgtctgttcagaaaagaaacctattcagatataagttaagctaatttagtaatcctagaattgtcctctgagagatttagatggatgggccacttcacagtagcagccaactcacgggagcacctgggcaacgctagtggacttttttgtagtgagtgtgttgatcatagaaaatgtagatataaggaaataaactttgaggatagagaattaacattattttgagatattatatataggttgtgaagagtggtggttgtcacactttatggtctctggaccccttaatgtctgattcatgtagcagaagccagctagattttcatctgtctctattcattttgttgtgatgtcatggatcatgtggcctctggaaaactctactgtatactcgagaatgagaatataacaggcaaaataacattatcatgaaaatagttttgacctcatgaaccccatgaaaggttccccagaccaaaattttagaatcactggtatagggtaacactttattgtgtaaattcagttctctgtaccccacttaaatatgtattattatctcttgacattattttcccaaaaaatgctgtttgatttcttacttgttctgtactttgtttttcaggtaaagaaggaaaattcagccagttgattttgtttttagcttactgctgcctttgtccgaagaaactgttcctccattatttgaattactgaagacagcaagatatttgtaaattatcttaaaataaacaacttaaaataaaatcattgtttttcttatatataagaacaatagatatagtttttgaaatgagatgatactaaaacatttaaaaatat

SEQ ID NO: 59701 - DNA, 1342 bp, Homo sapiens
gttacaggctaaaaatcgaaactcttagcagtacacagttccctttgtgagctagcattttgcttaccttttgccagcctgccatgctaatctgcgaccacgctgagctacctgccttttccaaaatgttttaagctgtccattcctacatgcgtgctgtttcttacctagagtgtcctttgcccgtggcccaccaatagtattacttttattttcagatgcacttatcacttgctctagggaactcatgttatctgctttcataattctgtgcatatttcttttatattatttgtcatcttgttttgtaatcacctgtgtatgtctctttcccctctccaggagaaaaattgattatatttgtattctgtaacctgtagggccattatataataggcacctgagaaatatttgttgaataaatgaatgaactgataaaccactaccctaaaagccacttattgactttacatattgagttccaaaaatgtatatgttttgaatgcttgatttcactgatacttctattactcttcttcttttgagacagggtctcactctgtcgccgagcgtggagtgcagtggtgcgatcttagctctctatagcctcgaacttcagggctcaagtgatcctcccgcctcagccttccaagtagctgggactacagggatacgccaccatgcctggctaatctttttattttttgtagagatgtggtctggttatattgctcaggcttgtgtcaaactcctgggctcaagtgatcctcctgcctcagcatttcaaagtgctgggattacaggcatgagccaccatgcccagctcactgatacatctgaatgtggaaccacaaagtaatatgcgtgcatttttatcttgaaagtacatcaccagctgactactcttctggcttttgtttctttttcctctggcctccgctgcagtggtccttgagtataccgttagtgataggctaggctaggctaggctaggcatagtccagattatgtttgctaccatgtatctttagatattcaaaatgtctcctgaatacatagttacctttactgccatttatacaaaacagaagggagctgccactctatgtgactaggtattccaaagtcatccaggggtcactgcagctcttcagtgtaaaccttgttcctaattaccaagtttccgtagccagtttcttggtttcagtgagaatgagattgtcaggttcattattcccacgtaatttggtgacttttttttaatgctaattttggtatacttattagatatttttagattcttttttctataccagccttattctaaaatcaaattctgtag

SEQ ID NO: 59702 - DNA, 1317 bp, Homo sapiens
ggcattttctgtgtgtcaggtgctgttccagatgcttttgatcatctgtaaactactttgaaatttgttctataatagctaatcatgaatgtggtttttctgtggtgttctggctagttgtctgattatatttaaacttgactttaataatcagcttaaacatgattctgtgatactctttaaaatctattaaattctttccaataactaggttaaaatgtttgattctgagctgcatatttacttactactttttcttaatatttaaaaatatattcgtgggatttcttcaaataatttgatttgcttttcactttgtttcagatggccgaacagacccaattttggatgatgttggtgaagctttccagctgatgggggttagtctacatgaactagaagactatattcacaacattgagcctgtcaccttcccacaccaaattccgtcatttcctgttagcaagaacaatgtacttcagtttcctcaacctggaagtaaagatgcagaggaaagaaaagaatacattcctgattacctgccacccattgtgtcttctcaagaaggtttgtgagtgtttcttcttcatatgttagtgattattttaatggatttttaatcctcttagctttccatgctatgtcaactttataaattctggaaacacaatagaaacatttactgttacttacaaattattctaacccttaaaccaacaaacttgcaactgacattaccaagccgagtcacggtgtaatcaaggtcatgtctgaagcatttatctcctttgtaaagttcaagtagaggaaaacagtgaagccaaagagaagcctttcaacagccctattatatgagaatgggatattaggtaaattagaaaacatttgaaacaaaaagaaaaattggggtagctcttttcctcctcgcttattattcaggccatgagttgaatgccatggctttatactggaaacagtgagtgaatcgtgagtattcagtgacattgtgtagacttctgttttttatcatgaggagcaatgtttattgtttgatcatatagaacttttgattataaaatgatagctaatcaggtataatggtcagtccaattgcagagttcccttttttcctgcataattttagatgttgatcactaagttcactaagattctaaggagatatttaagtaatttctggtctctaacacaagtacacgatattttttcttataagagttggaaaagttgcaataagttctttcattttgtaaaaaattctaaaacctgtatacttcaggacaatgcaaatgatgccag

SEQ ID NO: 59703 - DNA, 1121 bp, Homo sapiens
ggccaggctggtctggaactcctgacctcaggtgatccgcccacctcggcctaccaaagtgctgggattacaggcgtgagctgccgcgcccggcctagagctttcctatttcagataaaataatagcaagttatttgcttcttttacggtggttatatactgatggtgtgccattggtgccaaaagtaaattcaaaataattgtttccttccttcattcgtcaaggagctgtggagagcctgctgtctgcaggctcactgcttatttctgaaaagagaggtaaagaaatagaggtccttccctgctttcctagagcttacagtctacttggggaaagaagggctggactcatgtttatatactatttaaaattataatttgggattcttaaaggaaaacagagtgctccagtactataaacatcagaggtctctaacctagtgtgcttacaggaataagggaatcaatggatattttttaagtagggggttaggatgatttcattataaattctgttggtactgagaaggatggactcaagaggagatgtcactggaagagtcttgataaagcttgtggtagtcacccaagggacatgataggaaggaccaaatttgggagatattggatggtcaggatttggagatagataaattgtagaggatgtgctacagagaggagcctaggtttcaagcttgggagattggctaggtaatcagatatctaaatatccagatcttaaacagactggccagatctggagtgagaatttagaatggaccttatagtctgcaggcaatcctctaacaaaactttttatttattttttttaaataatcaggtagagctcaggattgtaaaacatgacacgaacctcgtacccagggcagacttggttgcttatgttaagggcagcaggtacacttgctttaaatcaggtggatggtgggcttttaccaaatgactgcctatgttggccaggcaccacgcccgatgtgggaggcagaggccctcctatcgttcattgagttgcgtgagtaccctatttaattaaagatggccctgtttgtcattgtaggatattgaattaatattgttttttttttttgtttttttttttg

SEQ ID NO: 59704 - DNA, 1011 bp, Homo sapiens
gcctccttagtagctgggactaccagcttgcaccaccatgcccagctaacttttttttttttttgtagagatgggctcttgctgtgttgcctagactggtcttgaactcctgggctcaagcgatcctccccactcagcctcctaaagtggtggaataacaggcatgagccaccgttcccagcttacagtcatcttttaaatgtctgcatttgtcttccatcattttttgatctgcttttagttgtagtcatctacaggtttaagtaacttttaatcttttttgaacccttagtcatattgaagatgttttatttaaaatactacttaaatgtagttattcgtatctagttttaccacaggaaaaaagtataataatatttctctctccctgttgtgtgtctcccctatctctttctcactctttttttttttttgagcactgtgatcagtcgttggataattgtgttgcttaattattgatattttgtgcttatgtcacacatacaattaacatgcattaattgattatttctcccatgtaatcagacttggtttaaatttataattcattttcactacatattatgtagtgaaaatataatggttaaatacactcttgttagttaaattttatcatccattttactctttgtggacttcaaattttgcagtataaataagaaaacggactgttttatatggaagtgattacaattcagtaggtggcactctttcaatttctgttagtgttaatgaatatccaattaaatgtcaaagaatgttttaaaatcttgagaaaaagcatacaactttagtcattgatgccttgttttagaaaggatagtaacaatttgttcataatttagcgtctctggaactttgtgagaatagttacgtatgaatatacttaatatttatttgccttgaggaaacttacctaaaacagaatttcttttaataaaggctttgtgatatcctatctgaaactgtagattttctattcagaaattt

SEQ ID NO: 59705 - DNA, 1048 bp, Homo sapiens
tagaagtttttaggtcaaaggtataaacacatttatggtttttgacacatattacccattgatttccaaaagagttgtatcagtttacagtgccgtaatgaatgtatgattacaccagtgtcccagcagtctccctggaatagcatttcaaagtgtattgtttttttactagcttagattaaacaatttgggaggtgtgtcattttgttttaaaatttttagttgaaatgtgggaactaccaaaaaaaaaaaatctcccactggaatataactgctgttatttttttgacgccgccctccaggtctttgtgtgtgtgcgtgtgtgtgtgcacacggttcctgctttagcatagcttaagtgtagtgttgaattttatgtcctccgtttttcgtttaattaagtcacttactatatgctagtcattaatttctatttgctgggcagtgctaggggtaggggtgaacccaaagtgcataaaatgcactgaaatgatttggtttgggtggttctgttagtcacgaaagggtatgtggaagcgagaatgtgtttgagataggtggtaatgtgaaaatatttatgtttgtgaaatatttttatcttaaatgcttgcttggtgaatatctgtgagtattatagcagtatctgatcagatttagagtgaaggtgagaggtctcatctgaaatgaagatgaagagccttactccgtgtggctgtataatctcagcatcattttcaattggccgtgtgagaggccattccttagtattgagcatcttagtcttttctgatttttaacttatgtgaatagcattgctttcttgacatttcagattttttgtttttaatttttatttctatttgtttcttttcaaatgcgttgaaggcaacagattatttcttatggttgaaaaagtttgatttctgagtttaaaaggatgaagtggtttgtgtgtttttgttttttttttttttttttgaggcaatgtctcgcctgtcacccaggctggagtgcagtggcgcaatctcggctcactgcaagctccgcc

SEQ ID NO: 59706 - DNA, 1021 bp, Homo sapiens
cagcaggcacccagtcatcagccagcaaccccttccaggtccctcgacctggtccctcgacagctgctagatatcctgttgcaaattaaatatgaagcagggatggacttaattttgcatttaaaggatttcttaaagttcagcctcaaatgaagttgttagtgttttcatttttattgaagctggctttgttggaaaggaaggggcagctagaattgtcctcagtggtattaaagaaaaatgctctggaaaaaataaagtttatgcctaaagtttggcataaactttatgccaatatgcctttatatatctatatgccacatttcataactcttcttataaatactgcacagttgtcaggcctgccaaaatggtatgtagcctactgtgtcagtacagcctgttagtaaacatatgtttatagtttaactgtttcccagtagggtgtttttgagactttcctttttcagctttgtctttctgaatggtagtaacaaagggaaataaaacatggtgagtttatatcacactttgagggacaggaggctaaactctagaattaaacttatgaaccgcaacaacacttacatgtttccttaggtaccaagtgcttcacacacattaactcattgaatcctcataataatcctgtgaaggaagtactagtattatctttttttttcttatagatgagggaaataaagtgtagggataacttttaaggtatgttagaaactggtagatctaggatttgaattcagacagtctgactctaaagagcttttttaaaaaaattactgagctatttttgtctttagattatattactacaagtgatattcccgtttgtaagacatcatcctaaaggttcagtgatccataaggaatatttgggatatgttatgccactggtgtcatcctgtagatcttgcacttctgggacgatttagggttattgcatgggatgtgtgaatttatgtttcataagcattgtatgtaggctaaattttaaaaaattatg

SEQ ID NO: 59707 - DNA, 1032 bp, Homo sapiens
tacagtcctggcttgctgcagcctcaaactcccaggctttaagcaatcctcccacctcctgagtagctgagactacaggcgtgagccaccatgcctggctttttttttttcttaattttagtagagatgacgtcttgtcatgttgcccaggttggtcttgaactctcgggctcaaacgatccttccacctcagcatctcaaagcactgggattataagtctgagccaccatgccaagcctttcccccaccatctcccagagacggggtctcactttgttgcccaggctggagtgcagtggtgtgatcatagctcactgcagcctcgaattcctgggctcaagagatcctcttgcctcagcattcaaaagtgctgggattacagacgcctggcacctagctagccactaattcttgaatgtcatcaaataaccagtcttttcacattttaaattttctctcaaatgttataaacgtttgttggtttattatgtactgttttttgaattagggtccaaataacatccacacgttgtgactggttgatctctctccctctctcattctttctcattctctgtctctttcccttttacattttcatatttgttgcagaaactgcgttgtttgtcctgtagagttttttatagtctgaattttgcttatggcatcctaatggttttgtttcacgtggtcctctgtttatcccataaattggtatagtcggttctaagagcttgatgaaatgtcatgttcaattgttttggcaagactacttcatagctgggggtgtgtaactccgtcagagtacacataatatcaacataatatcatttgtgaatgtgtgggtgtgattttagcaaacattgaaccattaagtcaatagaagttgcaaattggtaacagtctaattctgttttcttcacaagctggagtgcttctataaagagaaacttcctatcatctactatttggtttcctggtggtagagtttgtatatgaaaagctggatgaatgcttgatcccttttcttc

SEQ ID NO: 59708 - DNA, 1209 bp, Homo sapiens
atgtttttgttaagaaagaaaaaggcaggggaaaattagagaagttatgaaagtactattagctttctaaattcattgggaagaaactctcttgattttcagctatatcacaccccagggttcttttcaacatttctgattttttttttttttttctgctaaccttagggatttctcagaaactttgccagctgaattatctgggggaggtaggagtaggggagagtggaatttgaggatttatggagttgacagcttacaaagaggtttgaacggcctcagtagaatattaacatttgggctctgttttgttacaaatagggacatgaaatcatattgcttcctcttatatcccatagtaaaagaactatgggatgtagttcaaaatatataatcaaaataacgattggcctggctgttaagaatcactgtcttttcccagagaatttttgtgatagaatataagatcctcctctttattctaaagccactggtctgcaggtcatcaaagaagtgagtgatgttacaagcaattgccagtaatattgtatcatttggacttggattctggttctgttcctgaattgtatgtttagtttttcttcctggcgcttgatcctttagaacctcctggatgatacaatcgtttatgtcagctaggctacaattatgatcattagcaggggttgttcttgcatctatacttaactgttttttcactagttccggatcttactgattaggtactttctgaactgggaggcagaaaaatgtcattgattggcaagttcgtatctgtgtcatgttgaaaattgtcttagattattaactaagttcagtctttttgtgtgttctgcctgtcaatatatctactgttaatgagaacttattttaggattgcagtgagtttaatgtgtataacatgcttagaaccgtggccgggacatattcacatgcttagcacatgttagcagctatgaattattttaatgtcaacattatcatcatcagatttcactggtacattataggctctgtgtgtgtgtgtgtgtgtgtgcgcgcgcctgcatgtcactgaatgtacgtgtgagtgtgcgtgtgtgcatatgaacatgtgaatgtatcctcctccattactgctggcctcttcagcgtcttctgggctctattcatatgtcatcttgtcgaggcctttctagaacaccttat

SEQ ID NO: 59709 - DNA, 1909 bp, Homo sapiens
tgttgtggtgcctgcttgcatttgtgcttcttaatccttcaaaatgtgctgtttttcttttgatactcaattatagatagcagtttgtaggttttccttgttttaagtgaagctttcttatcttagctgataattgaaataaggagactgaaaccaatcttcatattgattttatgtattctttatcagtcactatttatatggtagtaaataatcaccattgctgtcataattgttcctcctcgatattttttttctgtctccatacattgtttatttatttaaccatttaagttgcaggtaatataagcatgtgacatcctttctggaaattgtaaactttttttttaaagtcctataaatgacgttctttgagcctttggcttattaatctttataatattggtctacatttccacctacttagccatttctctttctggctgaatagtgataatttttcctcaacattaggtcaatttattttattgctggattagattgattgtgttataagaaagagaaaaccaagaggtacagaaggatgtgtggaaacctccactgaaaacggatgctgtccttccagagccagcgggcacgaaggggttgttggcctccagttgaaaagtagcatgaaagagaagttgactgcctcttttcaaaagttatctttgtgtggtggtcctaatgcaatattaagaaaattagagctttaaaaaccagaacaatggtccttttaaaatatatctagtttagtgaatttaccccccaaagcctctggtgtctaattactcaaaaaggaaaagaaagaggagaaatctttactagcagaaaaataaattgcaaaaagtggcaagtttttacttttatggaaaacattttaattctgttttaatccagaaggcaataaaagcagcaaattttaagagtattcatttttttcttgtacgactaattttaccgacagaaaataattgaactccaaacaagtgatagtaatcttatattactattaaacttttattttatttatttttctctttaagtttttttatcatactattaaacttttaaatttatatttataaaaaggaagtttgttttcctcctttttacttataatttatcttgtctgtataataaagggagacgcttaatgaccaaaagaacaaatctgtacatagataaattaattttgtgcggtgttttatatttttcttttctttgttcccaaatagtgatgaaatcgactattttagtaagagaaagactggattattgtttagggttaattttctgaaatattgtgaagcagtttttaaatttaacaagattaattattacctgaaagcaatactttagcttcacatttagaggtcctcgtatttcagactgtgggcctggttttctctaaaattaattaggaacccttgtaaagaggtattttcaatgaaatgggccataagcaggtattttaaagtacatattgttttctaaaagttttcttgttggttttataagaatcgaatatgaaagaacaacttatttattgtagcaggagttcctgtaatgctgtttttggaaatgagtttattgtccacataggagaaagaggagagaggcagtcttacctattcctgtaggtgagcaccgtatacagaatcacgggggtcagtggttatgtgacagtttgtgtgtttactcagcttacttgaaaatacagctatattgtcctaaaagtcaggaaagttctttgacttaattatctttatctttggagcatagccaaagtcattatttccactgaagttgtcatctgtgctttacattttcttccatctattaaaactatttttcctcttcccccagcagattgttgaaactttgggaagtgcatgattcttcctcc

SEQ ID NO: 59710 - DNA, 1142 bp, Homo sapiens
tgttacttccttttggtaaacacaaatttaggtgataattacttagcttaagtgagaaaattgtcagtctccatgagtctttagaaataatttatactgatttcataatttctaaaaagctacctgactttgtgactttggggatcatcattaaggactgaggtggcaagaatggtggtatggaaatctgggaggtttttcttctttcatatttgagtgtatttcacataataatttctcaatattttacaaactgtgtaaaataagtagatacatttcttagcccagaatagcccacaaatatttaatgaaagttggaatttcttgttcagttctttaagacacatagaaaaaattgtcatagaaagcaccttgttatttaattcctaaatatttagaatatgaataagaatgtaatgagaatatggcatttattgttagaattttccaatattgctttgatataatgaataatataaatgctttccctttatcattatcttgtagtaagagaatttaagaattttagaggtaaagtgccctctgagattacaaccctactatttaaaaaataagacaactgagacccattgtgatgaagtgacttggccaagatcttaaaagctcattagtgacagacatatagagtgaggtttcttggttcttactccattttttttaaccacatgctcaattctgtgtccctctctctccttctagtaccgtttatacaccgtgtgtgttattttgagaagggactagttaatttctatactgtaacggcaattcagatctcaaatacattggagctaatgtttctgtcaccttacctgtcacagtgtcctttgagtagacgcgtactttgcaacttggcatttattcagtaaacattttttttaagtatgtaccatgtgcctctggcgtgcaaaataatagggaacgggtattatgcatctgaccttcctgtgttattaattctaaaacatgatttttaaaacaatacatttaatcatatagatgtacccaggagcagatcctgattttgtgaggcctaaagcttgtacaattttgggagcctttttaaagaaagtaatataaaatagcaaatgcaaaagcagattcaaaggcctgtcagtagtaga

SEQ ID NO: 59711 - DNA, 1133 bp, Homo sapiens
ctaaccccttgtttttattggcccattggacatctgcctagagcatgagtgccttctgtttcagtgatttcaacttttctggaaaatcctttgctgtatctgtacagcaatggcttcagtttcccattaaatttatattttgtgacaattatttctcttctgaagccagcagacagttcttatctcttccttagacatcccacggctctgtttttaagcattttgaagacagacaatgcttttcttgaaaccaatgcatcacactttcttactgacatcatggtcctggcacgaacaccttggcctgccacatctatgctgctgagttgtcagtaagacttttggtcataagtataagagtcttatttataatcacaaggaaatgggtaaaagcagagggctccaggttgagtcttgggaaattggggcatgattctaattgaaaagggcctgggctttggaatgagactttccattgcacacatttttttccactaattgtgtggcctctatctacagttatagaatttttgctttctcatctacaaaatgaggatgacagtatctgtttcttaggggtgaagtgaagataaagtgagaaaatgtgcgcagtttttctggcgttcagtaggcattcaccaatgtcagggctgctttctccccacccctgcgcctagttatcacgtgacaggaatcaagtgccttcagtgaacaccgaagctgaccatgcgggggtggaaattccaagttgggccagtgactgtaaatagtataaatagtaaaatatatatgagtagcaggagtgggaatggaataggagaattcagagaaggaaaaggagtgggttaccaatgatagttgaagtaactgcatcggttgctgctgataggtccctgggcctcagtttaccaagccctgaaatgaaatattggaaccttgttctattgtgtatgctagtaaggtaaaaacaactctgtttgaacctttcagttttctaataaaataataacccttctctatattctttttctcagatctttactcttgtgactccgtgaatggggggaaaacgtagaccaaaaccaattcttgccagaaccgttttcattctggggatggttgtaagttctaat

SEQ ID NO: 59712 - DNA, 1866 bp, Homo sapiens
gaagaatacaaatagtgttttgtagcaattattgataaattatacttttaatggaggcatttgtttcaaaatcattcttataaggaaacatatgataatgtgttatttcttgggtttggaattgttttggtagcctgaaattggagataaaatgggtgacagctttgtacatgactgctactcctcggtggatggctggagagagctcagaggcccagctatccaaccactattgtgtggtcctgaaaggagccaagaaaacaagcacacaccaatgctggcatcattgaaaactcctgtgcccctataatgtggggcatgaaatcgaatctcaactaggaaaaggtagaaagttatgaaatgattcagattcttttaattactatagaaaaactatttttataaaaatttttatttctaaaacacatttaagtagcagtttccccagtttggggggaggttacataaggaaggtatagggtagggtagtgtttcactgttttactgaactttttgctctttaggcttcgtattaagaaggtaaagattttgattagaagcacatggattttctcctacattagcagatcataaaactttttaaaaatcataataaatttatcacaaaacaattcacgtttaggataccatattaatcttttaaattattttttaaatgggtgcttcttgaagtagcggtgtatgtagatatttataatttcttctggtgtgcttgtggtgatcatccaaaaattagttttctggttacacatttgaagctactaagatccactgcatttgattataatttatttttaaatgccctcatattataaacctgtatcttttatggggacttatctaggtgttggctgtcaatgattttattaaagctatttgtaattaagtttaactaacataaaactataatgcatatcctttggatgaagaaaatactttaaaaagaaaactttaaaatacataaatacattcttggaatgtttccaaacctctgcgtagtccatgccacagaagtaaagggtctttctcaaatgaagttaattacccacagggtgcatgttggtcactctttaaaattcttataaaaacaaagaaattaattatccagtatgaaaacaagttctactctttctggcaaacattcaattaactttttagtgcttgctatttaatgttgtttttgaccaaccaaccattgaaaactactttcctttgaaattgggcttgagtagaaaacagtattatgtgtggctgtttagatggccagttccatttggccatcagcttttttcccatgatctttgaattcaatggcttgttatattttagactcactgtgaggtgtgcattgagcacagttattttgtgtatttagtgttggaattaacatctaaaatgtgttgggaatacccagtaaacttcttaaattaatattttatattaagacgcttcagaaatacaatggtattaaaagcactttacagctgaatgactaaggctgtgacggtcacatttaaataactttgttttttcagaaaataggtattttcattgcctttctttctgatattttgtggatgtttccttcctatgttttggaaggtatattccaaatttgataatcttatcattttgccacattggctttcttccctttgaactgacagatttgtgtgtgcacgtggacgctcctccagactttatgttcggaaccactgagaatactggcagacactaactccgcaccccacgttcgtcagtgtgtgtgttttcttagaaccaggacatttcttctccataaccaccaattaacatatttagggactttaacattgatgtaacatc

SEQ ID NO: 59713 - DNA, 1087 bp, Homo sapiens
tctgtaatcccaactactcgggaggctgaggcaggagaatcacttgaacctgggaggtagaggtttctgtgagccgagattgcaccactgcactctagcctgggcaacaagagcgaaactctgtcttaaaaaaaaataataaaaaaagaatcttttcttaggagatgttattaagagtccgggccaatattgactgcgtgtggttgttttctcatgacgaaactcaggggaaaaacgtttctcagggttttcataggtgctgttgtttccttttcagtgtgttacatcaggaggcgtataatgtcaggctctctgggtgctgggggatgactgtgtagttcagatggtgtctatcggatgtttttcatgtaaaggtcactttctccctttataattaatgagtaataggctgagtgatactgtgagactttgcaaatgttctgatcctccgcgttcatttagcatttattgatgattcttgtcagttattatacttgtggctgtagaatgttgattttctatcacttctgtattgaaattcttccatttaagaaaaaaagaattgtctctcttccacttctgtacccttttttagtggttagaatagactcaggttttttttttatttaatgtttaaaaataataaagtcatgcttgtgctcacctatggtcccagctagttgggaagccgaggtaggaggattgcttgatcccaggagtttgaaaccagcctggacaacatagtaggaccccatctcttaaaagaaaagaaaaagttatcctggcatggtgacacacccgtgctcccagctacttaggagagtaaggtgggaggatcgcttgagcctagaaagtcgaggctgcagtgagtggtgattgtgccactgcactctcagcctgggcaacagagcaagactctatctcacaaaaatgtaataatccatttctgtcatcatgtatgctgctgctcaaattgtcccaaatttgacaaatgagaggcccctacaggtgacccctgtgtcctttgacaagtgtccatctcagcttttgaacattttcttactcttctggcacaagaagccccagg

SEQ ID NO: 59714 - DNA, 1001 bp, Homo sapiens
gagatgaaaatcacagttaattgttgtcattctttaaaataatatggttaaatctgaaaagctttttgaattgtgggcaaaacattcttgaaataaagcttatcttaccaaatatttgaaggaaatttggtagcattgaaatagaatttttgtcaatttagaaagttaataatttttttaacagtgatttatactgtagctaaaaagctgttgctggtttcccaaatcttaaagctaactgaccttccatttgaacctagctttaatgtaaacattttcttgaggtggttaggggttgggccagccaatctggaggatattagtggcgttctgtttgagggaagttggaatccctagataattctcaggagctcttttctaggccagaagctgtctcagacattatatatttattttttaaggttttttttttactctttctttactgcaatgccatattatatatttcttaattcttccttggctttgttaataatgtctactatctgaaatctaattaataaaatacataattagctttactttgaagtagaaggaaagagcagttttatttggtagtttttctatcctttccactttagttgctgagaaatataatgtagtatgtaggctactgagagtgaggttattaccctactgcctttaaaaattctcactttttagtcatctattacttagccaaaatattgttgttcaaagctaaattaagtactttatcaactttctttgatacctcccctcccccgtttaaactttctgagcggtgtttttcaaacttcaggtcatgacccattaatggttgttaaatcagtttagtgagttgaaactagcattttaaaaaattaaataatacatagctcctagtaagacaaggtattatttcaacttttgttgcacttacacagatatatttgtgtgaatctatattgaaaaatgtaaaataccttttactgtgggtcaccaccaaagtttgaaaatga

SEQ ID NO: 59715 - DNA, 1070 bp, Homo sapiens
ctacttcataaaaatcacttataaccccttcctccttaaattgtgatgtttaattgtgatgaaataaatatgataatatatgtagttgataatacaataggtaccacccgaccagatttataaaagaaagtataaaaattatgttaataaaataagagttataatcatgttttgcttatgaagaggcactgtttccttttcttctcagcaacaaggaagttgcagaaataacgggctatgtttaaaagtgtcatcacccttggaattacagggtcaagattttcttctcaaaatctggacattgtttttttgctcccccacttttttttttggagttctggatgtttgatgaagaattatttgttttacggcctctaacattttattttgaaagggactagtctttaaaacttggctgtaaaacaaaggattaagagctcttccatttgtgcctattttagatctataaggtgggagtaacaacactgatttagagacctttgaccttccgcaatgaaaggacaaggaagtaaatactactcttactgttttgtatattccactaaaatataagtttcggtggtcaggcatttttgcctgtttaactcactgccgtgtcccagtacctgatacctagtgccacataggaagtacttaagtattttttgagtgagctaattgatattgttacactatagcggaattaccttaatcctgcacctttaggtaactgagtgggccacataaatgtgtttttcatgtagttttaccttttgtgtcaaaaaatgccattttaatgcatttatggaaatcttcaaattgtgtcatagtttttatgaatttcctaactagagtatttcaaacatattttgcctgttgactcaagggtgtcattatcaataataattactgtaattcctaggtgggccagtgaagcttgtaggattgcccttgtgttaataaccatgaactgttgtgttggcgatttagaacagataaggatgaatgttgtaatggtttttctattccttctggggttgtctgtcattctactcacgatgatctaggta

SEQ ID NO: 59716 - DNA, 1029 bp, Homo sapiens
attagttctgggtagtcaatcaggcaacaagtattaatactgagtgcttatttcatttaatccacaaacatttctgggcagttaactatatgtaaaggactagatatacaaatgactgacagttcctacctgctcaaagtattgttttgttgtctttggcctcatggataagacaaaaacagaaatgaattcattacaatgtaatgtggcagatgaaataatagaaatgtactgggtcttgaggagtacaaagtgctagagatacgcaaccagaatatattttcctataattacttttattcaagcaaattattataccaccctatatagagatacagaaatgcagagatcccctatggatttatgttttagttacttcttggaaaaactgagtcttagaaatttaactcggagcatattcaatactgggagtatagtcactgttttaaaaagtaaaaggaggtgaacatgctacctctatcagtcagtgtgacaattgatcctatttaaaatattataaggaatgacctgtgcactaaagggtagtgtcagttttcacctgggcagataattctcttttccccgcttcttggaaaacacaaaaatctcatggaatactgtgtgtacagtccaccacagagagggaatggcatctcaactagctagtgttccagcagatagcacacatgccggaagtactgattcagtgttttttacagcaaatatccaaaggtcaagagacagactgagagaaagagaagcagggtgtgagagagggaggagagagattgattatgagtctggggtcatgttttaaatgagtaaccagaatcaccagtcaaaacaaagcattcctgtattctctaacttgaagtactcccaatgtaaagatcagttgtgttaaccccattcttagtccaaaatacaagtgtgtagctgacgttgatttatgttccacttaatttttttttttttttttttttttttggagagagggtcttgctctgtcatccaggctagagtgcagtg

SEQ ID NO: 59717 - DNA, 1048 bp, Homo sapiens
aacacgagctctccatagtgagatttagagtgcactccataggtgaatgaatgaattagtcccagttaacacagagctctccatagtgagattcagagtgcactccatatgtgaatgaatgaattttagtggcattgagtcacttcaaggaactggttacaataaatatacctaaattcagacgaatagaaaggtattttttgaaaaaagtatgcttttttgtttttcaacctctctgccccacctctcccgtgctgtctaagcattcatttaaatgatcctttcatttgctagtaaaagaggaatctattataaaaacagtgacatgtatggactaataggaaagtttgtgcatcattgtagaaattaatttctacatctgcatacatttttcatttacagattctgacacaagattgtgtgtacacttttaaccaatcataagaagtctagctttaaatacgtttaatttttgatgaaatatatgcagatagcattttgttgttcctttgcttaaagtttaagaatacaagcatattttctgcttagttggagaacatgccactgaattttaaagttgcatgcgtctgtgtagttagtcagataaaaagcttctatgccatgtgcaaacaatttccctttatttcctaatgtctatgaactttttagattatagtgtttctttaaaggcatttactattctagttaaaaagatattttgttctaagtcaatatttatagtagcttagaattaacctcccaaaaatccttttggtgtgtcagaccttattgccttgttctgtttttgtctgagaagtttagaaaagaagcatgtttttctcattattcctcaggagaatgtagggagtgtggattatttgtttgtgttattaatgaaggaaaattgaaatggagtttgtggtgtcctgctcccatcaacatttgtaaagcttttgaaagatagggattaatatggatacattttgttgcttttatgtgattaaaaggaatttgacaattgttctgcagtcacactctgatgctttta

SEQ ID NO: 59718 - DNA, 1030 bp, Homo sapiens
ttttctgatcatctgtattatatttcagctgccgagtaggcattgcagactaaatgttcatcaaactctgtgtctagggattgagctaataatcattgtccttttctatttccttatttcctgtttctgttcatcactacatttatcactcaccaaggctcaaagctttctttcccttttttttttctttaaaaatagggtctcgctctgtcgcccaggctggagtgcagtggcgcaatcatggctcattgcagcctcaaccttctgggctcaggtgacccttgcacctcagtctcccaggtagctgggactacaggcacgcaccacaacacccagctaatttttgtattttttagtaaagatggggtctcactatgttgcccaggctggtttcaaactcctgggctcaggtaatcctactccctcggcctcccaagatgttggcattacaggcatgagccaccatgcctgaccaggctcaaagctttgaaattgtgtttgagtccttgctcaagtcttataccctaatcatttatcagattctatccattctatcctcagaatatccttcacctctgctgcttcctgatcatttccactgttctagctctgacccttactgcctctcacatcacttcagtaatccatgttattgctctccttcagtacccatcacctcccaccctcatccatcctgcgtgttcctgccagtgtgacttttcccaacacataccccacacgtttttctctgttgtctaaaatccttctaggtccaaactaccagtagaataaagattatgtttctttttctggaattcaaaagtcctaggatctggatgcaattttactaaacctgcttcctactgctccccaccttgcactctactttccagacaaataattttctgtttctcttacactccccgtgtttcaccttcatctatttgtcatctgaccctttgtcctggacttcaccacttccagtctccaactatcccaaacgctgcataattaatcaagcctcctccgc

SEQ ID NO: 59719 - DNA, 1046 bp, Homo sapiens
aatcatatttgaagcattgtttttatttcttaggttttgttacattccaataatatttatttttttcttcctttttcttcctttaccagaagaagaagaagagcaggtgcccactgatggaggcacatcagcagaagccatgcaggttcccttggaagaagatgatgaattggaggaggaagaaattattaatgatgagaatttcctgggcaagagaccactggatagtcctgaagctgaagaactgccagccatgaagcggcctcggctattaagcactaaaggggacacgctagatgttgtgttattggaagctcgagagccactcagctcaataaatactcaaaagatcccaccaatgctttctccagtccatgtacaggacagtacagacttggcacctccctcacccgagccgccaatgttggctccagttgcaaaatcacaaatgccaactgcaaaaccattagaaacaaagtcatttacacctaaaacaaagactaaaactagctctccaggacagaagactaaatcacctaaaaccgcccagtcaccagcaatggtcggaagtcctattcgatcaccaaaaactgtatccaaagaaaagaaatcacctggacgttccaagagccccaagagtcccaagagccccaaggtcacgactcacattccccaaacacctgtgagacctgaaacgcccaacaggactccttcagctacactcagtgaaaaaatcagtaaagagactatccaggtaaaacaaatacagacaccccctgatgctgggaaactgaacagtgagaatcagccgaaaaaggctgtggtagcagataaaacgattgaggcctctatcgatgctgtgattgcacgagcctgtgctgagcgagagccagatcctttcgaattttcttctggatcggaatctgaaggagacatttttactagccctaagagaatttcaggcccggagtgtactactcccaaagcttccacttccgcgaacaatttcacaaagtcaggatccactcctctgcctctttccggtg

SEQ ID NO: 59720 - DNA, 1005 bp, Homo sapiens
atattttaaagagcaggaaagggatatcctttacactttgatgactttagcaatcagaacaattaaaaattttaatgtttctttatccccaagtcctgtaggatttgcccccaaataatcttttattaaatttaaacggtttgttctttagagaatgataaatcatctaattggtttgtacctttaaggaagggttttcatccttttcctcttttgtttaaagtaatgtagtctcattccaagtcttttctcatcagctattgtaattaattcgtgaaatgaagggttttttttgtaaataaacccaataaaggggagggaaatgtttccttcctgtttctcataactgtatgttccaagagaaaacaagaaacttaatgtttaaatgagtatatttaaatttgtagttcacccaaggccagctcccagcctttctgactctacactctgagcacggacgggaaagctcatattctgtctcagctgtctacatggggtggcacttgttatacttaaccacaactgcacatcttctgactctctgtttaatattttaaatagttatcagagtttacttagactgtgtttctaaatggaaataatgtaaagaccttaattgctgagaaatacaagatggttacagccatagttcagcatccaaatgttaggttattctgttgagctttcatcagtactatttgtgagtttttttctaacataccggcatagatgggaatctgaactagcgcttgctaaatttgctgctaccctagctagtatacatatatggtgtttttttttttttttaatgaaaggagtttaacattaaaagaataaaaaaataaaaaaccttggacagattatattgacaaagctgcccattacctttgcagaaagtccctgtcaaaagataaactttaaagctggaatgcatgaaagagttccaagatagaatttaaatttgaactgattctttatagataagctttttaaaaatccacctct

SEQ ID NO: 59721 - DNA, 1100 bp, Homo sapiens
tggtcctggatgtatggtggaataactaagaggtaaaagggttggggcaagataagttgataattcaacaaatgtctgccgagcatctcctgcatgcaggcatcatgcaagggagctgtcgaagcagtagatcttgatgggctgagggatttgaaaaacaactctaggaagagacagataaatacatgagagaaaataatagatttgatctacatgtactatattaactttatgatatgttgatcattattttatgtgttcccctttagaaccactatactgttcaattatgatgtaattcatgagcttgaaatacataaattaatgttgcagctagtcagtgactaacagtaaaccagtgacattaaacatctggcagtgcttgggacagtgccttacaacaaagaaccatcccaccaaaaataccaatcctacagccccaccgaaagacttggagatagacagtaatttggaaatgcagagcttttgtttagcttgttaattcaaaatgttgattatatgatctgcaaaccaacaattgtgaagagaccctttaacatcagacttagtttctgtgttctcttctgacgaacaggtcagatctttctgaggtctttatcttatttggcagccattgccttcaccacaaatccattccaaaagagaatatctgttttcgttttctttcttttttctttttttttttttttaagatggagtcttgctctgtcacccagggtggagtgcagtggcacaatctcagctcactgcaacctccacctcctgagttcaagcgattctcctgcctcagcctcttgagtagatgggactacaggcacccgccaccatgactggctaatttttttttttttttttttgagacggagtctcgctgtgttgcccaggctggagtgcactggcatgatctcggctcactgtaagctccgcctcccgggttcacaccattttcctgcctcagcctcctgagtagctgggactacaggcgcccgccaccacgcccagctaattttttgtatttttagtttcaccatgttggccaaactgatctcgaattcctgacctcatgacgcctgcctcag

SEQ ID NO: 59722 - DNA, 1413 bp, Homo sapiens
agccgccttggcctgtggctccgtggcagtgcgacagaaggaaactcaagcagaggcgtggcctgggggctgcccctcctccacttctctaataccagtgacaagtattattaataaagagcgtacatcttcccttttgatttcctttattctctccagggccttttcattgaggtattagatgagaagataatgtacaaactgcctcaactgtaatttaaggatgatagagtctgtatacagttttcagcccctttccctctatagtaagataatcagaataacataaaagaaaactccagttggagtaccggtaaatatttttgtgataagaatatatgaagcttccctccttcccccgtttttagtactaacatgtaaaatgttcaggcttttgtgaaataccttatattttttaagaaaaaggtttctatcatgtcctgtttgcttttgtgcaaattatttttgtttaatgtattttatatcttcgttgcattctaattttgcccttctttaaactgctggagtctcttctcactgcttgtacatttcatcaacttgtataaaaactcttcagactaaaagattgcccctaatgtaaataataaatatttatgaagtagttattttttaaatttttatcgtgtttaattctggctttctctgaaatccactgtgatttcagccaggtctgtaatgacgctggacagaaacaaggctagagaaaaagccatcgttcaaagaaatttcccttgagctcagcctgcgcagtgcccggaaacatggtggggaaagggcccgagcagttggaaggaaaacaaggcaatttaaatttagagtttatgacttgaagttgttttgtttgttgtctattttgtttttgtaaatttctttgacagacttttactaaaaggacatgtagtttccatgaaagtaaaaaaaaaaaacaacaaaaaacccacatatactgtagcattttgtctttatattgttttatttctacaaatctgttcattaatattgtgctttaaggctgaaatgaagtatattatgaatttttttaagaaaactcatcaaatttcagggtatcacaaaactttattatattattatactgcccactatttattatatgttatagatgtctgagaggtaaaccaaatattttatttttaatgttaaaaaaacatcaaatttaactttattagcatattttagcaactttgggataaatacggacttttacttgattttgaaataatcccagtgtaggcccatgtgctggatctgttggatgctagaatatgggctttgaacctaatacaaatatattactagaaaatgtgatttttttaaatgccaagtaaattgatattagtgtatgaattagtcatattttaaaacattatgtgg

SEQ ID NO: 59723 - DNA, 1050 bp, Homo sapiens
gtttgcttttccattttctttatttaggatttagttccttgaggcgtggtccatgatctgaagttgccacgtttaagtgagcaggtcacgctactgaaatcagaatggaggtgcctatatataactttccccccaatcttactgtctgagagacttcagcccatgctacatttaaggaatttcaatcagtttgttgtcccttgctatttcatggttgctttcctaaatccagttcatgattttataaatggtctttgcaataataaaaccaaagaatcattttcagggggctggagagctcgagggattagtaatggaatacagagcctttcacctctaggtcagtgagtcggatccagtccaggtcactagagaccaaaagttgtcaccatcttatgactgttcagtggcctgtgtgaaatgaactggtggtctcagtctctactgggtggctggctgtgacaccaaccaaaggaagttcaagaaactgcaaagagaaatgtggattagaaaataaaacatccacattacaaagaaaaagttagaaagttgggcgtagtcattctccagaaagtaataccgaagaaaaaagagcaacttacaaataccacagacaaacagagattaatttactttccttaatgaagtcaagcaaaaccggaaaagaaaagcctatattgggtgagaggggagagggttaagtggggaggatgatttgatcagaagaaaaagttcagggacccaaacatcagggaaaaatgggttttgacttttgagggagaaggaaatcgcaacagcagcaatttgaggaactactgtagcagaattcgacacaaaggaatgagaagtatttccctttagagggcttgcagtgttccagttggaagcaaaaccctgaccggctttcatttagcccagcactgtcatttgaatagcatcaatactttattaagagaagtaatgcggggggggcggggattgtcctgactagtgattttattgagggagatggtatttgagaaacagaccctcacctcatgaaaccgagac

SEQ ID NO: 59724 - DNA, 1059 bp, Homo sapiens
atttgtgtactttttgggagaaagtactacgtaaaaccagtgcttaatgattttgacaattaaattatatgtgattattatcttcctatagtgttttttttttttagaagagctactcagatatagcagattaatatcactcaggcacctgggtttcctagcccagcaattctgaatgtacagagtacaagcatataatgccaactggtaaagtcagagctccagatgacaaggtacagcatgtaatcttttgcagtctattgacagcaatctaaataaaagcaaaggaagatgcttccagtactacaaactttatgggaacttagggtctctcaaagccacactgtttgggtcactagcaggaggtacagtatattaaagcaagcagctcagcctctcactagtggtgagatgtatgaaaatcctggcaatgccagggggaaaagaatctatgagtcttcccttcggtcatctctcctatttcttgcattagttttttcagggttaaatacacatctcacagaagagctagctatatatgggctgggtggtcttcagtgaatctgcaaatgtatcaaacaaaaatagcaagctggaactggaataaagggtcagggaatacaggaaagaagaaaacaaagggttctaggtgttcagaagtcaaatacatctcagggctaaaaaaaaaaaagaaagaaagaaagaaagaaaaagaaatctgagtgtgtcctgtgttctacctccctgtagcttatgaattctatagaactaaaaacatcaaaccaccaaagacagatgattaagaaagaaaagacagatgaaaatgtgacagtcattgaactctaaaattcaaagcaattattactcagagttctagagatttcctatgaaaggtgagtggagataaaattgcataaaatggaattacgatcctcctctgcaatctgaccagacagaggaagaagacccaagaaaatgtcaaataaacttttgctcaccaatcagcccatgccttgagacttttaatccctctttttccttctttacttttattagaaa

SEQ ID NO: 59725 - DNA, 1050 bp, Homo sapiens
tgctgtgttattagtagtccatcttttccccatctttgttactgttccattgcctggattttttcctaccatctaaacttcaggacagtgtgtctaagccaaaggggctatctacatggtaaaaacgattgatcaccagttaaccgtaataaaaatattgtgcctacttaaaaaaaagtaagtggaatttatttaagaatttgagcgctgcagtgtttccagtttcaagatggtctcctaagctgtttagtgaaacttcttccacctttctccatccctctaggtggttatttatttatttatttatttatttatttatttatttattttttctgaacctggatgtaacacattaaaggacccgacgcaaatagaatcgaaggcattctaaaatggctaaccgtacactgaaggatgcgcacagcgtccgcggcaccaaccctcaatatctggtggggaagatcattcgaatgcgaatctgtgagtccaagcactggaaagaggagtgctttggacttatggctgaacttgtagtcgataacgccatggagttaatgtttgtgggtggcgaatatggtggcaacataaaaccaacaccctttctgtgtttaatcttgaagatgcttcagattcaatccgagaaaggtatcactgcagagtttatagaaaatgaagatttcaagtatgtccacatgttgggggcactttacatgaggctgatgggcactgcaattgattgctacaagtacttggagcctttgtacaatgactatcgaaaaatcaagagccagaacagaaatgggggtttgaactgatgcatgtagatgagtttattgatgaactggtgcacagtgtgagagtctgtgatatcactctgccccggctacagaaacgctaggtattagaggaaactgagcaactggagccttgagttagtgctctggaagaggacatagatgatgtggagtccagtgaagaggaagaagaggaggatgagaagttggaaagagtgccatcacctgatcgcctccggagaagctacggagactt

SEQ ID NO: 59726 - DNA, 1141 bp, Homo sapiens
ctgggcctcaagcacctctcccaccttggcctcctaaaatgctgggattacaggcgtgaggtaccatgcccaacctaaaatttatcttcactttgtctactttctctctctctttccaagccaccataaactcccacctgaactgttaaatggcctttgaattggtccttcccacttcctcttttgcaattcattctctaggtagaagtccaaatgatctctgaaaagtcatccatcaaaatattgtttttttcataaaatcatgtaagagtttcctattgcttagaataaaatcaatgcaatgcactttggttccaagggctgctttcatctacctctgcagcctcatcacctgctactttctttctcatttattttgcttctgacacaccggcctttctccgcacttacttccacagaaagttctcctttcaccaccctattaagtaaccccccaacacacttcctatcacatcgccatatttattgtcatctattttttatttgttgatttataaatgatctgttcccttcccccttagctccagaacaatgtctcccttgcctgtccggtttattcctccatttgtaggaccctgaacagaactggcagtcaataaatgtttgttgaatgactatatgagcccccatttcagagataagaaaactgagatctggtctcctactctttgtatgtgttcttccttctatttgaaagcccagtgtcatctctctgctctttttctcccctaccaaactctctaccacttgttcttctagatccggattttgcaaactacagcccacagacgaaatctagatagtggcctgtgcttataaatatatatatatatgaacacagccataacatctatttatgtgttgtctgtaccatttttgtgctacaacatcacagttgagtagctgtggcagagacggtatagcccccaaactgaaaatatttactgtttacttttatagaaaggtttgctgaccactgttctatacacatcctaggtttctttgataccttctctgccctgaagagatttatgttccttctgttggttcccaaagaccccagttttaacccctatcctagcatctgtgtcatccaataatataattgactagaggactt

SEQ ID NO: 59727 - DNA, 1153 bp, Homo sapiens
tttgaagtgtttttttcagttgagattgctccgttaacagcacatgttatcagctgctttccgagaggaagaattcatcccacattggctttttagaacactgatgttatctttgatctgggcagaggtattattttaattgtttaatcttgctgtttaattgcaatttgctgggttgagataactttggcatctgttgatgagatgcagtgagctggggaaacaagacccttgaaagacaagataaaaaggtgatgggatttttggatatgaacctagtaattaagatttcatgggatcatttggagtgttttccacttctcagtgtttggttgttttttttttctcccctgacagctacaataacactgtatttggcctctggtaaaagactgcaatatccttagcttttttacataaatccccaaacttcatttctctttaccccttccttacttttattaaaggttaaacactcgtttacttagcataaaaagacaggttacgtttggcatgcaaaatgatctgatacagctgagtgtaatacagccagcgcccaatatgacccagctcttgggcaaaaaatcagggtagcgatcattgttgagacttatatgtagattataatgggaatatgatgtcattgttgaattttttgtaaaaaccgacaaaaatgaaaacaaactctcataaatgttaagcagtactataagcattccgtatctaatttgcatttaaatggaaaatgttatattttcaacatgagtcaaggagcaaaattaataagtcatcaatgttgcttatgttcaatgctgcactttacccaaacttaataggtcattatttccactttagagtattaccgtttgggagattttgtttcttcacgggagggtcacattttcgctttttgttttcggattaggccatcacaaagagttagatgtttgtcagtgtaatgtttgttttacagaaccacagaagggagggtttggaaactactaatgatttccagttcattagcacctacaagttctcatgcatcctgtttgtttcctccaccaaggaggtgccgagtaatataatgaagccagtatcagtggtgtgctacttgtgtagcagtgcagaaaatgtatttttatttttccttaag

SEQ ID NO: 59728 - DNA, 1208 bp, Homo sapiens
ttgatggtatgaatatggagcagagaggtctgtagacctggcagccttgggtggcctcataaggtgctcaggccgcagaatgcctggaggatgtagatggagagagtccttggggaaatgacctagacaaggaattggtgatttttgccttatgtggtggtgtagggttaagacaaggggtttggggtatgggttatctgtagcatctatgtggtgtccagctgcagggtgtgtcctggttattttggtggttaataaaaaaggcacttctttattctgatgtagctgatagggtctttggagtgctaagagatcagagtctccacagaatgtgacagtttgctcccagtgctgcaagtgacttgatgccctagatcagacagcacagattctgtttggaagcctaaagcctcggtgtgtgaatccattgttgaggaatatcctccacgacgggccaggggaatatttggcacctactgtagctgagagtgtgatattgactgtggagaagctctctgggctgtgaatgtgacctccaaaatgcagactcttgcctctcatcacacagcactttgcattagggtgaaccagggaactttgctggaggcaggggggcctttggcaatatcaaagatgactgttgttgctgagattcttgggaagggaaaactaggtctgtggctgaaagctggcaaaatctttggagaagagggccagccacacagatactacaaatgtttctgtacaaattaattggtactttgtaattagcactttttctcttatcaatgtccaagaagtctgattaactttataggcagactttcagttgggccaacagttttaaatctgcctgttgtaaaaagtgaccaaaattggacttttgtcacctcagaagccacgtgattggccacacttttatcttgcctctctctcagtctcgtttttcaggtctcctaaggatgtgctacttttgttccagatttgtttccagatgcctgctcaagtaataatcgtgcagaccccagaagccagaaaacattttccagtgtcaaccaaactaattccttgccaatcatacgctgctttttggtgtgtgtttcttttaattctgattactaacactttaagggatgctgccttcctgtggttacattttctgaactattttatgagattagttattcttgatttaggatataccatgg

SEQ ID NO: 59729 - DNA, 1050 bp, Homo sapiens
gtggacacttattcttcatttatgataacggtatattttatgaagaggtttctttggaggatttcattagacacctggcattttcccccattaacttccaacttaaaaatttttgcatatgacttagacgaatgcttggccttctcaggtggcgctacgccttcttgtgaattagaaaatggttctcaggtggcattttgtccccacagcccacctcagttgatgaccttatgcagtatcctttctacagtaacatccgtttttactccctcctccttaagtaggcctcgtaagtaggcaatagaataaatgagcctctatgcaggatatcagtggagtttcaatgatggacagctgtggccagctgacatgtggtacctggtccatttcaaggatcattacactttcagccactccacagctttgtgctcaagtgcataaacatttgatgggattctgtgttttcagcaaatcataaatttctgtctacttctagatacccaatgtaaaggaagggataatagaaaagttagagtagaattcatgcatgggttggcctaacccacaaaccatttcatactgaacattagcttgtcgaaatgcctttactcttggcaggacacaagcgccataacctaagaggatgtgatttgagtggagttttcatgccctgtgtgcttattgtattcttgctactgatgcaaacattatctataattacattttcaagtgactgaaaattgcaggctttgtggaacaaaaatacagccaaagaatggaatgtatattcactccaccctcattataaggctttcagaaatcagactgtaaggcccaataccatggctctcaactacgtgatactaactccattctctgatgtttgaacactttgtcaaaatgctgggtttccaatgatgatcgtataatttgaggaaaatgctattacccttttagcgcttcatttgctccattgttgactcaatcacagtggcacctcctcacacaagtcctctatttccaccctgtgaaacaaacacaatttgattt

SEQ ID NO: 59730 - DNA, 1163 bp, Homo sapiens
cttcacagctgggaggaggagaacacagtgtcattcatgcatcctcagaacattaccactgcggaggactggcagtgtccttcggggaccccgttgcccgtgtgcatgctcaggggcaccataaacacttgctgctggttccccatgccacctgctggttccacatgccacctgtggcctgtcaggtgctcagagggccttctggggcaggcagtatttatgataaatagtttcatcaggatgtgtggctcagctgggcagctccagctttcttgctccctctgggtttcctgacaaactggcctcctgctaagggcagggaactgaatggcactgagaagagttaatgagccacagaaaatgtggcgttctaagaagagaacagtatttgtgtcccgaactctttgtccgtgaagtgttcagagagaagtccagtgtaatgggcttaaaaacatcctgcttgcactgatctcttttaaatggtgaaagaaaatgcaacatttaaaaatcattaaactacattgtctggacattatttgggcttgggtttcagatacttctgggacatgcgtgagatgagtgacactgctgcagaagtcatggcgagcagaagacatttgtattattggaacctggcctggcttgaacatggagtgtcggttctaatttggttctgctggactgtagcagctcctgctgctggtggggagccagtcatcttggattcatagctacgtgcagacactttctgtgcattcttactctttaatattgggttgagcacttagctctgtagggcctgtttccgtgatctcccatcagtccctgcctttccattccaacatcaccactctgtctccagatgatcgtgcagcctcctgtcttctctctgtcaccaatcccttccaccctgcattgccagacagatcttaaggcctgtctgatggggttgtgcctcttctcacaatacccaggggctgcccttccctgccttgcatgcagagctctgcagattatgcttgagcacaggccctctcctcccctaccattcactcactcgcccactgggcctcttgtttgcctgcctccctgctttcctcctgaatcctcctccataaagcttccactgtgaggaaaggagtgataataataaaactccgaac

SEQ ID NO: 59731 - DNA, 1055 bp, Homo sapiens
attctgtatctagtactacagtttcctcataatctgcatttcatgaacaggatcagattcctgtgtttctgagtcagaaaaactgagagaaagaataataaagggaactatttggctgaccgagtatcattttcctgggaatagttttaatgtggagacacaggtgccataggcactctcaggtgcatttctcctttcagaatctttcctcatccctgtgccctcatgcttcatacacttatgagtgactgggatagatgttcttggcttagatggtttttaagattcgttctaaacctgatattctgtgcagtggtttctgaagtggaaagacattctttgctaaatgtggcctaattttgatcccgattgctctcccaaactcttgatagcgtctggaaggcacggcagactattctgtaggcccagtgcaagtgctgtggccgccatcttgaaagctcttacatgtgagtcttttcttcttttccctctccccatctggagtatcccccatctagccatttctaaaggttccttttcagtcccaactgctgtattatttaaatcccatctacagcactcactacaagcaatgcttaaatctgcttttgtatttgaaaacaaagctttaaaagcagataggggagccacagagaagagtagtgattttgtgacaatggcctaaatccaagaagtgcatttagaaagtgcatttgtttgttttaaacaattggtttcagcatgtttgtccattgaaaatgggaatgctgagcccatgtatagataaaccctctgatggaaactggagatttttgttataggtagaagtgtgtgtgcaatatgggaccctatattccacaattctataaagctctttaaaatgtattcataatcattctaataattcattctgcatatagaatatgccctctcacactcagtcatatttgtggggttattccttaaatgaggctttgttgtttctgcaggaaatgagtggttcgatgtttttataaatcacgtctgccttttctaagatgcatagctaggaatag

SEQ ID NO: 59732 - DNA, 1224 bp, Homo sapiens
gggtcaccactccatttccagaaatacatcgaggatagcactgccctggatgaatccagaccttcacaataatccagaccttttctgtcaactctctgtgcctcaacggcccatctgtaaactgaggaaagcgacagtaccaataacaagttcattgtgatggatttaatgaattaatacacgtgaaagtgcttaggagaacttcataaatgttagctattgttattgccaaataacaatttgcaatcaaaatatatttgacaatctcctggactcttctttcatggtgttctaatacacgggatcaaatctataggtacccactgtttttcaatgaacaggattattcaggataatgcagtgccatctggaagacccttatagctatagggcagctccactgaggagagagcggaatctccccagttgagcaggtgatttaaactcccctggcattcgcagcaataacaaccgtatttttccctccgcctggcctgtgtcttgactttggacaggagtccaaagtgagctgcgtctttgtgtctgctccctgcactgcagagggtgtgagctgcacgctgcctacccgggtctgatagggagtggggattagacgccaacattccaacatcattatgtaaagtaaaatagcatcattgagagaggtgaggctgagcagtccaaaatatttgataacactgaaagagcgtttttcctcttccacagtgaatccatgtctccatttgcatttgttaaaaaaaaaaaaaaaaaaaaaaaaaaaaaaaactcccgacagcaccagcaacacaacaggagagatgcacagcctgagcaataaatctctcgaggcattcagcaagtgccacagggctcattaatcttgattatttcccgtaatagataacttcacaaatcagctattattcctaatcacgcacataaagataatggatgggtaatagcttcctgcatggttagaccaaaataaaatttcatgtaaaaatatatttctacacattccagggaaaggtgttttcttgctttcttaaagggacaggaggagatgggggagcaaccactgagggcaaaattgatccttgagaattgggtttgaaggaagtattaggtctctctgatttgcttggagacattcactggcttgtgtgccaccctgtcactgtgaggcgggtttgagagacttagggccacaggaggctacagaat

SEQ ID NO: 59733 - DNA, 1490 bp, Homo sapiens
gtaacacatcatcccatacttagttgcatagaacctcttccttatggactgcgtgggtcaggagtttggacagggcacagagatggtggatggcttgtctctgtctgacaatgtctgggagcctcagctggaagaattcaaatgacaggtgactcagctggctgaggactggagtcatctggaggtgtcctcgctagcacatctgacaggtgggaagtgttaccagaaaactgggctcatctggagctggtgactgaagcacatgcaagcctctcccgtgcgttgggctgccattggcacggctgctgggtttgagagaggcgagcttctgtaggggggagccttctagtagaaccaggagaaagctgtacagtcttttcagcctagcctcaaaagttgaacagtgccacttctgccacatccttttggtgacaagagtcctaagagccagcccagattcaagaggagaggattggactcccactgtcattggggatggcagggtcacgttgcaaaagagcatgtgggatgggaataatttccggagccatctttgaaacacacagtaggccacagtggaggttggcagccgatggcagcaaagatgactaattcagttaacacttgctgagtttgaggtgcgcataggattttgaaggtgaaaagggtgtagtaactgaagatagaggactttacacaccagcctagagacattgaagacttttaagaaaggagataaaagcagagatagtggccagagataagcgtaactgctgcaggcatctcgacatttagaagagcaggatgaggaacccaagaaggggagggacagactgaggagaatatgagccacagtggctagatgaatgaagagcgtgaagacaggagtgtcagtatatggtctttgaaagaggtttcagtggctggtggaagcagaagccagatggcaattgcttaaggattaacgaggtagagagaaggcagaaggcatgagaggtatatccaaaggagaagaaatcaccctaccaaaaatatacatgccctcatatgttcatcacagcactgttcacaatagcaaagacacggagtcaacccaggtgcccatcagtgccaggttggataaagaaaatgtgttgtaccatggaatacttcgttgccataaaaaaaagcatgaaatcatatcctttgtagcaacgtggatgagttggaggccattatcctaagtgaactcatggagaaacagaaaaccaaataccacatgttgtcacttgaaagtgggagctgaacactgggtactcatggacatgaagatggaaaccatagacaccaggaactccaaagagttgggaggaagggaaggggacagacatcaaaacctagttactgggtactatgctcagcaccagggtgatgggatcatttcacaccccaaacctcagcatcacgcaatatacccaggttacaaacctgcacatgtaatccctgaatct

SEQ ID NO: 59734 - DNA, 1032 bp, Homo sapiens
agcatcatgggcctttactgaactaattgtcatggtagagctcttgataagccactgtggttgattagtataatagtgtccctgtcaattttacttaccacattgaagttgcatagtttctgaatttgacattcttagaccagactgtaatccagtgaatccattacctaagcaaaaataaattcacagaagtagcaatagcttttacttaagccttccttccagtccatggcaaaaataggacttcagtggatttcaagatacttgcccgactgtgctaattctaaagtaatcaattaaaagagaaaggcattagctggttcttctttgtataagaaacaaatttaaacatctaagcaattctcagttcataaggtaactttacttttcctatataaacagtttctgctatagctgaagatagaacaaatgcatatgctattgaatcttttagcaagttacatggctctaaaattggacttcttttcaggcatcgcaagcagaccattgtctgtagctttcatggagatgtgtgtgatttgtccttgaaactcggggccctgttctcctcccactaccaagttcagccatgctggtggcttcagacagcgtccttggaactcttgacttttacatccttatctcaagccctgcttttttcttgaatgccagtaattttggattggaaatctcttcctaggcaaccaaattcaatgtaaaatggagctcatttccccctttctttctccatggaagtcttataaaactcaaccaagcatgccttggaatcatgcctcactcctttttctctctcattccccacagctcatgaaaccctcagccctgtcagttttttctttctcaatttaaaaattttcctttcttttcatcgtttatggacagaccacttctcccttgcacagttggaacaacctcttcagccaccttctacctctacacaaaagttactgatgtttctaaaacctgagtctcatcttgttactccctattcagaattctccagtgcctctc

SEQ ID NO: 59735 - DNA, 1058 bp, Homo sapiens
tatgtaattactgttttttacagtacagttatggcaattatatttattctattttttggaaagtacatataatgtaattataattaataactgcaaagataggctcaattacttaagtcatgaaagtgaattaccttaatcatactgagaatttttcagccgccctgtataaagaatatctatggaaacagtaatgctctggagaatgttacttgtaaggaaactgaaataaataaatgtggagtttatgctgaaatgagtagttttaaacaatgaagaaaactatcagaattttatagcttgctactatctttaaatccttttacatagtgcatgaatcatcatgctttcattgtaaatttaaaattttaaatgaaatttcaagaaacattgtctttgcaaaacacagttctaaatagttgaaaagagtgaggaaagaaattctgttaaaattcaggattatttttgaacccttgattgactttcgaggaatattttaaactgtctagaaaactttgcattattatttatggtattatgtgctaaataaaaggggccatatcagtgttttcttataaatagtttagttacttttggggatgaaacttccatatagattatgtgatttttatgtaaaaatgtaacctacaaggaaggtatcgctcaagcttgtgagttatttgagtgcaattaatgtatacatctttccattattagtctattttaggtaacacttttaaagagtttaactcttccttcttacctaccccctgctatctgatgacttgccttatgcttcttctaaattttagttgcacaaatacctattctttacctctccccgtttcctttcccagtaccctaaagtagaccacatcattcagtttttttttttttttattcagcaaacaccccctcaggtcatctcaacaaacctctcaattctgcctctctcatcggctcatttctcttcgtctccactgttaatatggtagagtaagccatcttcaatttctcacttgcgttattttccaggaggttcaaaccggaaatggttt

SEQ ID NO: 59736 - DNA, 1049 bp, Homo sapiens
tgaaataaggtaataaggtttcccttttccaaatgcctgtgttctgtgatcttttctgcaggaatagttctctacgaattttggatgcattttaccctggcaagcatttgagacccccaaccgaacacagttcagcaatacctttggtaatccagcataatgtccccaagaacacaaatgtgttatttcttagttgtttgtgaataacaatgatgtcctgtacattcttaagaaactatttttttaattttgtcaaagtgcaggattgatcataaggtaatacgtgtgtatgtacatataggaaacctgaaccttttcttcagaggagctcaagctatttaatgacaatttgaccatttagagaagggctttgactttgtaatgtttagggtatttgctctggtcaattttccatgtggattcactagctgatgtgtggccatctcagagatggtttggggcctcattccataatttatgtggcagtgactcaaaaggtttagtacacatgataaatggtaacaataccttccacctaaataggggagtgtcattattttcacatatttttggtggcgtaactgataaccaaaacattttgttaaatttacccaaagttttcagcagccctggatgccactacagttaagacatagctgtgtcagaaaggtggcaaactctgccctgccgaaaggcagtcatggaagacagacgcgtttttcatgatgactgtgaagcagtgcattttaaaagggagttgcaattcccagagctctgggttggatgaccactgactcctcttcctaaatcgaaaggatgcgctaagttgagcatggacagggcgcctcctgagggtagggcctgagtttctgatgtgttctccagcatgcagtgtgggaaggagctgatgctgagaccttagttgccccactgccagtctgttgggaagagatttctcttcttaaataatggcaacaccaaaatgaacaatgtagagattgttaatattaatgaatttcatgtctgtcctgttacccgccggaggcacc

SEQ ID NO: 59737 - DNA, 2144 bp, Homo sapiens
agagttaagaacatggcttctgaaattggagaaccctaaatttaatttctggctctactgcttctttgctacgggccttgggcatgttacttaatcacatcttaaagtggaggcagtccttgtagtgttgctgtgtgatgaggtgatgtgctctccacagagctaggatacagtaggagctggttatggcagtcatgatgatcatagttgttgttattatctccatcaatgtctccaagaacgtaaactctaaaagggacaagaaggcaggtccacaggtaactctcatacaaaagaacatgagctaagagtaaatgagtaagaaagagatgggcttactggaaccatggaagttgagcgaggaaatgaataagtcgcagcttatgggagatgaaaaagatggcatctttaccaaatcttgaaaacagtcttaggatttcagtaaataatgatggtgaacattacaaatggatggactggcctgcttcaggcatgcaggtgcggaagtgcagggcaatttctgggaactgtgaattctcccacagttcagaggaaatgggaaatacgtgacatgaagtagagaagggaaggccacaaagcctagagctataggctagagcagctcttagcaagccttccttcccaggctgaaggatttaaaattcctttgttagactctcgagactctaggaatattttagcaacaagaggctcagaggctgatgcagtgtgttgacgtgtgttgaggtcaggatgtcgtctgtcatgggaatggaaggggaggctgagggacagacggacagtggaaggaagaggacttgataactaaattgggctcagtgaagaccaggaggctttggcttaactgggaggattgtgagcacagtcagcagtggtgggaatggaggagaagagcattaagttcagttttgattgagttgagtctgcagtgtcacagaagagtcaagaaggatgcaggccaagaaaaaccatgggatttggtgactgggaggacccaagagtatttcagaagaaggatagaggttgtggggaaaggaaatgcatggatgtatacatggtgctgagtgtagatgtgcctttctagtagtctggcatgaagggagaggaagcttagacatgcagtttgtttgttcagcaaatgataagttgtacagcaaaggagattgtcaaagtgtaaggtagagatgactctgcctcaggtctgtgaaagagtggaaagatacttcatttgagacagaggggcattcaggaaggagtaacaacacaaagtttcagaaataggagacacttcgtacaagcgcctgccctcagacttctcagtaaataggaaatttctgaagtcccaatgaattgaagacttaaaaggaatggaaaaggtttgaaatgactgctttgggaaattgaatggaaagagtggtaaaactgttgaagagcagggagaggccggtcacacttagatcatgtccatctggagtgggccctgatggttgtggactgtttatccctgagtgaggaaagatacagagtcatagagaacccagagttggagatgttcaagaaggcatcgtagaaggccaggaagggtagcagatatgctaggaagttctctcggaggtctgaagtaaggaagccggcaatgctgaaagacagctcctggtccaggaggtggaggaggaggagttgaagggttggcagttgatgttcaatgggagaagttggcagatatggaaagtgtgttcaagcgagaccatacttggaacctagaatcagtagataaattatgtgctttggatcatcgctctcgtaatgtgttagttaatcaaagttacaatcccaaatcatagcactctgagaaagcgtgttctataatgaacactttacatttttctaaacttaaatggttaggtactgtcattctgattttatggaagtgaaaaccgagtgatagattaaaatcacttggcatttgagattagaaggtaggaacagcacctcagtcctaaccaaatgtcttgttgatcacattttactggtctcttttggcaacttctcagctcaaagagaaatagaaaagggaagtggcttttgttgactatcactacgtaccaaaggaaaaaacttcc

SEQ ID NO: 59738 - DNA, 1037 bp, Homo sapiens
ggagcccgtttatttaagcaatgttatcttgaaatcaggaattgagaaagaattcaaactgcaggaagatgaacctacactacattttaacgcatgcaagtagggaatgggatttctgtcctacatttcttgaaaagcagggttgctgccctagattttctgggacagccccagttttggtgctgcctcagtggcccacaggaagggcatctcatcctgaattaatgttatgttaacagaaggctctgtgttacttactgtgacatcctttcattgttggctgaccgacgacctatgggacaaacataaaatgcagtcagaatttttagattcatgcaagcggaggatccttgtcacatctttgtgaaaggtggcttcactgcctacatcatacagctatattaaaagatataacaattcattttatgaaatgcaattttaaaatatttttactgatactgactctagccattgtgctgattgagataaagccagggacaaaggttaaataagcctcctttaagttacaggaagaaggaatccctttaaatgccccatactctggtgatgccgagactgtgcccgtcggtcacagtgctgaatttctgtgacttctatcaaagggcagcgtctgccctggcagataatacctatcatgggtacgttttgatccttatatctctggagagaaaaggaggaagaaggggaaggagggagacaaaaaagaccgacagagcgagctaatatcaaagaagaaaagaaattactcctggccgcttttaaccattttgttttcttctcttctgtctggggcattaagacttcagctagtccccagtcgtcttttccccagtagctttgcttttctggaattaaagtagcagaagaataaagaaaacaggcgctggatgaaaggagaacagacttctttggtagaaatgtgacatgaaaagaaaacccagggtttctaggcttctgtttcaatccctccagcacgtattgcaggtagattgaaaaagtgaagtctaggtgatctc

SEQ ID NO: 59739 - DNA, 1040 bp, Homo sapiens
ctcttgccctctggccacttcctccacacccccaggaacattgcccccatttcacagaaaaggagcctgagacaaagattaagtgatattttaagcaaagctgataatcccagggaaaattgctgatcaagtcttgaaatccaacacatccttcggagtaatttttaatgctttcgcttcttttacctaagccatgtgtgttccatatgaccttaaatctaagccctaatattgtaaatggagttcagaagacaacttagtctcccattttctttcctggcattcattcaaataaaaataggcacgtaatactgtactgttaaaaaaaaaaaatcaaagctccacgcacactttgaaaatcttttagaatttatgacgcttattttcttaagtatctttatgcaaataaagatcagaagtcctttgagtttacatcgcttgctgaaggactgtatcttgtgtgtctctgaaatttgcgtgcctagctcggtgcctgacatggaatagccattgaaaagtagctgcagattgaacgaatgaagtaaatgctacctctctctgatccaccactaacttacccatttttacagttactattctgtggagcagagacatgcttgtattcattcttaggacatgtgttgagaaccctacgtgccaggcagtgtgccgcatcccaggaatacaaagatgactactggggcatgatggaatggagtgaggaacatgagggtatgtgtgtgcgtgtgcctgtgttggggagagagcctgtgacagtcttcttttctttcccccctgaaggctctgtgatcctataaaggttaagaacaactgcattgtacaaacagggggaaggagggtcagagttgtccagctcgtatagagtgttgccaggtgcatgctgaaaatcaggtcttaaattagcaaagcttacgtggtgtcaggtaacagtcacactcagccctagttctcaaaatagtcctaaaccaaaaaatgttcactcggactcctagccccctagtcttctctgtcagcagccc

SEQ ID NO: 59740 - DNA, 1051 bp, Homo sapiens
gaataagttagtttttataatgaaatatttccaaaggcctacagttttattttctaaaaaaagataattatgcctaaaaatatttcaaatgttccaaaatataaaatgaatgtagatacgttatcacatgtatgtgtgtttagtgatacaaattgtttcatagacacagatctatatatgtgtatgtctatatgcccataaacataccttccacacgtacacctgtggatgtcagtccaaataaatggaggaagatgaaagttaaagtcctccccgttctctgtgcagcctgctggcttagtctcaattactttgtagcgaactttcttatttgaggcttcaccaacgatctcagttccttggtgtaattataattctttgtttatgggtgctttgagtccggatcatggcagattcatggtgcgtgttagagagggtgcttgagaaatggccgtgcgatgatggtgagctctgcttcccagcatcctcacagtcaggcctgagcggggcactgcctgaggagcttcctgagccatgaggaaacatgcctcaaaaggcactgtgtctgcctcctcatttgtgtaggtgtgaactctccttgtggagcaccccagcatacaaacgtgtggaacatacacgtattccacacatgtattctgctgcggaatgtgtcagtcaggacatccatttggtgcagatgcttcagatgtacatttgcagaatttggcctgggctgagaaattcgccctcatgggactgcctaggaggagccatttccctgccatctgtgttttcagataatactcaaatctcatacaaataaaagccaaacaaacaaaataaggactttgtttctcttggagatgactttttaaggactgtgacagagagtagcagggggagctccggaggagtccttgagggtgcagaagctcccttccccctgcaggagtcacagcagtatgaaaggggtaggggcagagtgtagacccagccccaagtcgggctcagccaggtgcaacaggatggctcccagctgagcggtatagat

SEQ ID NO: 59741 - DNA, 1007 bp, Homo sapiens
cgaaattcgttaccaggaaagcaaagcatttattaccctgtgtctcttgctatccgcagcttgagagacttttgctgacaaagaaaatgtaactaccacatgaatgctagagtggaatatactattgcctgatgagggatgctgggtctatgtatgtttttgcaatttgggaggcttaaaaagaatgtcatctgccctgaacagtgtaagatttccccttgagtgagttctgagttcttgtttttcattcttccttcttgtgaatctggagaagtttttcacattgtgggttattcctaattattgtagctacaacaaacatcctggattgtagtctgtaaggacaaaatcatttgttgctgcataaaacctgaacttaaccatggtcagcgtttgcctaaatcagcagctgctgcttattagaccagcatcaaagagtgagctgcagttgggcgaccaaataagaaacaaagtgattagaagatccttgtggaacaggaagcagagtggggcaagacaagagagagcatatacccaggggaggagacaagctagggtatcatatctgcttgatggggtgtcagccctgagcagagaaggggatccggaaggagtatgtgggctggaagataaaaaggaccagggttcctgcagaacttacagaagcacacacattgtgtccattttgctcattgcaaccaaatgattaactcttcagaaaaaaaaaaatcctgtttacttagtttgtatatggttgctttcttttttttttttttttcccaaaaaggcaagaaacgtttagtctttgatagaggagacagctttccaaacaacgggactcaataaagacagcatgaggtcaactgaacctgatcctgtctcttctctttcccctctcttctctccattttacctgcagtgcactcaaaggcaaaaaaataaaaaataaaaaaataaattaaaatctttcatcatctcaatattacataaaaattgtgttcaaaaga

SEQ ID NO: 59742 - DNA, 1049 bp, Homo sapiens
caaaaaaaaaaaaaaaaaaaacagaataaaatctgtatccaaaaatatccccagagaatggtagtgttgaacagttatacaagtactttggaattttagtcagcgcattactgttagtttctgaataggagaaaagaacttaacagcattacatgtcatattaaaacattttattagtaagcacaagcacacggggagatgggttcaggaagcaccaggtgggagggagtggcagggtggggcgcatggagggaggaggacagctggacgtctgcagagttggccttgggacacgtgcttggtctcacatggctggggcctggtttgatggggtaatgaagcattgattacaagaaaaaaagatgaaatggcctttgctcattcgttatttttatctcctagctgtggaagacagaaaattgttcataggaatggtatcgaagaaatgtaatgagaacgacatcagggtgatgttctctccatttggccagatagaagaatgccggatcctccggggacctgatgggctgagtcgaggtgagtgtgctgtctggaaagcctctccccttcagtgctaattggagctctgtgtcacagtcgagacagatgtaggcaccgcacacggcaagaggtcaccctgtaatacatcccatgtgataaagttatccaacctgaacttttcaccatagctgaaatcatcaccttttatttctccagttcagaaggccttggtgccaccatattagctcaagttatcactgtcaggtgtgaagccaacaggctgccctactgctaggcatccttttcaatctcatattgaaatggatttggtggggggaggtgcaagaaggagaagtagaaaatgagaaaggatatttgttgttttcatcttagtcctcgggcttcctgcctgtgcctgaaagaaatgttaagagtatgttaagagtacagtgacacaaactgggaaaaaagcgtcaatgttcacatgtagtgcagagcagatagggatgtagggtaactgggcctgtattggggtattagagttttat

SEQ ID NO: 59743 - DNA, 1167 bp, Homo sapiens
gtaactatcttgctgttccttgataaagacccagagggaaaggaaagtcagagcaaaaatcttggatcccagatcacatttattgggaatgagacttaataaaaatgtaaacagccacttctttgcaatccagcctacctctgaaaagctgcccagcgttatgccgcatgcccatttttatcagccgagaactgggcagaaaagtcatgtcctcttcttcctcctctagtttgtaaaggaattttctctttagctttaatagcagatggatagaggtgcttagtatagaaccttccgaacagctgacgtttagacctaaatgtaaatcaggaccatagcttcctgtcaccactcggatcagcaccctttacagccttgctatacctctgctgctgcctcccccagtgctggaacagactctgggaccaagatcctcttgtcactgggtctttgcagttctttttcaaaagcttgccttccctgctgtttatggtggaggtcgttgctacagagtaagagatggggaattctcttcagatgattaagttctaagccgttgactatgtatcccccagactttgggagatgccagggagcaatttcctttctgctgaatttactggagctttggaaatggaaagtgagataaggagaaaggcccagcacttccctagtctccttggtattaactccaaatgggtaaaaatcaagtatgagtgagttattctagagtttattcgctaattgacccatcctccagctaaacaggtgtaggctctgtgtgacagacgatggagagctcgagtgacaggctggggcttggcagtatctgctgttctccagcccttcccttcccgagcctgcctgttggcctcacctggctgggacacgtgagcccctaggggcccccacagccctgaaatatttacaccactgcttgtatgagtagcatgtatggacctggggttcttttggagagatactaaaggacttgaaacacaatgatttgagcgagttcagtaagtggaactgaattcagccaaacaattgagtctgaggtttcagtgttgtggggaggggtgtgtgctccatgatgccacatttccagtccagccagctgctccacagctgctcagtgggcacgccccatcatccactcacggtgga

SEQ ID NO: 59744 - DNA, 1051 bp, Homo sapiens
tgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtcctttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagt

SEQ ID NO: 59745 - DNA, 1048 bp, Homo sapiens
taatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttcctaatacttgtttctctctctgcgtgttgtattgttggtagtcattatatgttggtgatacatctgcacacctcactgtttcacgtatctgtttttttctctatgttgtgtaaaaagatacagtcgattccacttaagtgaatatctgatttggggaagaggaaactgcacagcagccacctttgatttatgtacaaccgcccacttgaactcctgcttccaagatttatacacttttttcctacagttcacctcagtaactgcctttggggttggatttgccaaggtgttttacggtcttttgaccacacaggttaatttccccttctctcccctccctcatgagtctatccacgcagttcttaacatacattccaaactgctgcggggtttcctctccacacccacga

SEQ ID NO: 59746 - DNA, 1020 bp, Homo sapiens
ggagcctccgaaggactcgcaggggcagtcgcagctgatgtttgagtgccctgggatgggagtcagactggctgaggtttcaattttgcattcatggccagccaccgttccaggtcctgttgagatcatcatgtaacaggacaacaaagtccctgtcctcatggggcttatattctgatccatttcctcatctatgaaatgaagattgtagtttttatttcatagagtcatgaagattgagttaatctctgaaatatccacacagtgttgtcactcaggaatgatttggaatgttagggatagtcacccaccaccacagtgctaggtttcagtgaccaggagcgatgtggagctgagtctagtgggagtccagaggtaaagacacagtaaggtcacatgtgacccaggagggaggaggcacaggcagggcaatctgaggagactgtgccatggctggaggagcaggggctccaggaaggaggcagcatctgcactggaaatgcagcaggagggcccagtgagggaggcctggaaagtccacttggacttgacaatgaggagctctctgctgtcacctgctgtgattcctagagtcagaatcagactgcagtggccacaggcacaagtgggaagtgatgcagctcaaaggtttggatgagatgggatgtgcagcgattgagtcgtagctggagcgaaggatgtgctaagttagggattggaggggcgtgcatttacatgggaaagtaatgctaattagaaatcagttggacttcaacattctcaagtacttccacaaagcatcccttggttttattccagtttgttgctttacgtatttgtaagtattaaacaccaattactaaattatctgtaattcagatttgtcatttggaggaaaatcaacataatctgaatataaagcaggcagcattgagaaacttctacgtatgtgaacatcattgacttcgtcgagcagtgatttaaagtctgctccacatgtagtaaacaaagaggagatgt

SEQ ID NO: 59747 - DNA, 1088 bp, Homo sapiens
ccatggcctccctgcagtttctgtagatagtcccgtgagatataaagcttcaccggccgcagaagatgccagtccatctggatatccatattcagggcccccgcctccagcctaccactacaggaatcgggacgggctttccatccaagagtcagtgttgctgtgagatttgacgtgtacttgctaaagacgagagagaaaccacgtgaaacctacattgctatgttcataattgccaaagcagtatttatactattgtaaacaactcgcacatctctcctgtctgttagtagtaagaatacagggaaatgtcttcagccccacgtagatgctgcttaagatgagcgtttcaattgcatcatcactgacctgttagaatttaacccggaaacatcgcaatagcatttagggatgcacgcacagtggtaatttattactcagttccggttatgtttttctccaaaacctgaacatttttactctgttggctcattctattttgactaatgttacaaagtactgaaaaaactgtagaatagatatttttaaggctatatgtagtgtatgtgtcttttaatagatataggcatctgttcatccacatttgaacacagagctaaagaaacgttttttaaaaaactacttttaatccagatccatggaataatatgtaattcttgttttccttgtcttttagtccagtttttctttttccctctcatatatttgtaacctgggtcctaaactgactgaagagtttgtcctgactttattaattgcagtctcacagaatgctcatcattctccttcagctgttgccattttctttcaatctgaaaattaaagacattggagagaaaggctaaccacttaatggtgcttaaaaatcggggcacttaaaataagtttacggccaaaggtgcagcagtgcttatcacatccacatactaagagattggtcttagtgcgtttgtgccctttgttctggtctgactcttgcgaatctcagagcaggagaagttgcagcttactgatccctcagtgctcacagtactcatgtggggcagccacactaactgcattagcag

SEQ ID NO: 59748 - DNA, 2013 bp, Homo sapiens
ctgaaacagtaagaaatacagacttaaaatggggcttcttggagctccgtatcaataaaagagaaaggcctcatgccggctgaggtagtctttctgtgtctgtctctaagaagctcttgctctggggtaatactaatgcctaggtgtggttattccaatgaggaagtattaggcagtattctcctcccatcctttctcccagtaaactttcctgcttttctctgtggctgctttaatatcaggcaatatttttgtcttactgagttttaatgatgtcctcaatgccatatgtaagttgtatgctgcttgcgccctttttaatgcccttttacactacacctgaatataatagaatatcttcctacctaaagtagctattgacttggcattttcatttctcttatcctttcttagaacatctaatgaaattgtccatggaagaacttgtagaattttttcaggagaccctggcaaaggattttttctttgaagatgattttgtgatagagcaacttcagatttctatgacagaactaaagcgggcaaagttagaccttccagaacctggtaagaattaccccaatactttatatctacgttataattaagattggaagacatggcataattaacatgggctgtttcttgcccacagcgtaagcattatacttgtgatgacataatgtggatgaatgccttaccagctcagctgctttggctttttccttattttagggaaaggcaaataaacatattaattaaatctgcctctcctaatagatgactgtactattcctgcttacatttagaagtttggttggcaaatactgttgttcaacagaagtagccatggtgctttaaacgagcataacaataagcttttttttgctttcttcatctcattttgtgaaaccgtatacaatagtaagtacagcaatagtaagtacagtaaaagccccatcttatagatgaggaaattgatactttagtgcctaagtggcttaaatatgaagccacagaaccacaaatagcattactgagactgcaggccagtttttctgactactagcccagggctctttgtagtatgctacagtatagataatatattttattcacttattgtaagacatttttcagcacctactaataggttttctgctaggtactactttgctggggatttaagaactgaagagaaagatgagaagctctcagggtgtgcactggagagctagaatatacgagaatgataacagagggtgaatggggcattactagagctagccgcagggtaaatgggagaggagcagaagaaggggagtgcaggaagggagggaagaaaatgaaaatgtcgaaagatcacaggaggaataactttcaaagtttctaccagatagtacttgaccatgtatgtcttgagaaaaagttactttcgcttttcttctttcttacctttgttgcagtggatgggtgtagtaagaggctagggaagtggaaggtcatgggcaagagatgaaaagtaaagaaagtcagttatgtatgccctcatgcagaggtgaatttggcgtttccccatcagtgtgtcatgttggctgtgtctgtacagaaggacaagcagtacttccatggaaaatacatttttccttttggtaaaaaccaagatgtttgcttttatttacttaattgagaagggtctaatcagcactgctccaaggtttgctcaaggtcatccaggctcctaggaagcaaccctcacagcagtaatggggtgtgggccttggccttgtggagccgttgcctttgttaagtgaggtcagccctctcctgttcagtgtaatgacttctgttttctactatcatttatttttatttattttattctactatcatttatttttaaataccttgcctccttctataaaaagaggtcaaggcaaattttagtaaaagtcaaatatagaggaaaaaatatagaactatttaaacgtgagataattcaaaacctgtgtc

SEQ ID NO: 59749 - DNA, 1038 bp, Homo sapiens
aactttgggaactttatactaatgaaattcttagagtaagcctgaaaaaagtaataaattgttatttaacatattaagagtaaaacaaaatgactagtcagggttggaataatatattacaaatatatgcatttaagatatggcccaatatcttaaaagaacagataatcttgataaatgtcttcagtgtccttttttttttttttttaaggtttccctttaaattcaaaaatacaaagttatagaagatctttagcaaacaaatcctaggctaaaagtttcattacccaaagcttatatacagttttttcctaggtggggagaaaaaatattttggtaactactgaatgtttctttttatttttgacagttacaaatgaaatatgttgtgttttaagattggagggttttgttggtattgtttatgaaatgttgtttttatgtttgtattctaggcttttttgtccaaggttttcctaaactcttgaggtttcaagaacatcatgaaaaaatactgaacaaatttctgtccaagcttaagcaacacttggtaggtagatgtgccactgacttacacccacctacccaccccccaaaaaaagctgggataattaaattgtctttggtccaattaccttattaatttatagtgtcatccatttcatttactatgcagttataattcccagttgtttacaaaccattagatttgtaaaatttaatattgacaggctatcacagttcttactgagggatttgaacttctttgaagctaatgatacaaacaatgtgataatttaaagatatgggatctcccagttgttttggaggttttttcattgtacaaaaaatattttttcagggtcacagaaactcgttgttagtgaactatatatatgccttactataaaacacagtagtttagtaaaacaaagaaagctcactgtaaaatatattaaagagaatctaattgttgtattacagtcctaagaggaatttattcttggagtgattttgagaagtaaatgtgtttagctt

SEQ ID NO: 59750 - DNA, 1062 bp, Homo sapiens
attaaatgatgtgtgtaggcattttctggtttttatagagtagctttttctctgtacatatgcatgtaattcgactgaactccccagcttctgtgttcccctttgctccccaggaagtcgggtattgtcaggggatgagccagatcacagctttactcctcatgtatatgaacgaggaagatgccttctgggccctggtcaaactcttctcaggccctaaacatgccatgcatggtaagaaaaccctgtgctttatctaaacaatcaaggtagggaaaaaagtagattaaaacaaaaccaaagatgcttgcaagagttacatacagcaaatttaatgtctcagggctcgttgagttcattagtatttgttactagtttcttctttcatttttcattattgaacttttctaaaacatttacatttattttcctttgtctttactccaaggtatattgttggcactttaaaattcttccttacttgcccttggtcaaaagaaactaatttaggtttggaggaatttaagaacaggtatattattgggagaaataaaagatgccttttaatcaaaacttttagatggtcatgaaattatcattttagtgaaatgtttaccattgactggatattgtgatatataacaacttgtcaaaaaaacagtaattgagaaatgacacttaggtttttaaagaaaaggtaataattaagtagttttatatttcaagtgtagtttttgttttttcacataaaattggttccactttaaataaaaggttgataacgtgttctaggcactcgattatttaatatctcagaacctgctgattttttggttttcaagttaacactgtttataataactgtttccttgtttttgccaaattaagcaataaactttatttcagagagtttagattacaactgttgagacagggtcttgctctgtcacccaggctggagtgcagtggtgtgactcattgcagtcttgacctgggatcaagccatcctcccgcctcattagcctctctagtatccggaaccacacaggcatgtgcctccat

SEQ ID NO: 59751 - DNA, 1424 bp, Homo sapiens
aagaactttcacatagttcagcagtgccaactctgaaaagttctctatcctaaattaaaattaactagatagacaggatggaagagaaggaaggtaggggaagagggagaagcaggcagtaggagaaatgggggaatggaggggagggaaagtttctattgtgtacctttttgtatatatagttttgattttttttaaccattgagtgatttttttaaaccaaaaactttttaatgagaattattatttgtcatagagttttcaacaactaatttccataaaaatctgttctgttctctctttctctcttcagaaattaaaacacagagcacggggctgttcacctgacatcagacaaatagacctggatgtcaaccgcacatttcgggaccacattatgtttagagacagatatggtgttaagtgagtaaagtttaatattatgaaatgttaatcgcatttataaatagtctttattaacttaaaattagaatgcctttatagactgtaatttcgatttaggtcctaaaggtttaagcttttgcagatcatttgcgtccatgttgtgtgaaacttaagatctaatttaacttaaattttttaacctttgatatagcacgtgctataaaattggtaaagactcattttataatctggggattcttagaaatgtagtagatacttttattagaagtcatagaagaatgacagtgtgtgtaaaaactttgtcagtgatcaatgtatctctataaccttgacccccatgcataaatgaaactttttttaaaaaagggacatgaaatgagaaattaatgaattgatacatcattgctatgacaacttataaatgaaaagtacagttttgctgatctctgtatcagtcagagagtctaatcaggaaacagaaaccaataggagatatatgttaggacatttcaaggtattggcttctccagctgtcggggctgattaggcaaggccaaaatccacagggcaggccatgggaaaggacagtctgggcctcggggatgagctgaagctgctggccacaggcagagtttcttcttcagggaaacctcaaatctgcccttaaggcctttcaacagattgaatgaggcctgcccaggtcttctaggataatctctcctacttaaagttaacagattatggatttttatcagtctacaaaatacgttcccagtgacacctagatcagtgttttgtatatctggggattgttgtttagccaagttgacacccaaagccaaccactgcagtccagccttgtcaacttggcactcacacacaccaccttaaacaatttccaagtaagatagtaaccaagtcatccttccatctaacatgataccattattctgctcacagctgaaatgtgctaattctttccccacgtgaggatgcca

SEQ ID NO: 59752 - DNA, 1056 bp, Homo sapiens
ggtggcctgtttgtcctttcttgtccccataaagctctgtgggtggtattgaagaacgtatgaagatgaataggtacagtggcaagaatcttttcttctaggttggaggagacatggttgcatagaaatatttaataatagtctgtgataaatactctaaaagtaggagttgaaaagagggtaagaaaagaaatcacctttatggttcaggaagacttcatggagtaggaggtgtcttggtgggactttgtttcctacaggaaggaaaaagattgctgaatttcaaagcacattgcaaagaccttccctgatctcctccaatttggatctgattagttttaacttgaagcttcatattgccgtattttaaaataaagtacctactttaccatgaggagagctgacattgtttgaatacttttatgtctaagtgctctatgggaattacctcatttagttcctgcaaccatgccaagatgcaggttttgtccttattatatttatcttacacatgaggaaactgagcttagcgaggctaggtgacttttcaccccaaggttagcaagtggcaggggtaggatttactatccaagctgtcttggctgctcccatctaatatgttttcctcttctgttatctcatttttatttttctctcttgcatttagcagtgtaccttacagatggtataggatcagaccatagtggaaaacagcttcatccacagccttagtgtggctcagtaatctcgtaggccaaactcacaatgataatcctaattttttttttttttttttttttttttgagacagagtgtcactctgttgcccaggctggagtgcagtggtgtgatctcggctcactgcaacctccacctcctaggttcaagcagttctctgcttcagcctaccgagtagctgggattacaggtgcccgccaccatgcccggctaagttttctatttttagtagagatggggtttcaccatgctggccaggctagtcttgaactccctgacctcgtgatccacccgccttggcctcccaaagtgctggga

SEQ ID NO: 59753 - DNA, 1221 bp, Homo sapiens
attaactgtagagactaatctaagtttttttcagtttgtaaccttcagtttctttttcttttaataagtttcataggcgaatttacaaaggaataccactccagctcagaggtgaagtctgggccctccttcttgagatccctaaaatgaaagaagaaacaagggacctgtatagtgtgagtagctaaagctaacttgttattttgaaattaaaaagtaaaatccatttcttttagcattcaaggtgacataagatattcatatgatcacttaaaattatattaaaattctatcgcattggaggttttggaggtctatttgttttcttgattgcaaaaatacttcttaaattttaaatagatacttcagtaaaaatgttattgtctgtatcaataagtatgaagtgcttttcaaatacataaatgatcaattaaagtaattagatgatcaatgttaggacgtggttgcatggaaaatggactaacacctaattatagctgcttgtttgccacatggtgttaatggagagatttgtggtatcactttgagagttcgtgggaaacagcagcagaattcagtttaaccaacacctgctgtgtatgattcttttcttctagcatgaaaaaaaagatgactttgccccaagattattagggtatctctaggttttattatttattaataaaaagttaaacttttgactgagtaataatttttttcttaaattaggtgctttaaatgtatctccttgtcatctcgtagctataccctttctgaacctaaattttctattaacctttgaaaggagtaagagatttacatctaagaatcttagacccatagattttgaaatatgttccttagaaaatatgtacaaaaaaattaatgtggaataaatgggaaaaaataaaaattgctgttttttttttcttcaacttttattttaagttcaggggtacacatgtgcaggacgtgcagatttgttacataggtaaatgtgtgccatgccatggtggtttgctgcatagatcatcccatcacctaggtattaagccttagcactcattggctattcttcctgatgctctccctcccacctccaccccttgctgacaggccccactatgttttgttcctcatcatgtgcccgtatagtctcattattcagctcccacttataagtgagaacatgcattatttggttttctgttcttgcgttag

SEQ ID NO: 59754 - DNA, 1718 bp, Homo sapiens
actgatgtctaagcctcagtttcctcatctgcagaatggagataatagtgtcccatttcaaagggatgaagatttcatgatttaatgcatgtaaagcacttagcattgtaccttacatagaacaagcattcagtaaatgttaactacccctattaatttcttgaaggaaggctgaacaataaaaacattttaaaggaaaaaaaggaaatctaacttagtcctactagcaaaacacaactgagttaactgttgggatttttgtccattcctcacacttttttcagtataatcctttcttttccctttttgtatagatacagattatcttatgtcaacatttgctgatgagaattccagggagcatgagtttcttgggttctactagttccacagaagcagtagtatagcctgatggtgaagaggcagattctagaggcagactatcatgggtcaaaccccagctctgccacttcctagccatatgaccttgggaaaggcatttaacttttttctgctgtactacctaccccattaggcttgttgtgaggattaaataagttagttgatgtaaagcatagaatagtgccaggcgtttagtatgcagtcagtatgtgttgcttattattaaatgaggaaagggctctctggttaaataaagttgggaaaacctgaactaaaaaaaaattaagcaagatttctttctttactgtaggattatttagtctttaatatgaggtatgaatttttaagagggatcttaaatcacatgaaaccgacttaaccatgggaatctttttgacatgggtatcttacagagctaatgagccttttctttttgagcatactaaatatccttaggctcttatattactttgttttcatcaggggtgagttcatttggggtggttgattttattaactgtctgttttagcattaggtttagaactcaggatgtttttaagaggacacacttcaaagtagaatattagttacaacatctgttctcttgtttaatattatgcagtctcagattggcctacatttgacaactactttacatctttgtggaaagattgctcaagtggtaattacagggtagatttcaatgcattgcacctatcctttaatctcacattcattctaataaaatatttgtagaatgaatattttgttattctgtggtctacatatgcctatgaaagtacgtaagcctctctaaaaacgaacaattctactgggctattattctgacagcaactctggctaatgcagttcccatttagtgagattttagcagtgccatgtctttgaagtataattttgaagcactctccgataactataatgctagaatcatttgatgatatatgtggcccaatttggtgtgaaacagaatgaaccttctaaaagaattactgctttcaattcacacctagttttaaattgcattcaagtaaaaaaactagcattttttttcttgtctttcaaggagaagtatgttttctctccacagattccttacttatatagtagtaatacagagaaattctaaaaatatttgaaataaaaatatagccctggtagggaatatttggatttttagaacccaagctttaatgaaaaaaaaaaaaaaattctgttaaggttgtttgtgttgcctctgttctcacagtgactgcctccctatgtacagtagtattgtaaatttttttgtttt

SEQ ID NO: 59755 - DNA, 1019 bp, Homo sapiens
ttataactcataagtaaagaaacgaacaacaataacaatgaatttcaattttattttagcaaaagcacctggaaattgaaagaactaccaaatggctgaaaatgctgaaaggatgggaaaaatacaagaacactgaaaaggtaatttaaaatcatgtttttccatatgaaactatataaactcaatgtggattttcatagtagaagttcttctttaattataagagtgttacattcatatttggttttgaaattttggtttaatttagcagtatgcctcgaattaggagtttttatattgtaagtaacgtaatacccgattcggattggtttcgacatttaagtctgtattgaatggttcagaggtgggatgggtttcaggagtgatttaattcagctgcttaatgaagttgcctgtgccatagtttcttccatctcttctctgccttctgcactgtcagccccatcttgaggttggcttccctttgaggtcagaatcactggagcagttccaggctttgtatccacagatcatactgctcagaaagagagagggctggcctctgaaagcattccctcaagcaggagcaatctcctttttcaaaagcttctagcaaacctcccctttaatgtttttgccttgcgttgagtttgtgctaagttagttagagaaaaatacatacatatattaatatcaccatgcgtctcatcagaaaagtctttaaacagtgagaagatgtcaagctcctggtggtagaagttttccaaagctgttaagttttatttgaaaggtcaaatatcatcagtggcaataaatactgtgtcagttatcttccttcaagtgacaggctcatttaagatatttttgagataatgtctgccagatacccagtgcttgagtggcagttgcttattctttcaagtaataacagtggtttgtgaaaatgttcatgattcaaagaatttcatcctaagcactttttcttgacacagtcattgcacttggttgtgcagcacaga

SEQ ID NO: 59756 - DNA, 1051 bp, Homo sapiens
gttcacatttgtcacatatgaatatgttttcagttacttcttcaaaacagttgctggaatagttagcttcggcatctttggtgagaaagtatatttcatctatgaattatagattcatgattgggggaaagagactttcatgtgcattcaagtttggtattgttgaatggacagcattatggagttagcacttaaacttgattgaatactgatacataattttcggatcctatagcttcccaaggggtgtgtgtgtgtgtgtgtgtgtataatatatattattttattttattttttgctgtagggaaaagcatacttaatgatccttaattttttttgtatgtgtatgtgtgtgttttgttcttgcagcgtgggaatgtatagcatttaaaataatctgtatatatgataagcattagaattcaaaagtgtgcttttaaaaaaatgactgcttcctaaagtgattcattgataattcatggtcataaaaatgaaagatagcaagagacctgctagatctcagcagggttgttcctggcaaagtgtatgttgttatactcttgggttggcttgaattatttggtgttttcctgttggtggaaaaaaggattatgctttgaagaagtcaggggagaaagtgcagaagaacaaaaaataccaaatggcaatttagatcaatcttaatttttcacagcttggccttctctaaagtcacatttagcagaaacattaattagatttcagtgccccactgagttttaaaattaaacatatttctggaaccatctgcaacagtttatcactaataatataatgaggaaaatatacttagccttttgaaaaatacgaattataaaagaatatctttttctcatgagtgctcatcttttattgtgagaaacccatcaaaaattttaaaaagagttaggtaattgagagttttaagaatatgcctaaaattgaaattctataaaaatattctcattggtgagataacttttcctaaattcaggattttctttggaattttatgtacttttaggtctaaaaa

SEQ ID NO: 59757 - DNA, 1442 bp, Homo sapiens
tcatttgtgagaggttgagctttaagtttccttccaattttttaactttttaagaattaatttttaaaattaatttttaactttaactttttaaaaatccagtccgttttgtcctcaagactttactcctaacaaatgccttgtatttatatagcactttaaagttttggctgggtgcagtggctcatgcctgtaatcctagcactttggggaggccaaggcgggcggatcacgaggtcaggagatcgagaccatcctggataacacggtgacaccccgtctctactaaaaatacaaaaaattagctgggcgtgatggcggatgcctgtagtcccagctactcgggaggctgaggcaggagaatggcgtgaaccccgggaggcggagcttgcagtgagctgagatcgtgccactgcacttcagcgtgggcgacagagtgagactgtctcaaaaaaaaaaaaaaaaagttttaaaatgctttatgagcttgattaaatgtgatcttcacaagaattttatgagctgggcaggaaatattttataattatcaggcagctgtagtgtaatgattttgagaatgggttctggatcccaactgtgttcacatcccgctctgccgcctgctgtgagacatttggaaacttcagagcgcctccctttcctcatctgtaatttggcagcgataatagtgactacaccatagggttgtttgagtttacgtatgacaatatgcttgagaaaatatgcttagaacactccaacctgctccaaacagtgcctgacttagtggacattgagcccctgtgagttcacgctcttattgtgttgtcatcattgtttttcttttatagattatgagactgaaacttgtgcaggttgtgacttgcccaagtttacatcaataataagtagtaaagaagttattaggaattctgttgaatcagatgaaaacaaaaatgaagtaaagttaatggtatatggaataattttgtgaaatagtattgatttgttaaatgaatcagattatgaaattattggctgtcgatttggggaaaattaaagtttgcatgtgtttacagatatccacacattccagacattatttgttagaaaagttgtttctaaagcgtatatcaataaagaaaccacattttccaaaagatttttgcttgatagtgtttaaaaggaagtaggcaattaactttggtttctgtttgcattccatcatacttgccaggcagtttaagcttctgatttctagatgtgcttagatttgtagaagaacagaaagccaactgaaggcaagtcctataagaaaaatccaaattgctttgggaggcctggctgggcggatcatgaggtcaggcgtttgagaccagtctgggcaatatgatgaaaccccttctctactaaaaacaacaacaacaacaacaacaacaatt

SEQ ID NO: 59758 - DNA, 1099 bp, Homo sapiens
tagtatctgttcacatttttgaggcatgcactgaaggatgactcactatcctgactcacttgtttaagttcactgtcattcagaagctctttcattctgcttttctttttctggttttcatttttaccccagtgaatagaattattatggtaagtctcacattgctgaatataacctttgttttttcttaattggtgtgtgtatgccacgcctctaagcacattcaaatcttttactaaagatggctgtcacttcaatgtttagtcttggcaggaagtatagtgtagtgggaattagcaatgtttaagagtagtgaaacagacttccttgttaataagatgaatatataaatactatattatttactttagtggaaatatgcacctgctatttaggtatgtactataaatttagttgtaacctaaccaactaaagcccattttaggaagtaccatcaggcctggtaactgtctctgcttaacaaaacaattgagctgccccaactatttcaaagaataatttgatacaaaattacagtgaaataatttgaatagtccttaaaacttatgatggaatctgaccattaacttaagatcctaggtgaataaactgaagttgtagaatgtcagtgagctttgctacactatatagacgttaaacatagttaagtgaacaggacttagagtcagagaggcctgagtttgatctgtggcaccaccactcagtagccatgtaatctggggccaacattgatctctctaagtctcatttttctcatcgctgcgatggtatctttatcactatggttgtgattacgattaaactagataattcttgttcattcagttagtctttcagtaactttattgagccaccaattagatgtcgggcactgtcctaagcactggttacagtggtaaatgacatggtctgatctgtcggttcagtggaccaaaataaacaagtaaacaaacatacattttctagcatttcatataaatgaagttctacagtatgaggtcttttgtgtttgacttcttttatttgcattgtttcgtgttatcagcagttttttcctttttgttgttgaatagtattc

SEQ ID NO: 59759 - DNA, 1065 bp, Homo sapiens
cgggattacaggcatgagccaccacacccagcctaatcttgctattttttgttatactgagacaaatctaatattgatgaatggagtgagggttcaatgaatggatgtaagtatatattcccataatatattaaggaacattgattttcagccttttatttagttttggcatacataacaggtcacctgagtgagtagtctcgtaagtgagttatatattatttctggtatccttgctgaaatgacatccacacaaggaaacctggaggctgaagttagtgagaggagtattattttagagaaagatttgaatttcagtgttgttaattgtcattattggcaagttacttgcgacatgcctgccaaatgatcccaatagatcacacttgggattatcgtacactgtcttgaaacagctttttctttgcattcaacaattcagtagccaaaatatggttgtggattaatgtgatagtggagcaaatgtaaaaggaaggatgattgaaaagaatattaaaaacttagtgagaaattacaggtagaggggtgaaggataaataaaatgttaaaaatgatgccagtgttctcacttataagtaggagcgaaacaatgggtacacatagtcatagagagaggaacacacattggagactccaaaaggtgggaggtgggaggtgggtgaggtttgaaaattacctgctggatacattattctttattggggtaatgggtacactaaaagcccagacttcaccactacacaatatatccatgtagcaaaactgtgctggtacccaccgtcccccaaatctattaaaaaaataataaagcagcaaagcttttgtatttaaggcctgagatggtgtgatggtgttggtagaaataggcaaattagaaaggggttccttgtaaggaaataagtgtttcattacctaaagctaagaatatgtttagtggatatgtttcccattggtgtgtatgaattttctgcataatgtgaattgtgttacaccaatataaaagagtttccttgatcttattcccaccctaaaggatgttataga

SEQ ID NO: 59760 - DNA, 1067 bp, Homo sapiens
gtatcataggggatagctgggaactggtagagcagaggtactaagttccacctggaaatgctttagagtagctctttgaatatgtctttacttattatcttacagcgtatgtgtatatgattattttctagagggtcgtaccctttattaagctgtgagcttcttgagggcaaggactgcaattcattaatcattttggagaaaagtgaataattctgaagaattcggtggttcatgagcttgcctggtatttgtttctctatggcttatcatctaagtgagataacagatagtagataattgataaatttaatctgttacctaattactgagaggattcgattcttgctttatgttattactgaaacagactgcccagtaatcttctctagagagcaattaggtttgcaatgagttattttattgagaatgctacttgaaattaaatgtttatagcactatcttgatataatttaaatataatttaaatgtgctgaagtatcttcattcagataacttgttaccccttaacaaaaggctgcttgagtattgtttctctcccatttggcaaacaccagatgcagtgattaataaaggtcattatgctacttagtcatggagcgcttttaatgactgttacctgaacatctgctagattcacgatggcagttaccagaaacatctaacaaaatatacatgctgtgctttgaaaatctggcttggactaatctaaatgactacctaagaacatttgaatattccctgaagttttattaattgtgagaaagcccttatctttctgtaatgtgaacaatccaaaatgtcaacaaaatgctaatttggaatggctgtccttgacaatctcagcttcctgagggctgcatgctcaggggctgggagtcgtctgtgtagagtcgatggagaccctggctctcttgcacttctgattatcatgggaagcctcgccttggaaatgtgggactggagttgagctgaaaagaaggaaaaactttacctagactctgcagggagcaagttgaaaagcagagaatgggtatattaattat

SEQ ID NO: 59761 - DNA, 3102 bp, Homo sapiens
aagcttacaaaactaaagttatagcatctaatttactttatttggttgtaggtttgtagttctttatttacaaaggattcatgcccttgacaaaaaagaagatactatgacaagaattatttaatgagaacttgagaaatggctgcttgtgacagacagtgttcattgtccacccaatctccattctctcttgtgtttagagtgttagtgccctaggttaaaaaacaaaccagcaaatgaactctctttcttaagatgtaagcaaaagcctgctgaggatttctggaaaggttttaccttctgagacagttgtcacctctgcttttctgttacatctttctttctacctggaatgtgagtgcaattcatggagtaatggcagccatgatgtgaccgtaaggacaaaagcaatatgggggagaagaaacataggaggctagtcttctgtgacaccagtgacactaaggaacatttgtaccaacccctagttacctctagaatttttggccttttacttgtagtcaaagtgattctcactagtatggtttctaatgtgataaagaataagactagaagtaaaagcatgtcatttaaatataaaactaaaacactgttacaaagtactttgttctgtgctgggatttggcagtcgtatttagaagtagcatatatcctaaggtgaaacacggatatggccattagaatgtggtgagagggatattgatttgggagttggaagacctgtgatctagttttactatcatatgactttaggtaagtcagcgaatgtctttgtgtcatggtgtttactatctataatgtgattagatgttctctaagatcttacagagcattgacattcatattctaattagtttcttgaagccatttttgttttttatggtaacctcttgaattacagtgtcaattcataatgcctccctatgtttactctttgcatacaagcacgcgcgcgcgcacacacacacacacacacacacacaactacctcccgacacacacattgatacatcaggtaacagtagtcttagaaggttgtgcatttggcttagctgtgactagcttttagagattttcacacgtgaccgctaagctgatccacagttacgtgagtggtttaatgaaaaggaaaggcagcgcagaagtggttagctaagagcgtgggcattaatcagacagacagaggtctcgatcctggatttgctcgctcatttgctgtttagccttgagcaagttatggaacttccctgtacactagattctttatctgaaaagtagaggtaataatagtgtatattttcccaggtgttatgagggctgtgtgaggtcatgtgtatgagggactcacacagtgcctgccacactgtaaggaataaaggtaagctgctgttggtatttttgttatttttattattgttgttattctgttgctgatattgctcttctgatctcttagatggctaataatttgtttgtaggtgtttatgtctggaacagaatacagagctctgtggatagcagtctgtttcaatatagtgatgtttgttaatttctataactgtgtcagctcatttgtacttggaaaactataagcagtatatttattccttaaattcagctatgtcatatttgaagtcaaaattgtgtatgttgtgggtagagttagttaataaaagttttgtcaagactttgttttagggagatgtatttagtacaggttgtaattaatttaataatgttttaaagaaaaatgagtccattttgtttagctcgttggcccagtgtattgtcttaactatggaaaggagtttttgaagtaagttggtaaattttgcagtcagttgttgcttgaaacttgaaatgaccttgaaaggttttctttgaattgtttaaaccattaaatttgtaaacatatacaattatttgtcaattaaaaataaaatgaaatttaaagaatgaaattgactgcaatggactatttaagcaccattctttcccctcccccatttttaaattttcgagacaaggtcaggctctgtcagccaggctggagtacagtggtgagatcatagttcactgcagccttgaactcctcggctcaagtgattttcctgcctcagcctcccaagtagctgggactacaggcatgcgccaccgtgcctggctaattttgtcttatatttggtagagatgaagtctcactgtgttgcccaggctggtctcaaatgcctgagctcaagcagtcctcctgccttggcctcccaaagttttgggattacaggcgtgagccactgtgccccgcaccattcctctcttgcttgtctctgagtctcttagtaaagcaggtccgtatattaattaagaatatggtctgaactctccagcatggtagccagtagccacatgtggttgaataattaaaattaagtaaaataaaaaatttagttcctcattctagccacatattaagtactcaatagccacattgcagcaagctctgttggacagtattggatagattgtatagccagattgcccgagttcagctctcgaatccactacttactagtcttgtgaccttgagcaacttagtttctctgtgcttcagtttcctcatatgtaaaattggattaataacctcaaacaaaagttcttataagttcgtgaatgtggattgaaggaggcaacatttgtaaagtgcttagaatggcccccatttaagcacacagtaaatatgtggcgtttggtaaataaacaaatatgcgtggtgttcagatttattatgctttgtgtgtgtaccgatttttttgtcctttcggtatcttttattgccctttgagaaactgtttatatatgccaacctgctgaatgcatttttcatgtttctcttttaccacagtttagactcatgtttctgccacacactctagcttaaaaatttattatgagtgctcactgctttcagggtgaagtacagcctccttcatcaggcatttcagagagtccagcctgcccttcccagctcattttcatagccatccagctctagccctgtgttttattccattaatcactgccttt

SEQ ID NO: 59762 - DNA, 1382 bp, Homo sapiens
cagtcttatattcatagcgtgtgtctagaatatgctgaaatacatttttgaaaacattttaaaattgcatgtctaacttacagatcttaaatgagctaatgtagatacatctttaaagatatacttatatattttactttttaagcatttaaaatagtacaattctaaaatgataattaggaattgattttcaaaaatcacaggccatcaagtcagttgattatattggcaatttcactaaattatggtttaaaatcagttggtaaattgatatatcagccttttcacatgtaagcattcacatgtattaagcattctatctttatatgatttgaaaagtgtacatataactcagatataaaatgtagattactttatattttttctttaatgtgatataatctgtgttttaaagtaaagcttatgagattccataagtcttagtaaaatgatttagcatgatagtatgaattgtgatacataaaatagtcaaccatataaagaatattagagctgaaagaaatcttagacatcttgtctttttttttttatttcattttgtggaagaatgtggtatttaagtgattgaacagatacgcatctcaaaaagcagagagactgttgtcatttacctttgaaaatgtggcagtattatttaggatactttacagttatttatctcctgctttctactttatttctgctccccttctgaaatagaaaactacattcccatctctaaatagcaggattctaacaattaggtatttaaagaaaatagcttttactatttccagagaatataaattagttaatttaatcccatctgtttgaaaatgtcagatttatgtagtttgacctttacagtcagaattttttattggaattttttttagtttttgttttcattcacaatcatagttacttggaatatacccagggaaaagaataataatttttgtgccttttaaaatgctcatatatagatatatctcatatattacaggaaacatcatgtggatatatgaaaaatactaccaaaagatagttatatattaaataagatatttatatcttattatattaaagtagtaggagtagtatattaaagtagtagaatggcttttgttctcagacttttgtttaaaatttttcagacagtttttttttttgtgaaaaacaggaagtatatacatagatttttttcttagaagcttgctttttcaaacctcttctaatagtgttcttcatcattaaccaatttactattttatccttttgcagaatattgttacatcttaccaatttttcatattgacagactccttgaaaaaaaaagtcatatggacaaatataaaacactgacccctaagaagagaatt

SEQ ID NO: 59763 - DNA, 1141 bp, Homo sapiens
acatggtgtagcacgtcgtgtctgaagagctgaaaacttcaccttgaattttaaaactagacatttttacagacggtgcttgctggagagaaagcagaaggctgatttttggatcggtttacttgtaaccttggttgattcactgtgctcagttgtccagctgaaaaatgggaaaataacaagcctttaactgtctgaaggcaaaggaactgcctctgatttgctctgggatctaatattttatgatatgttaaaaatgtcaaaataattcatgggaaggaaagaaaaataggagaggaaaattggcagtacagtaagaggaacaaattgctggtggagaatcagtttaataaacatagcatttagccatgttcacctgagtgtcatttttctcttttagttaactctgtaggtttactttgagaagggctgctatgggataaatagaacatataacaaatatattaaatattaattcagcatttgttacaacttggctgttaaacatcatatggaaggagcagtggttatacttgttttgaaattatctggtccatgccgctggatgttgagaccattgaatttacagactcctatgggaatttctagtgtgcatgtgaatttagacttctattcatggactgggatgtcagaggtgtatatgtgaggaggaggacaaggaatttataggatatttttgaggcaccatatcttttatgcaaatctgggagcttagagttagcaagatagattttatttttatccacattttattttccgtttcaaatacaaggtttttgagaaattggaaaaaagtattaaggctttcgacagtgcagggtattttggttgactacttaaaaacttgcacatagcatctgtgatgcactgtgaaaatttatagcagagcactttattttttctgtcatggcttttgtgagaaaatgttttcactttgcttagtgatttacagaagattacccacattttgttttgttttgtttataactagttaaggctgtgcatagtaatacattttggactttgaggatggggctttcacacgtgctgaaatcactttgaatccatcatttcaagaagatacagcctatcctttcgttgtttcttattaactgcttca

SEQ ID NO: 59764 - DNA, 6747 bp, Homo sapiens
atcatgtgaacctgggaagcaaaggttgcatgagctgagatcgagccaccacactccagcctgggcgacagaatgagactccgtctcaaaaacaagcaaacaaacaaaaaccaagcttaagtagaatgacaaagaaatgaaggaaatgaagtctattaactgatttcttaacccaaaaaagagagaagagttagaaatggtttatagtttaatatcctacagtctctttatattttcaggccagtggacatcttgaatatttacagattatgtttgtcacaataaaatcatctctcacatttttttcatctcatttatctacatgttctgaaaaggatgacagtagttcaattctgaaatgtatttccaggaaagccaaaaaagttttctgaaaagtgggttaaaaaaagtctgaatcattgccaagaatgaaaagatgctgggttgttattcgtatgatcaaaagaatttgtaggcttagagcagagtccaaatattcttgtctgtgttttttgcataaaagtgatgttgatgacacatatgaaagtgtgaaaacacgttagttccaaaagaatatgcataatagtacctcacttttgtaaaatcagtaacaaaaagtacaaagtaagtctaaaagattgtcagtagtgcttatctctgtatgtgggacctaagacagatttttattttcttttggcttagtgttagattcttatttttctatagtgaacattcattattattataataataagaaaaactattagagatgtgtattgacaaaaagaagaaaatagagacctattagtttgtaattctttaagagtctagggtgttggtttgaattacttataacattatttgctctgaataatagtataattttgctttagaattataccagtactcttgtactttttatatttagggccaaacaagattttgatatttttcctttgtgtgcctcccccatccatccatccatccatccatccatccatccatccatcatctatccgttcgtcattcatccattcattcctccatcaatccatccatccaacgagtgaaatcatgatattttatacctttcatgtttacatagtcatttatagttagcttttcctatgtcattcttctagaatggtggttctgaaccatggctgaaggttaggatcatttaggggagcttttaaactttgtggtgcccaggctgcaccctaggacaatgaagtcacagtccctgtggatgggttcagccatcagtcctttgaaactccccaggtgatttcactgcagattgacaatcacttgtctagaatgcaatttttttaatgccgtctagtattccatggtgtacactcactgaaactttattaagttcttgttgtcggacatttcgattatttcccattttttttgcaattataaataatacacattgcaaacatccttgtagctaaatttgtgtgcatgactatatttgttaatataaaattactgtcataatattactgttcagatagtatgcaaaaggctaaggcttttgattctttctgccaaaatggagatcatgattttgatttatctaattaggaaatttttagaaattatattgtttaattattgatatacccaaatctttattaaataacaactaatgagtctaaagctataataggaaagcttcagatgttactcaggacaaggtcaccatccatgagggacatggtctggggcagggtttgtcaactcatcactattgacttttggggctagataattctcgtggaggctgttacgtaaattgtaggatgttaaccggcatctttgggtctatgcactagatgccatagtaccccacctcctgttgtgactatcaaaagtgtctttagacgttgctgccccccccccgccactctccactggtggtttgtaatctgcaaactacagcctatgggtcatatttggacgcacattcatgtgtgtattgtctgtgtattgtacaatagagttgagtagttacaacagtgaccacatggctcacaaaatagaaaacatttactatctagcttttatagaaaatgtttgcagactgtagatctagtctatctcccccatgagggacatggtctggggcaggaaaataacttgtgaatagctaaaattcactgggataagcgttctgatagatttaggtatgtatagggtgttgtaggtatggggagagagggaacagctaattaatgccctgataagattgggaagacctctttaaggagataacaaaaattaggtcttgaaaatctgagtagagaaaatggggaagttcctgtaggcagggtgcatggaatatacaaaggcaatggtgttgtattcagggaatggaggaaagtgtcatgtgcgcactgcatgtaattgaagtagtactggcaagaaacttcaggaatcgtgtctgcagtgatagatggggactatcttattaatgaggccacactctatgctaaggaatttaaacttatctgtgtgcaaatggaaagccattaatgtttttagacagggaagtgattatcaatttgtggtttgaaagatttttccatatggtattctgatgttacattgcctggttcctgattctgtattgcaacctgccctgtcaactcaaaattggttttggtgctactttgccacttagcacattcttcttggttatgagtgtcttaagtctctaattcccagtgcctacctagcacatagtaaatgctcaatgaatgcttgttgaatgaatgtaagtattacttacaggatcttcaaactttttttccccctgcatccagtgttgtgctggtaaatgtttaacaaccagctactggggagtgtgggagggggaaaaccccgattgtagtgtttgctaatttctgtggtataaaaacacccaccacagtcaattttaaaacttcaagctaccagcaagctgatataaacgagatgtggcacatcactgcatgtacctagcaagtacctagtaaaatgacataaactgatccctcaggtttttaagttgaaatagaaaggtttttattgtagcttttaaattctgtagttataaaggatgatattttcatatattgtattgacatttaaaaataacattctcaaatcactgttctaaatcaggaatggaaggggatttccctaacctgatgaagggtgtctatatctgaattctttaaaaattttaaaaaataattttgatttattttttttagagatagagtctcactctgttgcccaggctagaggtggagtgcagtggtgcaatcatagctcattgcagcctcaaactcctgggctcaagggatccttccgcctttgcctcttgagtagcctgatagagtatctataaaaggcttaaagcaagcatcatcttaaattggaaaatgttgaaagcatccctttaaaattaaaaaagtagaaaagtatgccggttagaaccacttctattaaagattgtattgatggtcttagccagtgcagtaaaacaagaaaaatggattagaagtataaggattggaaggaggaaatgaattgttcataaattacagatgaggttgggtgtggtggctcatgcttataatcccagctctttgggaggctgaggcgggcggattgcttgagctcaggagttccagaccagcctcggcaacatagtgaaaccctgtctccataaagaatataaaaaattagctatgcatggtggcacaccctgagtagctggtggtcccagctacttgggaggctgaggtgggaggatcacttgagcctgggaggcagaggttgcagtgaggattgtgccacggcactccagcctgaacgacagagtgagactctgtctcagaaaaagaaaataacatcacctgtataataacatcacctgtatttttttttcttttattaggtagagaaaaccagaagaatttacacataaattgttagaaataaggaagatgttaacaatgtagctacaggtactaaggtacaaggccaggcacagtggctcacgcctgtaatctcagcactttggcctggtggctcacacctgtaatcccagtactttggggggccgaggcaggcgggtcacctgaggtcaggagttcgagaccagcttggccaaccaacatggtgaaaccctgtctttactaaaaatacaaagataggtgtggtggcaaggcacctgtaatcccagctactcgggaggctgaagcaggagaattgcttgaatctgggaggcggaggttgcagtgagccgagattgcgccattgcactccggcttggctgacagagcgagactctgtcctcccccaaaacaaacaaacaaaaaaacaaacaactaatatacagaagttagttgcatgcttatgtatcagcagtgaaaaggcaattaagagactccgttttcaatagtatcagaaaaaatagaaataaatctaatgaaagatatgtaagaattctaggctgggcgtggtggctcacacctgtaatcccagcactttgggagggcgaggtgggtggatcacgaggtcaggagatcgagaccatcctggctaacatggtgaaaccccattctattaaaaatacaaaaaaattagcctggcatctggcctggtggcaggcgcctgtagtcccagctactctggaggctgaggcaggagaatggcatgaactcaggagacggagcttgcagtgagctgagatcgcaccactgtactccagcctgggtgacagagccagactccatcgaaaaaaaaaaaaaaaagaattctaaaggaaaattatatatttttaaaaaaggattttaggaggacctagaaatagagaaatataccatgttttttgtacaggaaaactttgtatctgaaaaatatcatttctacctagttggcatatagaccaatgaaattcaaattaaatcacaatcaggcttaccagggaacttattaggtgattttaaattttatatggaaagggtggaaagataaagagccaaaagtagctaggacatttctgaataatatcagagagggaggatttttttctattagatatcaggacttattatgaagttacagtcaatttaaccaatgggatgtagcccttgtgttattctgtttgggctgttctaacaaaatatcataagctggatagcttacaaacaatagaagtttatttcttacagttctggaggctgggaagtccaagatcaaggcactggcagatttaatgtctgttaggggcctgctttctggttcatagatggcgccttctagcttctcctcacgtcgtggaaaggcacggcagctctctgggattacctcttgtaagggcactaagcccattaatgaaagctctgctcctgtgatttaatcaactctcaaaggtcctgcttcatgataccatcaccttgggggttaggtttaacacaggaattttgggggaacttagacattcagatcacggcatggagggaattgaccagtgggataaaatactgaagtgagaagatccacctatgttgtcccactgctccaccatgcctcttctgggtacactccagagagagtgagtcaggatctaattttttattttgaaataatttctgacttaggaaaatgttgcaagaatagcatagacaattctcatattcttttacctggatttccccagcgttaacattttatgacatttgtttgctcatcctgtgttaatattattgctttttttttttttcctgaagtgttagagagtgagttgaagtatttacccgtaactattttgaagtatatatcctgaaatccaagatgttctgttacataactacagtgcagtggtcatagttaggaaattaactgatgaatctatagactatattcaaatttcacctcttctcccaaaatgtcccgtatttcccctcaccctttttggcctactatctaatctgggatcctgttttgcattttgttatcctgactcgattaatctgtaacactttctcagtctgtctttgtcttctatgactttggcattttaaagagttcagctcagttacatacatcagagtatgtgatcagatattcttactgatgcaatgtgtgatgaaaaatgagagaaacaagaaaaagctattgattgcttagcagaagctaagcattgacagtagtgaaccaatgtgttcaaagtgattgctatgtgattttcattttcaaaaccagtgataataccagtgagataaggaagatgatgattgaaatttatgagacatgaatttagatactcctctcttccctggccaggtatggaggaaatagttgactgagaggttaatgtcctgcttatctccttccttgcagaaagagaaagactgggagagaggaaagctaatggaaagttacctgtcaaaacagtaccttccaaagatcttctctccagaagagaggaagtaatttctcaggagctggaaacatgattggaaaacaaaggcagtagatacttaacacttattacgtgtcccaaactgccctaggaagtgggatgaggcacagagagaattggggaaacttgaattgaggagttagatttctacttttatttgtttaaatttacatctacagaaggattcaagatcacagttttgacttgaggtttaaaacttagtctttgacccatctgaactcttactttgatttagt

SEQ ID NO: 59765 - DNA, 1221 bp, Homo sapiens
atatatttattggagtttcatatggttttttgtttgtttctttgtttttttgagacaggggtcttgctctgtcaactaggctggagtgcagtggcatgatctcggctcactacagtctctgcctccctggctcaagtgattctcccacctcagcctctcatgtagctgggactacaggtgtgctccaccacgcctggccaatttttgtatttttctgtagagatggggttttgccatgttgaccaggctggttttgaactcctgggctcgagtgatctgcctgcctcggcctcccagaatgctgggattacagtttgtgagctactgtgcccagcctcatatagttttattttgagacatgtaccattttgtgatggtcagaggagagataatgcatagtataccgaaaaggcagaagtagtaaaaggtttcagaaaggggggaagagtggagaatagtaagtaccaaagatgagtttggcctaaggtactattctttcagggacactgttggcagtcttccatcactgttgtaattaatgtgttatggtgattacagatttcatactgggggaatctctacaaaaatctctctgaatgttagagggacgtctgtgtttatatacccaagtgcttttgtgaattctttggcaatatgtttgtctttatgtgttttatgtgtatgtgcacttatgaaccttttatcttaaatgtgatgttacgttgaattaacatttattccaaggctatacacacagagctaaatgctttggtttgggaacagggtcttgctctgtcacccaggctggagtgcagtagtgtagtcttggctcactgaaattcttcctgggctcaagtgatgattctcccacctcagcctcctgaatagctgggactacaggcacacgccaccacacccagctaattttgtgttaaatgcctttttttccttttctttttttgagacagagtctcgctgtgtcgcccaggctggagtgcagtgacgtgatctcgcctcactgcaacctctgactcctgggttcaagcgattctcctgcctcagcctctgaagtagccgggaccacaggcaccctccaccacacttggctgatttttgtatttttagtagttttcagggttttgccacgttggccaggctggtcttgagctcctgacctcaggtgatctgtccgcctcagcctcccaaagtactgggattaca

SEQ ID NO: 59766 - DNA, 1058 bp, Homo sapiens
ttcccagagtcccagagacttgaggtggaaccctggctttgctgctggtagccacgttatgtatggcaagtggcttgacttctttaaccccctccccacacatcctttactcattcgtaaatgtaggcactagatagatcatctggacgccttctaactcttaaaatttactgttaagtcagtgagaaaattttcatttctaattttgtcttataggagtacatctattgggtaaaacaaggaattcctgtattagttatgaaatatgctacattacaggaaacacagttttcagggtttgggggcctactgtgttgctcagagtctgattttccaaagtaccatgattccaaatgcaggtgcgtgttctccgcgtccttctgcttgttctcctggcagccagagttcagaggggaattatgtttcaaattaatcctcttaaatattcgtcttgttatctctttcattagttttagaaaatagagtttgatttttacagttttcttcttgaatctgtgttattagagttgatgtactggttggaaaaaaatctgtatctcttttacattaacttctccaaaactggatttctatatgaaaatattatgtgtatgatttttagtattttttatttgtgaaaagatgtagtggaaagcaccgcttagtaactgagatttgttacatggtctgaataaaattccacataagtaacatccagtttttacaatagtatctggacagctatatattttcatttttttgcattgaacacaaatagatgtcttctactaagggaatttgtggctatcagtgtatgtgatgggtgccattgtacagaaatctcatttcctgtagtgtgaaattgatattagaaattttcaagcctctgtctttcttcctcagaattgatctaaaatagtattttggtgtgacttttttttggagataggcagggtgactgtgaaagtaattcttttcagcttctctttaaagctacgggttagaaaggtcggacatagagtgaaaatgtcttcccttatcccagtctcccactccta

SEQ ID NO: 59767 - DNA, 1047 bp, Homo sapiens
attaacatttatcacacttgcccattttgtttttctcagatggaaccaaggattaaattaagttgttatactcaaactgtggctatgatttaaaaggagctctcagatccataatataaatggtcacaagagaagtttgtacacaaggcacaaaatagtgattattttggtagaatatattttaaaaaaaactaagtgaaaacaccaaaacacaaaagtaattacagtattacttaatttctttttccaaagctttaagtaaaaacaaaaactaaaaaacaaaaaaacacttactagcttatttgctctgttttaaaattttaatgttctgtattttatttcagtttcttcaggaaagttttgctctgcaactaattacgtgatagatttcctaagagtttttctcttctggctgggtaatccaggagtgaatctatgacactggagtgtttgattctgccctttgttctaaataatgaaatgagttttttgaggtcatttttcgatatgaaatgtttctcattcacctgaggaagaataatggcagtgagtaatttggggtgtagtgtatttgtggttttctaatagtataggagtaaagaccttcattcactggagcaggggactaagtgttcatgctgaagtgaagaacaatttgttttaatatttgttagagcagataatgttataaataaatgaatagattactaaatctctcagtggtagtagaaggattcttcagagtcttactaagtaaaaaagttgtgctccaagtaacagaagacttcccataagtactggctaaaactctctaggacagtagcctatctagatagataaactgttttgtggaatagctgcatgcttcagaagttgggtagaagttaaaagaaaatttaagttgaattgtctttgaaatgccagcatgtctgttatttaatggaatcttaaatccccttacaaagtataacaggtatccttttgttatattaagactcatttatgtttgataaatttagatttgggaatataaagttctaaatgtta

SEQ ID NO: 59768 - DNA, 1052 bp, Homo sapiens
ctgtgttagtgggtcagagccctggccccatggtgacgttgagaacatcacagattcagtcactgagtcagctggcattaggtcagcaacctcttataagctgtagcctcagcacagttagtagaagcattttcaatctagtttcataattaaggaaaagtgccaccccagtctctggctttaggcacagagcctggctcttgaccctgattcctagggaaaacttttatttacagttttccccataggacaaaacttcctgctgctctgtcctgccctgggcccagagtccagctgaccttgtgccttcagtgtgcctcaccctttatgttcctgttagatgtctgatctacagagatgtttggggcatagctgtgccattttagtgacttgtgcttctctttcacctgttatttctgtgtgtttgtgtgaagaaggggaagctacagagaaagaacaatgccatcggggacttaacgccttacttcccacttcagattcttttaaaaaaatcagcttctgagtagtctgctagttcctagagccactgcctgtcacccacacagcactccagttgggaggtgagccctgtgcgctgcttctccatagcactctgcctgcctccttctgggacccatcaagctgtattcaaatcatctgcttatttgcttgtatgtttctctaatctgtgtgctccttgaggagaaaagatgatttcattcctagagccaaacactgttcctggcactaaataggtgttaaataaatattgcactaccttgggtgtttgtaagtaatgtccttagtatgcaggagctattctgtgttttattattattatttttaggtgaaatgggagctgttgccgtgagaagagtgtatgtgtagagtgtggcccgagacaaagcattccaggctggcggagcaatgtgagaaaggtgtgatgttctgactccacataggtgttgctagtgaattgaacattctggactctagagataggaagggggattgtaaaggtggaggagacgaaattggggtccaggtcattt

SEQ ID NO: 59769 - DNA, 1359 bp, Homo sapiens
tatcttcttagttgtaaggggatagtatatgtaatattttctctctattcctatatacttctgcttgtgaacaagagaactggattttacttttttgtgttaactgtttctttttagagggtgggaaaagaattgagattttaccctaactgggattatatggagatttgaagtatagatttcctgattatggaatctttgggatgcaatgagcattttcttattggaagatgatattagagtttaaatgtttttcacatagtatttgtattgattatatttaccttaatatgaaatagggcagcttttctcatcatcagttcaaataattaggcagtagataagtgaaaatgacgctgctgttgtaaaatattggagtgcttctactaagaataatattgtaaggaacggtctttgatttttgacttttcagtggtatactttttcggtagtgtactttgaagaaacaaagttagtggctagatgagttcagtacagattaagaaagagtttttttttttttttttgagacggagtctccctctgtcgcccaggctgcagtgcagtggcaccatctccgctcactgcaagctccacctcctgggttcgcgccattctcctgcctcagcctcccgagtagctgggactacaggcgcccgccaccaggcccagctaatttttttttgtatttttagtagagacggggtttcaccgtgttagtcaggatggtctcgatctcctgaccttgtgatccgcccgcctcagcctcccaaaatgctgggattacaggcgtgagccaccgcgcccggccaagaaagagcttttgttatttcagctccaatcatgacattttgtgagaaagtttatctaatgtaaagtgctaactctagtgaagatggtaattagttcacaaaaattaaaagaaatggcaagcattttaacttaaaaacgcttacatttttggaaagtgaaataaattttcttctactttgcaatttttgggttctgttaggatcagtgttgcagatgtaagtttttttgacggcaggtagcctgtgcctttcatgtttgaatttcggtgtttgatggtgtcttgtatactgcttaccctagaaaacaaagatcaaagtcttgcgaggatgaaggcagaggggaggaatggcttgccaagcaactaatagtgtttgaaccacataacatttttcacctttaaattgtaatatttatatttcatttgcaagatttttaactggttctttatatccactaatccactaattctttttcatgtccacttaaaacaattggttctgttattttatctctttgtggatcttttacatgcttattttaaagtct

SEQ ID NO: 59770 - DNA, 1009 bp, Homo sapiens
ctttcagtgcacaacaccagacgtttctttctagctcactggtctgcgctctctgttgagtttggctgggtttggctgtaagatgtgggttggcttcagttacatgttaggttatttattcattgtgggccattgctacctggggcatacatttcttgttctgcatgtaggagcacaagggaaggcaggctgcctcagtgctcctcaagcctccagttagaaccattccagcaagtcatatggccacgcccttagacttagagtacctggaaaatgagatgaaaggccaatttttgcagaaatatcccaatataatttgatgtgaaattatgggtttaagacattactttttccctgttggatggtgtgaaaaacagaaagtaaggtttttcttctttcacctctgtatgtttagtgcaaaagtagcatttaggggaggagaaagggagtctaaacattttctcctgtgtgctgctcaactaccttgttccatataacaattggtagactccttactttgaaagtaggtcggaggggctgggcatggtgcctcgcgcctgtaatcctagcattttgggaggccgaggtgggtggatcacgaggtcaggagatcgagaccatcctggctaacaccgtgaaatgctgtctctgtgaaaaatacaaaaaattagccgggcgtggtggcaggtccctgtagtcccagctactgcactccaacctgggcgacagagcgagactacgtctcaaaaaaaaaaaaaaaaaaaagtaggttggaggatctatattttaaagctgtgattagtgtaaataaagaatcctgaacgcgtgacttcagttatgtcatttataaatgtttctaagaactaatccatgacattccaaaacatgcattatttagttttgcaaactataaaatttgtgtacatttattacctcagatggtaagattataagtctagtgtttataagttttattatactggtgtttttgaggttactatttttggtg

SEQ ID NO: 59771 - DNA, 1032 bp, Homo sapiens
ggtaaatactgaatgaatgaatagtaagatttattatgcattatacattatatatttattgtaatacatattatatattatacatagtaaatccttcctgttatctatgttattatctgcctgttttaaatttaaaaacagaacattaatcatttaagtattgagttatagcctttgaggaaacaaatgtagcttggttgaggcatcatttctgatgcttttttctttctgacttgatgagaaagttgcgttaaatacgttgctcgttgtttattcattcattgtcattgaatttctttaagacattttaaatgagtacatgagaatctattaaatgtgaattaacaatgtagtcaatcccttgttatttggacgtgtgtgtgtgtgtatatgtatgtatatgtatgtatatatattgctattacaaataatacatcaatgaaggacattttcttctttttttttctttcttttttagggggtaggacagttcactaaatagcaacttagaaaaacaggatctaggaatttctgtgaaaaaatgagctgggattatacagctgtgaaggtgagatcagaagctttagtggtcagacagctgagataagacagcacaaatgatacaactcttggttagccagctccttctccacgtagataatgtataatcatcagtcttcacataaaagctatcttgcaatttgtgttggaatggctatcacttgtgtttgtcttttacttttaaggaacaaatgaaccactacaactcttttggcctcttaagcatggcttaaagattgtaaatgcatttaacccctttatatatgtggttacatatattaatgttacttttataatttcctttctgcatttcattggaaaagttttggtttttcatattaaaatactgtaaaatatattcatacaaagactatgtgtaatatgttacataaagactgacataatgatgtccatcccatcctctcctcagtttaagtgaaagaacattcccagtaccctcctggatcacct

SEQ ID NO: 59772 - DNA, 1020 bp, Homo sapiens
ctgaattcctagagctggttaatggcagagttgtaacacatttgcattgaggacttcctatatgttgagtgatttccctgcaaggcttatagtccaccattgtactgctgaattccagttttattgacatcctacaggaattttcctctcttcacctgtgtgtatttacacctcttggtccataagttttccgattttcactcagtacagggcctttatatagccttgactgtcactctggttgcccttagcacttttattctgaatatgttctgttagctgcagatggctggaaccaagcttgtcttgattgttttatcccaaggcccttgagcagtttttgcgtgttgtggagctgaattaatatctattaaatgaatagatgaatacattcttgtatttagaatccaattagatatagatttttgaagatagggcctggaattatttactcttttctttgtatttttcatggtgtctgctatagtgcttattgttacagttggcagtctggaatttttaactgacttttaaaatgatgtcggactcctgaacaccagatatattgtatccttcattttaacttttatctatggagcacaggcattatgtgcagttctgatatgatgtatcaagtagattaggcacatataccatgtaaactaattataggtcatttttaaaaggccctgactctgtaactgatagaagtagggaagacttggaatggacatttgttttcctaaatacctgaagttgtcatgttgaccagtataaacctactcggatttgataagtctgtctggaaacctacctgtggaaggggaaatttgacctcattcttatctcatgcctcattaacatacaagtgtaaagaaaccgatgaaaccagatgattgctcattttgctcttaggcccatctcattctttgatcttattagcaggaagtactttgttgatttagtgaatagcgtaaacaaacctcctttctctctagcaatgacagaagatttgcttta

SEQ ID NO: 59773 - DNA, 1052 bp, Homo sapiens
agaatattatttttaatcttcttaatgtattagttttgctgttagtaatgttatgtagatcagtgatggcaaattattattattattattttttccttttcctgtgacagggtctcaccctgtcacccaggttggactgcagtagagcagtctcagctcactgcagcctttgccttccaggctcaagcgattctcccacctcaccctcccaggtaactgggactacaggcatgtgccaccatgcccagctaatttccgtatttttttggtagagatgaggtttctccatgttgcccaggctggtcttgaattcctaggctcaagtgatcctcctgcctcagcctcccaaagtgctgggattgcagttgtgagccactttgcctggctaatattttattatagaattaatgcagtatttataagtcagttggctctaggttttttgttcttgtttctttttgtttggtttttggacatttaatgtccattggcatatctgtggtaagataaggtgaaataagattttgaagtcagtcacaatggaaaaaaattgaatagatgtgcaggctaaaatttataaaagttaggtatatatgtatgagctaggtgttttttgtgtatttccctggtgcccatattaaaaaataatgaattggcctataataactcttgattgcagtagtgcttaaaaattaattttggccaggtgtgatagctcactcctataagcccagcactttggagggccaggtgggtggatcacatgaggccaggagtttgaggccagcctggccaacatggtgaaactccatctctaccagaaatacaaaaattagtggggcatggtggcgtacgcttgtggtcccagctactcggaggctgaggcacaacaatcacttgaacccgagagatggaggttgcactgagccgagatcacaccactgcactccagcctggcgacagagtaaaactccgtgtcaaaaaaaaaaaaaagaaaaaatttcaaaatctgtcttcacctcttctatgttcatttttaattttttagcttt

SEQ ID NO: 59774 - DNA, 1127 bp, Homo sapiens
aaaacataagctgcaaaaataagttaaagttctggaaatgtattggttggaggggtcacattagcatatttttgtctctcctctctgtgccaatggctctattttaggaattttgtttactttgatgacagcagagtccccccacccccattttaatagaattgggagcatcttcatggtggtaattggagaagtaattattaagaaaactgccttcaaggcccttttccacctcaatttttcaaggaagcaccaaataccagcttcagacctttaacccaagagcttcacacaagcacagtgaggacagaactgtctgtgaagggtttgatttgttccccagagagaaaaatccacactcttcttcagcacatttgccaggaaggcaggcgggggtctgtcactactcaagagctgagcttggggccaccccctgcggcagcccccaccaagcttagtgtccttgttgtacaatagggctctgtccccatggggctctcagaaagaccaaattacagtgcctggttcagagtagatatttaataggagttagtgctttctgtgccttttttcacccttcttccatagaatcggataaactcacgcttatgaaaagtgctctggaaacaggaaagtcatataaaatgagagacgttggctgggcgtggtggctcacgcctgtaatctgagcactttgggaggccaaggtgggtggatcatttgaggtcaggaattccaggccagcctggccagcatggtaaaaccccatctttactaaaaataccaaaaaaaatttagctgggcgtggtagcccatgcctgtagtcccagctactcaggaggctgaggcaggaggatggcttgaactcgggaggaagaggttgcagtgagccaggatcttgccactgcactccatcctgggcaacagagtgagactctgtcaaaaaaaaaaaaaaaaaaaagcaataggcgttaatgtcgtgcctccctctgggtggaaatgaagtaggtgtgtttgtcccgcaggtcatgatgcacatccggaaccaccccgttcccgtcattgccatggtcaatggcctggccgcggctgccggctgtcaactggttgccagctgcgacattgcc

SEQ ID NO: 59775 - DNA, 1063 bp, Homo sapiens
cacctcagtgacatcccgtgtctccccgtaggtggccttggagatgctctttactggtgagcccatttctgcccaggaggccctgctccacgggctgcttagcaaggtggtgccagaggcggagctgcaggaggagaccatgcggatcgctaggaagatcgcatcgctgagccgtccggtggtgtccctgggcaaagccaccttctacaagcagctgccccaggacctggggacggcttactacctcacctcccaggccatggtggacaacctggccctgcgggacgggcaggagggcatcacggccttcctccagaagagaaaacctgtctggtcacacgagccagtgtgagtggaggcagaggagtgaggcccacgggcagcgcccaggagcccaccttcccctctggcccagccaccactgcctctcagcttcaacaggtgacaggctgctttcgtgacttgatattggtgtcatagcatttggcctacattaaaagccacaatttcatggggaaaggacaaaatggagagtgactgaggtgctgacctcagtgcaaggctggtgaaccctgcagcgggccagctatggtgggaagcctggcatttggggtgctccttgcaacgtcttaagcaagcgaccccccgacatagcaaaaggtggcaacccatggaggcagaaagaaggacgccagcctgacccttatctgaaacgtcctaagcagagttaatcctggctgctcaggagaggcgacacatttcaaatctccacgagatattctccacacagaaaatcttcttgattctatagagacttaatcatgcctatggctttgaataatcttatgtgatttaaataaattaaatctttatagagactggtatgttttatctccccagctacactgcaagctgtctaagaaaagaaaaaaaaatcaattaactgtttttgtatgctcacgctgatggcatagagtaggtgcctcctatttctataacaaatgcccttgttatccacgtttttgtgaaacccggaccccaggctcaacctgaggatgaaaac

SEQ ID NO: 59776 - DNA, 1036 bp, Homo sapiens
caccacgtccagctgtgtttttgtgttttttgtagagactgggttttgccatgttacccaggctggtctcaaactcctgggttcaagcgatcttcccacatctgccttccaaagtgctgggattacaggcatgagccaccatgcttcgccttcctttacaaaaaaaaaaaaaaaattccggtcctcctagtgggtatgaagtagtatctcatggtggttttggtgcatttctcgaacgacttcgttgctggacatctcttcagatgcttgttggccacatcttctttagagaaatgtctgctgagaactcgattctctttttgtgttagctttcgtatcatgaaattttgcatgtgactaagtacagttatttgtatagggctcggtttgtatatttaggttccttcctaaagcttcattctgttgtgggttttttcctgctttctcttttaggctgctgctgcttctcctcggaagccagttgtctgacttgcgctttgtcatttttaatcttctgcctgttgtagttcttgaccccaagcctggggtattgatcagttcatctggcagtacagtatttatggattgaccacgtacaatgtgccaagctgttgagcgggtcattgggcatacaaacatggaagtccttttttttttttttgagacatggtctcactctgtcacctaaactggaatgcagtggcacaatcacagctcactgcagcctcgacctcccaggctcagatgatcctcccccctcagcctccagagtagctgggactacgggtgcgtgccaccatgcctggctaatttttgtatttttgatagagatgggcctcgctgtgttgcacagaatggtcttgaacccctgggttcaagcagtccccccaccttagcccctgaaagtgctgggattacaggcaagagccaccttctctttttgatacatgtctctttgtgatgtgcacagattacattttattttttttaattaggttaatgggcatatcaggataaagaatggtactgcactgga

SEQ ID NO: 59777 - DNA, 1471 bp, Homo sapiens
ctactgagcagttacaccaaggagagcgtgaaggagatgattgagccagagaagaaacgggttgtgatggtaatggtgtgggggaaatgaacttgagctttaaacttgatttgagtttcagtgtctctgaattgaacatcccacgttggaagaagatacatttgggggctccaggactacagtagaaaagtatagagcaagcaggaaaatcttctagtaaaacttacatgcaggacaacaaaatgatgaaagatatccaaataccagataatccaccaggaaggcttttgtttaggaatttgtttcaagaggaacaagggatgagggagaaaaatccgttttatccatcagagtcagtgctataaaattgcctattaaggtaaaagaaaaatgtggagactattttactatacagagagcattaattcagatggcttagaaaagtgataccagcccaagaacagggatctaggtgagcccattgtaagtatcattgaaaacaaaacatgcccgtcaacatgtcacagaaaacgaacgaaggacaacaagaagtggatgagaatattttgttgaccttcatgggtttacagcctctgtctctaaacaaagtatggaaacaagtagagcttttattttgcttttgtttttgttttgtttttttttttgttttcccccactaaatagaaatgagggtccttagtctgtttctgacaatctgttaatttcttaggacagctgtctttggtttgctttccagcaggcgtagtatatttagtcggagagcacatctgtatgcgacaacttgattacatctttttttctagctattttgcattttttcttttaccatgtttcagtttctgcatgtagatttaaataaaaaacaaaacttgtaaagttgtaacatttcacatggaaatgctgcccaatcttcaccagcttcagaaatctgacctttgccgatgctgcaataaagtgttgtaatttagatttggcgtggtgttgttttgttgggtttgggttttggaaaccgattgaacgggtaaattggtatctcccagcgtcatctttgtgctttaaaaatacattctcggccgggtgcggcggctcacgcctgtaatcccagcactttgggaggccgaggtgggcggatcacgaggtcagaagatcgagaccatcctggctaacacaatgaaacaccatctgtactaaaaatacaaaaaattagccgggcgcggtggtggacacctatagtcccagctactcgggaggctgaggcaggcgaatggcgtgaacccgggaggcggagcttgcagtgagccgagatcgcgccactgcactccggcctgggcgaaagagccagactccgtctcaaaaaaaacaaaaatacattctcagacgactagtgttgtgttcaccttaaggattccatctctgcatgacttttcttaggtgccggagttaatgtacc

SEQ ID NO: 59778 - DNA, 1063 bp, Homo sapiens
ttttgagacaggttcttgctctgtcacccaggctggagtacagtggcgtgatcacaggtcaccgcagcctcgacctcctgggctcaagcagtcctgcctcagcctctcagtatctgggactataggcacacaccactacaaatggctaattttttttatttttagtggagtcgaggtctcactatgttgcccaggctgatattgaactcttgtaaacctatcttaagtagagtctgcattttttcatcagattttttttttatatatctttatgtaaggttaaattagtgatagttttgttatacaatagagtccattgtagaattgcatttaatccaaagtgtatattgtattaataaacagtttttgagctgatagatttttgagtcactcagaatgattgtttgcttataaaccagtcaaatgacaccttacactataactagtgatataactataccttacttagcaaagattttgaacatttttttcctgtcatttactgcatttatttaaagtattctaggttagatagctgccttttcttgacttcaggagagatgcttgaatcttctctttcattccctcagggaatacttgtgttctttccatcagttcatttctggaagagttacggatcttatccagctgaggatatacttttccatatttgcatcttaacgctttgaaagtttcttgctaaggtagcttgctctgtaagaaacaaactgttcatctgcttgggctgccatgacaaaatattacagccctagtagcttaaacgacagatgtctgttgtctcgcagcactggaggccgccggcaggaaacctgaggtcagggagtcagcggggctggttccttctgaggcctggaggaagactgctccaggcctgccttctactgctgggggtgccggcagtctttggcttccataccttgtcatacctcaccctggtctccgcctttgtcttcacgtggccttttccccctgtgtgtgtctgtgtgcaaatttccctttttatagagatgcagtcatatgggattagggctccaccctgctc

SEQ ID NO: 59779 - DNA, 1040 bp, Homo sapiens
catacaagatggtccctcaaaaccgtttccccctctaccaagctgttactctagcgatccatagttgatttgtcaactattgagcatcactacgtgccaggtactattctatttcaggtcctgaggctacagtgataaacagaacaatgttcctgcccttgtggaacttatctcctactgagagagcagagagacaaacgcacatatttgcagatagtgaaacatggtatgaagagaatataggccagctttcagatacacctttaggtgtatttaggtcaattctgtaaaaatttgtttacatcttaacatttctgagatcaagttgcttcttagagtccatgaaatcctgtgttaactgacagcatttctttctgctttagtgataagtaaaataatggtgtatcttagaattaatagaatgttagattttgttgcatatggtagctgccacagttatcttagacaagtccaataccacattcgtctacacagtcatttaacaagtatttattatttacctgctacacaccaggcacttctgtgtgcagaatatagaggcagttagccagagtccttcctctcttgcgagctttcattctggtgttgggaggcatatgagaaatacaccaagtcacgttgggatggctaccaaggaggataaagcagggtaagaggatagaaagagacacggatggtgagatgccaggagagggaggctgcctcttaggtaggatgatcagggaagaccctacaataagttgcatctgagatgtcctccccactagcacagcctcaaacagatgatgcctaaattttatccctgcatttgtcaggcaacttctcatgtacaccgagatcaaaattgtgcactatacttgtgcagtatacaagtgatatacttgtacagcatgaaagtgatatacttgagcagtatactacttgttgctgcagtgataccacctatataccaattagaattgtggtgtgtggccgggcatagtggctcacacctgtaatcccagcactttgggaggcca

SEQ ID NO: 59780 - DNA, 1729 bp, Homo sapiens
gaggcagggactgactgtgaggatggggtgaagtagtccttgaaaaccaccagttaggggagctgaaaggccaggtcttctgcttaacagcagtgtgcccttgggcagatcacttaacttttctgagcctcagttttttcatgtgtaaaataggaacaataaagcttgtccttccatcctcagacttgggtagagcaaacaaaatgaagtgtatgagaacaccttccaaatcgaagtgctttgtaaaaggtaatgctgtatcactgctttcagctggtaatgctgttacatttgaacttttgttggtttccattgcagttagatgggtattaaagaactactgtgagacattcagcctctccagatttgtttcaggaggaggagaacacaaaaggctcaggaaacttcttcattgtggaattcaagaaagagcttctacaatagatctctgtattgttagatcagttgaaggtagtgagatgggttttcaactactgatttgtcttaaacgttgctagctgactttgccctcccattggaaaccaactacctaaagagctaaaacttgagaataataaacaattatacagaagttttgaaatctttttaaggcatgtaaaatatggttacacttcgaaaagttatttaatcttctaatgttcaataatttcaggagggttctgataatgatgatgatgagggagaagaagaggaggaagagaatacagattaccttacagattccaataaggaaaatgaaaccgatgaagagaatactgtacgtatggctgaaaaatttactttttgaaattgtgcagcatttttatagtatttgaattttagtcacgaaactgaatttgtttcttttgattatgaaaaatatttctttagaaattcattttcaatttgttttcctaaccattttctttaaattcttttaacattgaataatgttagatattttactcactttactccttgagttatgttaaacaagttgtcaatactaaaaggctttgccctagaaaacattacagttaaaatttctggtctgattttgttgttttgttttaataaggaggtaatgattaaaggcggtggacttaagcatgtaccttgtgtagaagatgaggacttcattcaagctctggataaaatgatgctagaaaatctacaggtattaaatgtcatttgtttcaaagactcttctcaatacaaaacattgcagcccattacattctggttcatgtgaaggcctctcctatctaagtgtctcttctgcagcagcttttgctagatcatgtgtagacagcttgcagccagcttcttgtccttcttgtatcccacatcctgatttgcatgaggtagagtcggtgaaaatgcaacacacacaagatttggaacagaataatttcattgtgccaatctttgccttttatttcttaagtcatatttcttttttttttcttgagacagagtctcactctgttgcccaggctggagtgcagtggcacgatctcagctcactgcaacctctgcctcctgggttcaagcagttcttgtgcctcagcctccctagtagctgggattacaggcatgtgccaccaccccgggctaatttttgtattttagtagagacagcgttttaccgtgttggccaggttggtctcgacctcctgacctcaggtgatcctcctgctacggcctcccaaagtgctgggattacagc

SEQ ID NO: 59781 - DNA, 2937 bp, Homo sapiens
aaagtgacacgttttggccaggtgtggtggttcacacttgtaatcccagcactttgggaggccgaggcaggcagatcacctgaggtcaggagtttgagaccagcctggccaacatggcaaaaccccatctctactaaaaatacaaaaattatccaggaatgttggcgcacacctgtaatcccagctactcaggaggctgaggcaggagaatcgcttgaacccgggagacggaggttggagtgagccaagatcacgccattgcactacagcctgggtaacaagagcgaaactccatctcaaaaaaataaagtaaataaataaaaagtgacccgttttcagactattaagctagtgtttgatttcccactagaacttggtacattcatgtctgtcattaagggatctttactttcgccagttatgcaaattatataaatttacgacatcgcatatctgaagaaccacttttcatggtaaaggttttacaagtgctgctactgattgtgcaagtattaacttttcctacaacttaacccgtaaaggcatatatgattctttttgttctttgaacctttttccaagttacctactttcttttccttttgaaatttctaattgaatacatgatctcatattgagcagagtatttatgaacttatttcacttgctttggatccttggaaaattgttaagtcttagccttgtttcccaaaaacctgcatgaatggtattctctgtatagtggacatgagtaaatattagtgtgacacctagtttagtgacagaaaagagaacagttgtgctttgtcctttgtagatcaaaaggctaaattaaaggactgcaggcttcttgtgaggactttgtccttgtttagaatatggaggtaaaaatagatcgctgtttgtgaatgaaactctaaagatggtagcggccgcaatcagtgcactcccaagtctccatttgcttcctggttgaggaagaagacgtatgcagaaaaatcaatattaaatccgtttcctactgataaaccaaaagataatacagtattgtgcctttggtagttttttgttttcagacacctgaaaattcattgtctcatgttagttttatagtatcccaatgttaacataatagttaattggaaaacactaaaaccatttttatcatattttaaaaataacttttaatagtattaaaagtaatgtgttcatgacagtaatttttaaaaaaccaagaaagcaataccaatattccatacagaaagataatcgtgttaatattttaatacatatttttctactctttttaaattttttttgtgtttgtgattttctaaccaattggttctacttaatacattatgaaattttttcttgacattacacatattctcttaaagctttattttttgttttgtaattggctgtattcatttgtatctatgtgccataatttacttaatacagctgtttcactcttaggttgattctagttttataccactgtaaataatatttttagtgtacctgtgattttctcaggatagataggattactggctcagatttttattttaatttaagaacaaaactaaaatggtaattggcaatgttatttaattctggtttggaagtgttcaaagcagtattcatgaaatgagagggttaaatcacatcatcgctaaagtttcttcctgcttgaatcctctaagattctatgcatgaacaggtatttatttaacacctactgtgtatttattaatatatgggctgtcttaagttttgaacatttaagacaagttctttgtcctcaggggtcttataatctgatgtaatatttatgagatcgttaggaaaaaataacaacatgctatatcatcaaatgtaagatgctgtaagttctccacatgctttaggagcaaataggagaaaaagtaatagattgaagtactcattgacagttcatgcaggaagtaaaactgaaactgaacatgaagagtggatgggatttgaaagtgcatattgaagggtattctctattgagaaggatattgggcaagcaagatttcaaagcagtgtgttctgtgacaggagacgtctaaggcaacttcaggggagggcttaggagagaggagtgggtagcagatcagtgggatcagatgagaccacattgtgtgcatatcaaaagtagagagggtggattggaattccaacaggaagaagaattgactgggcagtgaaatgtgggatggacacaggaggtgaaagcaaattcaggccagggagttccattaggcttaggaggagaatgctgttattgaagaaaaaaaattagtctgtatggtgacaaagctgctatggcgttttgccccattcccccgtcttaatttgcatacattcaaattgatagccacatatgatttctccattaaagtggcacgatttttttcatgtcttttgagtttttggagactctttaaatctcacttggtaaagagtgtggccaacgctgtatcttacatatggctgagactgtacctcatctgttactgttttctacctttgtccaagactgagatatacaagattatccaagtatttaaagctgtaagaaaagagggaaaagtatacacacacatacacttattttttctcgctttttgttagttgtgtttatttgttgaaatgtaggcctacacatttagttttttaaatgtttctcaccgtagtttttaattcttttacctttgttctgagaaaatggctgttgaattcttaatgcatacttttacatgaattggtatagtgtagaaaactagcctgtgtctatttttaatgtatttttccatttccaccttctcatttcaaggcctagtaaatgacaaagactcaaaagattctatgacagaaggagaaaatcttgaagaggatgaagaa

SEQ ID NO: 59782 - DNA, 1074 bp, Homo sapiens
atattaaaaagtagccgggcgtggtggcatgcacctgtagtcccagctgctcgggaggctgaggcaggagaatggcgtgaacctgggaggcggagcttgcagtgagctgagatggcgccactgcactccagactgggtgacagagcgagactccatctcaaaaaaaaaaaaaaaaaaaaaaagatatttagtaaattcaccaaatagctcaagacctgtatagacagagggaaatgattggaataggatcattgctgttgaccattaatagaaatggtaagtgtcttttataacctttcagcttagtagttataactgggaaacagcacaatatagtttattattttaaaatattttgttactaatttcttatagctaaatttatttttcatttgttatcagcgttatgtttggtggaagaaaagtttggaggtttggacaaaagaccatccatttcctattgatatagattacatgatcagtgatacactagaactgctaagaccaaagatcaaactctgtaattctctggaagaatccatcaggcaggtacaagacttggaacgagaattcttaataaaactaggtaagcaattgattgcagacagaaaatgaaggtgatatttggcagattatttctggaatttgctttataatgttaccagtcagagcttacattgtatcttttctattttcggtgttgagtgttacgtagtagtgttaggtaatgcctgtgtggtgtgcttgatttcactaagtaatttcaaaccggaggacaacagttaagcaggacttgcaggacaggacttgaagcaggtgacagtgatgggggaaaaaaaacccacaatcctgtctacctctcttacttttagaatttttggttgctaatataaaatctattttttattaaagcatttcttatttttgcgtatatattttcaacaggcattatttcctagaaagtgcaagcaaagaaactgtagaagggagtacctgtcagaagtttggaactctaccctacaggatttcagagcttacccactggcagagttgcttctgtctctaaggactaga

SEQ ID NO: 59783 - DNA, 1051 bp, Homo sapiens
gctgtgtcacccaggctggagtgcactggcacgatctccgctcgctgcaacctcttcctcctgggttcaagcaattctcctgtttcaacttcccgagtagctgggactactacaggtgcatgccaccacgcctagctaatttttttgtatttttagtagagacggggttttgccatgtcggccaggctggtctcaaactcctgaccgtaggtgatcacctgtcttggcctcccaaaatgctgggattacaggcgtgagctactgcgcccggcctaacagtttcctcttactgtaaaacccagatttattgtttccttaattcactgatggcagagaaaataggttaagggtagaattacattttaactgttttagaaacaattcatgtaatgatagctaaatttaatacctaacatgttctttttatgaaaacactttaaagatagccatttcctagagagagaaaaggacacctagaagtaaccagtttattagaaaagatctgtcatttctctattcagtgttctttcagtaatagatattttcaagttacagagacaagtttaacctgttttcatatacactactcctctttaatgaaaatctgtggttttgttgccttttaggttaatcaacctaaatttaatcagaggcgcatcagcagtgccaagttcttaggagaactttacaattaccgaatggtggaatcagctgttattttcagaactctgtattcttttacctcatttggtgttaatcctgatggctctccaagttccctggacccacctgagcatcttttcagaattagactcgtatgcactattctggacacatgtggccagtactttgacagaggttccagtaaacgaaaacttgattgtttccttgtatattttcaggtatataagctgaaatattcagtttggcatcatttaacatattgcatgtgttttaaaagaatactatgagagaagaaacgttatggtattcatatattatatatatgttcataattagattatattcttcatataagaatgcttttgga

SEQ ID NO: 59784 - DNA, 1068 bp, Homo sapiens
attgagaaaatgtctgctgtgtatgtggcatgtgtttaaatacaaaacatctaacaataaatatagaaaggggtttgacattcgtttccacatatctttctgtgaaagacgtcaaatatattgaagtttttcaataaaaattaatggcagaacacaaaagatgctcagcagtgaacccaagtagactcacttctgttttttacgttttccaagttgttacacacattagatgtatgataatttcttctctactaggattgaagagttgcctttgtagttttcatcattcttcctgttgcagatgcttctgtcagacttctctcatcaccatattgaaatggcatgcaccctgctggagacatgtggacggtttcttttcagatctccagaatctcacctgaggaccagtgtacttttggtaagggcttgaggatgctggtaagagctagaggttcttgatttacctgtgcttcagaggttgaaaatattgaccagtgctggttatcttattctttcatatgaatacaaacatttctacttaaagtggaacatcccatacatatgagttgcaatccctggagagctgtagacatttttctcacttggctaccagcgagttcacagtattgcaaggggtaattaagttcaacctgtaacacttttaacaaatgatgcagatgagcaggcacccaatactgttttgttagagccatgtttatgaatgtttttgttatgttatgaatgttttggtgcatctcaaaccattattcatgtgtcatgtaagcacataaaatgtaagcttaaatatattaaattttaaaattaaggccaggcgcagtggctcacgcctgtattcccagcacttacaaaataccagccttggcaacatagtgagacctcctctctacaaacacattttagaactagccaggcgtggtgatgctttcctgtagtcccaactactcagaaggctgaggtgggaggatctctggaacttgggagatcaaggctgcaggagtcatgatctcgccactgcactccagcctgggcggcagaatgagaccctgt

SEQ ID NO: 59785 - DNA, 1065 bp, Homo sapiens
ctcctgaagtgctgggattacaggtgtgagccaccgcacccggcctatagcaagaaattttacccatatgtattaaaaatatctggagtgggctgggcacggtggctcacgcctctaatcccagcactttgagaggctgtggtgggtggattacctgaggtcagaagttggggaccagcctggccaacatgatgaaaccccttctctactaaaaatacaaaaaattacccagctgggtgtggtggtgggcgcctgtaatcccagctactcgggagggtgaagcaggagaattgcttgaacccaggaggcggaggttgcagtgagccaagattgcaccgttgcactccagcctgggtaacaagcgaaactctgtctcaaaaaaaaaaaaaaaaaaaaaactggagtgaattcgaatgcattaaaataatagtttttatcacagagattcaaaatgttgattaagcattatcttttctctcttaatttttaggtacggaaaaaggaccagatcaatattgaaacaaagaataaaactgttcgttttataggagaactaactaagtttaagatgttcaccaaaaatgacacactgcattgtttaaaggttagtgctgaattagttgattgtttttaattgaaaagtttaaagttttaattataaatggtggataaagtgaaataatttaatatttgattaatccaaaagaagaccaagaaaggaagaaaaagtaacgttaaacaagtgtgcaaaatacaaaacaaatagtgagatcttagatacttatgcagttctacgagtaattacgtgaaatctaaaaagggtgaaatatgtcaagtaaaagccttaaaaatataaaacttgattaaaacaactactaggagccatctacaacagagtcacccttaaatatgaagatgagaaaaattaaataaaaaaatggggaaaatatgctatacaaatactaataaaatgaaagctggtttctctgtattatcatagaggttaaaaatattgactggtggtagttatcttactctgtcatgtgaatacaaacatttctacct

SEQ ID NO: 59786 - DNA, 1177 bp, Homo sapiens
ttcttaaggattaaatgaaataatgcacatgcagctcctcacatagcatctgtacataaatattattttaataataattataccttctataccaccattctctcctggttcttacttgtgttactattcttaatctcctccaccttttttcctagctgagtttctttgttgggattggctcagctttcttccttcagcctcctttttaatgggatgcatttacctggcctttaattcacatctatttctcaacaaccccaaatatacatatcttgccagaatctctcttatgatacttagaaagttttcatgtacttggagctaaattagtccccaaaccaaattcattattttcttcttaaaaatgtcttttacttccttgaatctgcttctgtatttcccatgtaaatttacaatgtattttgtccagttactgagataaatacctctacttttgcacctagacatttaggagccattgtttactaaattcatttgatgctgtcttctaaaagaactaaaatctagcatctcctcttcatacctcctgccactgtctttcattttccatacctggagttatgatagtagatttttaacgagcttttcccgtctctgtcttctacctagatccagtatatttctgcagtctggtatgtttttccccctaagaacctcagctgagaaataaagcaggttaacaaagctgtatgaaatgtcactggcagttaaggaaattctagttgaaacaatgggtttgctaatttcactgacgattagaaaaggtaatagaaattagaaaccaacattctcagatacttcaggtgggaatctggtgaagctgtttggcactagatttcaagagccctagaggcattcacacattggacagctatgaggacatgtcctaagtaaacaaatctatgtaccaaaaaactgtgattcacagtatgactctaatagggaaaactgatcatctgaaagcccaacagtggattaataaaatggtcatctaatcacaatgctgaaatgatggacagccatttgaattgatgtttacaaaaacgtttttagggccgggcgcggtggcccacacctgtaatcccagcattttgggaggccaaggcgggtggattaccggaggttgggagttcgagaccagcctgaccaacatgga

SEQ ID NO: 59787 - DNA, 1064 bp, Homo sapiens
cgtgatctgggctcactgcaacttctacctcctgggttcaagcaattctcctgccttagcctcccgagtagctgtgactacaggcgcatgccaccatacctgtctaatttttttatttttagtagagacggggtttcaccgtgttagccaggatagtcttgatctctttacctcatgatctgcctgcctcggcctcccaaagtgctgggattacaggcgtgagctaccacgcccagcctattgattacctttttactttagaccttgaggtttccaaataacttaccctgagataaatgaaggaaatggctttaaaggattttgtcttgcactagagaagttaccttgagatttgtaaatatgcagttactcagtaattatgtgattaaaaatttaagtcgtgtcaaaacatactgtttttttgtgtgtggtgtttcatatttcatcaaaattacataataaaactacagatgtgcagtaaattcacggaatggaaaatgccagaatattaataaaattgtagaaggctcattgaattttcaaacacttctttatgatggcaataaataggcatgtctgtatgattatgagttttaagatcatttaatgtgtgaatacatctgaaaagtttaaattttaaaatgaattatttttgatatgtctttcctttgacacatatcacatataacttttgcaggttggatttgctaccattttatgcaagattggttgctacattgcatccctgcatgtctgatgtagcagaggatctttgttccatgctgaggggggatttcagatttcatgtatgtatttaagcatttattttgaaatatttatattcttatacgttgagtgaggattctttaagaatgtaattgttggtaagcatattcttgaaatttgatagtggtataacagtttagaatttacggcattctaaatttttgaaatgtgatttacttaacgaagcttgaaattgatcagtgatattctggttgggaggtgagctgttcctgctaccttgttcccccattgcgggaacagcactttttgcttttcta

SEQ ID NO: 59788 - DNA, 1008 bp, Homo sapiens
tgaccaccatgcccagcctaaccatacctttcaaatttatttccatccttcttttttcagtgtccctttagctaagggttaatgtatccatctgaggagctttccagatcgaattatgtgtttttttccctgaccatcaaacattttcatatattattgtatggtacagtgatgtgctcagcaataatctttttttgagatggagtttcgctcttgttgcccaggctggattgcaatggtgtgatctcagctcactgcaacctctgcctcctgggttcaagtgattctcctgcctcagtctcccgagtagctgggattgcaggcatctgtcaccacgcccagctaatttttatatttttggtagagatggggtttcaccatattggccaggctggtctccaggtgatctgcctgcctcagcctcccaaagtgctgggattacagatgtgagccaccgtgcccggcctccactcagcgataattaagactcgtatgattatttgtgtctgttctaattggcttcaagctgtcataatttttaagctcttgtaattttatagtttttagcttcctctctcactgtcagctccattatttgctgctgtcagttaagctgcttttatcagttgctcattacttctcatcttcagagtctgatctgctgagtgttgaatcattgattaatcaggttttacaaaataacatctatggcaggaatggaaaataaattttagcttgtgtgttgattccaactagtagtggccacctggagtgctgtgctaggcaggattctggagcatcattcctgtgtaatgggaaagagtgctttgacaatggaagagggtggcagtgtgagtgccacatatttgccatttactgtccaaattaagatcctgaatgaagatctgagtgggttctgtaatgagttgaaatacataaattagtatttagattttgtaatattattttgccttcgtagaggttttttcagttattgagtaccattca

SEQ ID NO: 59789 - DNA, 1083 bp, Homo sapiens
ataatgtatatatttttttgagacttagtttcgccctttttgctcaggctcaagtgcagtggtgctctctcggctcactgcagtctccacctcctgggttcaagcaattctcctgcctcagcctcctgagtagctgggattacagacatgtgccaccatgcccagttaatttttgtatttttagtagagatggggtttcaccatgttggtcaggctggtctcaaactcctgacctcaggtgatcctccctcctcggcctcccaaagtgctgggattacaggggtgagccatcatgcccagccgagcataatgtgttttataaaatctaaatatattaacttcagttgccaggtatacatgcagcttctaaaagaacctgcagattttgtgagtcttaatctacttttgtgcagcaggattttcatatgactttgaatttaggtatacttgtttgtttttcaacagaggcaaaagaatctaaggagaataaggaggtatcaagtcccgatgatttggaacttgagttggagaatctagaaattaatgatgacaccttagaattagagggtggagatgaagctgaagatcttacaaagaaacttcttgatgaacaaggtaaagaactaatttaccaactttcatttttaattggtttttacacacagagctcttgcctaagaatatagatcttttctccttaattctgtattttttaattccttgtttttctgttgttttcagtccatcactgttttcagaatttgatttataacaggacactacatacccagtattgtgtgtctacaaactttaatgatcatctaaattttaaataccttagttctaaataatattttttattttatttttttttctgaaactaagtctcactcttgtcctccaggctggaatgcaatggtacgatcttggctcactgcaacttctgcctcctgggttcaagcaattctcctgcctcagcctcccaagtagctgggattacagctgcctgccaccatgcccagctaatttttgtatttttagtagagatggggtttcaccatgttggccaggcttgtctcgaac

SEQ ID NO: 59790 - DNA, 1147 bp, Homo sapiens
tgggattttcactgacaaggaaggtctttccttaatctatgaacagctaaaaaatattattaatgctgatcgggagtcccacactcatgtctctgtagtgattagtttctgtcgacattgtggagatgatattgctggacttgtaccaaggaaagtaaagagtgctgcagagaagtttaatttgagttttcctcctagtgagataattagtccagagaaacaacagcccttccagaatcttttaaaagagtactttacgtctttgaccaaacacctgaaaagggaccacagggagctccagaatactgagagacaaaacaggtgattttcaaatgtttctcagagttgagaatttattttggagctcatacttaaaaatgtttaaagtcttcatgccactgaaagaacttatggaaaagggctccttacaggtgatttcttaacattccaggaaaatttcaaagtagaacagtctgagtactcatgttttaatgtgagtctacgatagattttgtttctgattttaaaaaaatctgccaagtagatggtgatttttgctttgtggatgtgtattcttcctgtgattttaaatactccttaataatcaaggggtaaaatttccttttctgtcacttaaacttacctgctaatatttttctgtgtgctttaacgttctctctataacaggtttgctttcattgttttgtattttaagttctttatgtcactgttgctcttcttaagaaaatgagtcattaattaccagtggtatttcagattagagttttgggaaataatgcacaaaattagctgtgaaaaaatttcttaaatgcaactacaaaactcatttgtaggagtcttcttcctgggggcattcatttaaaattctaaaggaggaatgtactgtgcctgtggtaattggtgaaaagacctgactttggggccaattttggttgttaaaaggtatggtagactactgtgtagtatttgtacctgaggagcaacaagaagctagaagttgatggagttgctaggcattaggtcaatttctatggaggatggatttggaggggggctgagggagtgtagcaaagaggtaatagccatagcacgtggctgagtattaaactattttaatatttctaca

SEQ ID NO: 59791 - DNA, 1040 bp, Homo sapiens
ggcgtcgttctcctcagaccccctgtctccgaggctcccatcaacgcgggagcccccgggccgggccatgcttggggggcggtggaggaggtgcctgccccacatgcctgggccgggcctcgagactggaggcggggagcccgcggtggaggggcgaaagtgttcgggggcgtggaggagagcgaggggaggtcgggggaagctcctcgagagccgggagggaagcgagggcgagaaagtggggagggcgcgtgtgtgggaggctgcggagtggggagaccggccgggaaggcttctgtggcgagggagtgtggggcgagaagttggggttggggcagcgatggtccgcgaaggtgaccgtggatacctgtgggaaggggagttgtgtcggggaagtgtggtgggtttagaggttcctacaccaccagagcaggggtttgtaggagaggtatgtgtaggggaaggggcttggggtgtatctggggatggtgggcatgggctgtttggttgacttccttttaatcacataggctggttgattcttcactttaccttcacctcttcaaggcgccaagcactctcttcttgctaggactgttggactaaggaagtgatcacaggatatttggtccccaggttggcagagcagagccagctgggtccacgctggggtgatcggaccttcagctctcttgctcatcttagaggacttacacgacacgaaacgatgcatcagatcaaagtgaaaccctcgctgacgctttatctcatttccatagttcttaggtgttccttaacatcgtcagtctcctcatttgtgagctggtacaatttctaacagttcttaatacgtcctttatactaaggatgttctttaaaaaataaagtcagaaactgggagatagtgttcctgtgctgttctgtcctgacagcattttgaataagagaattgaaaggtaaaaccgcattctctcatactggagtgttttcggagcactctgattgggatttcatacataatccatatggtactttgcaag

SEQ ID NO: 59792 - DNA, 1054 bp, Homo sapiens
tgggtgctcagtgttggggtcatcccccgtccatcctctgtaactgaggatctttgaggtccacgcttgggtggtcttcccatcttgctggtccggacctggtttcggaagggcttttctttcctttgttggaaacgtgtgagaaactctttttttctttctctttttgtttccttttttttttttttttttttttgagacggagtctcgctctgtggcccaggctggagtgcagtgctgcgaccacagctccctgcagcctcgaactcctgggctcaggctatccttccacctcagcgtcccgagtagctggggacacagagggatgaccacgcccagcttttttttttttttttttttttttttcatttttagtagagatggggtcccaccatgttgcccaggctggtcttgaactcttgagctcaagctgatcctgcagcctcggcctcccaatgtgttgggattacaggctgagccactgcacccagcctagaaaaccagctctttaatgaggcggagctgtgggagaagtaaagttttaaggtctcccaaggatacatttccaggaccatctctgaggcttcttttatgtgagcaggtgggggggtccaagactgcattgcttgggagaagtgggcagttagttccagtcttggaagacagcatgatatttattatgtatttgtctccttgtagctagtctgttactttaatttcagagtttaactcttaactctgctgaatttggaactatgtgctggtggggtttctttcttttccttttagccactctattgacaccttgatatgtgctggtggttttaatgaattaacagtcatgaatatcagcttttggaacttctgttgcatgctcatttgcgagactaattttgagtatttggtttacgctccaaaattattgtatcattatttatcctcacggagtagaagataagtacagattgcttattagaggaaaatcatttggcatctttgatctgatcattagattaatgttgaagatccccttcggcatctgggcacctgacct

SEQ ID NO: 59793 - DNA, 1041 bp, Homo sapiens
cctcccaaagtgttgggattacaggcgtgagccacggcacccggccaataatgacccaagttattaagaacaaagcactctgcgttgaagtaattattttggtatgttccagaattaacttgccacatgatttttttttttttaaattttttttaaatatgaaaatttattttgcataggaaacaataatctctggtaaaaatcattactgcatataacaaaacaatgccttcaattaaagggggaaagtgagtttttaaacattggggttaatttagaagaaaatacagtatataataatctcaacatcatgttaaggaacatgattattttttaagatgacccctttgattgtatttcacaggattattgaacatggggaaggaagaggcctcacttgaggaagtgttagtctatctcaatcaaatctactgtgggcagatttctattgaaacctcccaacttcagagccaggatgagaaagactggtttgccaagcggtttgaggaactgcaaaaggagacgtttaccacagaagagcgaaaacatctgtcgaaactaatgctggaatctcaggtaaaaaggagcatctaggccgggcacggtggctcatgcctgtaatcccagcactttgggaggccgaggcgggcggatcacctgaggtcaggagttcaagaccagcctgaccaacatggagaaaccccatctctactaaaaatacgaaaattagccaggcatgctggtgcatgcctgtaatcctagctactcatgaggctgaggcagcagaattgcttgaacccaggaggcagaggttgcagtgagccgagattgcgccattgcactccaccctgggtaacaagagtgaaacaccttctcaaaaaaaaaggagcatttaatagcaagggcataggtcagcctcactgcctataaagatatatagcctggctgacatagagaaaccccgtctctactaaaaatacaaaaattagccaggggtgatggtgcacacctataatcccagctaatcaggaggctgaggca

SEQ ID NO: 59794 - DNA, 1029 bp, Homo sapiens
gggattaaggcatcagccaccgtgactggcctaaaatttcttttaatatgtgagaaaaaaaagtcttttggtaacaggacatactgtcaccattcagggctatgtacagttgcagttcttgagacagtcttgctctgtcacccaggttggagtgcagtggcacgatctcggctcactgcaacctccgcctcctggactcaagcaattctcctgcctcagcctcctgagtagctgggattacaggtgcacaccaccacacccggctaatttttagattttcagtagagacggggtttcaccatgttggccaagtctcaaactcctggcctcaagtgatccacctgccttggcctcccgaagtgctgggattacagacgtgaaccaccatgcctggcctggtcttacttcttaagaactaaagatacttaagttcagaacttaatctgagatgatcaaaagatgacatgtggaagacaggctcagtacaaatgaatggaactgaacctctgctggggctgtgaccaggactctggaatgtcaagatggcaagaagccccttcctaatagtttgggtagttggatagtttgcagccttgattcataccgtagagccccgtgtgaaaactggggtactgggaagaggcagcagaaatctaaggcctggattccagtccagaagaacacacattctaagggggtttccttggggtgagttattctgccgctcaggttattctcctcagcccctcctactgtcccggatcctaggaaaaccatcccgctgtgtccgtgttatgtctctctccgggatatgtagtaaagtggcattgctgtggccacttggggagtgtggggccatctcacaacacacacagacttatctgccttccactggagaagctggctgtctcctggcagctcacgtctgacatgatgttctgcaggagtttgaccactttctggccaccaagttctcgacagtgaagcgatatggaggcgaaggggctgaaagcatgatgggctttttcc

SEQ ID NO: 59795 - DNA, 1066 bp, Homo sapiens
tgttacctttgcagtttatttgagttataactacctcccattgtgttcattgaccagagaggttctaaagcatgttaatttttctttcctgacaatattacttatttgtagtataagtcatgctgacaaccttcatcagagtatagacataggacagttatgcctgggaaacaaagggctagtgctggatgtactggaaagatagttttctctaaaaattgcagggcacatgatacctctccactcttatgcaatctcatcttaactatagacttttgaatattggacagcatatattaataactatctgttatcctaaggaaaattctcaggattaagccagtatataagaatttacagtcaccacaccttattattaggttatttatgggaatctgactttttttttcttgcttgcttaaggttttaatgttcgtctaagtggccaagatgttggtcgtggaactttcagtcagaggcatgcaatcgtggtttgccaggagacggatgacacctacatccccctgaaccatatggacccaaatcagaaggggtttctagaggtgagatgtttctatagctgttgtaaaatccaggtgccaacgattacacttccaggattcttagaacaagtaggaaggagtgctggcaactttgggttcagtacttttggaagtaaaggagtgctaaatgggtggatgaggtgggtctgtcaatttggaatgcaagtaacccctagagagtaggctggagctttcttcttctggtgacatatctgtaatcatgtaaatgtcaaatcaatgtgtgttttgtcaactcaaagttgacattatcatctgcatattgctgtaattcattaaagttagtcaaagatatggataagtcagtattccttgcctacttaaggatagcaaaatcgcacatcctcaaggttacctgttccctaaggtatgattggcttgacgaatgtacacataaccgtgtatttctttcttttttttcggagacttaatcttgctctgttgcccaggctggagtgcagtggtgccatcttggctcactgcaa

SEQ ID NO: 59796 - DNA, 1094 bp, Homo sapiens
cccggccgggagctgcccattcttgtaagagtggtgcctgcggtggtattggagcggcatgtgctgtccaggaagctgggaacgttcccctttgagtttgtcttccactcgtaaaagcccagggcctgtgccgtgataggttatggctttcttttttgagacggtgtctcactctgtccctcaggctggtgtgcagtggcatgatctcaggacactgcaacctctatctcccggggtcaagtgattctcccacctcagcctcccgagtagctgggactacagacatgtgccactacagctggctaatttttgtatttttagtagagacggggtttcaccatgttggccaggctggtctcgaacacctgacctcaagtgatctatccgcctcagcctcccaaagtgctgggattacaggtgtgagccaccgtgcctagcccatgataggttttcattcaatgaaatggacatttccctaagtatagcataacagttctagaaggtgcatgtaatgaaagcagttttggggggccaggcagaaaactaacattgatttccccagctgagtcgtgtcaggccactttgtccccgcttcgtagagctcttactccccacgtggtacttttccaggagaggccaagtggctcctacaaagcggcatcgtcatcctccttccacatggctacgatggggctgggccagaccactcatcctgtcgaatagagcgtttcctgcaggtaagggtaacgtcttccggagtcaatgaatcattttcctgcttcctagagcttttctacctcctgcggatagcttaacgcccacctaactgtaacacagcttagtatttgagtgaaacagatttgatgcaatgtcaattttctttggaaacgtaatgcctcaggtataattgtatcacggttttatggcaattaaagttctcttgtgccaggatcagcagttcttataccaggctgatcatcagaatcccccagagagcttttttatttttatttttttttgagatggggtctcgctctgttgcccaggctggagtgcagtggtgcgatcttggctcactgcaacctctgcctctt

SEQ ID NO: 59797 - DNA, 1072 bp, Homo sapiens
aaaaatattaaaattagtcaggtgtggtagcaggcacctgtagtcccagctacttgggaggctctggtgggaggattgcttttgagtccagagtttggggttacagtgtgctatgatcatgccactgaactccagcctgggtgagagaacgagactctgtaacaacaacaaaaataattgtccagattttgtcaactctctttctttcctttcactgcctttggggaagggttaggagttatgcctcagctttctgtcccaccaggatcttctgagatttaacttccttgccctcaatttttcaacctttctattagctgcttttgatttttgtcttaaagcacgcgtgcacacacacacacacacacacacacacacaatcgttttattacattaggaaagtgagattctgatagtgcttccttcccctgtcttaaccctgtagtaatcagaatatgtattttttttaaaaaagtcctttccagattatctttgctatcagccgtgtttgggaacaattgtgttagatgacacagaattgggccagtggagaaagccatcagagctctcctttggttaataccgcaccgttcataaattcacctgctgatatttttctgtaatgttgggcaatagcttttctgctataatcaagaacacctgtgtttccctttggccagcccattgtcactacgactgaaatagatgatctgaacattcttctcctttcttgccacttctctcccagatgtgtgacagtgcggaagagggggtggacggagacactgtgaacatgtttgtggttcacccaacaactcctgcacagtatttccacttgcttaggagacagatggtccggaacttcagaaaaccactcattgttgcttcccctaagatgttactcaggctcccggtaagcagaaggtggtgaataagccttcctccttttgtcattttttgcactccatttttccctattttccatatctaattatatttaaattacagaaacacctttttagtttcaactgactttgctactttcattttttttgttgttttttgagacgca

SEQ ID NO: 59798 - DNA, 1019 bp, Homo sapiens
actgtattcctctaagatgttgggattgatatacgtgatttaatctgcaataggtggaataaccaggggaactggttatgaatatgtgaatgcaaccagcaaatttatccttgaaggtgtgatggtagaaataggaaaacaacaaaagaaaaacaataacaaaaaaagaaagtgtgatggctgggtgcagtggctcacgcctgtaatcccagcactttgggaggcttaggcggctggatcacctgaggtcaggagttcaagaccagcctggtcaacgtggtgaaacgccgtttctactaaaaatatgaaaattagttgggtgtggtggcatgcgcttgtagtctcagctactccggaggctgaggcaggagaattgcttgaacctggaaggcagaggttgcagtgagccgaaatggcgccactgtactccaacctgggcgacagagcaagactccatctcataaattaaaaggaaagtatgatagtgttatggattttagctctgagtgagctggaaaactaggtcattatctagatgatttcagacttgaccctaattgaccatatatgaccaggaaacacttctgagtttacagctccgtggagatgacctcaacactgcctcttgatttgtttgatgcatgtcactttcattaattttccccctcctttttgaaagtcctgtggcagtactaatattttcattttatgtaatctctggtgctgctttccagtcactgtatgaagtgtctccccaacactagcaaatctaggtcctactaaatacaaatctctgggtggatgatcttctagtactgtatttttaaattaaggagttttagttataatgaaattgatttgtagtctgttttgccgtaaacttgtttttctttaaattgttcttacagtgatatcttactatttttaactgtctggggtttctgatatggggatttcagcccctggttaatcagtcttgtccctacaagtccctgatgcagtatgtttatttgtgatgt

SEQ ID NO: 59799 - DNA, 1079 bp, Homo sapiens
ctgaggcaggagaatcccttgaacccgggaggtggaggttgcagtgaatggagatcatgccactgcacttcagcctgggcgatagagcgaaactccgtctcgaaataaacaaacatatatcggtgactgcccatcatttgtagaggcttttttaaaaaagataatatagtcaactttaggcaactacagaaacgtaatcactcacgtcagctttaagacaattttgggatgttggtatatagaatccagtgtctgtaggggaagaaaagccgcagagcctaactaatacctagctgcggcttgtctttctccacattgcagaccctttggcaaaggacagaagcttgagagattgtcattttcaccctccagttctctggcaggacttgacttaagccgtgccagaagacagtgtctatccttaaagaaccttgatttatcttacctttatatgttataagagtagtctgggaaaacaatactttctgatgaaatgtaattgttaattctctgggttgattattttacacaagcaagtacttttctattacctgggagagtaactaggcaatgaaatgtggtctgatgaaatcaaacagagattacataccttttttttttttttttttttttttttttgagacggtctctctctgctgcccaggctggagtgcaatggctccatccgggcttactgcaagctccccctcctggggtcacgccattctcctgcctcagcctcctggggaggggggactacaggggcccgccaccacgccctgctaatttttttttttgtatttttagtagagacgggggttcaccatgttggccaggctggccttgagctcctgacctcaagtgatccgcctttctcggcctcccaaagtgctgggattacaggcgtgagccaacaagcccggcctacatactttaaaaaggtaactacaggggctgggtactgctcacgcctgtaatcccagcactttgggaggccgagacgggcggatcacgaggtcaggagttcgagactagcctgaccaacatggtgaaaccccggctctacgaaaaatataaaa

SEQ ID NO: 59800 - DNA, 1034 bp, Homo sapiens
cctgccacccctgtacccttcggagactccacttctgtcattccatattctatgtccatgtgtacacattgtttagctcctacttttaagtgagagcccacagtgtttgactttccacttctgagttgtttcacttaagataacctcctccagttcgttccatccaggttgctgcaagggacatggtttcattcttttcatggctcagaagtatttcattatttatatacagcatatcttctttatccagtcatcaagaagcatctgtgcatgtgtgtctgtatatatgtgtgcgtgtgtgtatatgtatgagagagaaaaaaatgtttgtaaaactttgtacctaataaacaaaaatgcttcctttataacacataacggacattcccaatttctgtgaattaggccccaaagaataacctcaaaactctgctgccccccaaaaatttgctgtttcttggttttgattgatgattctttacattttgttgtacagatccagtttagagagaaggttctgtggactgctataacgctcttcattttcttagtgtgttgtcaggtatgtaactatactattaaataaatgtctgcaccattgttctaaggttttgattggttagaatttgagaattttttttgttaaaataaagaatacattgagctcaatatattgagcattattatcctttttattttttattattaatttttttttgagatggagtctcactctgttgcccaagctggatgcaggggcatgatctcggctcaccgcaacctctgcctcctgggttcaagtgattcttcttccttggcctcccaagtagctgggactacaggttcctactaccatgcccagctaaagtctcgctctgttgcccaagctggatgcaggggcatgatctcagctcactgcaacctctgcctcctgggttcaagtgactcttcttccttgggctcccaagtagctgtgggactacgggtgcctaccaccatgcccagctaatttttgtatttttgttttattttat

SEQ ID NO: 59801 - DNA, 1104 bp, Homo sapiens
agtgttttttaaattgtggtaaaagtatagaaaatatgccatcttcatcatttttagatgtgcagtttagtaacattaggaatgttcacattgttgtaccaccacactccataagcgatgtatttactagtgaatgcaccaagtgatgatttgttgtttttatttttattttcactttctggttcttttaattattttttttattaacccttatctatgtgatggaatgtttttctttttattttctttttaataaacagctttaccttgaagatatgcttgtttttgttgaagaacataagaatagtttttaaaaaagtattgcaagcagtaagtgaataccttgtaaattaagtgcacactttatactttttttttttgagacagagtctcctgtcacccaggctggagtgcagtggcgtgatctcagctcactgcagcctttgcctcctgggttcaagcgattcttatgcctcagccttatataatacagtttcataaactattttgtgtactattttagatcccactgtttggaatcatgtcatcagattctgcagatcctttctactggatgagagttattctggcttccaatagaggtatgcgtgtcttttctgtctccacactcctactcacagcaaacagatggaaacatgtggattagcaatgagttttcaatgtctacagggagggggaggatatcattgcctagaaaagcctagtatgtagataatgacaacaccgtgtgattaatgtaatcatagagaaatctgttcttgggttttcatggactggaaaaccctgatcttcagtgtcaaagaaggtgatgtccagataacattggaattggagtccaggtggggcgccgtggctcacccctgtaatcccagcactttgggaggccaaggtgggcagatcacctgaggtcaggagtttgagaccagcctggccaacatggtgaaaccccgtctctactaaaaatagaaaaattagccaggtgtgggtatgcacctgtaatcccagctactcaggaggctgaggtaagagaatcgcttgaacctgggagatggaggttgcagtgaactaagatcgcaccactgc

SEQ ID NO: 59802 - DNA, 1694 bp, Homo sapiens
tttgtttttgagatggagtctcactctgttgcccgggctggagtgcagtggcgcaatctcggcttactgcaacctctgccttccaggtttaagcgattctcctgcctcagactcctgagtagctgggattacaggtgcccgccaccacacctggctaatttttgcatttttagtagagacggggtttctccatgttgtcccgttggtctcgaacttctgacctcaggtgatccacacacctcggcctcccaaagtgtggggactgcaggcgtgagccactgtgccaagcctatagtactttttattcagggcattgctgcaggattgtgttaataaatgagaacttttcttagcaagtagtgtttaagaaatgaaaatttgcttgttaaaattttcacgtgtgtttcagttgaggtaattagggagtgcgacacctctaaatcagtttgtatcgtgtacagcaaacattgcacacttctctccccttcctttccaggaactttaatggaattgggtatctccccaattgtaacatctggtttgattatgcagttgttagctggagccaaaatcattgaagttggagatacaccgaaagatagagctttattcaatggagcccagaaacgtgagcattaatgcaattaaagagcattctccaaatttgagagtgctcgtggtaaagatgttttctctagtcttttcttgtctttggtggtaagcgtgctctcctttccccccaactttcatcagtgtttggtatgatcattaccattgggcaagccattgtgtatgtcatgacggggatgtatggggaccctgcagaaatgggtgccggaatctgtctcctgatcatcattcaggtaagaaatcctatattttcctatgcagataacaaaacagtttgattcctttttccttttctaacagttctttaggtgattggcttattcattttcttacttttgaattatttaattctagtattttgatcactgaagtgatacgtgtaaaatttttttaaaaccttctgtcaccgtgacgtgttcaagttgtgttgacgtgaaaaattcaaatttattctaatagcttcataactgcacaatacaaagaattatggatcaattgtattttattgattcttaagatacacatttgtcacattttgatgtctctagaatcaggatgtttttgtacagtaaacagtgccttccacttgcggtctgccaggaggcagtcatggtggtgtcactgcctgtgcgtgtgtcagcctgttcaggtcatgctgaccttagttggctgagtgtgatcttcacagaatgggtgtttgagttcaatcgctgtctaaaggtgttcagaaaatctgttgtgatttgttattgaaatgaaagtttatgtatagaagggcaagctagatgataaatatctaccactaggtctaaaatacgtttttgtaagtagaaaattaaaattctttgcaataaggtattgtgccataagttaattggcagtattcttttcttagtagtacacaaaataatgatgttttacatggtaatgtcttagagtcagtgaaacactgtttatacacacataaatatattccatgggttttttaaatggatgcttaggaatggaatttttaaaggtcaacataattattagtgtcctaagtatctttttttttttttttt

SEQ ID NO: 59803 - DNA, 2638 bp, Homo sapiens
cgggtgcagtggctcacacctgtaatcccagcactttgggaggctgaggcgggcggatcacgaggtcaggagatcgagaccatcctggccaacatggtgaaacgctgtctctaccaaaaatacaaaaattagcagggcgtggtggcaggagcctgtagtcccagctatttgggaggctgaggccgaacccaggaggcggaggttgcagtgagctgagattgcaccactgcactccagcctggcgacagagcgggactccgtctcaaaaactaaaacaaaataaaacgacaaaaattagccaggcgtggcggtgtgtgcctgtaatcccagctactaaggaggctgaggcaggagaatcgcttgaactctggagtcggagtttgcagtgagccgaggtcacaccactgcactccagcctgggcgacagagtgagactctgtctcaaaaaaaaaaaaaaagattaactttgtctttgtctttatttgtccatttacaaatcacttgattggcaaatttacagcccttgggaattagggaaagaggcgcattggatggggagagatgatattctggagtctgattttagtatctttcagggcttagggtttctcttcgtatgctttaggcattgttgaggttatggacaggccaattgttgccttcagttttgtttctttacagcattttctttctgcaatccagagtttagaataatcttgatttttagaagacacttagaactggcatgtagctcgtagaacattatacatcaagaaaagctctctagtatcttacttaaggatctattcagattcctaaggaatctccactgagcgattctcagccagctagctacaggattgacttcttacagagtcagttatggattgaaattgatataaaatagagttaagctattttgctgttcattttcagtattcagaaatcagaaatacttacagtccaagaatgaaacaagtgaagtggatgtacactgattcatttacatgaattctgatacacaaatatgcgtgttatggctaattcttctaatgttaatatataaagaggggtgtcatgtttgattgtaggtgggcagtgacccattggtgtcttttcaaggcgttactaacattgaaaatatgtggatacactgaagagctatgattggatcagtgtgtttcacccagaaacataggttttgaaaactgtttgcatgccgttgtggaaggtatttctcaccttatttgtttatgtttcattcacgtggttagtgtttttcagctagtgagtttagaaatctacatagcaggtcttgactaaaaattttaaaaaactattagagaatatcagtgtgcatggcacataataaaggtaagtatgttttgacatactgaacaaaagatagtttgacaaaactaagttgtgtgtaggtgtcgtgcagggttaaaatgttaagtgccatgtttataccggctcatcatacatgtcgtccattccccgtgaacatgtagcagttagggttctggtcccatcactgtagacgctgctgtcacttcctgggttctcatcccttttcacaggcatgcatgatatttactggcttttattcccttaattatagaaaccgtttctcatttctgtataatttcttcctccctttggaaaaacccaagtttaattttcacaggacatatgtgaaccactctgtagtccgatggtcactgttctgaacagggggtgtggagaattagagttgtttcagagctgctgtgggactctggagaggtcatttctcaaggcccatcacgatgctttctgtggctgatgttcatggacggctgttgcctcctgcataggatgggtttctctatgatggggagtctctgttcactaattacatgattgtggttaaatagaatcggtagtaagtcctaacctctacattattttgtcaaaatgtcgaacttggttttcaagcagtaaaggattagcatgatctctcttagaagtttggagaatcgtaccctttctcctgcccattgaaactcagactaaaagcctgtaaatagacaagttaggctctgtccaactactgaaatggcagttaaggagaaaaacaacactgtgtaaggtaagcatgcctaaaatggtctcatgtggttactttggtcgctcttccagcaggtgatattggataaagtgagtacaaaatgagggtgggcggcttgagagctgggaggaatggaagtgacttcctcacttctgccggagggtgtctttaaagtggggacatgtgtgaggttgggggcatggaagcatattttcttcctgtcttgattaggttatttgagtgcagggaaggggtcatatgactgaggaggtcacttgaagggctagggactgtttttaattaatgcatacttttacaggaatgtcttctccaagaagcaagttcagaattttcaatatcccataaattaaagtcagtatgctttcatttttaaaaacaatatgagcttaaccttaaccgtcttcaaatttacattcaatctttgtcactatgtgtatagaatgcatttttacattgctgctcgagtacgtatttgagtacatatttgtgttctagttttttatt

SEQ ID NO: 59804 - DNA, 1748 bp, Homo sapiens
tttcaaaggatcaacacagcccttagacttatcctttgatggcagtgtacatttccatcttgctattataccagaattcatctgactttttacttccttggaggtatttgggatgttttcagtttcttgctgtcataaattctagaatactgtgatcattttttgtttcagtgtgcttttcaaacaggctttatttaaacattgcaaaagaaactattcagataagtgtaaatagactttaaaagttgaaatgtctgctttataatacaacagtatttccagtcctcttactgttctagattggcctgagtaaatgaaagcaggccaaaagatgcagttggtcatcacagtgagattgcaacgatcaggccttaatattcaaaacgcccctagcttggaaatagccaatggtgttcctctccccctttcttgagtttgttcttgcttccgcttacttgcatttctttccccacagttgtttgttgctggtttgattgtgctgctgttagatgagctgctacagaagggttacggcttggggtctgggatttccctctttattgccaccaacatctgtgagaccattgtctggaaggcctttagtcccactaccattaacactggcagaggtacatcgcacagcgactgcaactgcacgcgttttgctggatgtgtgctgggaacaaacccatcgtgtcgcagtacatgcctagagccgttctggtttgctctcctaggggataaggaatgcgaattcttcaaaacttaatgagcagagatttgtggagtaagcaatactacctcagagagaatagtatcaaaattttagcctctgcttatttaaaatttcagtggttgcaaacagattttcaaaatttcttttgttaaccttgcttaaggcattgctgcagaagtcatttatttgactgatttcagcatccgtagggggataaaaaggtagtggattttagatttttcaaatgaaaagactgttgttcattgaatccacctggagcactcctactctgctgctcttctaattggctttgtaatagcaccaaagttttgaaatatttcattctctctttccccttcctcatctccacttctaacagatactgtcctaagtggttaatacctaaactctgatcccagccttaagaaaactgtaatgatgattaatgttcttggtgcggtaaacttcgaggcaggctcgatagagtgacatctgtctcttattctgacatctctgctctgcttcgctgctgtttatttttcctaaaaacactctctcccttccctgaagtagaggagaggcaaatctctatgaatgaaattttgctttggtaaattttacgttgtatgttttcttcaagaatagtctcttgagaaaacttcggatttatgctataaaaacatagatttgcctcaatgatctaaatatttgtagaacctgctcacatggctatatcataaagcaaacattggcgaattcttttgacccatattttctgctgtatactggactttcacggttagttgtttgagctttgggacagctttggacgatgagtccacaggtcgtgtctgtcttgattttacaggtactgagtttgagggtgcagtcatagctctgttccatttgttggccaccaggacggacaaagtccgagctttacgggaggctttttatcggcagaacttacccaatctcatgaacctcattgctacagtttttgtgtttgctg

SEQ ID NO: 59805 - DNA, 2186 bp, Homo sapiens
gttaaagtcttatgtcagtattttagttgattgcattaatattttcatatggaaggatcattcatagggatcttaatgtactgactggatactctcatagctcagaaaatttcagattttaagtataatcagaggttgattgtaaatgtaatcatattcctattttcagtaatggaagattttgtaatatattacaatttttaaaaatgactcaatattttcacagtgtcttgcatgtaataggtgttcatcgtataactttgaaggagtgaaggtagtagacacaaaagtacattctgaaactacatagaatgactagctgtagatgccttgaacttaaaacactgtcatttctgagaagtttgaagtgacatgcaaatgtattcctgactaattaggttgaccacttgttctttgtactcctgttctgtaggatgtcagtgggggaggacccgcacgttcttacccagttggaggcctttgttactatctttctcctcctgagtccatgggcgccatctttgaggatcctgtccatgtcgttgtttatatcatcttcatgttggggtcatgtgcattcttctctaagacatggattgaagtgtctggttcctcagccaaagatgtaagtgtttggtttattttaaaataaaactcttggcaatgcatggtggcgcacatctgtaatcgtagcactttggcaggctgaggccgctggatcgcttcacctcaggagttttgagaccagcctgggcaacatagcgagaccccgtcatgactaaaaaaatacaaataaaaatcggccgggcacggtggtgcaagcccgtggtcccagctacttgggaagttgagacggagcagtaacgcttgagtccgggaggtggaggttgcagtgagccaagattgcaccactgcactccagcctgggtgacagagcgagatcctgtctcaaaaaaataaaaaaggccaggcgcagtggttcacgcctgtaatcccagcacttcgggaggccgaggtgggcagatcccatgggtaggagatcgagaccatcctggtcagcatggtaaaaccctttctctactaaaaatacaaaaattagctgggcgtggcagcgcatgcctgtaatcccagccactcaggaggctgaggcaggagaatcgcttgaacctgggagtcggaggttgcagtgagctgagatcgtgccactgaactccagcctggcgacagagctagactccgtctccaaaataaataaataaatagataaataaaaaatttttaaaaaagtaaaataaaactttgtttttggaaaattcatatttaattgtcaaaacagtagtggatacactcctttataacttaagctttaatttatacatttttaatgagtcagtgtcaccccaacaggctaaaaattggttcccaaaaggtaaaaaattcttagatattacagtggtttgcaaccctcctgcaaaacaaaatcttgtttggtaattgaagaagggttgagaagcaccggtttcatatgggtaacatggagcggaggagcactgaagctttggtttcctcaggcttaatgcgaatgatatgacaatgcaactttcaggttattgtatgttacgtgttagtgtgtggcgagcacttcgcatagaacgtggtagatgtaagcagtgaaatgttccagttggattttgaaagtcgtttttctctcggcaggtagctaaacagctgaaagaacagcagatggtaatgaggggccaccgagatacctctatggttcatgagcttaataggtaaggctgctagactgacacctttataggcctgtgtttgtgtttcagtctttcagtgttggctaaatgtttttctttgttcaagttcatatttaaaacccttctattcacacagatgaatcaaaatttcacacaaaacttgttttccatgtcaaaaccaacacctgaatttttcattgaaattgtgagcactgctctgctcatcccagtgataaaatcttgcagatcagtgctgttctcagcattggctggctgcacatacaatcaccagagagcttttaaaaaggatttcccaggaactgtggcttatttggtctggggtgagttccaggcatcagggttttattttttggtaacagctttattgagataaaattcagataccatgtaatt

SEQ ID NO: 59806 - DNA, 1965 bp, Homo sapiens
tgtgcagccaaaggttgaattactgaaatggatcctcaaaatcttatgacataaatttgttcatacctactcttcattccacaagagggaacgaaaggttactcatttaaaaatcttaaacattttaatatttaaatctgtccaggaatctcatgtcctgtaagattacatattgtctttcttggctgttgactggttcctggaaattagggtcagagtctttgcctggatcagagctcctgttcccatgccgtgccctgcacacccctccacactgcagcctgttccctctggagttcagggaggctttagacccagctatggctgctgcgcctcgacctgtcttcgtctctagctgccgtgctgttcctggtctctgctgccgcctaacttggggttctgtctcctaggtacatccccaccgcagctgcgtttggcggtttgtgcattggcgccctgtcagtgctggctgacttcctgggggccattggatctggcactggaattctgctagcagtcactattatttaccagtattttgaaatatttgttaaagaacaggccgaagttggtgggatgggtgctttgtttttctaaatgttcaaatatttcattttgtgcgtgtgaaagggaaaacactttgacggatcgtttttgtcagatgacactggtggctccccttttctcccctcacagtttcttgtttcgagtgctgactgacccgtttctgaaatgggcaccgagctaagtctgtgtgcagcattagtacccgctgccttaaaactcaagtttacattattcattaaaaaaagtacatctagtgttgcctgtaatgctggaaaccagtgtatctaccttgctgtgttaaatcatgacagtgagacggtgagatggattcgttttgcacacaacattcaaaacacttcatattgcccccacttgttgaaaaataaatgtagttcaaattgccactttccagtatttttgagcttatttaatgagttctggaacatttatatctaatctatattttagataattactttttatacttttttaactcatggtatccccactccccacccccacctcatttttatttgtcccttctcaaagcagccacttagcccacatgggcgaaatcaagtctccagttatttctgccacaactgcttctaaggcctcctccttctcctcctcctcttcctcttcctccttttccttctcctcctcctctcttcccagtgacagcatcatcgtgctgtttgcctgtattggctatgccttctaactccaaccagtcacttgagaatattctttcaagattctgggccccgattcttttctgtttaaatccctaaagcaaagatctaattctcaagcaatgtctgtagttcagtgggggtgaacaatgaatatattcatgctaggaatttgtgtctgttgttgtactcacagcagcaacatgagtgtaaacagtagacaataaacttttatttaagaaaactgattcagttgtgttggaaaaaataaagaaatctgatattaaacgttttctaagatcatttgtataggttcagtgtattcataagaagtccaccctgagatgcctgtaaaagtcaaatgtaattacacttcaaactttaatcctaaattattgacagatagatagatagtgaccaacttaagggtaatcatatatgtgactaacatttgggaggaaacaggaaaacagtggtctcaaaacaacaatatcccagtctccatttgaaagagcatagatcttggtaaatcattttgaaaactatgtgctttatttcccaaaagatcaaacttaatttttaaaagacacccttttcagaagtatgggttttcattgctgtttagtttcttaggtgtggtatgtcttacgtagcttatgcttacaaagccaaataatcgcagggcaaggcagataaaggcagg

SEQ ID NO: 59807 - DNA, 1064 bp, Homo sapiens
gcactttgggaggctgaggcgggtggatcacgaggtcaggagatcgaaaccatcctggccaacatggcaaaaaccccgtctctactaaaaatacaaaaattagctgggcgtggtggcgtgcgcctatagtcccagctactggggaggctgaggcaggagaatcgcttaaacccaggaggcagaggttgcagtgagccgagatcacgccattgccctctagcttgggcaacagagcgagactgtctcaccaaaaaaaaaaaaaatcattatccctgatgttcttgtctcatgctaggaatgtaatcttgcctttatagtctttattctttaagatccttatagaccaaaaaaaacgttatcaccagcatctagcataggaagtgacatatagtagtacctgctgcgcaaacactgattgaataagatgttttgtccttccttaacggcatgatctaagttgttttctttgctttccacagctctggtagctgaagaacatctcacagtggacgccagggtctattcctacgctctagcactgaaacatgcaaatgcaaagccatttgaagtgcccttcttgaaattttaagcccaaatatgacactggccatttttgtaaacgagaccaccaggccttcttcactaagactttgtattcaacttagtttaatgtagatttgccattagctttttcgtaaaataaaagcacagaacagatgtggtggtggtatggaattgtaattacaggtaggttgtgaccttcctttaaatttgttataactccagctaaaattaacaaagaatataaatgcaagtatgtttactccaatttttttaaagctcaacagcagttaactacagctcagttacttttctagtccagtctggtagacaggggtatttgtatagagaaatagacctgagttctcaattaggtcatttccactctcaacccccaatataaaattctaagctgggtatgcaaataaccatgtactccgttagtgtttaaaacagcgttaaaaagaaaaaaaaggctttttggcctcttctaattgaatttt

SEQ ID NO: 59808 - DNA, 1542 bp, Homo sapiens
tctacgtatctgggtgcccagaatagacaaactgatagaggaagacagtagagtaagcgctactagggatggggaattagtgttgagtggatcccgagtttctgttgggtgtcatgaaaagttctggagatggatactggtggtggttgtgcacctttttgaatgttatttaatgctactgaattgtaccttcatagtggttaaaaggtaagtttttatatgttctgtatattttacataatacgcagattcatatctataaaaatatacatactatcgaatatgctttaaattttgctacttaacattatgtggagaacaataacttcatactgctcgagtttgacaatgtatataaattaagttagcagaaacccaggcttctgtgaaattctcaaagcctttttgacgcctcttgtataaaagtcttccgatgttaccactccaggccttgctgaaatgttttccttctgtttatttccaggggatggaggtatgttctgcaactcctggtggccgagcgtgtatgacttagtgtagtggtgatggctgcagacattttgggttgttttggtaggctcttgacgttagctttgttttcacttgcactttgtctgtttagagtttgtggaagtcatttctttacccaagaatgacctgctgcagagacttgatggtaagcattctccagaccgccacccagtttctccagttctccccgtccccatcccagcaaactgggtactaaatataactccatttctttatcttttttgtatcactaaagtcaaatgcctagcaacttgtaaaactgcaggtgaccactactaattttcctttctgggtggcacagagtttgaaaataagagcaaagcattctgggtcaagtgcaaacttttggtagaggctttttctcctacagaatggcccagatgacattcctgctgagtagccaaaacgattctacactttaaaccttcagtccatagcaatgcaaaggtgtgggtagataagctgttagcttttcctcaagtatgctagtatgagggatggtcctttgtggaggctgtatgttcaaggagaaattgatgatgctccttcaacaaatacttgaggtatttcctgtatactccgtgtgatatgcttttcacataataaaccaaaccagctgtgtggcccttagaaatcactggtcatgtagatgcattgtataattcttggccacccatcttttagagactttgtaaacagtaagcttatggggagaaaagtcctttgataaaaccacgagaggagatactgtatggagacatgaggagatactgtgtggagacgaggagatactgtatggagacataccatgggcccttcaaggagcacctctgtatgggctggcaaatccctttcactcatctagaaagaagcagacacttgtcatcatgggaatattttattgggtataagtgttttaggtaattgataactgatttttctactgtttttaagtgattacttcaaatgtgatttgaagcattgtttggc

SEQ ID NO: 59809 - DNA, 1025 bp, Homo sapiens
ctgggcaacagtgtgagactcccatcttcaaaaaaaaaaaaaaaaagagttccaatcctcaggtttctctgtaagaccacttttcacagtgctccgattctcctaacgtagtgcagcagcaggtgtgttacaagaatgaggggttcagccgggcgcagtggctcacacctgtaatcccagcactttgggaggctgacgtgggtggatcatgagatcaagaattcaagaccagcctggctaagatggtgaaaccccatctctactaaaaatacaaaaaattagctgggcgtggtggcacgcgcctgtaatcccagctactctggaggctgaagcagagaattgcttaaacctggacgggcggaggttgcagtgggccgagatcgcaccactgcactccagcctgggcgacagagtgagactccatctcaaaaaaaaaaaaaggagggtttaaagaaccggatttcccgctcccatcacaccaatgatttggacttgcaggtctcatagatgatggtgaaaccccagaagcagctgctctccgggagcttgaagaagaaactggctacaaaggggacattgccgaatgttctccaggttggtattgcttgaaaattcaccaagtgatggattcctccgtctgggaagggattgattatttgggtgttctttacgctcagaattcactgaagagaaagaaatcacagattaggactggtcaccaagtgtaagggaatctcccctcccaggaggaaactggagccagaagggcctgaagttgggggagaattaatgaaattaaattgccttttggctggatgtggtggctcatgcctgtaatcccagcactttgggaggccgaggcaggtggatcacctgaggtcaggagttcgagaccagcctgaccaacatggtgaaacccatctctactaaaaatacaaaaattagccgggtggcgcacacctgtgatcccagctactcgggaggctgaggcaggagaattgaacccaggaggcagaggttgcagt

SEQ ID NO: 59810 - DNA, 1869 bp, Homo sapiens
aagtaggggcacttgcctacatttaataattcttccattaataaatgggaaggttctaccttcttaaattgtgtgttttaggtcacatattttaaaaatcaaaatgatatgaaaatctcaatagttcacgttgtccatagtagcttttgttcctagagacggggtgagtcttttcctatggcttcatttgcattacctgcttattaatctgtcactggctgtgctccttgcccagagacataggatccaaactaaagttttctgagaaagcggcagctcacatgcttagcaggctttctgtttcgggggcacccagaaggtgaggtgtagggtggcaagagttttcgttgttaattttcagaagctataggaaagcagaattagcttctttaatgcagacgtttattgctgtggtcttcttgaccagtatcatgagtacatttgcatgcattgcatttaagaagttctggttgtacagagaaaacctaagaaaattctcttctgtagcactaatgacttttttttcttctctgcctgaacagaacttgggaatcagtgaaacgtacaaccaggaaagagcagactgcggatggtaggagtgcaaacctattccaaccctttagaaaggaagttagcacttgtgatcgtaagagggttttcaatggaaccaagttaacttctattaggatgttgtgtctttaaatctccgcttaggttttgccatactatgtaacgaaattaagctttctttataagtaacttctggcttctgttatctaagcccaaaacattgtttttgaggggaagttgttctaatgtttataactaaatgtaaatcaatatagtttgaagccacacctgtgtctagacgtgttatgacttctagaagtccttgtgtcctgttggaaggatctagatgagaggctttagtttggaaagttacttggcacaccttcatgcttatggaccacttgctttacaggttgatgaggacacggaattaattgggcaaagcctattccattcaccctcccctccaggcatgaatgccttgactgcaaagagcctacaaacaatcctgagaatcactctggtcgaggggaagttgggcactaggcttttcttatttttccatttagttttggtttccatttttgctggaagcaaacagtagctatgctgctgctgctggcttcacagataggaagctgtggggagccaggggaccctcctgggtgctttgtgttttctgaaacccagtcgtttttgtttttcttaggttttaatgaaggccaagtaacttgagaggaaaggtcttttaccctaaaactggaaaatcagtcttgctagcatttattgcagacagtggaacttacttgatttcttgctcaaagttgacccaggagcacagggatggctgtggcctcaccagtggtagggctgccacacgctggaaagtggttctgtggaaggtcagtgtagtcagaaaccttacatccttgaccctgtaggaaatgtttcgttttattccgattttagtttaagaaactgtgacaattaaacagcctttttgtttaaaaaagaaagtgtaaacaacatggaagtgatgatttttaattacatttttaaaatagcttccaatattaactgccagtattgtagattaaaacggagtttcttaaagtctggggttttcattagcttgctctaaacaatgtgctggcattgctgacctctcattagggatttccttggttccatttcctggtgacaggtgtcgcggtcatccccgtgctgcagagaacacttcactatgagtgtatcgttctggtgaaacagttccgaccaccaatggggggctactgcata

SEQ ID NO: 59811 - DNA, 1813 bp, Homo sapiens
actcccacagagggtcatgaaatggcatgtgtgcagaccggatgcccagcagcagttccccacaacaccctacacagggctgagacctatgtgcatgactcattgtggggttctttggcttatttcctgctctgtggggtaaagatactgttcaaaatgtcaaaaaggcctgcatgacacccagagggtaaggcaaatatttcaaaatctgaaaaaccaaactctgaaacacttccggcccctcgtttcgggtaaggaatactcaacctgtacagctgtcacttggtgtctgtcggggttggttccaggaccccctgcagataccaaaatccacagatgctgaagtccctgatatgaaaatgcagatactcagtatgtatttgcctctaacctatgcacatcctcccacgcacttcatctctagagtaatcacagcacctaatacaatgcaaatgctgtgtcaacagtcgtactctattgtttagggaataatggcaagaaaaagtgtggacctgttcagtatagatgcaatttttttcctaaatattttcaatgggtggttggttgaatccatgaatgcagaacccacggatatgaagggccgagtctaagagataaaatagcagctagagaatcctatgttccaccgtctcattcatgaaaggggatgtggggttaattttagaaatataaaaatattccagtagtgttgtgtctattgacattcaagacagtgccgaagtcaccctctgaccctcccgcctcttgtgttggtgaactagagggaggaaggccaacaggcttttccataacaaagaagactaggaataggatgatctcactggaagcagaatcctaaagctagaagaggttttggagaaaacatactcattcctgctttttacaaaggagggaagagcctcagggaggctggagctctgggcttagctggcgggcaagtagagacgaagagctgacttccagtcagctgtgcatctcacaggccctttgaagttgttggagctctcactgggcaatcttattccgagatttcttatcaatgcgtttctgttttattgctggtgatttatggctcgttactgcttgtttccttcaccttaaccacgataatgatgctcctctttttgtttcccttattcctagtgtttgggatgggaccttcagtgcttttcccagcactgtcttcttcagtctttaggactaaccttaggaggcagcagagagagctatgccaaaaggtgttcatctcttgcaatctgtatgatttacttaccagcattgcttgttggtcagctccttgctactaacaggaatgttgggctgctgtgagttgtcatagaagtctgtttgattttcctgtgttcattttgacatatttggccttcggaatttgggtacaatgctgaaagacctacaatttccagacagtctttttgttttgttttttaaaaagcaaattaaatatttgaacaattttaatgaaaatatgacaaggtccaaattttaaggacagccggataggaagcatgagcaggagggttccgaggaggatatcttgcagctcttactatcgagatgcaggtggtaactcctttttatcccaagccccagagccacccacatgtttcacttcctttaaaagagatcctaaaattgtttgcttctccactctggtctcttaccactgcttttttctgttgtagggagaagagagtgaagggagaatgttccttttatgcctcgcccctttaaactgcataattgtgtcagtaactgggtttcctgtacaact

SEQ ID NO: 59812 - DNA, 1123 bp, Homo sapiens
cgctctgtcgcccaggctggagtacagtggtgcagtctcggctcactgcaaccacctcctcccgggctcaagcaattctcctgtctcagcctccggggtagctgggattacaggcgcatgccaccacgctgggctaatttttgtatttttagtagagacggggtttcacaatgttggccaggctggtctcgaactcttgacctcaagtgatccacccaccttggcctcccaaagtaatgggattacaggcgtgagccactgcgcttggcctcaaacacatgtttagactcattagagttgagggctatgttttgtgttataaacttaatttgacaggcaaaagagaaccaaactgtatcactatacattgggttccaacctctctatagtttcacaaatataaatacatttgaacatatggtgctccctaagacttgggccttgccacatttctgtatcgggtttgggccctacttattttgtacatttagttttccatatcaaactcacttggcatcttaagtgaagagttacagtctttcatggttggtggatcatactgtgcttagctttcttactgctgggttttaattcagcagtgctatctatctcttaacatgtttcctacagctctcccacattaggccttattaagggctttgctagtttagtagatataatcacagttgttcagatgactggcaagcccatgtatttgcatcttgacgatctatttcatcacaaagaaatcatgtactcttattggatcactttgcaaatggagttctcatactgatgaatttttatcacgtgatctggttactaaatttcatcctcattctgttgtactccatttaaatttcactaagtaaaaaattaattttcatagtattttcttcttatagtttataatatcaaaagattgctatgcaaaaatctggaaagtaaaagaaaaaaggttaaccacacagcttttttcccattttgctataattttccttccggctttttcttacacgttatttggcagagtttgaaaagcatatacatacttttctactttgttatcaacttaggagcttttcccatattgctaggttgtcttcagaatctgctttttaga

SEQ ID NO: 59813 - DNA, 1035 bp, Homo sapiens
cagttttgtttgtttcgttaaaagaatgagaagtaactagctgcttttatttatttatttgagacggagtctcactctgtgcccagattggagtgcagtggcgcaatcttggctcactgcaacctccgcctcctgggtttaagtgattctcctgccttagcttctcgagtagctgagagcgcgcgcgcgccactacgccggctaatttttgtgtttttagtagagacggcgtttcaccatatttgccaggctggtctcgaactcctaaccttaggtgatctgcccgcctcagcctcccaaagtgctgggtttacaaggcgtgagccacggccccgggcctaccaaccagccgcttttaacccctagtcgtgtcgcttaccacacgagctttaggcttgcgcgaggcatctgcgtctaaaagtatctccttaaatgtacattcttcctggttcacctaagtagttttaaattagaaacagccccaccgactgcaggcctcttcagaagggtgttccttagaataataaacaattatctgcgtattttgagttagaaactcttccccccaggaatatatacattgttttgggttgtgttttgtttttctcaaaaatgttactggctaagtggctagttggaagcagtgctttaaagaatacattttcaaagcagaggtaaatagattataatgttgcagagtatgttggtggggatggacagtcatgattcatcatttatgccttgatccggaactatgcagtcctttctgatttgagggaaagaagcaatattgtatatatgtctggagggtggtgccagaaagacttaatggcagacaggagcagtcgctcaaataattgttttgatttgacttagaaagtaaaaaattgcgcggaaggagatgttagcatcgatgggggatttatttaggtcagatgttttctaatgaagataggaatgaatgtacggaagagaatagatcccgggaacatagcccttctgcgaggagcagtactttaacagcccaagaaacat

SEQ ID NO: 59814 - DNA, 1893 bp, Homo sapiens
ttattatttcaaggtaaaaaacaaattatcccataagtttttaagagacttcaggtatggctttgccatccttaattatgattacctgaaacaaattaagctaaagcatgcctagtttaagcagctttatatctctggtgatcagttgaatagaaagccagcaagacacatccaaaagtatcatgaattcttagcggtaggtgctcactgccaacccaagaatggtttccagatcttgactctacttctgccctctatctttagaaggtgaccaaatgctagtcatcttctagttgggtttgctgcatttcctgtgttgcagcaaatatctgctggtctctgatttcttaaagacacataaatgttgtgctcactcagaatccttttgagcttgttgctttcatactgtgatttccatctggtggtttggatttggctggtttttgtttactacaaagaccattgtggcaataagatgaaccgcagtaatcttattattctgatttcttgtctactgctaccaaatgtacatcattaacattttctactttatattaaaagaaagacaattccaaaattaatcaagtgtagagatttttctctctgcttatagttggtcttttaaaatgatgccttttttggtgttttttttttagtgtcattcttccacttcctcagaatgtgaaggattatttactcgatgatggaactctggtggtttcaggaaggtaaagtattttagaaaaaaatttcttaaactttatcataaagaaacacataaaatgaatgaattagcttaggcaccattctttccctttagctctttttctctcctagccaaaatgatgtgctgatctttgtctcatattccttctcaatgttcacttaatattttcaacattaagtacttttccctctaataattacaagttgtgaaattgagcagttcctttcatctctgtctttagaaaacagttatgatgacaacttttccttctgacggtagcagggtgggggaagtacatattaaaattctttgagatccttcagttttgacgattaaaaattcactgttgcaaacaggctttatcatctaattcctcaacattttcttccccacgattgaactaccgtggccccccctccactttctagaagctgttcaggtagtttccctatttatagaataaagggaagaagttactgtgtttcagtcttttggatgcaaacttgaaaacgttgaagaatcataggatttagtgaagttctcattttttaattcgagtctgctcagaagtcacgttatgagtgttcagccctcaccagcctttctaaaatagcctgacagtaaccctatgccctgacctcccttcatttttctgcataacacttacttccacctgacaattgttaattgttccattagaatgcagtttcatgaaaacagggacttggcccatttgttcaccccagctcatggaacagtgcctgatatagcagaagtgcttgataaacatttgttggatgaaggaactatagaaatacagtaagaattgtgtgttttcagtactactaactggaccccatatttttgcctgttgggtttttagtgtggttttctggattatatttctgtttttggtattcacagagcctcaataacctgaaaattattaatgtagcgcctcattaactttgaataatttgaggctgaggaaacagtaggaaagtcagataagtctcaactttaggatatttacagatataattttttttgttttgtttttcttttgagacagagtctcgctctgtcacccaggctggagtgcagtggcgtgatctcagctcacttcaaggtctgcctcccgggttcacgctattctcctgcctcag

SEQ ID NO: 59815 - DNA, 1083 bp, Homo sapiens
agacatccaacagactcaacttttagaaattgtatagagtagttgccctgaacttttcaaaaacgtcaaggtcataaatggtaagaacaacagagagaggaactgccacagattgaagaagattaaagggacctgacaactagatttagtccatgattctggctagactggatgcctggaccagaaaaaaagtttcagttttttttttttctgtagaagacgttactaggacacttggcaaattttgaataagatctgtattgtgtcagtgttagttccgtgattttgatagataatttatagaaaatggtaaaatcatgactcatataaaactctttaatgcgtgttgaagatgttatttaactcatgagggaaccagacagattgttagaactggttcaaaagagaatccaaagaaaagatatatttttagatcaggaatattgaaatgagtatgtaaatgaggcaaaactggttttgcctccctgcagtatgggagaaaagacaattggacctcttccagatgagatagaaattgcctgtccgtaagaattagttcatgtcactatcacttacctagaatttgccaagttgtaaagtagctcacagacctggctaaaaacagataacctagaaggttgtgctgtatgtaaacagtacatagtcttccacttaagactgtgcataaactttttataatttaaatttgttttaggattcttatggcaggttatcctaaagttgaataattttgaggatttgaggggactgatcacatcttttaaaaggcatacatgaaaagtaatccttagatgtcaagctttatgggataggaaaattaaattgctttgtctttgaaagttgaattctttcccgttgtaaagtttgtgcaacaatgccgttcataggaaatactgccagtgcccatctcacagaagtggggtttatggctagagcggtaggggagccaagtcagccgcttcaggcaattataaggaaatgccctcacataaatcataattgctttggatggggagagatgaatggaaaataaaggactcagtgctgctgttcattttgaaa

SEQ ID NO: 59816 - DNA, 1051 bp, Homo sapiens
ccatttaaagttgtagtggttcagaatagctcacctccttctctttcagatttgatagacgtggggtgtaactgctccagccgccaaagttcaagtgtttggctgccactccccagaaacgggaagagtggaaattgatctctcttttcttggagagtagctggtcaggctatttctttactaccttaatcttgtagccaaaatgtcgatgtttctgatacctcattttcttctcttctattatcagtaagaaaaacactgggaagtacttaggcctgggctgaaatgtgaggaccctgacatctcagtgttcataaccaagtgtctgaaatgcagtggtgacgctttttgttgttaagcataatttaacatttgacagtactgcttaaatttacttgactttcttccttaaacccttgaagtgatatgcattattgattttgttataggcctgagcattcatagcagccaacatggaatatggactaaatagcatgtgcttcattctttaggatgcgtattggatagcaatgaatagttctctgaaatgtaaaaccctcagcgacatctttctgcttttcaagagttccgatttcatcactcgtgacttcactcagccgtaagtatctcttattctctcatgtcaatagtttcagtatttgtgcaaatttctctatagatgaaattccattacttatagtactattataaatcatagctccatataacaaagctatttcatattgccaaaatgacctgttaaagcaaatctttcttttccctttatagaaaatggtgtataatgaatatctgaaaatgttaaggacttcctgcgtctctgcccattaaacatttcagtaattttttttctattataaaactgataaatatttatcatagaaaagcaaaattagggattacagctaaataaaaacaggaaatataaaagctctcatggccgggcgcggtggctcacgcctgggattcccagcactttgggaggccaagacaggtggatcacctgaggtcaggagttcaagaccagcctggc

SEQ ID NO: 59817 - DNA, 1023 bp, Homo sapiens
ccacctcagcctcccaaagtgctgggattacaggcgtgagtcaccgcacccagtccaaaaataattttcttaaataatagaaaacgtatagaggaaagctctagatacatgtagtacttatcaatatgctgatccttgggggcgaaagggcagttttttaaaggataaaaataattagttaatttttattaacttgtgagagttcatgaccttaatttttgaggcaggatctcactctgggctagagtgcaatggtgtgatcatagcttactgcagcctcaaactccggagctcaagtgatcttcccgcctcagccttctgagtagctgggatgacaggcttgagcctccgtaccggctaatttttatattttttttagaggcgggacctagctttgttgcccaggctggtctcaaactcctggctttaggcagtcttcccacctcagccttccaaagtgttgggattacaggtgtgagccctgtgcccagtccttaatttttattgacgtaaaataactgttaagcttaattattattaaaataatttttaatcgaaagctagttttctagttttagattattagtcctcaagataatgtactgttaagttagtttgatttgaaataagagatttttgctttacagagaaaaactaggttgtttttagttttttttttttttgaaacggtgtcttactcggtcacccaggctggagtgcagtggcgcaatctcggctcactgcaacctccgcctcctggattcaagcagttctcctatctcagcctcctgagtagctgggactacaggtgtacaccaccaggcctggctaatgtttttctttttttgagatggagttttactcttgttgcccaggctggagtgcaacggcgcgatcttggcttaccacaacctctgcctcccaggttcaagcgattctcctgcctcagcctcccatgtagctgggattacaggcatgcaccaccacacccagctaattttgtatttttagtagagatgagtt

SEQ ID NO: 59818 - DNA, 1084 bp, Homo sapiens
ttggccaggctggtgtcaaactcctgacctcaagtgatccacctgccttggcctcccaaagtggtgggattacaggcatgaaccactgcacccatcctggggtacatggcatgttttgatacaaacaggccatgcctaattatcacatcatgtaaagtggggtatctgttccactcaaacatgtatccatcctttgtgttacaaatgatccagttacactctagttattttaaaatgtacaattaaatcgttgttgactgtagtcaccctgttgtgctgtcaaatactagaccagctatagaaatgatcctggaaggtacagtcttgctcataacattgtttcgatgattaaatgagttcatatctcaggctgcctaggctaatgcaaagcattgaatacggctcagtaagtgttcgtcgaatttgagttagtctcctgtttctggatgcttttagtaaaacgttactctcatgttaaatatatgttaagtgtgtgcataaactggcaccagtaacaaaaagattcagttgccttttcttcttcttccaaaggtttattcattgtactgatgattctccagatccatgtatagaatatgaggtaagaagcttattttctttgataattgtagatgaagatgtgttgagaattgctatttattcttaagtgaaatgaaatgaatgaagtttcttggattaatttcttcgggaacctaaagccactgaaattttaaatttatgaaatatacacataaaaggatatatattatatatagagtgtatataccaaatacatgtatgcagtatacacttgctacaggatatacgcagacacctttaatagaacaaacacctttatacgcctcacaggtgcacctaattgtttcagcattttaccatttttatattgttcactcaccttacaaataacttaataagaggataggccgggcgtggtggctcacgcctgtaatcccagcactttgagaggccgaggtgggtggatcatctgagatcaggagtgcgagaccagcctggccatcatggcgaaaccccgcatctctactaaaaatacaaaaattag

SEQ ID NO: 59819 - DNA, 1069 bp, Homo sapiens
agaaattttgatgagtttaaacatagtaagcctcaatttttattccagattttcctagttttgaaagtatacacacaacacacacgcacataccctgatctggaccaggttcttagctacaactaactgctcatcaactgtcatgaatggatctgaaacataacttttttttctttttttcttttttgagatacagttttgctctgttgcccaggctggaatgcagtggcgcgatctcagctcactgaaacctctgcctcctggactaaagcaattctcctgcctcagcctcccgagtagctgggattacaggtgtgcacaaccaccatccagctaatttttgtatttttagtagagactgggtttcaccatgttggccaggctggtctcgaactcctgacctcaagtgaaacgcctgcctcagcctcccaaaatgctgggattacaggcgtgaaccactgcgccctgcctttttttaaatgcagactccacgtttcaactccgattcctggtccttcttccacttgcactgtcaaaatgcaaacttttagaaactttgacggctcatagtttgttgcaaagaggatggccatctttgctccataattgcatttttacatttatgtgaaaattacattttcatttttggtcatataacaccaattcgaattagtgcagtaattttaaaatctgtctttagtgtctgtttgcttctagctacttttttatatatgtacacatgctttcaaaatttgtctgttgactcactgcattgagtaatttttaatgtgttgactgtagatattgatgtatcttttaggattataccatatacatggaacagttaatttactagttaagttactccttaccaagccaccaattactagatcttagagtgcttgtaggtgagattcttatatacaacttgtgagattttttcccctcacttaatagcatagtgtgagcattttcccagcttattaaacactcctataactttatataatatagtcacagctattgcttcacgcaacgaacatctgtctattaagtacctggctgtggt

SEQ ID NO: 59820 - DNA, 1019 bp, Homo sapiens
tgggaggctgaggcaggagaatcgcttctcgggcagcagaggttgcagtgagccgagatcgtgccactgcactccagcctgggcaatagagtgagactccgtctcaaaacaaaacaaaacaaaacaaaacaaaacaaaaagtaaattcttccagaagtaagaagacatggcaatgtaggacttcaggattcacctgttcatatgaatccttacagctgggtcgtgtgtaatgccgtacccatcagggtgatcttctaatctactttaatggttctttccacaaaatgtttaaatcacgtattgatgtttttgaaaagaatattgtataataacaggatgtaaaatattttcttgtcaggtatttctcaaagagactacacacaatactatgatcatatttctaaacaaaaggaagaaattcgcagatgcatacaagactttttcaagaaacacatacagtacaaattcttagatgaagactgtgagtatttttttattgatccagtaaaatgaaatgaaatatacattgttactggaccttatttactatggtgtgtatcctaataactagatttgaaatactgtattgtaagcattttactatattattatttgttatttttgatagtttgtatgttaatttctttttattattattatttttatttggagacagtcttactctgtcagccaggctggagtgcagtggtgcgatcgcggctcgtgcagcttccacctcccgggttcaggtgattctcctgcctcagcctcccaagtagctggggctacaggtgcacgtcaccacacccggctaattttttgtatgtttagtagagatggagtttcgccatgttggccaggctggtcttgaactcctggcctaagtgatccgcccacttcagcctcacagtgtgctgggattacagatgtgagccaccgcaccagccatgttaatttcatcttatttaactaaaatctatttttactgctaagtcagttccctgtcttgttttagatgt

SEQ ID NO: 59821 - DNA, 1079 bp, Homo sapiens
tattgtgtaagagttttcatacatctgaaaattatatctgctatgatttacaatttctctacttgccaagactgggctctgtggcagatttgacttaaaataagatgaatcatgcttcaaggctcattagattttatgctttctattataagctttactcattgcattctaccagatcagtgattgatgcccgtttcactagtactttgctcagtgactcccatctttcccatagaaccagtctataacggggaactggttgagatgatattggcgtttggtttgaatttttaaatataggggcttatggttggggaacagagaacagtaaagcaaagttatataaataaaacattgcaggatgcctttttatgtttgaagttttgaggtttagaagcatgaagtcctcagggtcatttatattctgctgtctttgattaaaatgtactttaattttcaaaaggagatttacattgtgaaatattagttcattaataactgactttttttctcctttacagttgtgttcgatatatacagagacagtagggtaagtaaaaactctttctgatatgctttaatataagagctggttttataagcaggcagagcatgcctttgttatgtgtgtgaaggatccatgctcaaaaaatattttgtctgggtgcagcagctcatgcctgtattcccagcactttgggaggcttaggcagggagatcatttgagctcaggagttcgagactagcctgggcaacatagtgagccctcatctctactaaaaattaaaaaaaaattagcccaggccaggcacagtggctcacacctgtaaccccagcactttgggaggccgaggtgggaggatcacttgaggtcaggagttcaagatcagcctcggcaacatggtgaaactccgtctctactaaaaatacaaaaaaatgagccaggcatggtggtgggtgcctgaaatcccagctactcaggaggcagagattgcagtgagcggagatcacgccattgtgctgcagcctgggcaacagagcgagactctgcctcaaaagagaaaaaaaaaatatccggg

SEQ ID NO: 59822 - DNA, 1013 bp, Homo sapiens
cctcccaagtagctgggactacaggcgcccgccaccacgcccggctaattttttttttgtatttttagtagagacaggttttcaccgtgttagccaggatggtctcgataccctgacttcctgatccgcccgtcttggacatgttacttttatgggcagaaaacagcactacaaagttgtttcaggaaagtctggctgtgaagctggcaggaaaggagagagtggctgggtgaagaaaccgggttgaacaatgttttgtttttttcggatgggaggtatctgagcatgactaaatccggatggacagagttgatagagaggaagaattgcaaaaagagcagagggcatctggagaaagaggaggaggacacagtgtcctgagggggaggtaagagaggaggacacagtgtcctgagggggaggtgagagagggggacacggtgtcctgagggggaggtgagagaggaggacacagtgtccggagtgggaggtgagagaggaggacacagtgtccagagtgggaggtgcgagaagaggacagtgtccttagggggaggtgagagaggaggacacagtgtcctgagggggaggtgagagaggaggacacagtgtccggagtgggaggtgagagaggaggacagtgtcctgagggggaggtgagagagaggaggacacagtgtccagagtgggaggtgagagaggaggacagtgtcctgagggggaggtgagagagggggacacggtgccctgagggggaggtgagagagaggaggacacagtgtctggagtgggaggtgagagaggaggacagtgtcctgagggggaggtgagagagaggaggacacagtgtccggagtgggcggtgagagaggaggacacagtgtccagagtgggaggtgagagaggaggacagtgtcctgagggggaggtgagagagaggaggacacagtgtcctgagggggaggtgagagaggaagacacagtgtactgaggggggaggtgacagaggagga

SEQ ID NO: 59823 - DNA, 1012 bp, Homo sapiens
tcccacttctcctgccaccgccgccctctccgctgccttctccccacgcgtgactgtgggctgagcatggtggggatggctgtttaccggctgtgtgcgtttactcgccgtgtgcatgggcgcaccgcgttggcgagacgtggtcacgagaagatcagcctccagtcgttcccatttctgtccttacatcatgtatttctatggaattggcatctgcacgtacgaggtgtaggcaagactttgggtggccacgcgaggatggaagggaagggcttcgcagtgctcagggtcacacgtgggcagagcctcaccggagggtctgtgcatttcacgcgggctcggccgcacgcgccggggagcgcgtctccaagggagggtctgtgcgcgtcgctgcgcgggcggtgctctctccgggctgcatcgagtcccatgctgatggctgtgtctcaagaaagcagaaataatccgaagtcgatggcaggaacgctccaagcatgtgctgctcagctcagctgctgttccctttctgcccaggagttgggtcttgtttgttttgtttcggagcggctcagaataggtggggaggctgatagtgaaagagaatcaggacctgccgaatgagtctgaagttcaagttatttccttccctcacacaatcagtatttgctctgcatcagtatctgtcagtgtggattcacgcacaggtgtgcagtcagaaatgcccattttgcaggggttcatggaggtgttgattaggctgggaagagaaaggggagctatttcatgggataaatcagtgcgttgttgggtgccctttctttccttcctcctttttttccgtgtgcttgtttttgtgcttggtttcttttttccagcaccacattacccagcttgtcttcacctccaggctcggcgtctgctgctgttcagtcatttcccctcacccccacgcagatctgcagggggtcccccggagagaagttgtgagggtggctttcccagtcctgcttct

SEQ ID NO: 59824 - DNA, 1588 bp, Homo sapiens
cataatgttatctaaacttggaaaacttggaagcatttcagagcttttggattgtcgtccttttgcttctgtggactttcttttttttttttttgagacggagtctcactctgttgcccaggctggagtgcagtggcgcaatctcggctcactgcaagctctgcctcatgggttcacgccattctcctgtctcagcctcccgagtaactgggactacagacgcccgccgccatgcctggctaatttttttgtatttttagtagagacggggtttcaccgtgttagccaggatggtctcgatctcctgacctcatgatccgcctgcctcggcctcccaaagtgctgggattacaggcgtgagctactgcgcccagccgcctctgtgtactttctagaagtggtccccagttcaagatgcctgctccaccctgggccatgaccggtgactctggcccgagtcttaatgtggagttgacttctggtcccttcagtggggattttgagtctgggcccttctcttgttttgaatgaaatctaacacaaatgaaaggcatcgacaattaaccactggcattcatttccaaagtatgccgcagttccagtcactttgtttgccctactttctccctacgtctttaagatacgaaggcaggaaagccttgtaagaagcagggctgtcagctcacaatgttcacatgtatttaaaataaagcattgcaaaggctggaggagcactcattttgccagactttgtaatctgatatccactgccttatccaggtatctcacctcatggagccgagcatttactgttggaagctaaggggtcaaggcggttaggctgtatggttagagggaccttgctggagagtgggggccgaatgggagtgaaggttggcccaggagggtggaaaatgagattgaggaagcaaagagcagcataagagaaaggactgggctttgtggtctggcctgggttgtctgatgcacctctgagtcaggtctcagggacaaacctttcaacctgtgcgcttcagtgcagcctcctacaaaagggaatcccagaacataaccatatctctgaataaggtggtgagacttaattattgtctattaatcaacatgttttcagacccttggcacactatgagaacaaataaatgttatgtaatggcaaattaggaggggtacacatttctgttggtgtatttgccaaggctgttcaggccgtccctatcgtagctatctttcagtgactactgaagcaaaaaataaaaaaacccctaaaatactattcggagaagtatatggatgggaggaaagcttcggtgtggtgtctaggaagcaccctagactcatagaagtcacttctgcaatttccaggctgtgaaatgtatgtgaatggaaaggcctgggtacttggcacgtggcagaatgagtctcccaacaaacctcatttcccctggagtacagaacatggcatgccctagaaaatggatcttcatctccgcgggatatgaatgcatgtttttcgtgtagactgagcatttgaagttgaagttgttcctgtctgtagatggctggacaa

SEQ ID NO: 59825 - DNA, 1056 bp, Homo sapiens
ctgctcacggaaacctctgcctcctgggttcaagtgattctcctgcctcagcctcccgagtagctgggattacaggcgcccaccaccacgcctggctaatttttgtatttttagtagagacgaggtttcaccatgttggccaggctggtctcgatctcctgacctcaaatgacccacccgtcttggcctcccaaagtgctcggattacaggtgtgagccaccgctcctggcctatttgactgttttttaaaaattatagttaaacgcctcctccagccattgaatatagctggctgatattacctaagtttggggttccgtctcctggctttggagcctcccctaccccccgccggtctgtgtacagggaagctgcttctttctttcttcccccttctttcttgcctattaaactctctgctccttaaaacaaaagacaaaaaacaaaaaagtgtgcttaaaaaatacatagtataaaacttgccatcgtaaccattttgaagtgtgcagttctgtggtgttaagtacattacagcattgtccaaccatcgccaccatccatctccagaactctttcatcttcccacattgaacctccactccacctatgaaacactaactccctactccctcctccctgaccttctgatacacaccgttccaccatctgtctcagtgaatttggctactttaggtaccacatagaagtagaatcatgtgatacagtcatcccttggtatctgccgggggctggttccagaatcaacctgccgcggataacaaaattttaggatgctctagtgtctgatataaaatggtgtagtatttgcatataaattttgcacatcctcccatgtactttttgttttttgttttttgtttttgtttgtttgagatggagtctcgccccgtcccccaggctggagtgcagtggcgccatctcagctcactgcaagctccgcctcccgggttcccgccattctcctgcctcagcctcccgagtagctgggactacaggcgcccgccatgatgcctggctaatttttattttttatt

SEQ ID NO: 59826 - DNA, 1026 bp, Homo sapiens
ctgtcccaaaaaaaaaaaaaaaaaaaaaaaaagaataaaaagaataagatgtctatggcgtttgaatttctgcttggcatcaggtacttccttagacactcgacggggcctttaccccatcaccaaccctgtggcttaagtactgtttgacagatgaggagaactaactggcctccggtcacgtgactaaaagaataagtcagagggcggggatttgaacctagatctgtgtgaagaagcttccggaaggctgtgctgaccgagatggaacagacttttccagagccggctttgagcctcctctagggcaggtcctgggaaactccaccaccggccagtggtccagggagtgccgccaggggcaccttcatgtgttggtgtgaagggtctttgttagtttattatggaatcatcaaacctgtactcctgtcatgcttctcctgaggtccggtggaggccttgcctggagcctggaactggaaatcatattaggctctgcagatgagaatgcagggtctggattcccccacctgctcacactcctgagaaacctttgtgctgacagaggaatggccttagtaaccattttttttcttttcttttcttttttttttttgagacagagtcttgctctgtcgcccaggctggagtacagtggcgtgatctcggctcactgcaatctccaccctctgcctcctaggttcaagcgattctcctgcctcagcctccccagtagctgggattacaggcacctgccaccacgccctgctaatttttgtatttttagtagagacggggtttcaccatgttgaccaggctggtcacaaattcctgacctcaagtgatcctcctgcctcggcctcccaaagtgctgggattacaggtgtgagccaccgcacccggccttatttttataggtcaagcacacattttgttattgcatggctatttctctcctggcaaatgaagataataatttttgaaacatccagagaaccctgagattttgaatcaggctgttggcaa

SEQ ID NO: 59827 - DNA, 1036 bp, Homo sapiens
actataaagcaagagtaaaacgttttaaaagaaaaaaaaactgttttgctatatactcacgacacttctgacactcattgtgtgggtttttccacaccagtccattttccttggaaactgtgactttgagtgaaatgacgtaacaaaaccacaatttttcatttttttatcagtgttgtaatgaaatgatattgaacaaaatgatgatattcaagtatgtcattttgcttaaagtcaatttccaagaactgactggacattaagtggggacttgctgtaccaccttttagggagaacagttgaacaacagttgtctgagctaatatttggaatatattaatgaaaaccatgttgtagaatgtgtgcccagcctctcactatatagtcagccccatggacaccttttatctgtgtcatatcttgtaatgataatgtatgtgaaatccttatggtatgcatcacacttgtttatactagatgataaggtacttgtgggtgagcctgacgcatgttttggtaacttacataggatctttcatatgaaatactcagaaataaaggtgctatagtctgtttattatcatacccagacataaaaatgctaatactgtttagaaagattttagctataaaagtttaaaaaccaggatgggcatggtggctcacacctgtaatctcagcactttggcaggctgaggtgggcggatcacctgaggtcaggagttccagaccagtctgggcagcatggtaaaatcccatctctactaaaaatacaaaaattagctgggcgtggtggcggacctctgtaatctgagctactcgggagactgaggcaggagaatcttttgaactcgggaggcggaggttgcagtgagctgagatcgcgccactgcactccagcctgggcaacagagtgagacttcatctcaaacaaacaaacaaacaaacatgacttcaagtaataatagcactttctgtgttccttcctagcactttgattaaatgtgtcgtttaatctgtacaacatccctgcaag

SEQ ID NO: 59828 - DNA, 1026 bp, Homo sapiens
gcttagcacttccagccacgtaggctccccgtggccatgtccacgtccactgggcaggctccttgcctggtgtgtcagagccctaccttctgctcttcctgaggtttgggtttttaactcagtcgtaaggagctgaatgaggggcccaggaagacgctgattttatgcaccatctctgtgtttggcccacagctgtgtttgtgtgattttaaaacaatttatcgctcatctcgactgggccctgtcggctgacccagctcctccgcagccattggtaatctccattttaattaatctttcaaagaagcagattaagttgattgcttcccaagctgagtttggtgtctgtacctttcagctgccttacagaagtgattaaaataaggatttttctatgagctttggtgcccagttaagattatttttggatctcgtctcaatggtttatttccatcatgtgcctgtttttaacataagagctgaaaatgagcggggctggtttttgtctcctgcaggtgttctgttctttcaagcgccctaggatggccatgacctttggttccgtctgctttgtgtgtccttgacccttggagccttctaaggtagccctgctgagtcactaacatggagtcacaccttttttcttccagtcctggcttctcttcccccacacggctttgcagataaaaccatttattcttgacctacccaagcggaggtcctgtaggccactctccccagtcctaactctagccctgaattgaacagactgcattgaaaatgttggttacctgtcagtttcctcttccgctgtgccgtccttgaggggagggctagtatttcagccatccctgtgaccctggggcctaggtgagtgcctggtacaccaggaagcgctcagtgatggtctcttgaatgagtgaacctccttgaagtgcacagaaaaattgactgaagagggtgagtgttgcttagagccaaggtagtaggaaaaatgttggcctaaagatgtgtttagtttggctt

SEQ ID NO: 59829 - DNA, 1053 bp, Homo sapiens
tccgcctcccaggttcaagtgattctcctgtctcagccttcccagtagttgggattacaggtgtccgccaccgcgcccagctaattttgtatttttagtagaggtagggtttctccatattggttgggctggtctcgaactcctgacttcaggtgatccgcccaccttggcctcccagagtgctgggattacaggcgtgagcccctgcgcccggccttatttgagcttttctaaaagcaagaaattgaggaagaaactcctaactgggcaaatccagaccttttcttagtatcttcagagaatatacagttgtgtctaattctttttggaaatatggtatgccttataaataggtacaccttaattagttgcaaagatttaaacaagtgtaggaaagctaggagagaaagctgtttgttactgttcattatgtattgtacagggtgatgctgagattgagttattcttggtatgaataacttcctttgaaagttagaatgatagagttttagaacgtaagggaccttagattttaatccgtaatgaccaagaaaactgtgtttttaaaaattttttttttttttgagatggagtctcactctgtcacccagaccggagtgcagtggcatgatctcagctccctgcaacctctgcctcgtgggtgattctcgtgcctcagtctcacgagaagctgggactgcaagcatgcgccaccacacctggctaatttttgtatttttagtagaaatggggtttctccatgttggtcgggctggtcttgaactcctgacctccatccgcctgcctcagcctcccaaagtgctgggattatagacatgagccaccgcgcctggctggaaaactgtatttttgagcattaagtaatttcctttaaatttttgttgataaaggagagacccagctgccaaagaggcttctgttctgggggtaagactggtcactgcatgttgaattgacatcattcaaccaaatgtggtttagcctgagccatcgtattgtgggtaaatgtgtagtttctgttgtgtctttgga

SEQ ID NO: 59830 - DNA, 1046 bp, Homo sapiens
gtgcccgacctctttcactggtaccctgatgtcttcagggcttctctatgttataacatggctcagaacttcattcctttctatggttgaataatattccattgtatggatatcacacattttgtttatctgtattacttgaaatcttgatacatactttttattttctaagcacttccccataattctcatccgattagtttgcctgccttattactggcaaataatttcttgattaattgaatttgctagcaattttgaacaagatgatggtggttacaaggcagaaatgccatttcctgttctttctgtctctttctgtgtgtgtgtgtaactctgtattttcttgagtgtgtatctctctgtgtgtcttctaagtgaggccatccagttggtgcacttgtctgaagataatacaggtgcaggggtgaaactgcagggccttagaacagttcgccccctacctcctgaaggtgttgacaggaaaagctagcctcggccctccattactctcagagtctgctcaagacagacacaactctgtctccttgtaataaatgtgtctcacagagctaaagcaatgcacagaagaaaggacttctctgaaggcctgctcagtttatcaacaaaattgatcaatttttgttgtttgtttcacagatcaatgaaggacacatccagtgtgatgaggcactggggcatatatagaatgtatttgacaacagatattagttctttgttagcaggaatgacacacgtttagcaggaatgacacacgtttaatgttgtgaccagaggcagagtcattctagatcttaggtgcgacctgagctttgtggagcctcagttctgtcttgaaagatattcttcactctgccctcttttattgattaattttaggcaatctctgcgggtatttccagtgctcttggcttttcttgactttgtactaattgccaaaggcggcagaggatgaggacttgttggggtggtcgtgtgtaccagtgatgtttctagagagtgcatggttagcctacactcttcct

SEQ ID NO: 59831 - DNA, 1067 bp, Homo sapiens
ggttagtcttgtgctacgacgtgcagtatttcagaataaaaggtggtatatagaattcactttttggatattattcttgttttttttttagcatctacattttttttaggagatacagaataatctctttaaaaaaacagcgttaactatattaatggagaagtcgctggaaatgtcacttcaggtggaaacatttagtgtggatttaactttttatggaattatgcatgcaatgccatttgcatttgctgagattttgtattattaatagaatagacagatcagcattttgtcggtgtatgtaaaactttgcttgtttttcctgtcttgattgcttgctggttgcacataaaatttagagttggaaaaagagtgtagcacagaacaggggttggatgactcaagggtctccgctcctgtctctgctctgctgcagctccggctggaggccttcatttataaactgtcggatggggccaggccaagagtccgtgcagaaaaatcccacagttgtgccctggggaagctgctcatggtgaagggcttcatttgcagagtggaattgctgtaaggccggggtcttgctgagcaccggagggagggctctgactagcactgggcggtggagagaagcagaactcacttgccatactctgtgtcagtttccagcaagagtgaagttctgtttttccggtgggttctgccctttccttatcagttcagctgagcttactccagggcttcccctttgctcccagctttccagggcatgttctgccaaaaatgagctttgccttgggtgtgtctgattgtgttgttggtagactccctaaaaaccttccggtgctagcgatgctgtagacggctgagacccatggaggtggttgttaattgtcactgggggcccggggtcacactgcttgggcctgcatcccagtttaatggtgggactttggacaaggttcctcaagcccccgaagcctctctgtcctcatctgtaaaatggggacagtggcagtacttgtctctcatagaacatccatgggaggaacttacctcagtgcctg

SEQ ID NO: 59832 - DNA, 1035 bp, Homo sapiens
gcggccatgccttgtgaaagaagaaagcttggccagctgttgactgattagagatggagatgggctgggcatctggctcatgcatgtaatcccagcactttgggaggctgagatgggagggtcacttgaggccaggagttcaagagcagtctgggcaacatagccacatcctcatttctacaaaaaattttaaagaattagctgggcaccgtggcatatgcctgtagtcctagctactggggaggctgaggtgggaggattgcttgaacctaggagtttgaggctgcagtgagctaggatcatgcactgcattccagcttgggtgacagagcaagactctctcttattttaaaaaaagttatgtattgcactccaactagcaatgtgtgagcatgaccttcttatcacatccttgccagtgatcagcattaaattttttttctgatttgctagtccaaaatgaaaccttttaaaaagtattaaaacgaatgaaggtattactagaaaagacttgatcagtcagttgagcaaaggttccaattgctgggtgtgtctgggagttgcagacccccacgtggtgggagatggggagtgaccgtccacccctgccgagggatgtcctgcagagtggccatagatggaaggcctcagccgagagtggccataggtggaaggcctcagtcgcgggcgtggtgtgtccgaagccgttgctcacagaacacttaagagcagctgcctgtttcaacattggtgcttgactttccctattgaatgaacttccctgtctcttttggacctcacattcggaaaggtgtctgagaggtcatccgtttcaaacttcatcatctcaaatgaatggcattccctcctgccttttaaaaccccagggacgggagattttataagctataatgactttaccatatattttcctcaaaactcaacagccatgatctcatgaatactcacccctactttctgcccctatgaaaaaaaaaataaataaaaggcaagagtgagaaaaccaaactcaag

SEQ ID NO: 59833 - DNA, 1031 bp, Homo sapiens
gaaagcaggatttgggcttatggaagtgtttgagagtctgagctctctttgggaaatatgtgggttaatataatttttttttttttcttttttgagacagagtctcagtctgtcgcccaggctggagtgcagtggcataatctcggctcactgcaacctctgcctcctgggttcaagtgattctcttgcctcagcctcctgagtagctgggattacaggcgcctgccaccatgcctggctcatttttgtatttttagtagagacggggttcctccatgttgatcaggctggtttcgaactcctgacctcaagtgatttgcctgccttggcctcccaaagtgctggagttacaggcgtgagccaccgagcccggctattgtaatgggttttgcttgtaataatttatacactatgacttgtttcttttggggagggtttgcttttgtacatgaaacttgggcttgtatctagaaagcacgcgatgtttttatgatgcagaataaaggagggaagaagggatgttgatgccgcttctgtgttcttctaggacttgggcaatttccttttgtactatccatctcatctaatattatacgggtgaccacttagctgtatcataaagaaaggccccttcggccaggtgcagtggctcacgcctgtaactccagcactttgagaggtcaaggtgggaggatcgtttaagaccaggagttcgaggacagcctgggcaacaaagtgagaccccatctctacaaaaaagtagaaaacatttactgggcatggtggcttgtgctgtggtccttgttgcctaggaggctgaggtggaaggatcacttgagcccaggaggttgaagctgcagtgagctatgatcctgtgactacgctccagcccaggggacagagtgagtctgtttctaaagaaaaaaaagaaagaaaggccccttcaattctacctcatgacaaataaattctattacctccggctcctgtgtgagttgcctgtgaatatccagaactcccaggtacaggga

SEQ ID NO: 59834 - DNA, 2216 bp, Homo sapiens
agagtgtcatgtacttggaatcctgcagtatatattcacatcagcttcttgttagggttcttactgagagctggtcacataggcacctgctgcctagcacagacccaaattccagaatctcagaaggaaagcagatgttcagcaaaaaccactttgcttgcataaactgtttaggtgcagtgaattgctctttagttaggatggtgggaaccctcctggaatccaggttctcaggtgccagccaagggccaaccttgtgaggggccttttgaagcacgtgctcttttctgcacacctcatgatggaccatgcttggcaaagtgcaattcaggtgtctgaagtcgtgggtccttcgccttgagcttgggaccttttccttttgtttttggctgctgcatggctgacttccttggagaaggaccacatgttaagctgcccttggtgtcttttttccatctctgagactttgcttcccctgtcgtgatggaattatacatgtggctattgtccctgctgaattgggaagatgaaaaaggtataatcccccatgacattcattcagtttctttcttaagaagattctaagaaaaccctgtttttgaagcactgggtgttccatcagttgaaattcctggacatatctttctttaaaaaaatttttttgaggtcacattcttgtctttactggggccatttttacatgttgtttcactggtttgggaatgaaagattttaatgaagtttgcaacgactgctgacctcttacccaggagtggtggctgcacatttttgctgttgcactaggaatgacttgagacttagaattctcaccatgacttttgaaggttgaggcattgcagtagagatgcaataaattatttctccttagaggaaacctttgcttttcttccctgccttgctccattctaccacagagttaatggtcttgattttagtgaaataacaataacagcaaacctgcctttggacgttaaatacaaactgcatccttggacagcaccgtgttactttaattttttaagaaagacttaatatttctaattgatttttttgctttctatggaattttccccaaacctcagctttctggtgcaggctctttcctgtctcttcctctcctgtttattaaaatagagtcatttgcccgtcacgtgtgggagactgtcgccagggtaggacagacatcaggcactatcgtctgtgtctaccagggcctattatcccaagttccattgcgcaggctgtctgaggactttgccttgtgtaccacagactaacattatttttctttttcataactcatattcgaagtcattcttgacaggtgctttctgtggctgaaaaggctgcatacgtctcagagccctgagcagttgtttgttatggtttaatatttatcgaaaactcccatctgtgggggcatttattgactggaggccagacagggagagccacgtgtttttcaaaattactctgtgctcgtgtatatgtccctttatttttttcagggagcattattgctgttaaatgggcatgactgaaaggatatgcatgttattgtttgcctgcgttttagggcttggctgtgataacagctgtgggatttgctctcaccagtcctcctccctgctgtaggtagtgttgtcaatgtgcacatcggtgaagggtcccggttgtagagccacactgctgagtgctttgcagttgaattcactgtcccgggaatcctgagagagggatcgaggacttacttgtttgttctgctgtctttgatataagacgaatctgaggagattttgtttttctaaataaaatgggaaagaccttagtggcctagagttttcatattagtccgttttcacgctgctgatgaagacatacccgagactgggtaatttatagagaaaaagaggtttaatggactcacagttccatgtggctggggaggcctcacaatcatggtggaaggcaaaaggcacatcttacatggcggcaggcaagagagagaatgagaaccaggtgaaaacagaaaccccttatcaaaccatcagatctcgtgagagacctactcactaccacgagaacagtatgggggaaaccaccccgtgattcagtgaactcccactgggtccctcccataacatgtgggaattatgggaactgtaattcaaggtgagatttgggtggggacacag

SEQ ID NO: 59835 - DNA, 1150 bp, Homo sapiens
tgcagcagtaataattcttcaagtcttattaaagaattcaaatggaccaaaactcagtaaaatgttaactctaggctcaaggacctatgaaggtagtctttcttaataacttgtttttcttaaaactttgaggccgggcgcggtggctcatgcctgtaatcccagcactttgggaggtcaaggcaggcggatcacgagttcaggagatggagaccatcctggctaacatggtgaaacctcgtctctactaaaaatacaaaaaattagccagatgtggtggcaggtgcctgtagtcccacctactcaggaggctgaggcaggagaatggcgtgaacccgggaggcagagcttgctctgagctgagattgcgccactgcactccagcctgggtgacagagagaggctgtgtctcaaaaacaagcaaacaaaaaaactttgatttctcttagacgttatatggaaatggaattttattctgtgaatgttttatttcagatagacttgcaaagcccttctatacatagacactgtttttagtttttttgtcaccccaaacctcaaaaatgcatctcagcttgaaagactttctagacttttcctgagtccaaagtcatcctgctgatatcatggtttaggttctgaaaggttttatatcgagtgtttttttcttctttcctaagaaggaaaggatcagaaaggaacttgtaaccattgttgagcattttaggaaaagtgaaaaccgacttcatccgtttcatttgtaaggagaagcatgttagatgtgagtatatttggaaacgtccaaaatttaaccatgacaagagacagcagtgtgatggcaaatttcaggccaaagtctggaatttctttgctttcttcccattttatcttgtcttctcatttcttttacttttctacttctcttctctcactatttctttgctttctaacgtttcccatcaattttgagccattttctttattccatctacatatgaactcacagcagtagcaaaaatactgagctctcagaaatatatttatccatgtatctaaggactctggaaaacagattcaaagatgtgaagcctcagtagtgaaactgactcgaggaggaaagacgtttatgtgcggcagatcttctcggggt

SEQ ID NO: 59836 - DNA, 1046 bp, Homo sapiens
gatagtagccatgatataaatcctttctctttttgcagttggagactttacagcaagctctatgccggtgattcccaagccctttggagttagaactctttgtccttgttgttctggtttgagtctacccttccttccctgctgtcagatactgtgtgctgtatcttagttggatgttgacttcctttgagaattctttgatcttttctgagaattacatgagataccttaaattgggctaaatgtagggaagggattttggaatagaactagggagtgtcccaactggcagcttccccaattcatcctaagacattttgccatgtctaggatgggttgtttaagacaacgtctccttttctgggatgttcgaaactcagtgtttgggtctaagttttttccactgtgtctctctctctctgtctttttttactgagtatattcttctgcagaatggtctgtatctcgtgttagcttcagaaggcaccactttcaagaggtaattaaattataaagatttgttcgaagtcattatcaatactggagaagttagcaaaggtattggaaggccaacaacaatttatttcccatgtcactctttctgcagaaactcacctagagtccttaaagggaataactggtaactttctgatatatcatgatgagaggcctctgctggccactgggcagccttcagatagttttttccttttttaaaatgtttaaatttttagggctaggtgtggtggctcatgcctgtaatcccaacactttgggaagctgagacagaaagattgcttgaggccaagagtttgagaacagcctgggctacatagcaagaccccgtctctccaaaaaattaagaaattagctgagtgtagttgtgtgcacctggggtcccaactactcaaaagagtgaggtgggaggattgcctgagcctgagaggttgggactgaagtaagccaagattgtgccacagcattccagccttggtgatagagtgagatcctatttcaaaaaaaaatattgattttaagttaatttt

SEQ ID NO: 59837 - DNA, 1017 bp, Homo sapiens
ttgtgtactggccagagagaaggaggctgtgtcctggtctgagacccagcaggtttgaggtcttgtattttctagtctccataaatgttcccaatgccatttcgagttacagtgaggacttggacagccctttgcatttagttttgttttgttatttgagactctggtgttttcttcaaggaggctaaatgctgggtctattgggttacctgtctaaggaaactcccattgttccagaataaaagaaggatgaaaaactcatgctttgactgcctggcggctatcaggtgctgctggccccagaggttatgagccaactggcatgtcctgcgcctcatgcaggctcccactgtgagaaccagctttgaagacctcccacctagacctgcccgccatgtaagaggtgcggtgctgggtgtctgccatgggccggggagtgaggagaaccattctttcccacatgagctctgaaccaattgagaagtagggctgaggggccaggcaggtggagatcaaaatgttaaattcattcctgataaaagttccattggaggactggggcatgttttaataaagggcttcctcactctcaacctcagaagcagtccgcctagccccctgcaggctcctcctctggcccagaggagagatgtagtctgtgggcttcccacgggttcccaagagaaaggagggagaaggagctgggctggtgccctccatcccctcctggccagctgggtaagtctgttctcttgccttgggaggaggaagaggtaggagggcctggaggagattcctctgtagacattgggaacctgctccatcttcactcttgccctcttcttgggacctggtatccccagggacccagtgccctggctccatttgaggatttccaccctggggcagctcttttcctgtctcagcttcacagactaatttatttagagggggcgagagaaatgagataaattctgataatagtggcacttaataaatattaattgtcattcatat

SEQ ID NO: 59838 - DNA, 1046 bp, Homo sapiens
caagtacaaaacgcaaggtgaaaaacagtgcatggagtatgctgctctttgtataagaaagctgggcggccgggcgcagtggctcacacctataatcccatggggaggccgagacgggtggatcacgaagtcaagagattgagattatcctggccaacatggtgaaaccttatctctactaaaaatacaaaaattagctgggtgtagtggcgcgagcctgtagttccagctacttgggaggctgaggcaggagaattgcttgaacccaggaggcggaggttgcagtgagctgagattatgccactgcactccagcctggcgacagagcaagactctgtctcaaaaaaaaaaaaaaaaaaaaagaaagatggacatacgaacatatgtatgtgaatttacttatatttgcatcaagaaacactggaaggataaacaagttataataaaatgctcttctgtctgaggcacaggggaagggagtgattgggaataggtgtcggaatgcctcctttgcatgggtcttttgatggattgtgttgacctttgaatcatgtagaaaagcaagtcagcaaccagcaaaagcaaatcagccagggaatgcctttgactttgaatgagaccaagagcaggtggtggagagtgaaggtggttgactgcatttcttagctcagaagcaaagtcagtgcattcattcattcattcaatctgcaaatgcataccgagcctctcccatgcactgtctgctgttgcacatgccgaggatacagctgtcaacagaagcattaaggtccaagctttcccagagctggcattcttgagggggcaaacacatgacaaaaaggtgattagtgaggaagagaaggctcatgcggcaggacctagagaggaaggcgagaggagtccatgctgaggccagaggggacgttcattgctgatacatattcctatgtgttcatcatgcatttgcaaacagtatttttttaattttattttttaaagacagggtcttgcactgtcacccaggctggagtgcagtagcacgatca

SEQ ID NO: 59839 - DNA, 1046 bp, Homo sapiens
caagcacatcttgtcattgttgtgaatttctcagaacaaaaatgtgttgcctcaggtaaagcccgtaccatttgtgcaaaaggaaaatggcttcaacttactttttaaaaaaaactttcagattcaggcgaacatccatttcttctaatgagtgtgtgtgcaaatgaccttgtcataatgcaggatatagtgatagcaattgtagtgagtctttagaatgagctaaatgttatcaagggatgtttccagttagttataaccatgatatgccttttccgatgatctaagacacttctgttttaataggtcagtttttttccagttttaaaaaattttaactgaatttttaaattcaaagactcttttctcataaatggcacaaaacatttagctctctaagaaatgcagaatcccagaatggttcatgtttgtgtattgctcatttagctttcgacgtcctttggaaagttgaggaataaacaggtggacaatttgaaaggatgaaaatactccaacaggttacactaatagaatcaggaaggaagaatgtccaacaggagtcattgttgtctgttgaggatttagtgggtgaaagattgaaaaattggaaatacatattcacctactattggtaaaacttttttcctcaaatattcctttatatgtatatattttttttcttcttgagacagggtctcactctgtcactcaggccggagtgcagtggcactatctcagctcactacgacttctacctcctgggttcaagtgatcctcccacctcagcctcctgagtagctggggctacttgtgtgcgccactgtgccctctatttttttggtattttttgtagagatggggtttcaccatgttgtccaggctggtcttgaactcctgagctcaagcaatcctcctgcctcggcctcccaaagtgctgggagttagcccaccgtgcccagcctatgtgtgtgttttcttaaatgttcctggttctctaaaggatgtaggcaaatgcattcttggtaaattaccttggttgccaatgt

SEQ ID NO: 59840 - DNA, 1064 bp, Homo sapiens
ctgttgtatgcacggctctgtgctaggggctcggaggaaataaaaagaaatgaagaatgtggactctgttcaccaggaattcctggcttatctgcggagatacgcatattccagcagttctcgactgagagtgattttttttcccgccaggggacatttggtgacatctggaaacatttgggggttgtgtgtgccgcttctagtgtctgtgggcggagatcgaggatgctgttaaacatcccttaatgcacagcacagcctccccaccctaaagtattatacagcctgagtgtcaggggtgcttgggttaagaaccctggtatgtctcaagggtgtggtccccaaaagccatttgatgcttttggagtggtgtgtgcagttggtgagcagtgctgctgtgacctccatggaggggagctggcggcagagtggagtgctcagagctgcaggccctagggagagtaggggaagcctggactgtgctgagctgggatagaactgaggcagctgcagggagggcaggcagccaccagggcaggcagccaccagggcaggcacaggctcagggtcaggaacgagtgtggagctggtggcacggtgaggaggacctgtcatagggcggaggctctgtgccgggagcagcaggcagtctggaccgaaggaatgagagacatcgcagaccgtgggctgagtgatgctgtgatggatgcagagctttaggaaggtattcaatggtgctgggcaagatggggcagagaaaggccagtccaacggaaggagaacccagccagggaatggaaaatcaggcggtgatgtaccgtgcaagctggagggagcattgccaatcctggcctgtttctcaggttaccagtgagaaaatcaggtgtagggcgatgaggcgtcttggcttgtgggcagcgctgggttcaaggcaggtcctcggccgcaggacctggcctctactgaccagcatcccatgggaaacctcagcctgtcctctcagcagccccgcaaggcagacaccatcatttacctccaccatacagaggaggggacacacactg

SEQ ID NO: 59841 - DNA, 1186 bp, Homo sapiens
ctctgaatgccctgggaagcttgtgaaatgcagagtcctgggtcctgtccctggcgcgttgatttgacaggcctggggtaggactgagatgctggtgtttttaacgagcatcccgagacacttggagaaacagctctaggaagacgattcccaaatccagatgctgcctgttctcagggagaaatcctgctttccagctctgtgctatgtatgtccttggcacctcagctgaatctttctggaagtaaatgcatcgctattcatgaaggccaaaaggtggaaacaacccaaatttccgttgacggatgaaagagcaaacaaaatgtggtctctccatgcagtggaatattatgcaaccttacaaaaaaaggaaattctgacccatgctgctgcatgggtgaaacctgagaatgcgctaagcgaaacaggccagacacaaaaggacaaatgtcctatgattccacttactcaggtacccagaatagacaacttcacagtagggacaatggtggttaccagggactggggggaagggaaatggggacttcttgctcagtgggcacagttcccattgggaagatgaaaaaattctggaggtggacggcggtgatggttggacaacaatgtgaatgtacctagtgccactgaactctacagctgaaaatggtaaaaatggtaaattttatgtgacatatattttatcacagttttttaaaaaagcaaacacatgggtctcctccctttctccctccccaactaaactccccatcctgaggcctctctgcagttcacataaccctgataaagccgagggagagggcttgggggacccacttgacttattttttgcacttaagctgaaagtcatgaaaatgcggtgtccttctttcccggactctctttaagaagattaaaggaaaccacattcataagccacaaggacactcctggaaaattctttgtcctgctccccaaatcttttctgcttccgtttgtcctgttcattgatggaaccccgctgggaaggactgaggactgggctggagttctgctggtataaatcaccttggagaggggatgtggggacagagtcttgaccattcacagctgattgcattttgtcttgtgcagagagagcagtaggtgcccagagagagaggtcaggggggaaccttcctctggataa

SEQ ID NO: 59842 - DNA, 1014 bp, Homo sapiens
agttagagaccagcctggccaacgtggtgaaaccccgtctctaccaaaaatacaaaaattagtcgggcatggtggtgggcgcctgtaatctcagctactcgggagcctgagacaggagaattgcttgaacccaggaggtggaagttgcagggagccaggatcgcaccactgcacttcagcctgggcaacgagaggaaaactctatctcggaaaaaaaaaaaaaaaaagaagaagaagaaagaaaaaaagaaattcattgattggggctgaagataaccactttgccaatgactgaaaatggctaagctggtaaagctagtccttgaatttctcaggcaccaatacagctttttaaggatcaatctgagctgcttagaagggtctaaaagagagagagctcctctctggaaagctcgcactggaatggagaacacaagcaggaaatgtgaaaagtaacggttgaaagccttacttatgatgacacatagggaggcaggtgcatatcttacaattctagacacttggataccttgggaaaccatattgaaagttaccttgatttctttctttctttctttttttttttgagatggagtctcgctctgtcacccaggctggagtgcagcagtgcgatctcggctcactgcaagctccgcctcccagcttcacgccattctcctgcctcagcctcccgagtagctgggactacaggcgcctgccaccatgcctggctaattgttttgtattttttttaatagagacagggtttcaccgtgttagccagattggtctcgatctcctgaccttgtgatctgcctgccttggcctcccaaagtgctgggattacaggcgtgatttcaaataaaaccatgcaatccccataaaacaggctttgagggatgcagtaagttatttagtgatggtggtggcggtggtgtgcgtggttaaagccgaaaacttgccaagctttgggcacgtacatgtgagcctgtctgctgaatgagcttaggcttt

SEQ ID NO: 59843 - DNA, 1164 bp, Homo sapiens
atccatccctacatgatggcagatccctcatgactgaaacaattcctagcactgctgcattgaggatttacgtttccaacacatgaactgttggaggacacgctcaaagcatggcagtttccctttctttagttccttctcccacagcactgtgcaaatgagtatttaaatgcctgtctgatagtcaccctcactaccttaattccaaaaagtcccctgcttaatagaatccaaactcatttgcaaacgagcccccgactttgtgatctacctctttggttttcatcttcccacccctcaccccatgtttcagtttagttctcctgaaaggaacagataattgcatctttcctgctgcagtttgacacacacctccttcaggacacctcttgatttcctgtctggatgggcccttccctctgagattccacggcaccaaggtttgcttctatcattcctgactgtgccatgggatctctgctgctccaaactgtggacttcctgaatctagccctgaactaaaggcaacatggtgggaatggaggcaaggattaggggaactcaggtaaaattaaggatgttagaaaccctgggactgggtgctgattaggcaaagaaggtttagtggaagggaggaatctatgctgacttccagttctctctggctttggtgactgtattagttctccaaagaaacagaagcaataggatatatgtagatacacaaaaagatttattatgaggtattggctcatgtaattctggaggctgagaagctccacaatccaccatctgcaaactggagacccgggaaagccaactggacttggcccaaggccaaagacctgggaaccaggggagccgacgtccaagggccggagatggatgtcttagctccaggagagagaaaaaccaggtgtagcggcacgcacctatacctgcagctacttgggaggctgaggtgggaagatcacttgagtccaggagtcgaggctgcagtgagctgtgatgacaccactgcaccccagtctgggcaacagagtgagactctgtctctaaaaaaaaagggaagaagaacaaattgattcttcctctgcctttttcttctattctggctctcaatggatttgaacatacccgcttacacgggtgaggataatcttt

SEQ ID NO: 59844 - DNA, 1840 bp, Homo sapiens
attccctcacagacacaccagaaatacagaaatactgttttaccggctgtctgggcatcctttaggccagtcaagttgacacataaaattatccattacattgaccaagtggatggcaggttcctcaaccaatatggggcattccagaagaggcggaaggtttgagagagagagagagagagagagagagagagagagggagagagagggagagagagaatgaggattcctttatggcaacagagtatacttaaatctggtctggcctctcctgccaccttgtatactatacatattactctgtagatatttagagtagttgaagaaacaatgtgttttatcacacttttaaaaccagtgttgcgtctttgcatgtttatttccttgtgccatctctgtcatctaatgtggatatttacatgggagttcagctaatatgtggactagttggtggtttaaattcctctaataatatatcttggcagatctttcccctttcttctgtaaacttacttagctaatgatttatacagattccagttaaatgatttgaagagcagtctgtctgtctatctatctagatatctatctagatagatagatctgtctgtctagatgtctctctctctctctctctctctctctgtctctctctctctctctctctctctctctctctcataggctaatatttttaaaaagtcagaatagcttacattggagaaccacactaatgaaagattaaatgcaagtaggcctgagatggactaagatggcagatatagaaaaagaaatagacaccaaagattcaatttttttttttctgttaagctttatgttgtgtccgttctgtcttctatgtggttttggcatgattcatatggcaaatgaattattttagtgaagctttatttatgactcactgtgtattttaagttgtatgtaattggattaacaaatttcatttcacatgtgtgaagtccagggctatcgtttgagtagtttgaagagttgtttactgtttttaagctatataactgtttttctcaaagcttaaagttgaggtcagaggctctgatgattggtctgaagccaggtttgggggaataaattttttctaaagtaatagttggatagaatttggtaaatggattaatatccattttttagctatttgcatttttctgttatgaatatttaaaaaatagttttgactatatgatatggataagtaggaggtatcacttgggatacaaacacataaaagggtatcttttaagaaatacagtgctgcaatagatgtagtgtttttggttcttgtcaaaagctgtagaactgatgacctaagtatacacacatgtaaatgtactatatgtaggtgtgtaaataaatatgcatatacacacattgtaaatatgtcttggaggccaatcacagtgtctcatgcctgtagtcccagaactttgggaggctgagatagaaggaccacttgaggcaaggagtttaagaccagcctggacaacataacaagaccctgtctctatggaaaatcaaagaaaattagcctggtgtagtggcatgtgcctgtagtcccagctacttgggaggctgaggcaggaggatcctttgggtccaggagtttgaggctttagggagctatgactgtgccactgcacttcagcctgggtgacagagcaagaccctgtctctgaaaacgaataaatacctacatacatctccgtatttttaatttttattttttattttgagatggagtctcaccctgtcacccaggctggagtgcagtggcacgactcggcccactgcaacctccgcctcc

SEQ ID NO: 59845 - DNA, 1049 bp, Homo sapiens
cacagatgaggaatttggacttatttaagacatttttaggggccacataactggtaatatgtggagaggaagttacccaggtctgtgtgtctctttccaatatgatttgacccgtctgctgtccctgtgttctcttgtgaagaaaggggccgcttctccttgatataggcaatagcccactctaggtaggaggtgttcactaatggtgaaagaataaatccgtaactgtggcttctcagctactagaaaggcaggatacagtgtggtgaagtcctgagaatcagctcatctgagtttgcatcagactcctgctttagaagctacttgaccttgggcaagtcatttcaactctcagcccccattttcaggataatggggatgataatagtatctgcctccaatagtcgttgtagggatcaaacagtcagtgcatgcctggcacatagtgtgggctctccaaatgtttgctgtgtacattattattatgtgtaagggacatcttgctagacagcgggaatagggggaaggttccttcccagaagtcacatcacgcaagtgtcgtctccctaaggctccctgttgaagcctaagggagcccttcttgaaataggagacagaggcagcagcgatgaggtggccggccttcttccaggggtgaggctgctgctgtcatagacccaacactgctgcagagttgccaaggatacatcagtttcaccatttttcttgctgactaaactcctgtgaaaactcttgctttcctcggttatctgaccgtctgcttctcttaatgttagagtcaccagagcattagaactagaaaaggaacttagacatcttggtccagttctctagactttcagatgaggaaaggggtgcagagaggtaaagtgattgcccgaggtcatggagctaagccgggcagacgcggagccagaaggatggtttctgaccttcgaattcagaactctttccacataaccatacttgcagagcctctttcaggagaatgcgggaaagtaactcttcctcatcttgcagaggtcctt

SEQ ID NO: 59846 - DNA, 1059 bp, Homo sapiens
aagcacatgtatcctaacaaaaagcttttgagagtagtaaatatgtattcatttcaaagatagaaagcagcacccaaaaactaaacccccccccaaaaaaaaagttctgatagaatacatgaaatcccaagcagaattggtaccaaattttcagttttgttgtcactttttctcagatgggaagtggaagactcttgatttgctttggctctacgtccccacccaaatttcatctctaattgtaatccccatgtgtcaagggagggacctggtgggaggtgattggatcatggaggtgtttcccccatgctgttctcatgagagtgagggagtcctcacaagatctgatggtttagaagtggtacttcctccttaggtctctctcctgccaccatgtaagacgtgccttgcttccctttgtacttcatcctgaaatcatcacagtctaggggtttgtatttcatttgctaggccaaggggtaaccattgaaaatttttgcatagcaaaggattgaggcggaatgttgggaagatgagggatgattcctgtggtggtgtgtgggatggggatggattaggcagtttcagaatagagaccagttggccacctggcatctgactgtgaaagtcctggctggaggggaggggccctaggcaaggcaatttactttttttttctaaagttttaatttttagagatagcatcttgctctgtcgcccaggctggagtgcaggggcgagatcacagctcattgtagcctcaagctcctgggcttaagtgatcctcctgcctcagcctctggaatagctgggactacaggcatgccaccatgcacgactaattttaaaatttttttgtagagatgggaagtctcagtatgttgcccaggctggtcttgaactcttgggctcaagccatcctcccacttttcttcccaaaatgctggattgcaggtgtgaaccaccatgcccaacccaagcaggttgacccagctggataccttgagaaggaagaatcagcagagctctgcgagtcataggaggtcaacaggagggagg

SEQ ID NO: 59847 - DNA, 1007 bp, Homo sapiens
cgttctggagactcggctctgtatttctagagctttgtagacaaatccatgctggtgtctggcttggtcctgtgcatgtcagtcagtgagcacacctgcatgccgtctatctcagaatggagagctggagtgtctggcagaaaaggaaccacatctctgcgagtgacacagagccccaaaacccagcctggggaaaggggtggagagaggccgtggaaccagttccagaacactttcacgtgcatcttggtttctagcacggactgggatgcctttgttaatatgtgccaggctggggcacttgcaggaggtgacggccaccttgactctgtatgctgaagccctctggtcactcacccatgtatgctgcagtccccccggccaataacacaagccaggacaagcccaggggaggtccccggacacacagcgaaaattcctggctggttctgtatgtcgccgtgttgggttcccagcccagttccagctctaggcttgcaggtctctcactaggaactatgcctccagccctttggtggattaacacctgccacctccagttctgaatctgacctctccctctaggcctccagcctggatctacccagttctggattcagatcgttacaggcccaaagcactgaaacattgcagagcacattgcttttcttctttatttaaagaactaaattaagcattttaaaccatataataaatgtaaagagatccaacaaagttctgtttctgccattattactatatcatggctatttcggaatgatcaaataggagatttttttttgttttcaaaaagtctctgtctttctcttttgttgtctgtattttgctgctaagccaccagttctcgattggttcactccctcttcctgctacagattgtcttaggggttctattcatgagacttctggagacctaaaccccactccggccaatgccccataacggggtatgatgcttggctgacatcgttaactcagcccctcca

SEQ ID NO: 59848 - DNA, 1049 bp, Homo sapiens
ctgaaattaaaatcgaggttccttgaattgaagcctttttttggaatatcacattgcttcctaatacaaacatgctttacaattcctgcatttaaaaaagctaaccaacaaaaataagcaagtcacatatagatttaaaagactaccaggaacatttggactgctgggcagctaggttatgtcctgatcatgtcagtcattaggctgggagctaatgttcagatcaaacatgttgcctcccctacaaagaggtctgttgaggataagccctcgctgagaaattcttcacagctcagccaggctttcttggaataattggagattgaagctggtagttcctgaaatttaaggtcatcagaaccacccagagggcttgtgaaaatgcagattgctgggccccgtccccagatgctggggcctgagactctgcatttctggcactcagtgatgccgggcctactggcctggaggccacacattgaaaaatatggatttaagctgcctccgcctggggtctccattctgaccctgtagttgtttctcaaatgcaatgaccaagtacagttcctaggagggctcagtctggaccactgtatttgtccgttttcacgctgctgataaagatatactcgagactggataatttataaagaaaaagaggtttaatagactcacagttctacatggctagagagacctcacaatcatgggagaaggtgaatggcacatcttacatggtggcaaacaagagagaatgagagccaagtgaaaggggtttccttttataaaaccattagatctcatgagtctgattcactaccacgagaacagtatgggggaaaccaccccatgattcaattatctcccactgggtccctcccacaacacgtgggaattatgggagctacaatgcaagatgagatttgggtggggacacagccaaaccacgtcaatcactaaagccagtcttcagtgacctgccatctcgatccttcggacactccatggaggcttctggacgcagcatctgtgctgctcagggccgttcc

SEQ ID NO: 59849 - DNA, 1055 bp, Homo sapiens
gcaggcacagacaacagtgtggagcccctctcatcatatcccgcatgcaaaattcagggagacttggagctaaaaacgcattgacttcttagttgtctccatttgttctgggttaggtgatggatccacagtgacttagcagctttgatgacagccggggcttctggaggcttggcggcatgttaaaaccacctgggtctattccagatggattaaatcaggctctctgggactggggtccagacatcattaaaaaaaaaaaaaaaagtctccccaggtggcttcatatgcagcccgagttgagatttattggaccagactaacaaacacagctggaagaagagggcagggaggactccttaggatgtgcagatggagtggctcatgcaggctgcagtggaattcctttccttcttgtaataaaacaactcctatttacatatcattttagaaaaatattttcccccttgtcttatctgatgctcaagagagaatagagtttgccttagcatctccgtagatttgttttttttagatgtatgacctgtcatcaataaacccagagacataaattagggaatggctgtgctatagaaagcacttactgatgtattaaagattctgccttcaagctcttttaaatagtgcctttctcggtgatttggacttaaaaatttaaggatatatgtacatgcagctttgtgggagcacttgaatattaagtagtgcctagctaagttgtgttgaaatgagttggtagatcgtagataatataaagtaagtgaatatttccaagggagcggagaaacttggatggctcagtaattatggaaattggcagggcatttggggaccccagctgctctttgtccctttgtcccataaatgggtgacagtctgcaaggcacggagctctgccagatgtttgcaatagtggttgggtggggagaatttcagagctggtttggccacaggaagatgacgagcttgttaagaataatgatcggacaccctgcatattcgctgactgcatgcttagcaaatttgcaaactag

SEQ ID NO: 59850 - DNA, 1049 bp, Homo sapiens
catagttactgttccataattattgttgaatgaatgcacttgaacaaaacacaatgtgatttgttttgttttccagatcagctcataatgaattatatgtatctaactgggcagacgtaaagctgccgcctgtagaataaaagagccatccatgattagaatcacagaagcagaaaattttagaactataaaggacttgagattttaattcagtctgtttattttggagatgaacaatgagagttcgtggagatcaagtgacttgcccaaggtggaattgctggtgacacatgaaccagccacccacttacttagacaatgactggtcacatgagagctgacattgctgacaattgttttagctacctattgtggtacatttaaattgcatcaatctttatgcctccgattttccttggagaagatagctaaccgatttttaattttatcttctctgaatttgtggctcattcatttctttgtttttcctctgtctgctttctaaaatttctttatgccgctttcaagaaagctgactggaacagtctgttctccccgtgttagacacagaggggtcagggacagagattgattattctagtgggcaatggccagatcttatataaaagtggagttctgacttccagtctgcagcagccagtccaggaaaccaaccaataacccctgtagcaattggcccggcatgcccaggacttgatcaattactggcagctgccctaatttttgtcgtgacttccaacttcggaccaaacagagaaggccaaatatgctcccgtaaccgatcacccggatgggctgcttttgttatccccctacggcacctgccaacagctgccacccagagctttcccttcttccactaaaaagtgtcacacttctctgcctgcctttgagtttctaccaaacacaggtgacagtggctgacttcttattatagcaagctctgaataaatagcttcggcttttctcattttggtgggcttcatgtatttccacgtagggaaagacccaggaagaagcccggccct

SEQ ID NO: 59851 - DNA, 2410 bp, Homo sapiens
ctagtgtctactcctcctggcctccagtccccctttcccacccacattttttttttagacctggtaattttttttctcttttctgcatttttcttgtggtttttttaggtgtctttattaacattcccactggtttagagattgaaagcaaagttcctgtctttgctttgaacactctagtgaaacaggatactcaaggtaaatgctaagatgaggctattatctctggagctcagggtctaattcatccaacgtttattgagccccttcaaagcacccatcagtggggatggaaaataaaaaatacacagctcctgccgtgcaggagcttgtaaccttgtggggaagcttagcacttcttgcctccctaggtttaagcagttggaggtgcagtatctatttggaaagaagaaaaatgcttttgaaaactgcacgtggtctgtatggtggctgctccttgtcctgaatgcaaggttgccctccatgattggggaagcatccatcacccccttgggaactgaactcagctataatgtttgtgcttaggaaacttgacattgaacttccagtaactgaggccaggaccttcttgaagcactgccttgtggttcagttctgcctgcccacggtcattggccttctgggctgaccgtttcctcgctgactcccacagacacgctgaccatctggaggctaaaggatctttcttcctagcaggtccctcatggtaggggctctggggcccctaccaggcaaaggaatggttgggattagaccctatgcagaggcacgtgacttttcatagaggggcacttccatggcccagttgttccctcattgagggcgttgtggggagccggttccttcctgtggattgtagccttcctgactttaaatccttgctttattcagatccttggccagttcttctgtactggtctcctgggccacccatagggctgtcttcacttcctaccatcagctgttccctctatccaaagatgaaggagccctgtatttgctgatgtgagctgcttcctttatttatgctctcactggatctctgggagatgtactctaccatcagaacactcagagacagttacctggacataaagtgttggtgttggcatcgttatcaaacaataacagaaaacacgtcagcaccaactgcatctgtccctgtgcttgataaggaaaaaacaacatgcacagtcctgtctttgaagagctgacattaagatggacgatgccgtgaaacacacgcatttgtaagttgcagacatcctcctatgcaagcactctagtcacatttgtttggtaaaagataatcacttttagcttcagaaagaactcattcatgccttgattttcagtgttgccacgggaaagcaatagcagaacctgggtccctgctgtgaaaatgaaaatacttaaggatgttcaattgcttttctgttattcatgtgcatccgtggtaggacatcatggcagagcagctgctcagagcgtgcgattaggtgtgggttcccacttcagcctgggattgtttcatttcctgcagctgttctccagcatggtaaaattcgaacgatgtcgataattttcccataaggggctctcaagatacatcaggttgtgctctctagagtagtttaaactactatttcttgagtacttactatgtactgggcagcattttccatatctcaggaagcagtctcattttcaaaggaaaatgaaatctgtttcgggtcacaccacttcctgcagattcaggacaccccactgagagatttaaaaaccgtggatgctcttttcagtctgacaagatgcttgtcatagagcatcactgtctgggctacagggatgcagaaaggaccgaaggtctgaagggaggaaaagggctctgtactggtgggtttctggaaaagcctttactttgaggtggtccattgagcttgtgtagcctggaggggtagaagcaaaattaaacgaatacgggtcaaccttttaacgcgtatcttgcaaataacatgctactggctctatgtgcaatgcctggatataacaaatctatttttacgaggcctacaaagaccaaaatatctcgatgtgtgtgatgtgatgtaatctctgcatttggggtgggaggtgagtagggaaacaactactttggaattagcacgaatgtacacaatttctgagtaatgatgcacgagaatgctcaggtattcatagaattcagagagggggtgtgacctgcccatgatttaggaaaggccttaggtgtttctgggaattgtatgttcatatgttcctacagccaataactcgcatataatgatcatcattatttgttgaacagttaggctaactgagtatctttttgggggttacttggagcagt

SEQ ID NO: 59852 - DNA, 1045 bp, Homo sapiens
ggaaggggaagttgaggacgtctgagcaaagaccggtggtggatctggacccacagtgactcccataagcatcacatgtctttctaactgcttgttattattattattattattattattattttgagacagagtctcgccctgttgctcccaagctggagtatagtggtgcgatcttggctcacagcaacctctgcctcccgagttcaagtgattctcctgcctcagccatctgaatagctgggattacaggcacgcgtcactgcacccggctaatttttatatttttggtaaagatggggtttcgccatgttggccaggctggtcttgaacttacgacttcagatgatccacctcccaaagtgctgggattacaggcatgagccaccgcgcctggcctctaactgcttgttgatgtttcctaatacatttcctacagtgacctcaagctcagcatgtccgcattccggattcctcctccccgcccagactggctctgcctgctgcgtcctgctgggacaccagttgcgcagtgcctgaagccaggaacctggacctccttccaggtcaaccccgcctcccaccctgacccgtgcacgcctgtccttgatcattatatcatatggcttcagcctctgaaatgtgacttgtgtgtcattacctctccagaacccatgaccactgtcaccttttacttctgctgttgtaataggtccttacctggccttctcacctgccttcctccagtccatcctgtgctattcgatggagtgggacctcgggttgagaacacggctccaggacagccatgagaagggtgcagaaggcagtcagcccgcggctggattagcacccgctggggatcattctcccctctttcccgcttgacccattcccccagtcacacacctcccttagtacaactctttgcttcccttgcttcttctccaggataaggaacaagctccttaacatcacatctccaaccagtcatgaaggggcctgaagtgatctttgctgtttcatctttcccccatctccagcc

SEQ ID NO: 59853 - DNA, 1107 bp, Homo sapiens
aaacgctgtgtacccagaggtctctgggagtttgcagcacctgcctaagctgaggaagcccttatctacctgaaaaatgcatgcctgcttcatagccagccaccgtgccagtggccatatccctaggcagggctggcctgtgccttctctggactccgatagtagttaagttcctctgtcatactgggatcgctcctgtcaccccccatcataaatacttatctgtctgcatctcagacagaagtgagcctctggaggcctgggacccgttcttatgtatctctgtaattcttagcacccaaccaagcctgtgcctggtacagaatcatcgttcattgtgaacgaatgtcatagaacacaggcaatgcagggagatgggggttgcgcaaacaattcaggtacaaattccaaggatggtggaagttgggaatagggagtggtacaagtgccagcgtctttgaagctgacaggcgttaataaggaatcagataaacagggaaaaaatacagtgaatctgacttcttagcagaagtgtttggccgtgttggcccttgggaagctgaacttttgcctcacccgagacgccatcagggtgcttggcttctctggagaactttccagaagtacttacttgatgctattcagagtctcagaaacttgagggccacttttaattatctccaatggactcattcccaagaatagtattaatttaccacctgcaagtgatattttgagcatttctagggagttgcttcaaatgtttcaggttccagttgactttggaatgtatatccatcatctgtcatgtgtctaaggtatatgattccctgtaggtgccaggagctcccaaaatagaaggaaggagtgactacttgggtagtatgaagcatctttaaacttagttgaccaaagcacccttttcctggagactagtgtgccatggaacctcactttgggaaatgcagatccaatgcaatccttttttttcttttttttttttgagatggagtctcactctgtcgcccaggctggagtgcaatggcgcaatctcaactcactgcaacctctgcctcctgggttcaagtgattctcctgcatcagcct

SEQ ID NO: 59854 - DNA, 1028 bp, Homo sapiens
ttttacccaccctttacggaaaaatccaaaggacagagaggtcaagtatctttttgtttgtttgttttttgttgttgttgttgttgttgtttttgagacggagtctcgctctgtctcccaggctggggtgcagtggtgtgatctcggctcactgcaagctccgcctcccgggttcacgccattctcctgcctcagcctcccgagtagctgggactacaggcgcccgccactaagcccggctaattttttctatttgtagtagacacggggtttcaccttgttagccaggatggtctcgatctcctgacctcgtgatccgcccgcctcggcctcccaaagtgctgagatgacaggcctgagccaccgcgcctggccgaggtcaagtatcttctcaccagctagagtagaggaggcagggcgggaaccgaggtggtctctgtcttgagtccatacattataactgttgaattaccggacacccacttcagtggcatttattcggtgaagtgtttggggtgtagggaaggggtggtggtgactggaagtgtagcttggggatcgcctttttaatatccctgtctagtcacaaaaataaggcatgttctaatcaactaagcacttgaccatgaacttctcgtaagcaaggtgagtggtagattttttttcctcaaggatgcaagcagctgatagaattgggaagaaagttattagttgcaaaaacatttaagctttgcagtaagattactagtgcaccaaaggaatcgtgactgttaagccctctagctgattaactggtgctgttattttattttaaaatgttgtaattttttcacaacaagaaaagtaatgtgtattcctagaagacaaatgaggaaaaatacataagcaaaaagaggaagaacactcataactccactagccagaaattccccgtgttaactctggcgtcacttacggtaaatatccccattcatctcttcttgctcccagaataaattagcagcagcttttcctcagagcaggggaac

SEQ ID NO: 59855 - DNA, 1008 bp, Homo sapiens
tcttgaagagtgactttcagtcccatcctgggtaagaacagctgttttgcatgttgctgagtaatttctttgcaggtccttgtgtcctagcatcgtcctttctcacctgcctttattctgtttcacgctgcacagtatggagtgtgcagtgattcattggggagagaagaaaataaaaccaaaaagcccatctgctttgtcaggagacacctccaaacacagatgctccctcatcctcctacagcagctgttttcagccacacctctgggctcaagccatcctcctgcctctgcccccaagtgatcatcctgttgtcccacccattgtcccgtaagcaggagttcaacagggacagagcgcggggtgggaggtggctggaatcatcccatggcttagtggtgtggggactaaggaactattgttccctctccagctggagctgcacatccattttctgctgtcagatgccatccatgtaggagatgctccttccagacagccccccagagccgcctggctgaccttccactcccgggctgagtgtcactacgagtcttgactttctcgtcatgctggtgtttcacaaccttgtagctagagtccggtgcagcttttcttcctgccggcccatcagctttcgcttctctctgccgctgggaggcaacatctcggggttctccaaggggaggtctcaccttgaatgagtctggcattttgaggtcatgatggtggccgggattctgcccatgttcagtgggacttgggtggcagcacaagcagatgaggcttggttttgttccattctttgtttagttgctcactcattccttcatttggcagatgccatatactgtgctggaagagaggatgcagccgtgacccagacagacaaagtctctgttttgatggggcgtatgttggagagtggaggggcagggacagtggatgatcaacaagataattttggaagctgataggagctgtggggaacatgagagaggttgatg

SEQ ID NO: 59856 - DNA, 1046 bp, Homo sapiens
ctaacaaaagttataaaattagctcatcactaggtttagatctgtgacatcccaggggactgaggaaattgcacttatcacagaagagtcacagctgaaatgtttgagaaaacaatgtaagagaggttgtcaaaattcccaaacatataaagggtagaagatgagatctatagactggaaagcttgacttcaatgcacagcaaaattctggaacagaaaattaagcagatggtttgtgatcatttagtaaagactgtagtggttgctaggagctaacatgggttactaagaacaaatcttcccgaacatcccatttcccttttaaatagtattatgtggtgtgtagagctgaagaattctacttctgcaaagcatctaattgtctccttatggatgggatggtaaaacacaggctagatgatagtactgctaggtttgcagctagagagcaattgaagccagctgattaacgtcatggttatcttgatgcgggtctctggtggaataccatggagctctgacatgtaaccttccatttaaaattttaattaggaatttgaatgaagacacatgggatggatatttaccaagtacacagatggcccaaagttgggagggataataagagcaatagatgagtcaatcaacattcagaacactgctgatcatctgaaacgctgcatggaatccagaatgattggatttaatgaagctaaaggtgaagacattaagctctcacaatatcaacccgagtaagaaaggagattgtgggctgggttcaatggctcacgcctgtaatcccagcactttgggaggccgagatgggcggatcacgaggtcagggatggagaccatcctgactaacgcggtgaaaccctgtctctactaaaaatacaaaaaatcagccgggcatggtggcgggcgcctgtggtcccagctaccagggaggctgaggcaggggaatggcatgaacccggggggcggagcttgcagtgagccgagattgcaccactgcactccagcctcggagacagagcaacactctg

SEQ ID NO: 59857 - DNA, 1048 bp, Homo sapiens
gtatttttagtaggaatggggtttcaccatgttggccaggctggtctggaactcctgacctcaagtgacctgcccacctcggcctcccaaagtgctgggattacaggcatgagcaaccgtgcccggcctctactttactatttaataccgtattcatgatactgtattttaccctgggatcagtatttccagatctgaatgctagagtctggacaaatgagtgatgatagagcaatgagaagaatataaaccgtattgtaggaagactggtcagcattgagaagactaagcagaggcattatatccctcaaatctgtgcaggatatatgggaagaaggtggaagctagttctctgttggtcctaggagtcattactaatgaccaggaggctgatttctggtaagtgtgagacaggctgtctgagaagcgttctagctccagccagtgcatgagtaccaggagggctgagactgcctttcttgtgtctcgttctccaccaaattcagagtacctaggactgtgcctgatacatggcaggcacccaacagatatttattgaatgaataatgaaaagaggaaattgagcatgaaatgagcctttgcctggaataggccttcatttggtgcttgtgccctacttctagggcacaatgcatggatagtcgtatggcattttttgaaaataactcatgcactaaaataatgttaaaactttacgttcagattttgcacattgtaagcaatgtgagggtggaataaagtacctgagaacagatgtgggaggccagaataattttttttaaccatgtttgaacagctccaagttaattaaaccacttttcttaagagacattaagaggccattttaggatttatttgaaatttctcaagtatgcttattcaaacattactcattccagctcaactcccagcaacttcttgagaccttctccataattctgacccattcagggctctgctttctctgaacttaaaggcaattctacagaatttagcatttgattcttttctaatttcttcctgagtt

SEQ ID NO: 59858 - DNA, 1039 bp, Homo sapiens
ctttccagggatgccgggggagggaagcagatggtaactgtgtatacccgtttcttcccttgtattattcctttgacagataacagcacatgtgactgaaaagggaattcgtgccagacataagagaagtataattggtgtcagaccatgacattatccccctcattagattatttttgcattccattaacactggagattaccaaaagagggaagaaatcagaaagccagatattcaaataaagactttacttgaaaatgcatttttaaaaatttagctgaaattagcctccctgcctgcataaatgctttactctaagtgataagattcctaggaatatcccagggctacatttagtagaattaactgatagaaactgtgtcggaatattatgctttaaccattacctgaataaataaatgctggaacatcataagattaagtttaatgactgaggagatttttgttgaacattagaatatagacttaatttcatgatttattaatgattttgagactttggattgttgagggtatggagaattgatgattaggctcacaatttcttttccatagatttttcttttccttatgaatgtttgaacaacacattaacttgggatcatgttaggatgcaaataagtgttcatcggtgcatttagttaacctttcatgatcttcaaaatatttttgtaggttatgatatttttgtataaatattttaaagctgtctatgccagaagcatatgtatgatttctctctgtcaaatggcagttccaggtggtgactagcagttttagagatttgtatgttatagtcagccatggtataagtcaaagaagtttttttacttcttggttaccatgttaactcgagttaccttttctagttccttgttcttctgtttgcgttacactttgccgtatttctggtttttcctagagagagctagttctccccaaatttgggagcatgccctagaagttcatgtgactttgctttatgcaatttctgctctataaagatgcaagcacatc

SEQ ID NO: 59859 - DNA, 1011 bp, Homo sapiens
tgacaatattcatttttgtcatagggctatccagttttcagcatcatttgttgtaagttctccaactttagtttttttatttatttgttttttccttaaaatagctttggctattctagagtatttgtattttcatgtaagttttagaataggcttgcctttttttttttttttttttagtcagagttttgctttattgtccaggctctgatgcagtggcacgatattggctcactgcaacttccgcctcccgggttcaagcaattcttgtgcctcagcctcctgagtagctgggattacaggtgcccaggtcattttctatagttgagtacaggtttggtttcaccatcttgcccaggctggtctcgaatgcctgagctcaggcaatcctcctgtctcggcctcccaaagtgctaagattataggtgtgagccaccgtgcccggctgccttttttaatgcttgtgggaattttgtttgagcttacgttgaatctgtttaccaatttgaggacaattgacagcttaaaacatgtagccttttgattaataaacgtaagtgttttcattttatttaggttttttattgctctcagtgacattttatagttttcaggatgtaggtcttcatatacttgttcaatttattctgaaatattttttattctattttcaatggatctttatttcatttttccagttgcttgctgctgctagcatataaaaatataattgatttttgtgcattagcctctgatcttgctaaactcacttactagttccagtgttgttttgtggatttcttaccattttctatctcaataatcatgtcgtctgaaatttacattaattctagttagtccctgaaggaatcctatttggtaaaactttgatagtttagttctaagtattaggtgtattttaatagcataataatatgtcttaaaatattttgtgttagacattttgaaaattcaaattagcctctcttattccctttttgcctccattag

SEQ ID NO: 59860 - DNA, 1017 bp, Homo sapiens
ccactgctcctggcccccatcttttctgtctgggtcagtgagaaagtggaaagagtttttgtttttattttgtttttgtttgactaaagagctaagaaagtctttagcttctaaatatatgaggaggatctaaaacacaacattttggaggactgtattttacaatgtttgtgcctcggaaagttttagtttcctaggaaacagcatcgtgggcactgagatacaacaggggatgctcagcaccttaatattattacctgtctaattgctatttcaattctgagtattgcagtagatttgttcctgtactgctgcagcaagagtcttaattgtttccaggagtctatatttaaattttatttgggtttttggaaaaatgcttttttttttttttttttcagaattctgtttttggaacattctgctttagatagtaggaagtcattatgacatagggagaagtgatagatggaaagtcagttcgtttggaatttatttctcatctgacttgacttgtagaatattaatccagggtcaggcgcggtggctcacgcctgtaatcccagcactttgggaggctgaggcgggtggatcacgaggtcaggagttcaagactagcctggccaagatggtgaaaccccgtctctactaaaaatacaaaaattagctcggtgtgatggcaggtgcctgtaatcccagctactcaggaggctgaggcagggaattgcttaaacctgggaggtggaggttgcagtaagctgagatcacaccactgcactccagcctgggcgacagagcgagactccatctcaaaaaaaaaaaaaaaaaaaagaacattagtccatatattcggagataagaaaggacactgcctcaactcctccccctttacaagtgtaacaacttaggaagtaaaataaacttcaggctgatacaatgcaaaggataaatcagaaatatttttaaaaagaaatagattatattgctgtggaataagaacatatttccagtaagact

SEQ ID NO: 59861 - DNA, 2117 bp, Homo sapiens
tactacaatcattatgtttatttcttatataattttttaccaatgttgtgagttttttaccagtgttgtgatttcctgctgagcttgaaaagctaaggacaaaacacccattctttaaagaatattaatttggttcctggtacccccaaggcatgaaaatagatcagcctccaagagaaaatatggtctctgtactctgttgtcttgtgcagtaagctgtttgcacagttccctgtttgtgggggtcaccgctgttagctgtcgtgtggatattgtattcataattcatagtctgtgttcccagaaacagttttaattagaacacaaattatgactcccaatagaaagccttctgtaagtagccaagcataataacgaagaaaaaaatgtttccgaatatgacaccttaatatatttatatataaattaccaaaatcttatctttgttcacagcagatactaattgaacacctaacaggcctgtggtttctgctgtttagcattgcgggggtgggaaggggcttgggggatacagacaagacacaatcgatgctcctcagtagtgctccttatagagaggagagattataaccctcggaggttgctttcgtgaggacagtgcagggcactctgggaggagacaccttaaatggagggtgattaagagtcagccagatggaggtgctgccacgagataggtagctgggctccaggcagaagggcaggtaccactagaagggttagggagcctgggagggaagaagagtctgtgaggggctcagtctatgaggggctttgtctgagaggagggctgagtctatgagggactttgtaaggagagctcagtctgtgagggtttggtctgtgagggatttaatccatgagtggttttgtcctgtaggagttcagtctggctggggtcagtggtaatgtgacatcttggtgggagttatggctggagatgccagcagaagctaactcaatacctctggttgctactgctgctgctttgtccttctccggactaacgattgaatatgctttgttctttattttttctgccactggaaaacctgctgatacataaaagatttagagagttaagaagataaagaaaaaaaaaggcataatctggagccagtcttactaggttcaactgtatgaagttgccagtacataatcatgtttttcaaggtcttcttttttaatgtaagcatttatagctataaattttcctcttagcactgcttttgtagcattccatacattttggtatgttgtgtttttatttatcttaagatattttcccttgtgatttcttctttgacccagtggttgtttaatagtatgttaatttctgtctgtccctgaattgtttagttttccttctacagttgatttctagtttccttttattgtgattggaaagatactttgtatgatttcagtcttttaaattttattgacactattttgtggcctaacatatggtctaccctggagaatattccacacgaacttgagaacaatgtgtattttcctgttgttggatgaagtgctctgcatatatctgttaggtccagttgttctccagtgtcatgcaggtcttctgcttcctcactggtcttatgtttggttgttccatccattattgaaagtggggtattgaagtcttgtagagctatttctcccttcagttctgttgatgtctgcttcatatattttggagcgccaatgtttggtgcatgtatggttatatttgttacgtctacttggtgaattaacacttttatcattatataatatccttccttgtctcttataacagtttttgactttttataatcatgtttttaatccaataattttttttttgagacagagtctcacactgtcacccaggctgcatcttggcttgctgcaacctccgcctcccaggttcgagtgattctcctgcctcagactctcgagtagctgagattacaagcatgcaccatcatgcccagctaatttttgtatttttagtagagacagggtttcaccatgttggccaggttggtctcgaactgctgacctcgtgatctgcctgcctcagtctcccaaagtgctgggattac

SEQ ID NO: 59862 - DNA, 1009 bp, Homo sapiens
caaagtattcagcaaattaaatgccccaaacagtacattttgaagtttgtagcaaatagtaattattgaaaacaaaacttgaaatatattcctacaaaagaaagaaagaaaacaaattaaatgatgagagcttaaatgatgtataagagttagttggctgggtgcggtggctcacgcctgtaatcccagcactttgggaggcccaggtgggcagatcacgaggtcaggagatcgagaccatcctggctaacacggtgaaaccccgtctctactaaaaaatacaaaacattaggcaggcgtggtgttgggtgcctgtagtcccaactactcaggaggctgaggcaggagaatggcgtgaacccgggaggcggagcttgcagtgagccgagatcgcgtcactgcactccagcctgggcgacagagtgagactccatctcaaaaacaaaacaaaacaaaacaaaaaaaagttagttttgacattctgtgattgtgtcttctggaaagtgtctttgtggcgcccctatttttaattggataattgtatatctgtacagcaatggaaagagattgaaaaggctgattattttgcagtatccaaatttggggaaatattaaatcattaattggagaaggtttatgttataaaattatttacttgtcaaaaggtagcaaaataatcatacctataaaaatattttgaaggctgaactacttatatacttggattaaaaatttacaattcagaatttgctcatttagcaagatttgctgtgaatatagatattgcagcagttgtagagagagtattttccaagttaaaaatattatgatcagtagaaaagaatcaattgaagaaggtgtggacaatttaaaacttagtaatcatcaaatgcaactttgaagaagactgaagacagttttatgaaaaaataaaaataatacatgttaaaaaatgaatttcccagatacgggtttagaaacatataaattaaaaatttgattggccaaa

SEQ ID NO: 59863 - DNA, 1697 bp, Homo sapiens
gtacgtgttgatatggaacgattgcgaagatatgatgttaatgaataagtaccatgcatgatgttgtagtagtacatactttttatttatttatttattttttttggagatggagtttcgctcctgttgcccagactagagtgcaatggtgcgatctcggctcactgcagcctccgcctcccaagttcaagcgattctcttacctcagtgtcccaagtagctgggattacaggcacgcaccaccacgtccagctaattttttgttatttttagtagagacagggtttcaccatgttggtcgggctggtctggaactcctgacctcaaatgatccacccacctcggcctcccaaagtgctgggattacaggcattagccaccacacctggccatatatacttttatttatggcttaaaacagagttatatagaaacatatctgcttatttgtacaggaagtgtccggaggaatatatagaaaactgctaggcttaattctcagagggaagattgggtgtttggagtgggaagcaaacattttttactgtatacacttgtactatttgaattttttaccatattaaaaaagattaaacaggctctatttgtacttcttcccatggctttaaggcttaattataaaaatcacttcccagatccataaaaacctttagttccctctagcagactggatctttgactaccaacctcaaatagtaattattttcataccaccaataattctcacagcagtgagagtcagttatcaatatgacaaaaaaatttcatttttctggcgcaatcagagcgtaaaatcttcctctgtagagagatatgattgagagaaggaggtaggtacagggatgtgtaatatacttgaaataggaagagacctgaagtggtccactctcagaacatattcatttttaatatcagccttcgtactgagcccttaatgacttgggtctttaattatctcactgaacaatttatgttgattcaggaccagctattctctttgatttattgatactatgctcagaaaaaaaaaaaaatacacagcatgttttgacaaagtgccttttaacacaatgcctcctgcgttgtgccccaaaaccatgtgccagaaattttttacatctgttttctccctactgggttttacatttgtagtagctgaaaaggtgcagtttgattcccgttacgacttcaatatatgattgtggaatctctgtgagctgacgagctcctaattttgttgtaatgtgaagtggctgatggatggtggtgattggcgtctaaattctaactaaattatattctcacatgagcaaatcttgaaaccaaaggcacatgatcaaatcattaaaccaaaggcatatgtacagctcagaagtgtccaagacaaagggtggaaggcatcacactaggacaggaggcatcatttgccccagtgcaaacaagagagccatgactgaaagcaaagccagatctctcaattccggagacaaatcaaaaagaggggatgctgaagttcacagctgttgcaggctacagtgtcaggaattttcctccccattgatgagctctaaggctgtaatagattgtgctttcttgccaatatacctcctgttccttcctcccaaggttctcaaggtctcaggaacatcttgactcataagcccaagaacagcatg

SEQ ID NO: 59864 - DNA, 1050 bp, Homo sapiens
ttaactaaacaaactatactctttagtaacctatttcgcctgttagtagtttgaccacctgcttcataaagaagtcatgtttctctctcaccctcatcccacatttaaaatgcatttgaacagaaaactcaggtaaaagtacccgtgaagtggttttctcacaagagtagatattaagaattggtttgaacttgccgggcgtggtggtgacacctgtaatcccagcactttgggaggccgaggcgggcggatcacctgaggccaggagttggagaccagcctgaccaacgtggtgaaaccccatctctactaaaaatacaaaattagccaggcctggtagtgcatgcctgtaatcccagctactcgggaggctaaggcaggagaatcgcttgaacccaggaggtggaggttgcgttgagccgagatcataccattgtagtccagcctgggcgacagggcgagactccacctcaaaaaaaaaaaaagaaatggtttgaactgagcctgctatttataatttaaaatgtctttatattcagcttattattaagtggggggaaaatgaggtctatgttgggtgaattcatttttatggttcattctggtttggagttcaacctttgattgaaaggtttatacaaagtaaacaagacattaacatacggagggctgtcatgtacagagattgtcggtgctggcaaatatttatgttgttttgtgacttggtgttgacagtagcactgtcctgtgacctgagtacggcctcgtgctctgtggctgtggctggtcatttctcttccatctccgtgtggacctgatagcttcactcaggccttgtgttgaacgcctgtctcacatgactgtagacctggtgacccagagaactgccagaaatatgtgtagccaccatttatggagtacttcctgtgccagccattgttccatatactgtgtcttgactcatttcatatctcagtatctattatggaggttgttaataaaagaccatgagatttgtggaggaagagtcattttctataagaaacaatc

SEQ ID NO: 59865 - DNA, 1036 bp, Homo sapiens
ggattctttgagtatgaggaggacaagtaaatgttttgaggaagcatggcatagcaagaacaccagggggcctcgcatacctgcctttgaagtttattatgtttggcaagaccctctcagagcctacgttcatagctgtgaaattagccataaacatgctccctccaaggccttctgttgggaggatttataaggatttaaatatgcttagcacagagtgcaggccataggagatactcagtaaatgggatcccccctctgcccgacctgtaaccctacgtggaatcctatgatagactttgcctaagagtgaccgaggcagcattgtcattgccacggctagagcccccattgtatttagtttaaccttcgctctctaaaggtcagaatacatttctacaacacaatacattttatttagtgctgcacacacagtggttttagtgagggccttaatagtccccccagaggttccacgtatgcacctcttgcactctgccacctgtgctgtggggctagtatcctgcaatgacagtgcactcccagcttatgcctgggagacgttcttaaagtcccagtggcgactgatacgtttacatgctgtttatgaaagagatggagtttgggtggtgatgggagggagggaaggagaagaaggaagcgccgtaactccatctgatgggcacagaagcagaggaagagtaacgcatatgctgtgcactcccccttcccttcttgccacccaatccctgatcccagctggatctcaatatagaataataaaactgtgattaagatcacgtaaacacaatttattttttcattaagctccataatatacttttgcacttgtttctataaagcttcagacggcctcagcaaaagagttgacgctttgcctgtaatataatttgcatgtccctatcctctttaaaagtgccagtttccttgaattacagatattaactcccaagacagtataagcatcatggccttttggacaggtgggctgttttcttctattcattttgaggtt

SEQ ID NO: 59866 - DNA, 1050 bp, Homo sapiens
taacggcatcccagttcgagtctcagccaagggagcaggcacccatgccctggggcctgaactgtggcatgggagtggggggcacagatcttttggcagaaggtggctacccaggtccaagcctcagacatctttcctccttgtcagaccttcctcctgggtgagtcacctatgtggggggcgggtgagaacctctttgtggaggctctgggaaagccgacttggagcttggagcctccacagttatataaatggaaaattagaaaaaaacaaaaaggccttgtgggcttgtaaagatggaatacattgtagctgagaaaattcttggctgagaaaatgtgaggagtgctaaggccgtggttggaggatttttttttttttcttggtaaagggagacagtggctgcagaaggcaccagctgtccccacctctttgccattgttgaaacaaactcgcaaatggaaaggactttgcaatgcagagtctaaggagggaaaatgaaaatatgacagatacaaagaactgaatgcattctgaaatcttaggggaataaaaatatctagtattgagacagcccaaagctaagagtctgcaaactcagaaacagcaagaagctttttcacaagaaaaggaaacttagtgctctaggtacatagaggtggagaggagggcctgtgtgttttaatctgtcacccgatatcttgtatagctgtaggattatggagtgattcagtttcctctctgtagcaacatccatgaaaatatctatttacttactgcctcgggaaaacattcaaatttatgatttaatcagcttcaaagtatttctgctgagttttgttactttgtttaacttttttattatgtggtagctggtggattgtaggcatatttagcagttgggaaatgtctaaggaaagattacctttgataaaaagccagtaggaagggaattgaaggacgcagagtcgatgcctgcagtttcttgtttttgtttccccagctctggagtcagactgcataggtttgcatcctgactcttcaagttac

SEQ ID NO: 59867 - DNA, 1035 bp, Homo sapiens
gttcagactatataccatggatctttgctgggtggattaaggttttgaatgtattgcttgtgtatttcatcatgcagtcaaaatccacctcccacataagcctgttgttggatagagctcccagtcatgaaagtctgtcctctttttctccccttctatttcttggtattaatttcagcttaatcaagtcttctggccctgtgattccaggaacagttgggttctggctaaaagcaaaagagaaaaccgcctgtttcagtcgcataaggtgatgtggcaagaacttgtttctgaggaatccaagatctagccattttcagcagtggtcataggggactggaacgggggcgccacctgcaggctaagggggaaaacacagagcgagaaactgaaccttgctttaggggacaggcatttaaaggcaaaggaaattcagtccctctgtgatagacagtaatgaactcagcaggctgtcttgtagataaatatgcatgagaatgcatcgttggaagagctctcacgtattcccttcattcctgccttttggagtttcagaatgttttacattttatgttcatttatatttttctttgtcagagtatggagatcctaaaatcatctgccagggtatttgctgcttcttggtactgcttgctgctcttttcagagagagcagtgccaggtaaaatattctgcattctcataagaagaggtgaatgtcattgcgttccctgttaatatgaggcagggaaggacgctctggcccggagccggagtcctcacaccactttggtctctgtcctttctagcagatctaaatatctactctgtctacaccctgtttttacagaaacaccagtgctagtctagaatgaaggcaacattgacagcagtgatgatcaaacgttcgtttttcaatatgccatgaaaaataacttggtccaaaataaaattctgtccttatatttctatttagatgtatacctcccataaaggtaaaatgtttttctcagacgtaatttcagattttctgtg

SEQ ID NO: 59868 - DNA, 1755 bp, Homo sapiens
gaggcatggtacctatttcagatctccttagagtttctgttaagtgggtgcctcccttttttttttgggatggagttttgctcttgttgcccaagctggagtgcaatggcgccaccttggctcactgcaacctctgccttccaggttcaagcgattctcctgcctcagcctcctgagtagctgggattacaagcgcacgccaccaggcccggctaattttttgtatttttagtagtaacagggtttcaccaagtgagtgctgcttttaagaagtcaaatgataggcaacttgtggacgatgcctttagtttatctaagtcctgtttcagctttgaggtttccatgagttgcgttttaccctgaggttggtgaagtgcagcattgggttaactttgctcccacgaattccaggggtgcccattgctaactggcttctcacagcaatgacatttgaggccggaatggtctctctgtcggcacggtacacagttgttcactggtggcttattggtcagatcaaaaaccaaaaagaaacagggagggaatgcggactaggatccatgtttgtagaaatctgagcagggagaaaggaagaaaggaggattgggggacccctacatgtcctcccttcagttgcagatgtttgttaggatgtggtcagatgtggggaagggcaggtggccatggaagcagggcccccaacaagtggcattcacctggatggatgccccacagcccagcatctagacttcagctggtttgtcaacacaccaagtgtggatgcttttgttggaacagaatccctcaacagagacagaatgccagtattattgattcataataaaatgtataattatccagtgggctcatgttggctaagtagcatcgtctttcccctttagggcaaaaatacttagaaaggcaaactgtaatcagaagatcgcttggatggatgggatcagagcaggaggagggaacggggttatgttgacagctggtaccatcaggctgtgatagctggtctggaaccctcacctccactgtaaggacatccctgccacagcccatggtcacggcatgtagccaggactctgctttcccagtggtcctgtggaggggctgctgacttggaaggtggtgggcttctctaagtctcttatccatggtcaccctgctgaccgaccccaccgtcaccccccacccccgtaggcatagacatattatatctttagaatatgaatccagacaaccgtctaccttcatacatggcatagtccccaaaacatgcacccctgtgcaaaatggaacagtacacttacatgctcccagcccagagaggtttaaaagtatatttatatttttaattataattttaaaataaaaagtatatttatatatttataaataggtgcattaaggccaggtgcggtggctcacgcctgtaatcccagcactttggggggccaaggcaggcggatcacgaggtcaggagttagagaccagcctggccaacatgatgaaaccctgtctcactaaaaatacaaaaaattagctgggcttggtggcaggtgcctgtaatctcatctactcaggaggctgaggcaggagaattgctttaatccaggaggtggtggttccagtgagccgagatcacgccactgcactccagcctgggcaacagagcaagactccaactcaaaaaataaataagtaaataaataaaaataggtacattaaattacacacacacacaca

SEQ ID NO: 59869 - DNA, 1048 bp, Homo sapiens
tttagaataatgccctaaacttgtaatgtgagcaggtcttcagagtttcgagctgaagttacaggtttagagttgtccgttggaggtttttgtttcttcgtttaatgatttaaaaacaggttatgatacaagatcttcaaaatggttttaccacatgcatcatgacttagaatcttcgttggctcttttggtttttttcattcaaagttgaaatgcctcacctcttctttctttttctctctactaaccattttctactgagcacaccgtaccttatcagtctcataactgggccacctaactctccctaagacagcactaggagttgacacccagagaatctgtaagtcatgtactgctcatctaacgaacagtccctgctagccttgcctgcttcttttgcatagaccccactcttgggcacttccacatctgctaagtccactgaaacccagtggggtagattcatctcatcaaaaagaaatagagacaaggtacgacaattacacgatttttgaccgaaggttctcatgggaagttccccattaaaattgttatagaggccgggcacagtgctcacatctgtaatcccagcactttgggaggctgaggcgggtggatcacctgaggtcaggagttcgagaccagcctggccaacatgatgaaaccccgtctctactaaaaagacaaaaagtaaccaggcgtgatggtgcatgcctgtaatcccagctacttgggaggctgaggcaggaggatcacttgaacctaagaggtggaggttgcagtgagccgagatcacaccaactgcactccagcctgggcaacagagtgagactgtgcctcaggaaaaaaaaaaagaaaagaaaaaagaaaactgtaaaaagaatttccctcatttcatgaatgcaccaccctaggtctcttgtatcaagagaaatctgggaggaaacactttcctggcgcctgtgggcaggggtgaggcaggaaggagtgagtaggctggattgagcaatcttcaacagaatcctgtttcactttttagggttag

SEQ ID NO: 59870 - DNA, 1018 bp, Homo sapiens
aattggccgagttgtgcaaccatcacctgaatccagtttcagaacgttttcatcaccctaatggcacacacaccctctttttaaaattatgtctggtagattttgaagcaaatcacgtgagctgaggtttcagctcagtgaagttcttagcttgaagggctctttagctgggaataatatgagcgagtgaggtgccattgaacagttatttgagatcacatcatagaagatcttgggagatgtaactaactaaaagctgtttccaaagagaatgactccagctccctgtgttaagtggtttattccccgaggtcgtctaagaataccacatctgacaaagagctccatgctttagagttcttccagtttattcttcaagaggagagcccgcgtcagagacggggactgtttaaacacatatggatgtgcgcaagacagcaggtgttaaaagaggaagggtgtgtgggaaaggaggcatagctctgatgagaggtcatcttggtatgtcaccagaaaagaggaagagtaaagacaaagaagattgaacaagaaaccaagacaaggctgggtgccgtggctcacgcctgtaatcccagcactttgcgaggccgaggcaggcagattgcttgaggtcaggagtttgagaccagcctggctggccaacatgatgaaaccccatccctactaaaaatacaaaaattagccgggcatggtggcaggcacctgtaatcttagctacttgggaggctgaggcaggagaatcacttgaacccaggaggcagaggttgcagtgagccaagattgtgccaccgtcctccagcctgggtgacagggtaagaccctgtctcaaaaaaaaaaaaagaaaaaagaaaaaaagaaaaaggaaaagaaagacaagggaaaactaggctatttctaaggtcgtataaaaatttgccttcatttgtcacatttctgctcctgttgatgaaataatgggtctataaaaaaagggaagaatgcacttaaaaaataggta

SEQ ID NO: 59871 - DNA, 1076 bp, Homo sapiens
gcttttgtccaataagggactggaacacatagaaagtgtggatgtttgtttgtttgtttgtttgttttttgtttgtttgtttgtttgtttgttttgatgaagtctcgctctgtcacccaggccgaagtgcagtggcacagtctctgctcactgcaacttctgcctcctgggctcaagcaattctcctgcctcagcctcccaagtagctgggattacacgtgcccaccaccatgctaaattttatattacaggtgcccaccaacacctggctaatttttgtattttcagtagagacggaatttcaccgtgttggccaggctggtctcaaactcctgactgcaaatgatccgcctgcttcgttcggcctcccaaagtgctgggatgacaagtgtgagccactgtgtccggccagaaagtgtgttttaaaagctgcctacaccatagccatgagtagaggttttgttctattctcgggttgcagccatttgcgctgagtgagaaggagccaaggacagtggatgcttacctggaacgtctggcagctggtctgtttcctcatcttaattctaaaagagcacatcaattgacaaagccatttcagcacatactgtacatttgtgcaataacaagggaaggctttaaaactattatctgtcaaaattcgcaactgacaaattcccatgatttaattgttttttttcccaggcgctgagtatgtgtgttttgattaccctgccctgtccatgtggcacagtttgggctgtgacattgccagccagttgtccccacccgggggtcactctgtgcccacatgctgtgcatatcactcactcactcacttaccctttagcagatcattctaaatggttttctggcatgatttttgaaatggatgattattaaaatgcgctgaagggttcttttgtttagatgtaaccttcgattgcagagggaagtcaccaagtcttgtctgctgggggtccctgcacaaagccaggaccagccaggtgggacagccattccctgggtgggctggaggttctagaatattcttctgagtgtgaggcacccactcc

SEQ ID NO: 59872 - DNA, 1051 bp, Homo sapiens
cctttgacagagccatctcctgtctcttccacttgtcatgtactcaaggaatatcaaatgactttagtatcggaaaaagtataattgaaaaacaattggccgggcatggtggctcacgcctgtaatcccagcactttgggaggctgaggcaggtggatcacaaggtcaggagattgagagattgagaccatcgtggccaacatggtgaaaccccatctctactaaaaatacaaaaattagctgggcatggtggcgtgtgcctgtagtcccagatactcgggagactgaggcaggagaatcacttgaacctgggaggcagaggttgcagtgagcagagatcgtgccactgcataccaagtacaatcttcctaactggaggtaattgtggaaaggccaatatgtgaccatcaaagagctaattacaaaatattttcaaaaattaatacattcgagaacatctgttagtgcaaagctcgtgctggctgtgttcaaccagaaggtcactagctggggctatgccatgtcagtgactggttcattaacctaggacacctcaggaaatatgtcatgctaggttgatagctctgaacctcatcttacaagtcctcattagactaaaagtttatagagagatatctaattaatgcagaagtcacaattctcagttgtgagatttttttccaaataccatccaccccgtgtggtccttgggatcttagaacgggctgcctcacccttctgcccggaatgcttttcccctgaccacacgtggctgcctcgttcctgtccttcagaggggccatcgctgaacgcactcaacagtggctgcaccagccacccactagactgtttgacctctccacccagcatttctaacccttctctcatggcctgtattctccgaaagagtgagttctggctgctttcactggttcccctttttcagtataattccatttactgggccttggctgcccactgggcttctcttcacttaactaaatactgctcctcctttttagttttatttcttatttttttgagacagagt

SEQ ID NO: 59873 - DNA, 1001 bp, Homo sapiens
gccaagtcttggacgccgtgtactatctccacagaatgggcatcgtccacagagacctcaaggtgaggccatcgctcagcagcatcctgcagccactctgcagcccgcaatgcacgcgaccaagagggctgatgccagtgggggcatgcagctgctctgatgtagagtgggtgcagcagatggtgggcatttgtgtactttgagttgtcagggcctttgggatccagacccagaagtatcttggaagaagatgaagattcacatggctggccactgttcatgagatttttacaaccattatgtagccaaagggttacagggaggtgggttatatattgcttcgagcctatctaagagacgattttgctcaagacacgtaggctacagaaaccctcctcccggtgcagttccgcagcacctttgccaattccagccccattgcagcacaacacactgtataaaagaaagagagcagtggtcagacatcatgagaggaaagtgaagggaaacagaaggtaagcagatatagaagagggagaagagaaatagaagggaaaaagacaggttaaaagagctatgactggctgggcgtggtggctcaggcctgtaatcccagcactttgggaggccgaggaaggcagatcatgaggttaagaaatcaagaccatcctggccaacacggtgaaaccccatctctacaaaaatacaaaaattagctgggtgtggtggcgcgtgcctgtagtcccagctacacaggaagccgaggcaggagaatcgtttgaacccaggaggcgaaggttgcagtgagccgagatcgcaccactgcagtccagcctggcaacagagcgaaactccgtctcaaaaaaaataaataaataaaaatagtgtcttgcaggttcttttcttacagtttcctaatgaggttttggtatattgaccctttccccgttggcacagaaggatctgggccttatattggcatatatgcccctccccagcag

SEQ ID NO: 59874 - DNA, 1014 bp, Homo sapiens
tgtagattcttgtcgttatcacaggagaatttcatccattgccatatacttggcctaaaggactctcgtttatggaaattggtaaagggcagattcacctgagctttaaaactaacatattgcacttacagaatgctttccctttcaaaagacattgatcaccttttgcagttttatccttttgaggtgtgtttcacatccttttgagaatctaatgaaggtcatggatcctatcccctaataaaatcacatgtgtgcgcgcacacacacacacacacacacacgcacgcacacaattttgcataccattttctcggggggtgtggtcattgtcctgggtaagcagacactggacaggagccctgtgttactcaccctggctctctaagtcctcaattagaaatcttatcagaggtcctgcctcatccagcttgactatggaaggcttaaggaaataaatgctaggccaggcctcttcctgcaaagaactgaagctggtatcagtcatctagagaaaccttccctggggctggggaaagtagccctttttctggccttctggttatttgttcctttatgtctatctggaccttgaaccatgactatggtctgcacgaatgtctgtggactccctttgggtttgtttgtataattatttccctgaagttacagccttggggtggggcattggtacagctctggttaggtacttgttgacagatgctgccagatgtttcttagaatgactgggataagcagtttaaaactaagcaatgatgtcttagtcagatcaggctgctacaacaaaatgccatgtggtttaaacaacagatatttatttcttacggtctggaggctggaagtccaagatcaaggtatcaaccaattcgtttcctggtgagggctcttttcctgacttgcagacagccaccttcttgctgtgtcctcacatgctgtagagaaagtacagaagagcaagctctctggtatcttttctaatccagtcactggcaa

SEQ ID NO: 59875 - DNA, 1028 bp, Homo sapiens
tttgaggctgggggtctgatgtacagggaggcccatgcacagctatagtaggtcacagaatgcagtggtcattgaggacagggaaaagcaccatcaaggcgggtctagaaggttggataagcagagagataagagcatcagacaggacaggggagggaggcaaggaccagagcagggtgccatggcctgtgtgagggctcatgaagctatcctctgactgttctgtagcctgggtttgtgtcgatgtcagaggtgggcactggatttaagcagcgttagacatcagaactcgtttgtctcattctcagactctttctccttcctgtgggtccaccgtgcctggtctcccattcccacctaaagacttatgcacaaggccactgagcggtccatgagcaacaggcagcatgccagggaggccacctccccacacggaagtcacggagcgcctcattcttcccagccactgtaatggaaaagaggtcagcccctgcagtgttttggagcatagcactcttattttttatttttgtttgataaacctgtcacgctgagatatcagactgcagccaaagtggccgtgacaagccgtggcaccgagttttctcctcttgcacgccatataaacattcctccttttgctggtgtgcgcccttgataaattggccctcttttggtctccatttatctactattcatcatttggaaggagaagtattttttcctaccaaggacactcatttttaaaaacccatgtgatgagttcttatcctgccaggaatcttgctttggggattaggacttgcaaaaaacatctttgctcaaatagcttatgctgccaggaagggctgaggacggcgtgggttgcgctttgtgataagcgtgttggtgtccagtgtgacgggcttggctcagccaagatagcataaggtccaaggcacaaattttctcagtcaagatgaacctcagcatctcacagatcaatcttgattctgtgataacatgcggcccgcctttcttctcagaac

SEQ ID NO: 59876 - DNA, 1013 bp, Homo sapiens
ctctacattgctcactttttaaaatttactcacataaatgtcgatttgcctgtgcatgcagctgaattagctttggaagaatggaacagggaaggcctaatctgcatgcttatatccatgttctgaaacaagagatgagcctcgccaaggcagttcccatccctttgagcaattgacagctggctcttgatggaatacatatgttctaaggagaatttgagcccaggcatcccccagagagaatgcagcgtggtcaccgagccccaagccccggggggtcgtgatggctgttattcctatcagcatgaggagtgctgactttaatagggactgttcactgatgtggccagcgggcaacagtcgcctgcttatattcatgagctttgtgaggtggggcacggtgcctcattcaggccactgtgggcccatggtctggattttggctttagaaatttggaaacttagtttgatctgtttattcatcttgttcagacatctttgtgaattgattcacagtaactagactcagaggagaaaaaaaaagactggactgtccacttactaaatcataatgcagtttgtgcctcacaaggtaattggatatgcatgtcagcaaacaaacatgttctctcccctataggaaatgctccgtgagaaaccaaatgaaaagcagaagttttctttcttttggaacagggtatcagagcagtggaggcgggtggccttagatatattcacgaagcctgtgctggtctccaggccaccttctccatagaaggatgattccgctgagcagctctttctcttggctgggtagcacagctgaccagttcctttttttttttttttgtttagagacagggtcttgctttgtcacccaggctggagtgcagtggtgcaatcatagttcaatgcagccttgacctcctgggctcaagtcatcttcccacctcagcttccaagtagctgggaccataggagtgtgccactatgcccagctaattaaaaacaaa

SEQ ID NO: 59877 - DNA, 1061 bp, Homo sapiens
taaattacaatctagtcttaccagctgcctgaaatgggagggaggtggtggggcagctcctagaacagagctgggactctgccctggcctgaggaagccttcccaggataggttacagcgatctgggtttggaaagatgggtgagaatctgccaggagagagctagtccaggctgcgggaagagctctgtcttcaatatctgcctagagagactgatggtttatcctctcaagactcaattatctaaagataaaatgtgctgtttgtgtatgagaaaagagatgccattcaattagaaacatagtgtttaaaatagagtttgaaggagttgatcgagctttgaacttttaatatctcaaacttggggatggggaaaatatagtctctgaattatcaggatttttcattcccctagcaggacactgtgcacacagaagaatcaggggctctttattatggttttatatatgtattggaggtgcacagcagcagcactcagcaggacaggagcagggcatagatggtgaaaagaaccaaggaacatgcacagggggaaaatgcccagctccacggtgggtggcacaatagcaagcgggtggcttcaggccccatttgtgacgaagagagtagagatggaggccaggaggggagggattccatcgtacaccagcaagtcagggaaaccctggaggacacgggtgggaggatccttggaagagttgatcagaagcccacgactcgacgcaacaccatgtaatgtggtgcacggtgccaccttcccgcttttggtctccttgccgtccacgttccaagggcttgttttctagtccatctcagaagtgcattgttgggagtcagcaaagaggacacgccgaaagtgcagtgaaaggcctcagccaatggggtggagggagcacgacattgccctggggccattgtcagcctatgcagatgcgtaactgcttacccatccaaactaggagggagggagggaaagagggagaaaaagaaggagagaaggaaggaagctagggagggaaggagggaggaaggaagaacct

SEQ ID NO: 59878 - DNA, 1043 bp, Homo sapiens
cccctgtaatcccagctactcgggaggctgaagcacgagaatcgcttgaacctggcaggcagaggttgcagtgacccgagatcgtgccactgcactccagcctggtgaaaagagtgaaactccatctcaagaaaaaaaaaaaattgggcccccccgccccccaccataaacccagcccctctgacacctggcagtgggaagcagggtgagaatttacctctgaaactctgaagcccacttctgctgttccctgcaggtctggcaccttccacgctctgtagtttcatttcttcttcgtcgggggtctcaggagttggagccgagcggagacccaggcccaccactgtgacggcagtgcactctggaagcaagtgactggccctggaggtggggcccggggtcggggctggggaaggggagccccagggtcgccagagccgcgagccactccagcgagaccccaccttgcatggtgccccttcctgcataggactggaagaccgaagtttttttatggccatattttctactgcaattctgaagtgttcatttctcacaaactgtactgactcgaggggcgctgatttcataggatctggtgctgtatatacgaatcttgcaaagctctaactgaacggaccttcttattcctctcccctaacaccatcgtttccactcttctcagtgtaggtaaccgtctatggtgtgttttttcattaatgacaaaaaaaaaaaggtttcaactggattatttaaatattggtaaatattgtgcattagggtttgtttttccttttaagaagtatgtcctttgtatctctaagttacatgacctatatcttttcctctttaatagtagttttatgttaacctttaagagatttgtttttcctcaaaggagaatttaaaggtattttttaaaattctaataagaggatcagccgggtgcaatgactcatgcctgtaatcccagcacgttgggaggccaagtcgggcggatcacaaggtcaggagatcaaggccatcctggccaacatggtgaa

SEQ ID NO: 59879 - DNA, 1109 bp, Homo sapiens
catgtaataaactctgcaagaagtttaacccacataggtttgcggcactgcaaaattgttcatgggtctatgtagcaaatgattctctgccttgacaatcatgtatacatatcaagatttctatcataatgataatgagattgatgacttcctgttttcctccaataaagacaattaatcaccttcagatgctcatttcctctgtcatgagaaggatgtggagtttcagtgtctctatctttcctctgcttcctgaagtttggatttgaaggaaggagtttgaattgagaccccccaaactcatggagtcccccttaaatatttcaggtcacctccccagtgagcagggagtggcagggatgggtgaagggatggtacatcgtgcctttggggttggggacaggtgcccaggttccatgatcactggacaggaaagctcccccttttccctgctgctgcagagggggactggaggtgagcctgggaactcaaatcgcactaactcaatattcctaagtcatgtggaggaaaagccaatgctgatccccaggaagcgcctctgagtcatgggtggcttggcagcctcaggcttcagcaatacacacccacgttcttccatttcctcggcatagcagtgcccaaaggaagattcttttccaggcagaaggctggctgctgtcttttgtgggggtttgggggagatgcaggaggaggaactacagttcatagctcatcaaatgtattgtggggctcgggtctgatggccagacaattcttccaatccaaatagggattgtgtagggagaaaaaaatgaattggacatgtgttatagaaatgtagaattaaaactgtcccacacagccagcatcagatgaaaacagcatgggtgggccttactgaaaaaaggctatgagcccaaaagaaaggcagtgcccactgtctgatgtctagttcttttgtggttgattcttgcttctgtagcccagaccctaatgatgagttgcatcaatacaaagctatcattcagtgggtgaatatgtgatgtcgttattgcaggttttatggaacataacattttgatggcaaaaaaggagatacaaatcgtgtg

SEQ ID NO: 59880 - DNA, 1051 bp, Homo sapiens
gatggattgtaaaggtcaacaaggttaagagatctcagaagcaaagaggagatggagtgagcagttggcctatgtttggtcatagtctgtatcttgagaggaggtaaagcagccttctaaataaagaaaaaatatgatcgcttaatgtgttaatgaaacccagtctcaattgcctcttctttcccacagctattttctttcactagttgaaagtggtgtttaactgcagacgtatttttaaaacagccaaggtctcttaaccaaataaaaagcatagatcccattacttttgatgagggaagaatggaggtggaaaatagtgtatataagtatgtaagtttaaatctttttatgaaaacacacacataaagcttggaagaaaccatataaaagctgtcaaccctagccaaaaagaaggaaaagaagaaaattggcttcctaagcttttagctataaataaaaataaccttcctgatctatgtttgatgcattacttgggaaaaactttactcttgtgtattctgaatgatttttgagtgtttttcacacttaaaaatccctgtaatgtttgatgtcattttataccacttaggacttagcttttccttctgaccccttgatgtgtcattttaaatgtaacagtgacagttgtaagccgttcgaaatgtaacagcccattttatttgtttaaatttttgttttttgagacagagtcttgctctgtcaccaggctggagtgcagtggtgcgatcttggcttactgcagcctccagctcccaggttcaagcaattctcctgcctcagcctcctgagtagctgggactacaggcacctaccaccacacctggctaatttttgtatatttagtagagacagggtttcaccatggtggccaggatggtcttgatctcttgacctcgtgatccgcctgcctcggcctcccaaagtgctaggattacaggcgtgagccactgtgcccggccaaaagcccattttattatggcacttcattaatgcatcaagttttattcttgcaaccttgagatttggg

SEQ ID NO: 59881 - DNA, 1030 bp, Homo sapiens
tctgtaaccttcgaagacatgtgcaaggatatgtaatgtatctctgtctttcctcagttgaatgtagctcaaggtgatgttaaaaacagagaatgaagctttctgtaactggcattccaccgacagatatttcatatgtgcactgcacagtgatagctcatagtgatgtcctaagataacctaagaattatgaagtgccctttgagtcatccaaaatcagttaaattagtttttttttctttttttttttttttttttttgtgagacagggtctcactctgtcacccaggctggagtgcagtagcatgatcttagctcactgcaacctctgcctcccaggttcaagcgattctcatgcctcagctcccgagtagctgggactacaggcatgcaccactacacccagctacttttttttttttttttttttactattacaaaatttatttaacaaaaagtctaatatgaaaatgtacatgacctaacttttacatcatagtaaaacaggccctatggagagaggacatgggtttctctgctgaacagccattttttatactcattccaaggcttctaacatgaggatactgtttcctcgtattaccaccattccagtattgttctgttgcccactagtcgccatctccacacattcatctatcacaagattcataaagggatcaagtccctgcaatattccttggacgtgtctgccaccatttaatttcaatgataacttcttgtccataaatcccttctagccatctggttagaacatgatgctattcgagatgttcaacaaaaggtggcattcgagatcttcaaggaacgaagaagggacagcatgggggtgaccaggggcccgaccgcaggaccgggaggcgagtcggccagaaagaggtgcagtggctgctggtggtaactacgccgacgtgcgagctctgctactaatttatgtatttttagtagagatgggatttcaccatgttggctgggctgatctcaaactcctggcctcaaatgatctgcc

SEQ ID NO: 59882 - DNA, 1053 bp, Homo sapiens
gtgttaagaatggtgttactttttttgttgtcgtttattcggtgacttttaaacttagctgtgtcctaaaaggaaaagtctttccttctctaatgaattcttatgaatgagataccatgttcatggaacacacatgcatccacatgtgtaaacacaaacaatttcaaaaacattgctgcataggacagttgcatggaaacaaatggtgttcaagatgagtttcacttgccttttacctctgtgtgtatttgtctgtgaatcaattctagccaattttaggatgaaaaataaaactaatgctaatatagtgaatgtgtagagattttgaaaacccctgatcctttatcccaattgtaaacaatgttctttttagtacttctgtaataattgctatttctcttaaagccaaagagaaagtaacttttctatcttctgtgattttccagagtttcagattttgaaaagaaaacaagtaatcgttctgagattgaaacccagacagaggggagcacagagaaagagaatgatgaagagaaaggcccggagactgtgagtcctaagattccacggccactaccacacccacacacacgagagtagtccagccactgaattcaaatcttgtgatgggttatttgctttagaaatatagaaatcatgttgatattgaatattatctatctattccttttatatgtccttgtcctgctctgtgtcaattgtagcgagatgtatttcttttttgttgttgttgttggagatggagtctcactctgtcgccaggctggagtgcagtggcacgatctcagctcactgcaacctccgcctcccaggttcaagcagttctcctgcctcagcctcccaagtagctgggattacaggtgcccgtcaccacgcctggctaatttttgtatttttaatacagacagggtttcaccatgttggccaggatggtcttgatctcttgacctcgtgatcctcccacctcggcctcccagagtgctgggattacagatatgagccactgcgcccagctgcaagatgtatttctat

SEQ ID NO: 59883 - DNA, 1017 bp, Homo sapiens
caagcctactgtaggaaaaggaatgttgtccactttataatgagatcatttgaggatatgacttagaaacttgagggagaattgaaagatttgggttctatcccattactggtttgaataaagtagtttgaaaggaaaaggttcactgttgtcttgttcagtgttgtctggtaattgagagaggtgccttcgagtctgcagagagtcttcagctttcggaagttaatgaagccgtgaaggttgatagccataggggcccacgtgaaaggcatttacataaaatattcactttaggtaattaatttattcaacaaatatgtacattgaatgcctattgtatgtcaggagactgagaccttactgttgaaagaagagagaacatttagaaaacagatgaagagaccaccagtgaataatagttccctgttgactaaaacgaattcaacagccagtagcagggaaatatggtctttcaaggcatcagaaactcatttacaaaaattatagagctgccaggaaaaaggctgcacaacaaaaatagttgagtaaactagaaacatacactgggaagagagtatgggggcaagttgttagctggatagataggactgtgctttgacacctctgtggtctatgatctctgaacctggaatagggttcattttaatagcgataaagtcattatcccagtgcatccaaattgattagttcatgctttattaggaaacagaagttacccaaaacttagcaaacctaagtaccaagtatccaaaacattcttttcctacacaatgtttggggtattgtcaaagttggattgattcaccagccagtcttaattggctactaatggttcagcctgttttctcctaaagaggtttgtttaatgtcagatgataattgtacagatatgtttgggatttcccgtatgataggttggaagcgaagtggaagcactgaacctccaggtgacatctctgtttaaggagcttcaagaggctcatacaaaactcagca

SEQ ID NO: 59884 - DNA, 1050 bp, Homo sapiens
acaaaaagttagagctacaagtggaaagcatgctatcagaaatcaaaatggaacaggctaaaacagaggatgaaaagtgagtatgttgagtcagaagggcagcgacggggcagaggagggagaatcgcctttttatacagattggaattcggatttgagaataaattttaaaaaatttctttttcacttatctgaaggagtcctagcagacctctcagagagggggataaaatttaaaagttttgtcataataaaattatgctgattgtttgcactctgtcttgatttttcagaaaagattttttttgagagtaagaaatgctagtaggtcgtggggtgataaaggtaggcgagaagatttttctactggagtgttcagaaggttgggaggcaagactataagtttctatgatattttccccaggattccattttttaatatcttttttaataggtccaaattaactgtgctacagatgacacacaacaagcttcttcaagaacataataatgcattgaaaacaattgaggaactaacaagaaaagaggtattcactgaaaaaaattacttccatagcctagtaatgaacagaaactgttgaacgttttgtatataaaatagttacatgaatccttcactaaatctggtttcaaaggttgttttccaatgtatcattatttcttgcatctagggtttgtaacttctgatgttccacatatgtgtaatgtgctttattgcgtacaaagatgatgtgaatgtcctatggtcagggattaagcacttcgtatttctttttttttttttttgagacggagtctcgctctgtcgcccaggctggagtgcagtggcgcgatctcggctcactgcaagctccgcctcctgggttcacgccattctcctgcctcagcctcccgagtagctgggactacaggcgcccgccaccgcgcccggctaattttttgtatttttagtagagacggggtttcaccttgttagccaggatggtctcgatctcctgacctcgtgatccacccgcctcggcctcccaa

SEQ ID NO: 59885 - DNA, 1054 bp, Homo sapiens
tgttgtgagagaaagagaagaattgaaagtgacatttctaatattgctttcacacagccaagattctacattgctcatctgggcatctgagcctccttcgaagtttcctgtcacaactgtcctcttgacagcatggatggtaagacctggcagttttctgttactctgtttcaaggaaaactaaccttttgtccatggacttgttatttattctacctgtaaaatggtgaaaatgctccccagccctcaggtattgtcttagtggttctgaagcaatctcacatctcacagaggtcactgaatgttacttgcttttatcaggggagatttcttctggcaacagagattgtctttcataattacaatagctggtaggtgtacagtgggccaggcactgctccaagatccttgtggaaattaactgattcagtcctcaggcaaacgtattttataggcagaaaaacagggatgtttagtaacttgtcacagttcaagctggcatagcagggctttgaaccaggcagtctgacttcagagtttacatttgataatgaaatctgctgaagcgatattagtctagctctgacttaagtttttattaatatcatcctttctaattttgttcattttgcaaggatgtgtacaaaatgtttacctagaaaagagatgttgcactaattagcgatcacctaaaatgattgtgctgggctggacgcagtggctcacgcctgtgatctcaacactttgggaggccggggtgggaggattgcttgagcccaagagttcaagaccagcctgggcaatagagtgagacctcatttctatttttaaaaaattaaaatgattgtgctggttgtgaagagatctagttgcataattgaactcataatctgaaactgggtttttttaaaaaattcaaacatattacactttgccctttaaaacaaaacttgaaattcctcacactgtgatgcacagtggacccccgttgtccctgagagatgtgtttccacactcccagcagatgcctgaaacccaggatggtaccaaaccc

SEQ ID NO: 59886 - DNA, 2292 bp, Homo sapiens
ctatgtttggtgttttaaaattattcccttgttggttgaatttcatggaagtcggtgtgcgggaagctgtctcattgattggagtagaatgcttgaggacatttggccccgtggctggcccactctactcactaagcagtattggctccttcttagcccagtgtcccctaagaagcacctggggacaagaaagatggagacaaggagaacaaagaccaggcaaaatggtgcatctgtaggtttttgttttttttgtttgtttgtttgtttgtttttttagtttcagctttcattttagattcaggcttgttacagagatgtatatatagtgtgatgctgaggtttggagtatggttgaacccatcacccaggtaatgagcattgtacccattaggtagtttctcttacccccatggggtcatttaaattgcctaaagttgaatgtttggaattagccgtgcttattctctgtcctttctcttcttttcccctagaggaggaagacaatctgtctctgctgaccgcactgctggaagaaaatgagtcagccttggattgtaattcagaagaaaataacttcttgacgcgggaaaatggcgagcccgacgcatttgatgagctctttgatgccgacggcgacggtgaatcttatacagaagaggctgatgatggagaaacaggagagacaagagacgaaaaggaaaatctggccactctctttggagatatggaggacttaacagatgaagaagaagttcccgcatcacagtcaactgaaaatagggtcctccctgctcctgcccccaggcgagagaaaacgaatgaagagttgcaaggtgccctaactacttgccttccttatttctttcggataagttggatgaagaccaccaatctgatagttgtcatcaaaatagctgctgattcaagggtagagataaatgactttgtaaaaaaagaaaaaaagaaagaaaattatatgagttggtagatgaaatgtttgggccagcatttcagcacaaactatagactctatcagtgtcagccagctgcacttgatcctgtacggaatggctctgaaacttttcatatttcttatggaatagtagcactttgggatgtatgtggatgtggagccagagacaaggttgcaaagctgccacatatctatttgagcagagcattcctgaacagaagctttgacacatgttcttttctcattcctggcatctcatacatgtttaagctatagtaaaattcaatggttagctgtttcttctaatacagaagccagcatttattatattagttatgatatccaatttatgaagtaaatataatttttttttttttccgagacagattcttgctgtgtcacccaggctggagtacagtggtgcaatcttggctcactgtagcctccacctcccaggctcaagtgatcttcctgccacagcctccctagtagctggaaccataggcatgcaccaccatgcccagctaattttttttattttttttattttttgtagatacaggatctccctatgttgcccatgctggtctcgaactgctgggctcttgcgtcctcctgcctcagcctcccaaaatgctgtgattacaggcacgagccaccatgcctggcctataattatttctcaactcctaaaaacttgttaactgtggattttatttgatatctcttaatagtaaagatttataactagtttgattattgggtgcttcgtttactttaaataaaatatgtatttctctaagagacctctttgaagtaccaaagttaatcatgagctttgggtatgtgattatattgtgggtctcaaggtattggggcagggagtggacaacaaaaatattgcccgcatttttgtcatgtagaacgttttctcctgcctggttcttaaattaacatattttcatttcctagaggaattaaggaatttgcaagagcaaatgaaggccttacaagagcagctaaaagtaacaacaattaaacagacagcaagcccagcccgtctgcaaaaatcccctggtaagaagactgtcattctggcaatcgtgtgcatttattttattagaaattatcacatcatttctgcatccaactcctgtccaaacagccctttgaacctctttctgaatgggtttttactcacttattttacttttgattaagtagagaagtctccccggccacctcttaaggagaggagagttcagagaattcaggagtcaacatgcttttctgcggagcttgatgtccctgcgcta

SEQ ID NO: 59887 - DNA, 1066 bp, Homo sapiens
cccgtctctacaaaaaatacaaaaattagccgagcatggtggcacatacctgtgttcccagctactcagaaatcgcttaaacccaggagatggaggttgcagtgatcccagatcacgccaccattgcactcctgcctgggtgacacagtgagtccctatctcaaaggaacaaatccgtaaaaacaaatttccaaattccgttcgtgattatcagtgtggttgccttttcattaattgtgttaattttctagatcccaaaagctcatcttcaaggatgacaagtgcaccctcccaacccctacagacgatttctcggaacaaacctagtgggataactagaggtcaaattgtggggaccccaggaagttctggggaaacgactcaacccatctgtgtggaagccttctctggtctgcggctcaggtcagtagctaaaccatctattcatgtgcgccacggcatagctttttgtgcctctcggagtcctttagaagtagtgtgtttatacatcaggatccacaaaacaccagcagctcttgaactggacaaaacaccactggaagactagcagtagccctaggtttgactaagtacagttgcatataaaatgtttaagaaagactttttcttgtgtatgtaatcaacaaagaatctgtatctataaaaagaaatggacaaatgatagtatatttaatcagaaattgacagatggaaatagtagatttttaaaatttttctccatctctattgaggtataatttagactttttaaatacacagacagtttaaccaggataatatttatgcaattaagcaattactggattgctttggctcttctgggtcttttgcggttctgtataaattttaggatcattttttctatttctattgattcttgtagttgatgttaagaaaaatagctatgctgtttttctttctaatagtctttttaaggcaaatttatattctttgcatctgttatagggatacatttaagatagcctgttataataggaatatattccaagctcaatccaattaaaagctatattcaaatcttgga

SEQ ID NO: 59888 - DNA, 1050 bp, Homo sapiens
ggtgccttctgcatccctgttcctaaaacggttatagagccctggcttcaaattcctttagaccactaaaacctctctcctttttgagacggcctcactctgttgcccaggctggagtgcagtggtgtgatcacagctcatttcagcctggacttcccaagctctagtgatcctcccacttcagccccccaagtaactgggactacatgcacgcactaccatgcctggctaatttttgtggttttttgtagagacagggttttgccacattgcctaggctagtctcaaactcttggcctcaagcgatccacctgcctcggcctcccagagtgctaggattataggtgtgagccactgcgcctggcaataaccttcttaaatcagcaccaaccattcttttttctattcctgctaataaaaggccataattttgtccgcctttaactcctgccccaccttttcttacaggtgtgtttatctatcgatcatcctcagaaggtcttaattatgggtgaagctcttgacctgggaacctgtaaagccaagaagaagaatggagagccgtgcacgcagactgtgaatttggttggtttcagccttgttaggatggtttctgctaaagaaaagaacagttaggaataaactgttggtgctttagctgtgatgaccagtttggaactgagtttcccacttaaaggaagagtcaaaatgagaaaatttaatgtgtggttaataactgccagtttaaaaaagtgagggcaggggaaaggtgaggggatttaacctcttaggaaagtgatcttttatctgaccaagaagtttaagacagaatttttgtttgcctttaattcttgtaattccacagagcaaacatgatgaaatacaatgaaaattgtattttagcctatattttaactccattataccttttcttagggctttttaaaaaataatagcttcatttaggtataattcacataccatgcaattcacccttttaaagtaagcaattcaggccaggtgtggtggctcactcttgtaatctcagca

SEQ ID NO: 59889 - DNA, 1028 bp, Homo sapiens
agaacttcttcccctcagggactgagcagcccttccacattgggaacggtcgtggaggtcagcagggaggactctgcatgcgtcatgttccgggaagtggggagaaggaactgtgtctgctcactgctgtttcccagcctgttgccctcatcctgatgccactgctctgccttttgcagcgtgactgtgagtactgtcagtaccatgtccaggctcagtacaagaagctcagcgcaaagcgtgcggatctgcagtccaccttctctggaggacgaattccaaagaagtttgcccgcagaggcaccagcctcaaagaacggctgtgccaagatggcttttactacggaggggtttcttctgcctcgtatgcagcttcaatgtaagacgttctcgggcttcttttgggcagaggattttgcttatcaaagactaaacctactggttgtaccttcctgtaaccgtcataggatacttgtacaggttttatctttcataactcactacttgaaacaagttggttaaagaccgcttttattcccaggtagagagaaaaactttcaggagagagagagattgacttatgttgtgttggactttaagagagcccactcttcctcttcaacttttttttttttttttgagacggagtcttactctatcacccaggctggagtgcagtggtgcagtctcagctcactgcaacctccaagtcctgggtttaggtgattcttctgcctcagcctcctgagtagctgggactacaggcgcgtgccaccacgcccagctaatttttgcatttttggtacagacagggtttcaccatgatggccaggctggtctcgaaatcctgacctcaggtgatctgcctgcctcggcctcccaaagtgctgggattacaggcatgagccactgctcccagcccctctttgacttctaatgtgaatagtgcaccttcatcagggccattaaaaatgtgttaattacagtgttaacacccttttaattatttctcgtatgactatatgagt

SEQ ID NO: 59890 - DNA, 1091 bp, Homo sapiens
tgaggtgggaggatcacctgagcctgggaggcagaggtggcagcgagccgcaatcgtgccaacgcactctagtctgggtgacaaagcaagaccctgtctccaaaaacaaaagtaaaatagctcttaaaactattttttgccaggcatgatagctcacgcctataatcccaacacttgggaggctgaggcacgagaatcacttgaacctgggaggcagaggttgcagtgagccaagatcatgccactgcactccagcctgggtgacacagcgagactctgtctcaaaaaaatcaaaaaaaagaaaggggatgtaaaataatcgctgcaagttacagtgtttttcattaatgacttccaaatgtctcacatgtattgtctcttcccagtagcataaacaaagatgcagggaggtgcaatgagttcctacaggccctagagctgacggtaggggtgggaatacagttcacaccgcgtcttcagctgtgttccttgtggatgacatccactggacagccaattgataaaaacagttatcagttctaaagtgttaggacaattacagcttattcaaagaaaactcaattaaggaggagttagtaaagctagtattgttcttatcgtgtgcaaatttgaattaccagcctagaaggggacattattttgctaacaactagctcccaactggtggcctgcctgccgcctcccagtccactttgagttctagagtttttattttcgtaaaccctgtttgcgtattttgactgtatgttctttaaagatttctgcagagctcaagtgaagttgagagcccagctgtgccatcttcatcaagacagccccctgctcagcctccacggacaggatccgagttccccaggctggagggagccccggccacaatgacgcccaagctggggcgaggtgtcttggaaggagatgatgttctcttttatgatgagtcaccaccaccaagaccaaaactgagtgctttagcagaagccaaaaaggtaactggcatctcttctctttagcacttgagtttgcattctgtagagcagagctggaggaaagacagacacctaatagctctt

SEQ ID NO: 59891 - DNA, 1038 bp, Homo sapiens
agaagccaggcaggatgagaagcaatccttggttgtgtcggtgactgtcacatgcattgcagacagtgcagcaccccggtccctgccagccacagaggtagcaatcattgcaatgaaaaggaaagtgctcccaccaattttcaaaatatccccattcagtatcactactctgaatgatctgttcttcctttgattaacaaataactaatgagacagttctgcatcatatcttttcactggacttgaaactcaggagagatgccagagctgactgcaggctgcagagctgagctcctcgcctctgtggaacccttggccccaggccctcctgtctgtggagcagcactaatcccatcgctgcacccacattctgccacaagcatctctgccctcagggctgttccctgatgtcccgtgcacccaggaaactcaccagtgggggcctggaataccttgtgtatgtggagtctgtattagaacagtagaaataactgcctttgggcacacacttgacatactgatactgtcatgttaggagtgtttatttgtatttggtgctttaaaagtcaccaaatgggccaggtgcggtggctcatgcctgtaatcctagcactttgggaggccaaggcaggcagatcacctgaggtcaggtgtttgagaccagcctagccaacagggtgaaaccccatctctactgaaaatccaaaaatttagctgggcatgtggcgggcacctgtagtccctactactcaggaggctggtgcaggagaatcacttgaacccaggaggtagaggttgcagtaaggtagagattgcaccactgcactctagcctaggttacagcgagactccatctcaaaaataaaataaaataaaaataaaaatcaccaaatgctctcatgtccctttgtttttgcatattaagagctcgtttctatgcatcatcatcttttgctttgcagctcatgaggtgctgtccagggccctctcacacttagcctgcctcttccattctgttctgttttgattattatcagc

SEQ ID NO: 59892 - DNA, 1924 bp, Homo sapiens
aaggcttttgggttataaagagaaagggagaaggatgatccagactagaaagaagattattcctttcttagctcaacctttttgctccaaaaaaaagaggaggaaggggccaaacatagattatcctgcaccagagggccagctccttaaatctgagtctcatcccaaccaccatcatttgtaaaaaccaagggtgcattcattacctgcagtgcgtggatccctgtggtgccatcattatcatttgaagctccatctctgaagcctctagctttgtaaggacctacagaccacttcccaagtcattgcaggtttatttttgtcgcatttgagcataacctcagatttggcatacaatacgaatgtcaccttgaacagcttctccttgaatgggggcctactctccccaggtgcagtgagcaccgtcgtctttacatgagtgggcctacaccaccctgctgagtaaatccatctgttctgtttcagtaactgtggcctctacaaatgggaacgggacggaatgctaaaggtatgccatttgcgtactaatttttgactccttttagtgacccatgctaataatgtggaaccatctcctattaaaatattttcatttttctaggaaaagactggtccaaagataggaggagaaactctgttaccaagaggagaagaacatgctaaatttctgaacagccttaaataacccgaacttcagacattttcccacagacttcctggcctcctgtgactctggaaagcaaaggattggctgtgtattgtccattgattcctgattgacgccgtcaaaaacaaatgcttgttaagcccataagctttgcctgcttactttctgccattgggttggtttgataccacatttaacattgacatttaagtggaaaaccaagttatcattgtcttttctaagctcagtgtggatgattgcattacttcattcactgaagtttttgcccaaaaattggaaggtaaacagagagctatgtttctgtatcttttggttatagagtgttcacttctttatcataacaaaattctagtgtttatacgaacacccagaggcaaaagaatttggcttaattctcactccaggtaagtagcttaacttctgggcttcagttttctcatctgtaaaatcaggaagattggactaagtgatcctgaaatgtattttttagcactggatttctacaaataataaaactttcccatctagataatgatgatcacatagtcttgatgtacggacattaaaagccagatttcttcattcaattctgttatctctgttttactctttgaaattgatcaagccactgaatcactttgcatttcagtttatatatatagagagaaagaaggtgtctgctcttacattattgtggagccctgtgatagaaatatgtaaaatctcatattattttttttttaatttttttattttttatgacagggtctcactatgtcaccctggctggagtgcagtagtgcgatcgcggcacactgcagccttggcttccctgggctcaagcagtcctcccacctcagtctcccaaatagctaggactacaggcgtgcgtgaccaagcccagctaatttttgcattttttgtagagatggggttttgccatgttgctcaggctggtctcaaactcctgagcactagcaatccacccacctctgtttccaaaaaaaaaaaaaaaatgaaaggtcaacccctatgcaaattaccacagcaaaggtttcattcaggagattcttccatctgggcaacctggttttccaaatatcatttgacctaagtgaatgttgatactagctaaagattgggtaaattggttgaattattgtattgaagcttgagctgtagctaaaagtaatttaggtttcccctaagatgtta

SEQ ID NO: 59893 - DNA, 5703 bp, Homo sapiens
tctgtcacccaggctgtaatgcagcagtgcaatcatagctcactgcagcctcgacctccaggctcaggtgatcctcccacctcagcctcccaagtagctgtgactacaggtgcatgccaccacacccggctagttgtttttgttgttttgttttgttttgttgttttgttttctgtagaaacggagtctcactgtgtttcccgggatggttttgaactcccaggctcaagccatccatctgcctcagcctcccactttgggatatatttttatatcccaaagtgctggggttacaggcgtgagccactgcactcggcctcgagtatcctttagtagcaggttttcttttcaggcaagaagacgtcccgtcaccccctgcaccaggacctgcactatttccccttcaggcccagcgatctcatcgtttgcgcctggacggcgatggagcacatcagccggaacaacggctgtctggttgtgctcccaggcacacacaagggctccctgaagccccacgattaccccaagtgggaggtaggtctgcccggcggctgagtcttgatccgaatctccttcgcagtttctgtttcacatcagtacctctaaagagtttacaaatgagatggcatttcctttctgagcaaaacattgtcctaagatttgcagtgaggatcagagaaagttcaaggatgtcagagaaaacattcatcacacctattttcaacactttttttgtttgtttgtttttgagacagggtcttgctcaactcactgcaacctccaactcccaggttcaagccatcctcccgcctcagtcgccctagtagctgggactacgggtgtgcaccaccacgcccggctaatttttgtggttttagtaaagacagggttttgccatgttggccaggctggtcttgaactcctgacctcaggtgatctgttcacctcggcctccctaagtgctgggattaaaggcatgagccactgtacctgcccttaacacgtgtttgaaagccagccaaggtggggagcttgggtaggtactgtataggatccgagattgtaagtcctagctgcagaggtaagacataaacccttcgaccccagatgtgtgtggtagacaccaagtcagtcttactcactaactgatggctctcagagtaaggaaggagagattgtctccttgcaactgcagagaccagcaaaggatctggggaggctggtgtctgacctgagccttgcaggacagtgtacaatgtcccatagggaagagtcgatataggaaggcacaaggtcaagggcaagcctgaacttgaccaaagaacaggaaagacccagggagcttgcagtctagatgggctgggcgctgggggtgtattttggggagcagcagaggaggtgagcccaaaaatgtacattaggaccagattagaaaagactgttttactaacaagtctgcagtttatttgggggaagaatgggaactttttagttcaaacttttaggaagatcgaagaccctttttgtttttttgttgtgttttgttttgttttgtttttgaggagtctcactctgtcaccaggctagagtgtaatggcacgttctcggctcactgcaacctctgcctcctgggttcaggtgattctcctgcctcagactcccgagtagctgggattataggcgcgcaccaccacacccagctaatttttgtatttttagtagagacgggatttcactatgttggccaggatggtcctgatctctttaactcgtgatccgcccacctctgcctcccaaagtgctaggattacaggcgtgagccaccacacctggctgaagagcttttaattaaaaaacaaacaattaaacaaataaacagtttcattgaggtataattgtcatgtaaattgtacatattttgcatgtataatttgatcattttccacacacacatacctgtgaaatcatcaccacaatcaagatactccatccttctccctgctctaggcaaccactgagctgctttctgttactgcaggttagtttgcattttctaaaatgtcatagacatgtaatcacatagtatagatttttttgtcccgttctggcttccttcactcagtgtagtgattttgaggttcattgatgctgttgtgtatgatagtagttttttgttgtttttttttttttttttgagacagagtctcactctgtcaccaggctggagtgcagtggcacgatcttggctcactgcaacctccgactcccttgttccagcaattttcctgcctcagcctcccgagtagctgggactacaggcacaagccaccatgctcagctaatttttatatttttagtagagacgagttttcactatgttggccaggatggtctcgatctcctgacttcgtgatctgcctgcctcggcctcccaaagtgctgggctcaccgcgcctggccaacagtagttctttcccttcccttgctgagtagtattccattgcatggctgcaccgtgaaccatggtttgttcatccattcagctgctgatgcttggaaatgttaaatgcatttgagctcatgagtgatgggatcaaatcggctcttcaaggacagtaatgtcacgttctggtgcaggacgcgttagaggtataggcatctagaagcaaagaaaccagagagatgactattaacgcgttaggtctaaggtgaaaagaccctgtgggagccaaagtgggaggatcgcttgagcccaggagttcaggaccagcctgggcaacacggtgaggtctcatttctaaaaataataataataataattagctgggcatggtggcgcatgcatgtagtcccagctattccagaggctgaggcaggaggattacttgagcccaggaattcgaggctgcagtgggctatgttggtgccactgcactccagcctgggtgacagagcaagttcccgtatcaaaagaaaaagaaaagatcctgggctgggcgcagtggctcatgcctgtaatcctagcacttagggaggctgaggtgggcggatcacttgaggtcaggagttcgagaccagcctgaccaacatggagcaaccctgtctctactaaaaatacaaaatcagcctggtgtggtggcgtgcgcctgtagtcccagctactcaggaggctgaggcaggagaatagcttgaacccaggaggtggagtttgcagtgagctgagatcgcgccactgcattccagcctgggcaacaaagcaagactccatctcaaaaaaaaaaaaaaaagaaaagaaaagatcctggaatcccatgatgctgcgaatggaaagagcccccattgttaaagcagggagaatgagttgtagttcgataggaaatgaggaacatggttttaggaactcctaactcgtctggacacagtggctcacgcctataatcttaacactttgggaggccgtggcgggtggatcacttgaggtcaggagtttgagaccagcatggccaagatagtgaagccctatttctactaaaaatacaaaaattagccaggcatggtggtgtgtgcctgtactcccagctattcgggaggctgaggtaggagaattgcctgaacctgggagatggaggttgcagtgagctgagatcgcaccactgcactccagcctgggcgacagagcaagactccatctcagtaataacaataataataataatagaacgtctcagatttcttgcaccaataattagtgtcaaatgaaaatatgtgagtgtctggatcctgatataaaaccatttaatgtgaaactcatcagtgaagccaaggtttaaagtttggtgcatgcaactgcagtgggctttggctgacagaaggcaaagggaaaagtttgcagggcttccagagcgtgtggagtctcagataccctgctcagatgcagagtgggaggtatgattagcttagtgtgggtcacacattcaccctggccaggagagaagggctctgggtcagagtctcagcactgtctaagagggatgtcgtcattcccagaaggaactggggatgctcttaggaagaggaatgggctgcttcccttaccctgactcctaaggtgcttctcatgtcaatttctttaataaagacataaccgcattacctaaagtagcaactaatttgggaaatagttacaaacaaacacagtgttttaatttactattctttcattattctggatgtaacataagtgcctttgagctcagaaaaattgagcattttctcccccctattttggggaaatagcttctcagagacactcctgagtaagagatgaaggatttatttaaagttctgggcgaggaggagaacacactgggaacactcacagtttcaggctggaaatgcccaagagataggtggttgcctgcattaaccacaaaaggcaaagctaagctagatcttcatgtataatgcagtcatgaagggcaggtggaaattccacactgttcatttcctccaaaaaatcagtgattttaatatcaacatgtgacttctttttttttattaccattatttttcgagacagagtcttgctctgttgtccaggctggagggcagtggtgtgatcatggctcactggaacctccccctcccggctcaatcgatcctcccacctcagcctcctgagtagctgggaccacaggctggcaccaccacgcccagctaatttttgcagtttttgtagagatggggttttgccatgttgcccaggctgatctcaaactcctgagcataagcaattctcccaacttggcctcccaaagagatgggattacaggcatgaaccaccatgcccggccaaaatgtgactcttaaaaaccagatatctgagaggcttttgtatactgaaaaaaatgtaagcatttaatttagacatttatttctcttgggagagagaaatgctttctttccctgatgtttgctttccctgatgaaccattgacaatgtttttaattatggtactccctcaaatgtagacttcacttgcctcttgttctaggggggagttaacaaaatgttccacgggatccaggactacgaggaaaacaaggcccgggtgcacctggtgatggagaagggcgacactgttttcttccatcctttgctcatccacggatctggtcagaataaaacccagggattccggaaggtaagcattcacattgctgcacctgctgcagaagtgtgggttagaaacaaaaattgtattcaattcattgaattcaaattaattgaataaaattttaattaaattgcattaacattttaaagatttgtggcttttaaccaacctggactttagtccagtttatttaccaggaaatatatttgcttaccttgggctttctgtgctcttatcagtaagaagccaggtgacctcaggatcctaaccttgtcaatattgattatgggccgggcgcggtggctcatgcctataatcccagcactttgggaggccaaggcgggtggatcacgaggtcaggagatcgagactatcctggctaacacagtgaaaccccatctctactaaaaatacaaaaaattagctgggcgaggtggcgggcgcctgtagtcccagctactcgggaggctgaggcaggagaatggcgtgaaccccagggggtggagtctgcagtgagccgagatcg

SEQ ID NO: 59894 - DNA, 1014 bp, Homo sapiens
ttttttttttttgagacggagtctcgctctgtcacccggggggagtgcagtggcgcaatctcggctcactgcaagctccacctcctgggttcacgccattctcctgcctcagcctcccgagtagctgggactacaggcgcccaccaccacgcccggctgattttttgtatttttagtagagacggggtttcaccgtgttagccaggatggtctcgatctcctgacttcaagtgatccacccacctcggcctcccaaagtgctgggattacaggcttgagccaccagcccacacccatcagttttttaaatgtttctttttgagactctgtttcaaaaaaaaaaaaaaaattatctgtaattctacctcaaaagtcacgtttttggagactatgtattcatggtaaaatgtctatgctgtaatctaaggtgaaaaaaagatgcggcgtcacctggagtttaagaagctgcacgcaagtattgaattcctgacaatggccaagaacaaatttagagggcagaagtccaggaacgtatttcgcatagctagccaaaaaagctttaaggctaaaaacagagtaaaaccaattaccgctaatcttaagaagatacacattatgaatgatgaaaaagtcagcagagtaaacaaagcttttggaagtgtacaagaggaacttccacatttctcaaaaggcctttctcttgatcttctgcagaaagagctgattcctcagcagcgtcatcagagcaaaccagttaatgttgatgaagctacaaaactaatggctcagctgtaacacactggtgatgcacctaattctccacaaagaccaataaattaagtgttttctaccaaaaacagatgcaatgcagtctattcagtgtattcagtgtgataccaactttgaaaaaatatatacgtatgtatgtatgtacctgtataaaatgtatatttttcaactaaatgtgaatgggaaaaaatatagtgaattgtaacagtggttttcttgtgaaga

SEQ ID NO: 59895 - DNA, 1094 bp, Homo sapiens
acatagcacaggcattacccgtagtcgtgtcaaatagcagttggtgtcttcattttatgtatatttatcatataagtctgatttttttttttaagcgtcttgaatggttttctggagagacagcattggtaagtggcacatgacggtatcccagtcataagagggttgcatgattcctttgagtgtttgatttgaaaagcctagtcttgtctctcaagagcatctcggacccagaacattctccagtagtgcattcagttcaacacagcaagtgcttcattgcatggaaaacactttgaagacaaaaaagaaatcttatttctttttttgtagccttcctgatatttacagtaataccattaactgttttatcgatagcaaaaaaggatactttttgcaatgttattagatgttctatagtgctacaaggaattgccttccgaatggaggttcatgtataatactcatttacaattcaatatataattacacaaataatttttaaatataatcaatagtaaagactgttctgtggatggtagtgtttaatacattttctattttgtacagtgatttcaggccttttgttttcttaaaatcagcagctgtttggcctaattcttagcattattttgtcctttgcgccagtacttttttgtgcacgctttttgtgatctgtgttaaaaacctgcattgccaacattgcagctcgaacttaaacttgttattcaaataaatatttaattttttaaattgctcttgtataatcagatgccccttttagtattattttagaagcgttgggagggttttgcctaaagtacaatttatcgggaaaaactagattttagttttataaaacttttaagtctttcatgggacctatattttcttgaattaaattttgtagttctagaataaataggcaatctaaaaaggtgttctctgtgttatgtaaagtggaggcttccttatattttaacctactaagcaatgaggagggattcctgtcattaagcacaagggcgctggatcctcaagtgcccatcttcgtgagagaaaaagcagcacatcctgcccatttctggtgcttt

SEQ ID NO: 59896 - DNA, 1644 bp, Homo sapiens
acagttttgcatattgaatgcttgattgcagtaggtaagccccagcttggagctttaagatttttctgtaaagaatttgctcggcagggggttagctttgtttacttggccctgagatagcttcgtctttcatgtcttaaacatcactaagaaataatatgaaggagaattggtggaaggcgtagtgtttggggtataaataaaaccagggttattgacagtttaaattgttttatgcagtttttggttgtttttgtttggtagttttgtctttttaaactgatgagtaactcagaacattttgataaataattctcttgtgcagaatgaatctatctataatgaggatatgtcttgtgagtcatttttccagtgagctataatcatactttaagattggttttcttcattgccgtaacaactcacaaattaataagattggggtatattctcacatatcatggtgcatttaatttctacaactatcatctgaaactaccagtcctgagaaacagttgaaagagaataatcaataattacacgtctttcatcaacctggtatatcttagcttgatgtcgcagggtagagaaattctctaaggctgccacgttctttagcagtttttccctcctccccctgtgatggggagcagagcagaaggccactgcggggatgttgcgcagaggtgccttccagccccacctcccaggcctgagctagcagggagctggaagcaggtgaggcagggagtgtcacggatgggggagcccttctccactagcaggacactacactgcatgtacagcagtgccgccgtgtgtcccgctagactacacatacccaataaatcacagcacttaattacagaaatgtgggatgagaacagaaaagacgccatgctgacaggtctaatggacacctaaaatactatccacagaaaaaccagagttggaaaattcagttttctgaattaaagtccctagaagttaaataagaaaaagttgctgtttttctcagttgctagaagtaaagattaatcacattttcctctctttctctccctcacctacatttctattatcagcctgagaaatggaataagattaaactagtggtcacccaagaagatgtagagctggcctaccaggaggcgatgatgaacatggcgaggctcaacaggacaggtatgacaggtgggaagggcgcttcggtcccaggggtccaagacagtaaatgtcttaggcttttctggccacatactgtctcagggtaggtggccagatttttggccagtgactacagaccgtcttctcctggtaccaggttggcattccatagatcactgcagatggtccctgacttacagtgctttataattaagaaggaagtcctaacttctgacataccagaggaactatttctagaaagcgtttgtgtgggttacctatgtaagatttggaagcaaaccattcagaatggaaatttagaaagtttaagatactggagctatttccagaacataaccttggaagtctagaagtgcccccactcccacccatcccctgcattcctgcttaggtgtaaccactgaattttgtgtttattttcttgcattttagaatatttttattgcacagcccttg

SEQ ID NO: 59897 - DNA, 1371 bp, Homo sapiens
cagcgcttttggaggccaaggcgggtggatcacctgaggttgggagtttgagaccagcctgaccaacatggagaaaccccatctctactaaaaatacacaattagccaggcatgatggtacatgcctgtaatcccagctacttgggaggctgaggcaggagaatcacttgaacccaggaggctgcggctgcagtgagccaagatcgcgccactgcactccagcctgggcaacaagagcgaaactccatctcaaaaaaaaaaaaaaatagatgtattaagatataatttgcgtactataccattcacccatttaaagagtcagtggtttggagtatactcagagttgtacagccattaccggagttgatgttaggatgttttcattgctacaggaagaaaccccatcctcctcggctctcactgttcactcctgctccatcctggattttgtcacttagcatagtattagcatacttttaagggtcatctattttgtagcatgtgtcagtattttaatcctatttttaagacattttaggtgtttttgttttttttttttgagacggagtcttactccgtcgcccaggctggagtgcagtggtatgatctcggctcactgcaagctccatctcccgggttcatgccattctcctgcctcagcttcccgagtagctgggactacaggcacctgccaccatgcccggctaattttttgtatttttagtagagatggggtttcaccatgttaggcaggatggtctcgatctcctgatctcatgatccgaccgcctcagcctcccaaagtgctgggattacaggcgtgagccaccgcgcccggctgacattttaggttttttagttgaagtataattcacgtaacaaaatttcacataacatagaattcagcattttgaagtacacaatgtgttggtttttagtattgacaaggttgtgcacccatcaccactatccaattccagaatgttttcatcaccccaaaaagaagccctgtagctcactcccatttccctcctgctcccatcctctggcaaccaagaatgtgcttttgtctctaaggatttgcctgttctggacattgtatagaaatggaatcgtgcagcatgacatgctgtgtctggcttcactcccatagcggaatgttttccgggtccatccgtgttgtagcatgaatcggtatcgcattcctttccatggctgtataatccattgcatggatggaccctgctttatttagccattcctcaggtgacggacctttgggttgtttccacctattaggaatgatgctgccatgaacattctaagtttttgtgtggacataagttccggtctcttgggtgtatacctaag

SEQ ID NO: 59898 - DNA, 1189 bp, Homo sapiens
tttcttaagatgatttttctgtttatctcatacatccttgaaaagaagctacaaaaattttttttgttttttttttgttgttgtttattgacagtcttgctctgttgcccaggctagagtgcagtggcacgatctcagcttactgcaacctccacctcccaggttcaagcaattctcatgcctcaggctcccaagtagctgagactacaggtgtgcaccaccatgcccagctaatttttatatttttagtagaaacagcattttaccatgttggccaggctggtctttaactcctggcctcaagtgatccacctgattcggcctctcaaattgctgggattacaggcgtgagctatcacacccagcctaagctgcaaacatttcttaatccaagtgcacaaagactatctccatctctataaccactaaagccagccatttttagaatctgtttgggatatgtggctgtttccaacttttctttaggagagttgtttgcaggctttttcgctccatagctcttcccccaagactgtcggttctaaacttgcttctcctcctcattcgctgcacatataccccttcccctatctaaataaattgcagacttctaaaatttagaatggagaaaaactggtacattctttgtcctgcacaagaaagaggtggtaacaggaatgtctgagaaaaaacgaatggcctagtgactctgtgatgcaggaaaggttgccagtctgcaaatcatagaaactgaggaccccatcctagtagctgctactcctggaaagtctccacgttctctgtggagtccactccatggctcactcagtttctgcagatggaaagtccccggtcgtcctttctcatgtttccctctcttcccagggcaggatagcgtgtgccaatgtcctcagtgacctctatgcaatgggggtcacggaatgtgacaatatgctgatgctccttggagtcagtaataaaatgaccgacagggtaagtaggagctacccggctgctgcctggtccgtgttgtcccggtggcatctctggccttggttagacttggtttcccatctagaaagcgaggagcccaggccatatggctccctgcactccttctggctctccactttttggcagttaccagtaaattaaaatgaggaagcctggcctagtcatctctgcactt

SEQ ID NO: 59899 - DNA, 1349 bp, Homo sapiens
tcatcttcaaagaaattgtatacggtaccagtcacacgctacagtaatacagtaaaataataaaagtcatacagtgaaaaagatttttattcaaggcatcattaaggattaaaactatgccatattggagttgagtcttgatgagtaacattttcattggtattttccatcctaagctggatatgtttcacgtttatttcagttacgcttcttgataggaaacacatggcttcattggcagcctgcagtttccataagtatcttatgagctcttcctgttcagagcactggtgatataaaatgaaatggctttcccgttttatttttggatgctaatgacttccatctccacaggcattggaatggatacttgtgtcattcctttgaggcacggtgggctttccttggttcaaaccacagattacatttacccgatcgtagacgacccttacatgatggtaagcgtgagccgatgtgtttttgtgactggaagggcttatttgtttggtttgggttgtggctggggttttgtatgtatctgtggggttttggttttatttctgttatatcccgactatactgccccaccctgcccagactcctgcagttgctgaagtcaggcctgtcccctgcccacacttggcactgggcataaagcaattagggaggaagcagggaaggccctctgctgctgttgcaactgagtacatgctgtgagtaagaacacctcttgtttagtagcatgtcaatggcctgtttttgtcattttcttctttcttgcaccttctcttctttgacattggtaacctccatcacccctgtgttttaggctggagatgttactgtcctctgtaataggactgatcctaaatgtttccttcaagagattaaggagctagtatctcatcacaattagatgcctcaaacattaattcggatatctggttaattcactcaacccagccacttgcacacccaccaccgtgtgatgtgccgctgtacatagtaggtttctgaccactgagttaaagttcctggctactgatgatacactgctgaggtgtgttccccagttgtttactgcgtagttgcagccagccaccctttgatccacccaacctttaaccccaatttgctaccacccaggaggagccagtggagagactaggaaaatctggtttgctataaaatgccaggtgttcttcgtgtgtggcaaggacagtgggatcaggctgcactgtagggactttatcatgaggcagccacgtggggggtgttcaccctcaggtaccagtgacaaataccagattattggaaacctatatttcttccgcacatctgtccgtttt

SEQ ID NO: 59900 - DNA, 1054 bp, Homo sapiens
agaagatgagcagtttctgggagccgttatgccaaggcttggtaggtaacccagtgtttctttgatggtctgcgatccaatcagtgagtcaaaaactggatttctcgcctcccatgttgcctatttattttttattattactttttttgcttttatagatttgaggaatacacatgcagttttgttacatgaatatattacataatggtgaagactaggcttttagtgtagccatcacccaaatagtgtacatcgtaccccctttatttttttttaatttttgtgggaaggattagaagagcaatcaatgttatgattgctatgttatgttcttgtaacttatgtagagaaagtacttgaaacgcatcaagaggggtactcttgacagtttttaaatcatggagtatgcaattgagattgttattacagtaaaaactttttaatttttattttcaatttaattgaattgaattttctgttagctgaagattaagcagaaatactttattcccttttcctaaaaggactcctaaaatgctcacattcccttcattgccctaggaaaggcggttccagccttagggttcttgtgctgtacttggatggcagtgactgtgtcaggagggcattggggttctctgcagggtgcatcgggcgaaaagcgtgttacggtgaggaggtgggactgctccagacccaggactggatggatctgttcttgaccccaggatgtcatctggaaccagggcaatgtctttttctttactacattcctgatgtcatgagtgatttcacttttcccaaacacagagcttagaaacaaattctgggctcctgggatattgtttattcatgtttcttgtgcagtttattaagtacacagtacaagactgtgatcacttttcttgtgttcgacgcatagtttcggaggtttggatgttcgataattactgtgtgacttgatcagttttcttcctttttttttgaaatggattctcactctgtcacccaggctggagtgcagtggcgtgatcttggctcactgcaacctctg

SEQ ID NO: 59901 - DNA, 1087 bp, Homo sapiens
ctcaagaaaagccacccaggagctggggacaatttgcattaaaaaaaaaagtatagagaaagtgaaatcaaaacagtgctttctaaaatttaaaatggggcttccaaatttgaaatggggatgttcatctagacttagcaattgtcataaattggcattttacatacttttaaaaaattaataaaagtgtaaggaagaacatttcaattgcttttaccacccacagacaaccattattggatgatttttctcaaatgtttctccattttatttatttatacagtggagatcaaatatgtaaaattttgtttcctacatgtttttttgatttttacctaacaagcatttttccactctatggcaaatcttcatatgcattattttaatagctgcataatattctgttttgcaggtaaattatcttttaggccattttccatgactggacaatatgtggatatactctaatagtaacacacattcgtggcctttctcataaaaaatcattacaaatttccaatttctacaattgctcatggaggacaactaaagccttggctaaaaacttagcgacttaagtgtgaaacacagacacctccccagtaaattgtttacttgtccagaacgcccacctccagccatgtcacagaaccatgtacaactcttccttagagaagcggctctccgccttcattttcttgtctctgttgtaggtaatatatttgacaccaggagagaaaacacggaggacacagaaccaggtttcattgcctagactttgattttagtgacattgttgagtggcatatgtaacttccgtttgaatttccacaaagatccacgtagcatttcaggttcctgcaaagtgtgggtgttctgtcaagcttacctgtcatgtttgaatagtttcatatactttctttgtaatgtgtgataaccaagcctccaatctggtataagattttttaaatcatttttagggttgatttgttaccctttaaaagtccagcatatgattcagtgagttcattgtccattataaagaagtggttctctcttccctgttttcattcaaaacctcagtatg

SEQ ID NO: 59902 - DNA, 1038 bp, Homo sapiens
gactctactgacttccctccaaaggatatctgaagattctctgcccacaaaacccaggtacccccaaaaaccctcttactgaaaaggttcaaccgaatgttttttcctctagttttggggtggtctgtgttgattaaattcagcaaatattagtggagtctctaggttgtgtaggaacttgactaggccatgtattcattgacagcacatatcccaaaatggcaaggaaagccacattcgcaggcataggatgggcctgtgctagtgaacttcagagcttcagagcaacaggaaaattcagccgtgtaagagacacattgctttctctgccactgagtagctaagcaacagatcaatggacagataaatcaaatgagctacatagtgcaaaaagacctgcctacatcaagttcttcccatacagagtcattatataaaagagatttctgttcttctttggctgtgttttcacatttgtgaattaagagaattgaaatacgtgatctctgttgttccttcccaatttgtcattctctgaatatcagggcacgcatatcagcctcattcttatcacctgggcccaatcccagccgatccatgaaatcctaatcgtaatagacctagccttcagaaggcccttcaggggagcaccatgcctttctagctgtgcttcccaagtgccctcccaccctggccatctgcactgcctgtcctcctgtgtcatgtgacacagtgagcttttattatttgaaagccactccccttgaagtttatattcacccccaagtggtgagtacggaatgcctttgtattttcctatctgaagttggagatacgtttccagtgagaaaactgaggtcagagggtgctagaagagcctcatggaactgaaaaaaatgtcaaggaatctgagaatgagaaggaacttgagagatcctctagtccaatcccttctttttatccagtccttttattttacaggaaaaaaagcctgaggcccagaaacattaagtggctttcccacggcctcacagctgg

SEQ ID NO: 59903 - DNA, 1050 bp, Homo sapiens
tccaatcttcgttattttaagcaccttcctctcaacacctcttgatcactgcagataccattttgaatccacttagccaggtacaactacctgggggcaaatcccaattagaaatgaaggcaggacagtggagaccaagatgtatatataggatattcaggtctcctgcagggcatggggcctgtgctggcctctttctgaagagtcagcggtagccctgcttacccacacagcagtcatcttggcggtggcatgggccacctaaccctgatacccccttgcaactacattatttttagcagaggcatcaactaactcttcaagtttgaaagctcagaaacaccttgaatgcctttttttctttgcaactcaccctgctcaattacctggccctatcaactccttttgtccctcctctctcattcagtgccctttggcttctttgacaccatcctggtccagctgtgcatcactctgtccttgaaattctgcaaaaacactcttgaaatgtcctgcctaaccctcctttctccttccagttcctaatgtatcctaacagcctagtaacacccagaaaaccaaatctcgtgacatcgttttcctacttacttccccttggcctattcagtccgaactctggccttttccaagactccgtaacttgaatttctctctccttgtgaacatatttcccggtgcttcctcccgggtgagccagcaacactgttcctcaagcaccactcgttcattgtggactctgtgttatgctgttctccacagggccgtggtgcccttctctccccgctctttatagacaagcctgacttgttcttcctggtttaccccaagtctcatcccctgtaccatgagactttttcagatgccctaacctgtactgattgcccctttctctgagtgccagtaccacttactgcctttagactgcttagcagggcatcttaactctccgccttgctattgatgacttctatggaggatgagcatgtcatttactgcgcacactgggacactcctgagggtcagtatggt

SEQ ID NO: 59904 - DNA, 1138 bp, Homo sapiens
ataagctcaaaaaagggatctcatctcctcaaaactgtgaattcatatgtttactacataaggagcaaatggaaatgtggagaaacttgttaagaagggtgtggctttttttgatctttcttcagcctgtcacataatgggcaggaaccagttgtggattcacttgcaaggattccactccaactccccgttactgaattcttacaaaacctgcattttaacaccaccactaggggtgacaaaaacagcctcctgtcaaaagagatatgtttctggagcataaacagggccactacagtagaatgtgcattgcacaccattgtgggcactgttgccgttgtggacactgtcgatttgtatatttattgtgacagtttccctgcagcctaaagtacagtgtcttgaggaaagacacctttctaatctgaacaatggctccatatgtgccagctgtggccctgaaaatagaaagcagtgttttctgcgtggtccatctcttctttatttaactccctgaattgtgtggctcatcagagatgctcaccagcatcctaaggtaatgccacatcctcctattttctctccttttgtggggaagcagaattgtttaataagttcagagtcagtcagattgcattcctggtagcttttcttctggatctacaattttgatgccagttatctagcaagtgttccaattcagttccataacacgtattgactatctcctgcaaggtatgcatcaaaaatctgaacgactcaggaattggtatttgctagtatttctgccctgaaagtgcattgcaaatgatcatggaatactcacaaaaaaactaaaagtgtatgcaagcttccaataagaaaaccccttaaaaattcataactttcggctgggcacggtggctcatgcctgtaatcccagcactttgggaggttgaggtgggcagatcatgaggtcgagagattgagaccatcctggccaacatggtgaaactccgtctctactacaaatagaaaaattagctgggcgtggtggcatgtgcctgtggtcccagctgctcaggaggctgaggcaggggaatcacttgaacccgggaggtggaggttgcagtgagccgagatcacgccactgcagtcc

SEQ ID NO: 59905 - DNA, 1046 bp, Homo sapiens
aataaaatataagcctcttttgtagagattgtattttttacataatcttatctgtcttatggtgactaacacttaatgataatttatttaaaatatattgataagtatgactcaaggtattgctgatgaaagagtttttaattagaaacattcacctaagcattttgaatttaagaagaaacaacttatgatcttaccaagtagagtcttaggctttagtgctggggataaagcttagtgtcttggatttgattcagaattgatgttataaccagagtggaggttagtacccaggtatgttttccttacctgctgaggctagaattggtccacatctagttcttgctgtgatatactcggtagaccatgcagattaacgtggttagagttgtctaaatatgatagaatctttgaatccctgaatgctcttcagaaaatacagttgcaataaagcgatttttagagcccccgttgtaggatttttaattcgacttcatagtgatgagttgagaaagttttattactatcaaactgtcctggagtcttgaatcttcttgcattcagtggaaattacataggcacgtcaagtgaagaccttgttgggggttcttagttcatgccacacagcacaaactgccgctctcctgagaggccagccttgatggtctgtctggacagccacaggtatcagaacttctctgggagggaacactccttgtttggtagccctccaaaaaaataactgcgcttcttacaagattagaatgggtgcctggccgcttttgctgtcacactttcacaggctctgcagaaatgaccaccaaaacctcttgttttattcttgtgactctagatacctgtagggtccatatttgtcatcttatagtatctctatttccattaggatttaataaaaaaaaagtgaatagctcttttctatttgatctcacgtagatttaaattaatacggttggggtggaatttgcatcgatttatttattgatagtaacttatctgcgttctcagaactttttataagaacaagg

SEQ ID NO: 59906 - DNA, 1050 bp, Homo sapiens
tttaggaaatagaagtacttagttcttaccaaaaagaacataaaccaagtctcaaaactaaacacaactccatgaaaaatgagactctgaatcaggccttgcttaaaactggaataacggataggggtgctgtgcttcctagctcagttcctgcattgttgagttgtgaagtgggactgacgcagagggccttctctgcccccttctgttccccattatctggcaaaatgagtaaatgaattcagtagtgtttaaaggatgcttgaaagtccacaattaactttataaaataatacggtatttaaatggaactagcaagtaccaagcaccctttgttcatggccagaaggacataagccttcattaacagagaatttctcatgctcaatcagaattttttcacttaaagtgacagttgagttgtattaaatatgaaaagctacagagatatcacaaactgtgccatttctgaaaagagtgattcagcctgaagtgacactacaaacaacatgacagaatttgaaaaatggtcaatgatgtaagtaggacttcctgaagtgaagaagggtcccttctcaaaacaagaaggtcaaggctactggtgcttttctgaaatgcagcgaggaattgttttaattttctttttttttccccagggcagcatattaatattatgaaagcatttggaaattagggaaccataaatgaccatagtccattttaatgacagtagaagagtcatcctaataatagatagtaaagaaatagattgtgacaagtggatcgatgtgggtttcttctgccattttccatctacactagacatgcaagagtttgaaaaagtatattacaggccaggcgcggtggctcaaacctgtaatccctgcactttgggaggccgaggtgggtggaacactgcaggtcagcagttcaagaccagcctggccaacatggtgaaaccccgtctctactaaaaattaaaaaaaattagcggggcatgatgatgcacacctgtagtcccagctacttgggaggctgaggcaggagaat

SEQ ID NO: 59907 - DNA, 1016 bp, Homo sapiens
gctatgtaacttttgggaattttatagtatttatagatttcccttttgacaactagagaaacttgcagactatatgtgggaaagaagaaaagaagactggtaataattttcttgtctggagttttcttttctgaaaatgtgatgccttatttatttagacaggtttccagtttttgtctccgaaaggaggagggtgatggcgtaaataatctgctcactaatttcttttgcatttttaattttgcagtgacaattttcaatttccttagtgtagagacctaaaagaatataattaaatcctttgtagatgggcataaatgaacagggccatacagataagatcgcacctttctggaaacacaaactaataataaaaaaggagcagtcatgctaattctattttatagatgcaagccacaccactaattaggtggcagcgccatgccatttactccgtgtaatgataggttaaggctctgcaaaggtttttctattttaatatcacagccagaatgttgccgcagtccagaatgttggatgacatccgagataaccatctgacttgctattttacattcataggaccataaacgaatgtgtttaatagtgcactatatttgcaattgcatttctatttacaatgtctttctctaagtatgtttgtgttgtgaaccttaacttgttgggagagttcttaaaataaacaagaatgggggatctgttcttatcagattgcataggacgagaatcctgctgcgaactcccgcaggcctgtataggattggaggttggccataccttttaaactttaagtaggaaacaaattgctttttaaaaaagttttaaaaattttgaaagaaattgtgggaagacagtttgctagggtatatccacattgggtttttaacaaagggaggggacaaaaatcatcatcttgtgacttttttagattggaaagttgttggaacttttacctaattctcggtgttaaaggttcttttttttttttgaaatct

SEQ ID NO: 59908 - DNA, 1081 bp, Homo sapiens
gttatgcaaaactcaggttgtattttcagccatgtacttttcataggcataagttctggaactctgaaactgaggtcatgacaaagcagatttgccctcagaaggttccagaatccttgtgacgccttcctgttgctaatggtagcactgtatctatcctagcattatatctacagagcagaggcaggacctttggcaggagacacatcccttctcctgtgatgtgtcagttagtgtagagaagcaagctggcatggacttgagagccggggtgggtatctgccccatgtggcctggctatggctgctctgttcagggagcctggggtcaggggtggcggccaccaacctgtgccagagaaggctagtctctgcatggacttcagtgcaggcatacccggcctgatggggagggctgtgggtggaaaccacacagaaaagatgcctcctcttgcttgaattgtggtgttaactagccgggaacgtatgtgtctggttgctgaaattaataccgcatttgcctgtgggcttatctttcaggattcctttgggacctcttccagacacaccctgttccgtagcctctcgagaaagtagtaaattttgctgactctgcgttattgaaatctcgcttggtcgttcattctcataaaatctggaatatgatttattgtttatatattgtaattttcacaggggtttgaagtagaaatagttttatctcaaattagaatatttctcctctcaagcatatgccaacaacacatagcaatattgtaaatttggaaatctgtgttatttccgtgttcactcatgttcaattagacagaattaatatattctgtaatgtttttagtatcatttttaaaaactaaagatatttacttcaaaatagtgaacagtaaattcaaaataaacttccttatttagtaacataacacatatattaataagctaaatatctaactggaaagcacaaaacggctaggttattgtgcagttaccagttctacagagaaacctggcttatcctaagtgcaatcattatgttgatccatatatatatatacatatccttatat

SEQ ID NO: 59909 - DNA, 1026 bp, Homo sapiens
ttctttgctctttttgaccctaactgcccatctcaagccctttgtgcctttttggctttcagtacctgttttcccactaggatccttggcgttccttcttggtacctgtcctggcttcacatcttcagccatgattacaaagtgctcctgtcccctggctggggttgaccgccgtgccgcttaggcctgcccgtcgatcagaagagtgccattatactcttagagctgtgtacacactcttttgtttcctgtgctaggctgtaaactcctgaagggaagagactgtgtattacatttttttttcggtcacattgtgtctcataatttagtagtagtacagtaaatatttattaagtggataagtgaacctgatagtatctcaacagatttaaaagggtcttagctatcctttaaatgtaaatgccatgtatacattgggctgcttaattattttctatctgtagttctcagctgaacaggaccctcaagcacgtggagatatatttgtgtctagatactccttttcatggtatttgattcatccaattaaatgattctatggccactttttggtctttccttttccgtggcattcagcctatgcagtgtggagcccttggagttcttgagcatcttccaagggcggcttcaggaatcgggttctggcgcagtctcctcagcagagctttgctcttctttatttattggggttccactttagattgcacttgggaaaaaaaggacttgtttggaaaaccaccaccctgttccatagactgatgcttttcacactgttttttgctgagttcgactcccagtcttgtgtgtccctcataaacatggctgttgtccctgcaggctgccagctgggaccttgatggcatctgcatgttaatggggtctggaaagaggtgccagcctcaggtcctcaaagcacagggtctgtttcagattcctcttctttcagctcacttgtggaggttgtgcagagagctgcccgcaagcctgaaggccctggctccgtgc

SEQ ID NO: 59910 - DNA, 1061 bp, Homo sapiens
atctgtaaactgatgttgacattgttgacttctcagatttcacatgaagcaagcttttctaccttaatttaaggacataaagccatgtattaaagatcacaccaacaaaccttagtgcctgtcgggtttctgagggagttgggcccctgcacacagccaccgaagttgtacctgcccaagggggccctgtgaggggccagtggggctgacatgcagcctgcagcctgctcgccacggcccgcatgggggcagcagctgtcctggggaaaagccacctctttctgtttctcaggaaggctcattgtggttcagcaactgccctataaatgaaaagtgtgatatattgtggtcttttacttttcttacactggtcatgaccaaatcattgaaaaaaaataataaattcatgaaggatagaatctaaggaaacgtgttgacaattcagcctccctgtgattttgttttctgaggaaaatcatatggccatctatacagtgaaataaggattttgaaccagtgtgttttgcatctcatagttaaaaatagacctgggatgttggcgcgggaagtctgttatccttataactagcagattatcggagagaaagtgacctggacagcagtgcctcagcagtagcaggggagcggggctggcgaagggcagaaacctgaacctgcagccattgcgatccacacggtgcctttcggctcctgagagtatcgtgtgcaacttgggctgcccctctgcctgaaattcttttccatttttcagagacaggctctcgctctgttgccctggctggagtgcagtggtgtgatcatagcttactaaagcttccaactcctgggctcaaggtactcagcctcccaagtagctgggacttcaggcatgcaccaccatgcccagctaatttttttattttttgtagagacagcgtctccctctgttgccccagctggtcttgaactgctggcctcaagcaatcctccagccttggcctcccacagtgctgggattataggtgtgatgcttgaaattctttatcatctaagtgtaccca

SEQ ID NO: 59911 - DNA, 1051 bp, Homo sapiens
actttgactgacgtagcaagtttttcctttttccttttttctttttcttttaattataggtctgattcttctctttctctgcaggtgcagttttagaaaataaacttgcatattaaataaagtgcagtagctgaatgcgaaagagtcacttgtgtgaaagatgaaaatcttgctttcttatccaaatcatactacatttgaaataacaaatcagtatttttcatgtgtgcttgcctttaagctgcttaaaggctgagattttctgggtaaactgagaaaactagagtgctggctaaactttaaagcatactgttgatatgctggtgaaaatgggttgtgaagagaaatttggaaacctcccctgctctatgattgggcaaacatacttgccacctcaaagaaaaaaagcctaaaaattggcatctgtgggtacaatttaccgtgaacatggtgtgatcaagcaaagctgtcttctaaagccaaagtaatctttcaagtttgcgtactccagaataagcaaagttttaggaattattattgactacaaattctgtgattatttcagttctcaaaaagtttatttataaattatagagtatacaaactaaatagaatgagattctagacttgactgcttattcctatcttgaggtccttaggattctaatttttggttgttttctcatgccagattatcaccacgaggtgtataagatcccagaattcagcaacgatgttaatggggaggccaaagagacacagcccatttttttaggtaggttcctatgtcaattaatacctcagcaaaacatcgtgaccatttgcaattagggggaaaaaaggaaattgttcaggaacgggaaatgtctgccattgcttaatgtatgacattcttttcaagaccttttattttacagattgccaatatatcccttattaacattgctaaaagttgtaatttcagacataaatgtttattagtgtctacacacagtgctaattatcactcactcacagagccagatgctgactgtgcagttttgtggctctg

SEQ ID NO: 59912 - DNA, 1322 bp, Homo sapiens
agataatacttttgtgcatgtaatggggaaagttctggaaatggatttatcctgcatagcatttttagaaggaagcatgaggaatgcacatggtatgtatatgcatttggtttgattttgtagtgctgggagaagacaagtattaaagaaaaatgtagttttcaaaagataccaagaagtgacttaaaaaaattttaaaatgtaattatatttctgatgtttttaaaatatgggaaagtttaaacttgtattttgattttttccataaagatatttgttttatttgcttaattagaaatgaaaataagttttatgttaataaccattgagtagatagatattcagaaaggaactctcatttttgccttgcccagtgttgtctaacacacacttggtctggaataagaatcacttacataggtttactctgctggcttgtggcattcccagattcttaaatttgaaccttttcaactatttgataaggtaggaaagtaacttaatatagtggcagtttttgcttttgtttagtgtgtttttttgtttttatagaggaaagccctgaaggaaagtaattactgtaaagataattgttgataacttcgagtccagctcatgaaatgacttagattttttccccagagctattaactgccattatataattaaatgtgtttttaatcctgagatttttggagaaatatgtttccatgcttaaaaagtaaagcacaggtgtttctttctaaagatttttaaagatttccttcttggtagtaatgacatggtatccattccttttattcttttgtagaaatgagttagcattttttaaggcttggtgctgatttgacctgtgaaaatagaaaggcttagtttgttaccttaattttacctcagtatcaattagttacggtaaacataaacttgaactgtaagctatagaatcatgaattatgtaatttttaccatatagcctttcttaatgtgagtttcttccttaatgttgatcttcttttatgttcttttgatcttactcctactttcagcattttggatttatcttatggtcagatgggaaaccacgtttcagtatcttttttatagactccacaaaggggcttgtaaattgctgaattcagttttcttaaactgagacttgagcaacagatttgagaaaatatgtgaagagattgtttttcctacaggttcatatgaacaagaatgcccactgttttcctgggtggcgttagtagacaggtgcttttttccttgtgtttctgcaaggttggtagctcagtttggaccaactcttcgtagcatta

SEQ ID NO: 59913 - DNA, 1015 bp, Homo sapiens
tctaaaatatttgaaggattttatactttacacagaggcatgtatttggataattagcttttattaaacccaggcttggcttttaaggtacaatatacaaattgtttttgagatgtttagttttttcctctctcaaaagtttaatagctgggcacattagctcacgcctgtaatcccagcactttgggagcccgaggcaggcggatcacaagggcaggagactgagaccatcctggccaacatggtgaaaccccatctctactaaaaatacaaaagttagctgggtgtggtggcgggcgcctgtagtcccagctactcgggaggctgaggcaggagaatcgcttgaacctgggaggcggagcttgcagtgagccgagatcgcaccactgcactccagcctgggcaacagagtgagactgtctcaaaaaaaaaaaaaaaaaaaaaaatttactgggtatctgtttcactttgtaggtcatcagaagattgagagaaagaggagaaccaatcagactatttggagagactgattatgatgcttttcaacgtttaaggaaaatagagatcctcacaccagaagttaacaaggtaagaggacagaacaaagctagaaaaataccactgtactgcattcactagaatagagtttgactaattgcattattgtaggcaacaatggaaaagtaaagtgagcagattattgctgctgaatggaagttttcattaattttttgaaaagctcatatcttaagtataacatttaatgcattttgacaaatacatacaagcatataaccattgcccttataaagaaatagaacattttcgtcaccaaagaaatttccctgagagcatcaggaagaatagcgaatggatgctgggctcaatagctgggtgatgggatgatctgtgaagtaaaccaccacgacacacgtttccctatgtaacaaacctgtcatcctgcagctgtatccctgaacttaaaagttgaaaaaaaagagaaaaaggaaatttc

SEQ ID NO: 59914 - DNA, 1049 bp, Homo sapiens
atattatagtttttgctttacatttaaggctctgatcttgttttatggcttagcatatggtttattccatgggctcttgaaaagagtattgttttgctttcatggtacagttctacaaatgtcagtgatgatagtgttgttcagatcttctttggccttgctaactttttatctacttgctttctcaattattgagagacaggtgtggttacctatgactatgtaacagactactccaaaacttactagtgtttgtttatttattataaaggatttatcattaccaaatctgtttttggtgattaacaagccaccctgaaacttgatagcttaagataatttgttattgtcttaataattaccagttctgtggttttattgggctggattgagcagtatcttgcttggggtctttattgtgattgcagtcagatgaaggctgcggccgaaatcatgtgaggctgcctctggactggtcttctaagctgatatcttgcccctttcctggcgtctcagttggaatggcaggaacagctggggctggccaggcccgctccccgacctgctctgtctgctagcctgggctgtctgactgctttctttgttgccaaaccactttcctgctttacttcccagcattgtcattccagccccacaacactagcagttgctttcagtcctctgtgtctgtaatgatcatttttcctttgcttgctgtgtttctgccttgtatgctctggttgaaatcttgtttttatactttcacatgcaattcagtgaccacatcttctctcggaatctatttttggtcccagtcagaattaattgcttccttctccatgtgcctatgagtaaacctttgttagtgtacttactgtttttcgctattattagagttatgtgcatatttatctcttcctggtgggcaaaggctgttttacctttgtatgccaagtcctgtgccgtgcatctagaggttttgaggacaaagcacaggagcacaaggtctggattccattcctggattatagtaatcaattatttggccg

SEQ ID NO: 59915 - DNA, 1044 bp, Homo sapiens
atgctttttcttgtgtgtacagtttagatacaacatattattcatcaagattctgaatatattgaggatacagcatggaagtagatagggcataagaattagtatgaactagaatttcctctttgagtgatggcctcttcttttttaggatatgcatagatgatgcccctagaggacaacatcctcctcagccttctctgtttcctacttccaggaagggtgccctttatacagttaaacccaaggggcactgaggtagttatctaggggtgggggtggagtgggaatgctgggtcttggcttctttatttctgtttctctttctccttcctctcctttagtcaggtgctttcatggtttttaaacttaatcatggtctctacagcatatgtagaaagtccagttttcttgtaactcgtaacttgttgaattttatgtatataatacaaatacaaatacaagtttatttcctctcaaatagttaactatgaaacttgatagttgttttctgagggaagcaaattatcctgagctaggaatagatgtagactagggaagttggtgacttgccaaaggtactacttcaaagcattatcatgaccaataagcagaactagcttattctatattatttggtggcattttaatcaagacatttactttaaggatgattgtattctgtttttgtgtgctagagagcatttagatgtactgaaccactgggtggcattgtagtctaagtttacccatcctttcaacagtttcttcttggcgtttgggctaaagaattgaatgccagagaagattatgtgaaacgcagtgtgcagggtaaactgaacagtgcgacccagaaacagaccgagtcctacctaagaccactttttagaaagctacggaaaagggtgaggtttcttggaaaatactttttttaactgactttaaaaatacagtataaatttagaataaatgcagtctgttttttccctatacatctatacatagtagcttccaaaatttcttatttatttttttcagaatcttcct

SEQ ID NO: 59916 - DNA, 1082 bp, Homo sapiens
ttgactctccctatcaatctcataggtgtctgatttttttaaattaaaatctccttgaggcctggctttataagcttctcttaacccttgaggtcctttagaatttatttgctttatgtttttcttgttcttcctcacagctagccaggcttggttaggaaaaaaagccttttgtcttcattggtttctgtcttcattttttgtggctgttctttaacggttcttggcaggtagggggtggggtggggggcaaagtggagcgatctcatccttcagctattcgactggagggccagtgtttcctctctgtttacacatctgttaaagaccctgtgtggtcgtcggcacatactgagcccccacttccttcagagagccacagtgctgtgtagggagtggatattgtttagggttggacgatgaaaaactacttagcccctgtcttctacatgaccccctgtggagaagactgggtctaaaggagaccaaaactagaattttcatcagtgcattgaagtgcctacctggtaattccagatctgcaacatattaatttccagcatacaaaggctgcaaaggaatgtttgccttttttttactcacaacctagctttggtttctgttttttccatggacattggtggtcctgggcagggcagtctgttaccctgtattttaatctgttttgtttgaataacagtcatggtaatattttccatgtgcccaaaaggtggacgaaaattacatcataaagggctgtgaaatactttcagtaagaatttgagccagtacaacattttcgcctttctgatttcttcttacactttcctttcaggcaaatgatgcttatcttcagatggccattggaaatgcgccttggcccatcggtgtcactatggttggtatccatgccagaactggcagagaaaagattttttccaagcatgttgcacatgttttaaatgacgaaactcagcggaaatatattcaggtaagcagtttggagagccgggaattgccctggaagtgaatattctctaattcccaaaactctaagtctggaaagcaggcagagaattaca

SEQ ID NO: 59917 - DNA, 2118 bp, Homo sapiens
ggaagtcccctctggataagcactgacactgaagccaccttcactgaataaagtaaaaacctttcaactttcatatatgttggaagacaagggtgaagtattgtgctttaattaccttagcactgaaataaaatgattgcagtttgctttttttttttaagacgtgtattaggaagtaaaagttgagctcatcagagaaatgtgggagtttagtgaagagcaacaaacttagagtattttacaataaatcctgctttgttgctttcaaggtaaatctaacatctactgggttcaagatgtatggagagtaaagacttggctttaatgtacgtagcacgtaacaacacttctttagtcatgtgaataggtctaaagtgccgatggtttgttttcttcaagttatacatgcttcacataaacttgttggtactgtttttgggctaaacttttctccctagtgggaagaaaatcgactataatgtagtgtttgccagattgtcataaatcccagattgtgtctgtaaaatgacttgctggatgatagttctaaaacttgacagtgatactccggaagtttacttaaaatttgaagttcacttaaaatgcataaagtgctttcagattttgtgccagagaacagtcattaccatattcatgaaatatctttttgtttttatttcacttccaagtgctgaatgttaattcgtgtcatgctttatgccttagtcacatataatagctttttaaaatatgatttcaatcggactccctcatgtgaactgtatacagagttcaaatatacttctggaaattcaaccacatttccattttttaataaccaccagtgagtgtattaaaggcagaagcttttagctgaaaaaaaaaaaagttgcttagctttaacaatagaaaacaggttccaaagattaaatttgctaattgtgttcatctatattgtggccaaaggtatagtgtataaaagttcatatgattaaatcaatcgtctgaaagacatttcttataaacagtaatgtgattttcacctccccgaggagtgatttttttttaagtatacctagcatttattcaagaattctggtttattttggaagctatgtaatgacctgtccttactccattgttcttcctttttaactgttctcttcccattaaaaaaaattcttcttttgccccctaggtgattagagaaaattgatgagcatactgtatttgaaatttagctaggtgtttgaggcagacccagtggtattcttgtggatagggcaaatcaggctggactcatagctcattgacagagggaagccatggagcattaaataatggactcgtgtctcttagggtagatgctagagatgtatgtcaggggtcttagggacctcagtgctgtcctgtcgaaccttttaatgactgacttggatggctataccgaaggatgggtttatcaggtttgcagacagcaagaaactagaagggatggagtgtatgttaaggtggaaaagaaactgctattctagaagttcttgacagacgagagagaagggcagagtctaaaaatacaatatttaggaaggaaggattaccataagaaaattggacccatatacccttttgcttaagcttataatttgggcagtggatataaaaaagaattagaggctgagcatggtggctcacacctgtaatcccaacacttcgagtggctgtggcgggaagattgcctgaggccaggagtttaagactagcctgggcaacatagcgagaccccatttctacaaaaaatagaaactagccaggcatggttgtgtgtgcctgtagtcctagctaccggagaggttgaggcagaaggatctcttcagcctgggagttcaaggttgcagtgatttgtgattgcatcactgcacttcagacagagcaagaccctgtcaaaaaaaaaaaaaaaaaaaaaaaaaagaaagaatttagtggactaaatttagtgtaataaaatttgtagtatgatatggccacctaataacttagtgtaggttctccagggcaagaacatagttcagtattgtacccctagaatctagaacaatatctgactcatggtgggtg

SEQ ID NO: 59918 - DNA, 1261 bp, Homo sapiens
gtattttctcagtcctccaaacatgatacataaatagtctcctaaattttagatgcataagggagaagttatctcgttacatacaatggatgccttaggctgggcatttggagcttaattctctattggaacctggttgagactggccgaattgttacatgtagctagagttaattcatttttactgctgtaagatatcccatttgtgagcacactaaagtttttttcatatgtcctcctatggatggaaatttgggttgttaccagttttttggttttgttattgtgaacagttctgtgatgaacattcttgtgtggacctgcaggtgcacaagaaaaatttctctaggcatacatctgagtgaatttgcttgggtctgctgcattttatggggacattgacaaactgataacgagttcagaggaaggcagttaagaataatttaaccatgtcataaccaacctttgttttccttattttcttagggattgaagaggttaatgaccatttgccagaaacactttcctacagacccatccaaatgtgtggagtacaatgcactgtgagatctgtgtatggtgtgttaataacaataagaaacttagggaagcaggctgtggacttctggaattaccaacaggaatgaggaaagaagaaaactggagtttccagtctctgagttctacctgatgtaactcttgattggttttaagaactttgttggccttcatttcatatctgactgcaagctgatttttctttcttgctttcattttaattagtccaaaattaagttttaaagatttttcctcacaatttaaatccatagacaacagaagggggtttaaaatgacctttttttcagttgacccgaaagttgtggttagatgattaaaaagaaacatttgaggatggacttaattatttcagtaaaatattataatttgcctattgtcttttatgtaatatttatataaaatatttttatatatttcaaaaacatgggaccattgaatgaaactttatagtccttaaatgttgctgaacttttgctgtcttgcaatagaatttgaatgtaaatattattactggtataactcaaatgttatttttcttgcatttcaaagcttgcttttatcttccaagaagtgtaaattttagtatttgtcatctctcaggacagatacaattaataggaaatagaagtttgaagaaacagagatggcacatcatagcaaactaagttcaaaacagaataac

SEQ ID NO: 59919 - DNA, 1094 bp, Homo sapiens
ttccaacaaacatcatgatagtctggtagtcaagacagagattaagtaaaacaggttttactgtttagctgagttcagttaatacaaaatgtacataaaacgttagtcctttgagactgacatgattaatgatcagtgtggtgggaaatgatgtagttattgtacacaagcacttgcaaactctttatccctatttctttaaaacaaaataaggtgaaatacgaagtccttggtctgatataaagcccctattggattcttcggatgcgtaaaagaaattgcctgtttcagccagaagactggtgaaaacacatacatcagactatgttgtgagccaggttgattttttattttattatatgcaggtgagtgttgaaactgttaaaattccaatttgttttcattcagtattagtttagttctaaatatagcaaaccccatccaggtgctatcagatgaccagttactgcttagttaactaggtgtaaagttttacatatacattaatgtcaatagtttattacaagttgtgtaaaatggactctagtttaataatgggggaaaaaagattaggttgctcctgaaactgactgtagagcatgtaaaatgattttactggattctgttcaactgtaatcaatgaaaaagatgtacgttgtagacaaagttgcagaattaaaaaaagaaatctgcttttaatttattctttttgtattaagaatttgtatagtacctttacattttgcaaaacagtgttgtcaacacttattaaagcattttcaaaatgaaaagatcccagctgcctcctggagattttgttcctttgtctgtcagcgataaatgcttgcgtgtgcactgggaatctgtaattcaggtgcttgtgtcctcagtgggctcctttattaaagtcaatctatagatggcatttttatgagcttgctagatgatacagagaagcttggtttgttcagctgaggtgaattccctcttattctagtttccttctgttaactgtgcaagataatattgtctaaattatgtattcctgctactacaaaaaaggacttgagattagaggtcaatctttatgagga

SEQ ID NO: 59920 - DNA, 1043 bp, Homo sapiens
tttgcaggacaggtgtcccagaatcatccacataccacctacatatagtaatacccatggccagtgtcataatcaagggccttttcttactttgcttctgaagctggtttatttctggtgctccaaacacaggactctcattaaaatccaccagtatatgcacagatgccttgtgattttccagctttcatggattttaaggccagatgagaaacatttacaacatccagttgttcctagagaggttagcaaatgaaatagaaagctggggatgactgatgattctcaatcgtgaagctgtgtttggtaccgaaatgctcctaaaactcacccgctctgaactactttgggttagggtcccttcctgtcacccatccctcaccactccccatggggagatcagttgcaggagaggaattcaaagggctcattcaggatcattgaagagaggctgtttttccgaatcatgatccctagtaatgactattggcttccacatatctatgattgcttcttaagatttaagaattacttctacccaacctaaatggtgatacctccctaaaatacttaaaaaaaaaaaaaaaagccttttattttcttctatagactttcctattttaaatgaacacacttttataatcacaaaacaatgcatgttatttagaataaagcaaagtcatcattgattttttttaaacttttaaaacacaattcaaaataccaccgcagtttcactatagggaaaactcacattttgaatgttcttccaggacagaataaaaatttcctagtgacatctgttagccctggggtctcacggaggacaacccgggcagctgtcgtgtgggaaaagtcccctgaggaaagcccagaggttctggctttggctgcatctgagaatcacctggtggggagctttgacagttctcagcgctcaaacacaccccaaatcaattgggcccaggcatgagtatttctgggagttcccaggtgctccccggatgcagccacgctgaagaaccaccgcactgagtaagtta

SEQ ID NO: 59921 - DNA, 1039 bp, Homo sapiens
gcagaggttgggggggcatgtagagatggttgcccactgtgaccatgccatagggatgctgagaccctgctctggggtccttcccagcatccctggaaatggtgacctctggccactgggttggtgtcagccaacaagtcgcaagctctttcacctgtgtctgatccctgtctgctctctgcctttcttgcaccacctgcatgtagctgccttacctcaaagccagagaagctcgacaccgtcaagtgaaattggagccacccccccaagcagcccccaccacatcctaacctggcagactgggtgagttctccttctatgttcttcactgtgtcagctcgaaagagtgtcatagacgttcagatcctggtgacataaggatatgtcagtaaatggatgatgagggttcatcactgggaggtgtcttcctttcaagagaagccccatgatctgctgtcacctctgcctactccttttcctggctgtgcctttatagaggtgaattgtctgtgttctcttaaagtaggcggtggtccttgggatgtggggagatggaagcacgaagtgggactgtgcttctttggtaagatttccagacagcatttcatttcggtttggattatactcaggctgactcaaaatgccaggcaagaatgtcagggggagaaagagagctgatgaagacagcaaatacactggggcaggtgaaacagccagtgtcttaggatgtctcagggtgcaagaaaaagggctgtgtcctggccaagcacttgctctttctcaacacacaaaagagatcaggtgccctgaagccttcagtggaagctgcacacaacaaaattaatgaaaccgaaaggcagctccctttgatagcttgacatgtttgcatacagcattatcatctcggcgccagtgaggctattctgaactactggagggtctggcagacacaggtaacccgcctggccctacagcacctgcctcttctgttgcccctgagacatcatctctaagtagatgttaggttctgtcaacatct

SEQ ID NO: 59922 - DNA, 1085 bp, Homo sapiens
tagggccagccctctgttgcagtgctcctttgctgggagcacagaatgaggatgactgaaattcacagttaacctgcaaacgttggtattgcaatagcctaacaagcttggacccagaagataggtcagctccctcatttcacagcctaagaaatggaaactgtaggatttacaaaccatagtttcagctgggtattttactggatgctgctaattttttaaaatgaatgttcagttatttttttccattctcctctctctctgttaaattacatttgcactcttcaccgagtgccagtgagccatggaatctagccagaaagcaaagctcttccagagactcccagccaccatcaaaaggtgcttggttttcaaagagcttcaatttcaatgctctctgaaatgaactattttatttctaaaatttctaagcctgatgaaaagttctccaagcatgcattttttcatgttaaaaatcacatctaattctctataacagtccccagagatgacacgtttatcctgcagtctgcaatgtggcattatttcccgtggtctcctgggacatcttttatgtaaggaattcatcactgaggatttgtcaaggaaataaatatctttttatcataaagaagaattctaaccttttcctcatatttattcctgggatgtctgccaaaacttttccttacagcttttactgatctgctgggaatataccgccttcttcatttttttttttttttctctaaggtctaaagagacggattgtcatttcccttctttagttctagaacaaccgattcctttcttctttggagcattgtttgctttgaagtttcccctccttccagagaggaaagcaccccttctctgtcttctgaaatcagtggctggtcatcaatatcccctctgtgtcaaaaacagatgagccacgcgtggctcctgacaacgtcctcctggcagaatgtgcgctcatatccggtgctgagtcgcccagggtcttctgaacaattggagcatttctggctcgcggctgaatgaggctgaaagaggctgtccttccatgtgtctgccggccggga

SEQ ID NO: 59923 - DNA, 1067 bp, Homo sapiens
atttgtaaaaatcattccacttgtaaagttaaccatccattagtcagtaagagctgttcccactaattggtggactcctggggaaagcaacatagttagaggttagagtaatggaccaggtgcccttgacttctatttctggttccttcacttacttgctgtgtggccttaggcagttttccttaatttctctgggccttgtttcacccaagaagtaaatttcccacttgatcttcttgagggatgccaaaagatcaaaggaacgatgtttgcagggctttttaaagatgcttaagtgacgtgcactagaaaccccttgatttaataggtatgaattaatacattctttgattattggtagaactaagtattttagctttttaattagctccttggatataattggccataggcgttacacaaatccctaagggaaccggcccagtcatcctgatgatcattatgggtgcctgctgtgtttttatgcggagaggcagagtgtgttggcagctttacatggtggtgggttatgacggctgcactgagccagcgcaagctcgggaggctcccctgaggtggcgcagaccatcggggctgccccgaaaccagctcagtcagagcccaccttaccctgtttacaaaggggaggcaaggtggagcatctcctgtttgttgatttgattgttgtgtttgctctgccagcctcagagtgaggtatttaacaggcaggacttctaagcctcaagggcccatgggcagaaatgccccagaccccatgaagaaaatgatgcttttccagcaagctgcaccccggccctgggcaaggggcagctgcttccaccctcctggtccctactgccttcatattcctgctccctagctcaccccctccctcctaagtgaagagaagtcagatcaggctactgttctgacatgcacaccttctcttctgttcctgggacccttttgtttttgtgtttgttttaagaaggagccttgctgtgtcgcccaggctggagtacagtggcatgatcctggctcactgcaacctctgcctcccgggttct

SEQ ID NO: 59924 - DNA, 1030 bp, Homo sapiens
gtcttgctatgttgcccaggctggtctcaaactcctggactcaagcagtcctcccaccttggcctcccaaagtgctgggattataagcatgagccaccacatccagctcttttttgcatttttctaaaaatggaatgcagccacagtgaactgtcttaaggtgttttataagttggcatttatcatatgtcatgaactctggggaaaatgtcgaagtggaagacattgagggaggaagctgtgaacttctagaacattcgttaggccacagccttgcaagctctgggggtagagtgaccaagtttcccattaggggagctttctgattttcagccacagagtttggccagattgacagggctagacacccctaagttattgcagatgtttataaacagcagaaaagcaaacagaacatttctatagatttgtcctcggggaaggatgaagggccatggatcccttccagaatataatggatttggacaggtttcacgccttggtgatttcttgttagatttttttgtgtgtaaccttgccctggagcagagctagagaactcactgcaggcttcagtgaggaaatcaaacctgtggctgtcatcagggcaacttgtttgccaacaagcaagggtttggtgggtaaaacgatcccttcctcctggagttccttccttccccaaatatactttagatgtgatgggtgtgagtgaaacccaaactcaagtttcagctccttcagggagccactaattgcctttctcatggtttcatccaataaagttgatctgagaaaagtgcctttcacattgaagccagccctctgtgtgctgatggaccaataaatcaaatcccttttctcagggaacttaccatgacgcagggagagaagatccggaaattcatcagtgtgggccctcgagtgtttggtgaattgaatacttgctgaaactatgcctttatagcatgtgcttaaaaattaccgactgtacttgggattggaattgagttttcctgaacactaggagttt

SEQ ID NO: 59925 - DNA, 1012 bp, Homo sapiens
tgtcttcccaccaccctagattggttcttatccacaccgttttggtctttgtgttgagtcctatgagaacatccaatgaaatgatccttaaattcaatgcatgttaaataggcgaggtcagaaataataatgcagctctttccatcagattttgtaagcatgtgcaatgcctggggcgcttgaatctttaatcattttccctcccactggccacatttcacctcctcctgtttttgatatcttcactgggagatagatagtcaaggtcaggcttttcacccgaaaagtcaccacagttaaaggtgccagttctcacttaacccgagaacaactatggtgagagagaagttgaatcaatcaggttagatatttgatggtgctttcctgtggatatttttggtagctttcctgtggatatcagttatgttacagttaatgttcaccaatgatactctcctgggaccacataatgggctgtgtaaaatagaataaaagaccttccttcgtgttacccgcctccgcgcaggtagagacatcttcgtttagcggatgaatcaaatagcaaactaaaagctatgttcacacttaaaagtgttattttctgatggttggttttgagttgcgcatcagataagcctctcagcagatgttaaatattagcccgcagtcgaccattggctgtaacataaggtgtaaatgtttgacagaaaagcacacatacaacagcacgctaacaagtgcaccccaaggcattcaggtgggaatggaaacgcacagagtgagagtagaaaccatctattgtggaaatcctggacagtgtttctgtgaagccatctgtacactgttaaatgatttacattctgatgggacctgctaatcccggaactgcaattccaaacattcttccgcatcccagcaccgacagcctctatcaattccaaccgccgtaaagctctttcagctggttaaacgtaaggaattattgtccccaattcttccgtaggctctcatg

SEQ ID NO: 59926 - DNA, 1033 bp, Homo sapiens
attctcgggtcgggatcatctgagctagtttgggtgggctgttgcttgtggagtcaggaaacctcttagcaaggtctgcgctccatctagagtgttcctttagactcaaatagatgccctaagattcagtcctgctaagtgtgcccccaaaacccgtttaaaatgtaggtctgattatgattcagctgtggtgaggccagcagatgaggagaggacagacattgaaaagattgtcactcagttcctgggagaaggggccacaccatgccacgcagggccatgtgggaggcattggggagccgggaaacaattgggcaagagcattttttgtggtttctttggggaggaacgggcaaggctgggagagcaggcttgggattggctagtttaaataatttcagcgggctctgcagcatgggggctgccccctagttgtctggtacgtgtccctagggtggtgagggcagggaaatagtggccctgggtgtgagagccgagaggtggtgggaggggtggaccctggatccatggtgacatgtggaagtcttggggtctggaaattggctaaccctggcaccagcagtccctccaggcccagcaaggtcacagacatccaagcatcataaagccatggtcaatacacagccagactcggaactgtccatgcagaccctctgaatccgagacatagccttcatttatttccctggttacccagagacctggaatgttctttgtgaaccctggaagcactccctgctccatgctggtagttaaggaaatgcaacattgccacctactgctgaggctctcctgaaaatcagaaaaagaagccactttttttttttttctttttttttgagacagatctgcctgcctcggcctcccaaagtgctgggattacaggcatgcccggccaaaaactatgcccggccaaaaactatgcccagccaaaaactggattaaaaaaaaaaaagaagaagaggctggcctgtaacctgagtactttgggaggtcagggtaggataattac

SEQ ID NO: 59927 - DNA, 1916 bp, Homo sapiens
aagatggggcagattggggaggttagtttttacccactatgaggatagcatactcatcaaaggctatacctcagatcttcagacacagaggagcttctatggcatcagtgttgggcgagaaagctgacggcatccaaaccgactccccatttgcctcttgccaggaggatgcagtaagcagacaaccacacagataatttcatgcagcactgtaaactcggccactccgagcataacatttcccttctttgggttgcagagaaaaaatgcctgtcatcctaatgtttcatgcttattccatatagcactttgagattaccaagtgaaatctgtgcttccaaatcctctattgctctgagtagatcatacgttactcacagtaggggagggcaaacagtcaagagtgacatactaggaattaatatttgagacgctcatccctaaatccacaggcaatttcctgacacccacgtctttaccaggtagctccttaagtcctgaaattccacttaagagcagctggaaggtgacgtgagcattcagccccagagcatgcctgcagccttggttgtggacacatgcaggttgcatagacagattgccctgcagttcagcccacagacagcatcttctgctctgtcttccaaaattgtttccaccagttggaaatgtactttaaaaaaagcctttatcaggccggatgcagtggcttacacctgtaatcccagcactttgggaggccaaggagagtggatcacttgaggtcaggagttcgagaccagcctggccaacatggtgaaaccctgcctctactaaaaatacaaaaaaaaaaaaaaaaatagctcggtgtggttgtgcacgcctgtaatcccagctacttgggaagatgagacaggagaatcacttgaacctgggaggcggaggttgcagtgagccaagatcacaccactgcactccagcctgggcgacagagcaagactttgtcccccacctgaaaaaaagaaaaaaagccttcatcaaaatgagaggagccaccctcatcgcagtcttggaaccttctggaggacgctatagccagatatggggggcggagcatgttttatggtcagccgaactccctaagtctcgttgtcatatccttgctccttgaaaattattttcttcatttattctctgacccgaatgtatatttgggggagtatgttgagagcagagaaagggaagtgtgctttagccatagtgagaatgatttaagtaagaatttccggacagtgagagttgctagatggggtacaggaagccgttagtaggaaagattctggactctttctcttgaccttcataaaaatagagtggattttcactagaatggaatggctgaggtgtggcccttccttatttggttctcttgaggcttgtgagactgtagatatcctgtctcacagggagcctgcccagtgccagaaaaaccgacctgaccttctactgctagacaggcttcgtttcagtgcttctccccatcactttagatgaatggttggccgaatttcttccccatccccactttttgggttttttttttttttttttttttttgagagagtcttgctctatcgcccaggctagagtgcagtggtgcaatcttggctcactgcaacctccacttcctgggttcaaacgatctcctgtctcagcctcccgagtagctgggactacaggcctgcatcaccatgcccagctacttttgtatttttagtagagacagggttgcgccgtgttgacgaggctggtctggaattcctgacctcaggtgacccacccacaacagcctcccacaaagtgctgggattacaggtgtgaaccaccacacctggcccccacttttttttcaggcagggtctcgctctatcaaccag

SEQ ID NO: 59928 - DNA, 1097 bp, Homo sapiens
aaagctttgagaaattgttctgtgtccaattagaatttttgatttgactaacagatacaacataacatctttatttctgtaactgctcactaatgatatgcaccctggatatatttagactctcgtttgccggggccattgcactgtaaggtgctacgttactgtctgtgacagcatttccaccaagaggcttgatgaggatgggggtggggagacttttgggtttgggagtcctctccctcgctctttccacccctctcaggcctgaccttccatgcccaggcttacatggggagcagctctaggacttatcccctcctgggagctcctgacactggaccaggcgcccaggggcagatctccatgaagtgtctgggatggttcatggggcagccagccagtgtcaaaacctcccccaggaagaatggaaggagggatctgccagcacagctcatgcaagaccaagaagtccctgccagcgacattccagcagaaccctttccaaagtacttggttatgtaaacagaaaggcggtagcctctagcccagatggactgctccgtgtggatgtcaaagtcactgtggaaacttccccctatggaagcactacgggtccccaagctctccctgcagctctgtattggaatggggagggttggggacttctttttgacctcatggaactgggacctccgtgtaggactggtggttctctagttctcgagcgtccctgtttctcagatgtgtcttgctccgatgccactagaggtttgatctgatttaagggtgtcactggagtcagctgtcggtgtggagtgcttcctgctaaacgtggcaggacttggcatctgagcatgtggaccttggatttaggcacttagtacaggagtgctttgtatccaacacaggtttagcaaagcaggtggcctggcaggacatactaacctcataggtggccattttcctactgtatgtcaagagccaccaaagacccaagggtggaatttggaaaacttgcaggtggtctagaatactattttctgctccacacctccctgggaggcaatggagattatgactatagtagtatacaaaga

SEQ ID NO: 59929 - DNA, 1047 bp, Homo sapiens
tttagcaaaggcaaatctgactgtgttcctcccttgcttgaagacttcccattgattttagggcaaagaccaaaatccttaacatggcctccaggcccatcatgctctggcccctgcttgcatcgccaactcctcttgtacctctgcctttgttctccttgttccagacttaccagcctcctctctgctccagggctttcccacctaccaactgcctttcctcaaagttctcattctcccctttgtgcttagttaactcatgttggacccttagatcccaacttccttagggaagctttctgaactgtgcagagcaggtcaaatcaatctcataacacagttttacttcttctttgcaacattaggtaaattaatccttgtgtaattacttaatgtctctcttatgtatatgagctacgaagttgggtataatatctgccttgttcactgcagtattctccatttagggcttggcatacagtaggcactcaacacatatttgttgaatcaataagtgaacttcccagagttcacatggtcaatatatggcagaaccaggactcaaatccagtttgactaatatcaaagtttatgcttttaatcactgtattctactattgtcctctatgccgccaccatgataatgtcttaaagacattaagagcttgagcacaaatttactgtatacagaatgaacctttgtgttcttttcaatagaatgttgggcagcagctgcctctcaagctgactgttgctttttacctgttctcatatgtgattctactgaagtgagccaggaaaagagctagtgataaaaatcaagaggtctaaaataattattcttagtcaaaaagaagatagattaaaaattattcttagccaaaaagaagatagattaaaaagagtggaattttaattggataacctagaagaagtggataaattcctagagacatctaacctatcaagattgaatcatagaaaagtagacagtctgaagagaccagtaatgagtaaggactttgaatcagtaagaaaaaaacaaaa

SEQ ID NO: 59930 - DNA, 1102 bp, Homo sapiens
tgttactcgtgggtgatactgtcataaaggggttgaaagtacttgttagctgtatatgtcagaattgattaaagagaaccaactattcttgtgcaagggatggtattgtagttaattatgacatttggagaaactaatttctgtctgtcgacactatctctgttccatttagacttagagacttacatgggcaatgcttgactttttgcattcagcacagaaagttaagtaatccactgtggtaaaatattaactaaatttatatgacttcttgactgctgtaagtagagaatatttatcatataagcaccattttcctgaattttttgttactacatattttatcttactgtcactattgtgtaaaatctttgaaaggaaaatgaatactgtgtaatagttaaacccattcataggttgcaatagagtgtcagccaaatgtgtcatacatcaaatcttcagcagcttttgcataatccaggagaattgaataatagttgaagttaattttgccagtgaaatgtagggaaagaaaaatgtttgaaatttaaattattcagatagctaaattcttaatcctaaaatttaaaccccttaattctgtctgtagtgttatatcaagactttttgatagtcatgaaactgagtaaaactttattcagattacttaaaaacagcttttcctgtggttaataacacctttattttgaacagagtactcttaagcaacttatattgtgctgattaaagatttaatctgtgcatattttttatcctgttgtttatttagttttgataactgtgaaataaaccataattaaatcacaaaagtcacctgcctcttttgtttccctggaaatttggccaaattttttttaacggaaagttctgctaatgaaaattgggaaattggagacatatattattttgactgtgtgtcctctgtcattaaagatggactatactagctgggtgtggttgctgatgcctataatcccaccactttgggaggccaaggcaggtagacggcttgagctcaggagttcgagaccagcctggccaacatggtgaaaccccgtctctactaaaaatacaaaaaatt

SEQ ID NO: 59931 - DNA, 1036 bp, Homo sapiens
tgcctcggaccctgggatgacactttgaggatcaccatgctgtgcatttgtacacacagacacacacgtaggcatttgttttccaaagtaaagggcatactgtttggagcctaatgtttttctcctatttagtgccttgtgaatattttccctttcattatttattctaataatggatgattttaagctgcactgtattccattattagatatttaaatggcttccattttttccgctatcatagaccatgccggaataaatatcattctgtgtacacttgtctacatctctgttgatgtctttagggtaaattcctaaaagtggaattactgcgttcaagggtgtttcacggtaaggccttttgctacacattgccaacaaattcttcagagagtagcagaaatttgtcttcttacaagtagtctatgagagtagatgctgattttctaaatgtaagggaataagaaaaacttcatgattaacttttttcacgtgtatttgggctttggtgggagtaggcaagaagaatatccgtggatttatagagtaagcaaaagtatgtcaggaaaaactaggaagaatagggctgaactgtggcttgatttcaggagagtttctgggattcagacttgaattaactgaatgatgctgtaatgtataagtgttggtataggtgattttatgcaaagaagaataaacattggcttacttttatttatcgtatacggtatgggtgactactgctgctagttcaagggtcttgattttttaaaaatgtgtttcttgactgtggtagctgggagccccaggatacagacttttggttaaataacatctgctccactctgccttcccgtgtgggcctctctaaccctgggccaagcagttgagtctctcctcggggtgcctggagtgagggtggatacagcttgggtaattcagcatctgtacctaaaaacttactcaatgtaggcttcatgtaaagaagtcagtggttcttgggaacaggggtgagtgaatggaggcgaaaggtgg

SEQ ID NO: 59932 - DNA, 1048 bp, Homo sapiens
ccaaaaggcctaaacttctctcatctttattgcttattgcagcttttattatagatgctgcgagtactcagcacttctaagaaactccgattgctcttgtttccctttcagcttggagctgggatccagagtagttaactgaggggcctcgcaagccccttgtcaggaggatggcctgcctttgaaggcagttgactcttgtatgtgtcttagtctctttaggctgccataacagatgccacagactgggtggcttaaacaatagatgttggtttcctcacacttgtggaggctagaagtcctagatcaaggtgccagcagattgggttcctggcttgcagacagccgtcttctcattgtgtcctcacatggcattgaggctggagagtacagggagagagattgagaaagaaggagctctggtctcttttcctcttcttataaggacactgatcccatcatgtgggctgcagcctcatgacctcatctaaacctaattacctttcaaaggtcccacctccaaatactgtcactttgggggttagggcttcaacataggaattttggggggactcagcattcagtcggtgtgtgtgtgcgtgtgtgtgcgtgtgcatgtgtacttgtagaggagggttgattgtccacctgacagccgttgccatcccctcttccctgctggatgccaatttgcatttttctggcacgttttgcggctagagtggtcatgtgacactgttctggccaatgaggcgatggaggaaggcccccgggggcttctgggagtgcctgccttcgcagctggagagagccctcctcaggggctgtctctgccttcccttcttcccatgtgtatctggggcagctgaggcagggctaggagaagagcccaggttcctcctgccacctccaagcgatgaagcagccctgggccaactccagcattctcgtgtgaactgcagaggagccctgcgcttccagctacttgcagccaggtgctgttacctacgccccacgcaccctcacagacctgtgtacaagggcacaa

SEQ ID NO: 59933 - DNA, 1054 bp, Homo sapiens
agatggtgagagttgggaaacaagcttaggacagagactgaccacggagggacccgtgttggattgttgatccgagaaggtgatgttgaaatacagactgagaaggtgaggaagagccaggggtcaggagaagtgtgggaagggggctggcttgggagggtcatgcgctccaggtggggacatcatgtgcaccaagacatgcagcccagaaagagtttggtgtgttccaggaatgaaggcaggcctgtgtggctaaggcgcagggagcaaggtggcggagagactggcatgaggcatgagaagcaggcccaggtcagatcaggtggggagtgagggccgctgccagggcattggagaagctattgagaggccctgacaatcccatggggggaaagtccattcttagtgcacgtttcctgctttgaactttttctattcaataacgaaaacctgggtgctatatttgttttagccacaaaactatctgggtatctttgagaagtggcacttgctgaggtggccttctaaatctttgcctgctgttccatggcaggatgccttgtgaagccaggtgtggcttgtggcctagatggaccagggagatctcaagtgaggggcagtagcacggagcacacagtaggtgtcagtcaagtctaaacgttgcgcacggctttgttttgtccagagctgagctctcgttaggtcggggcttgacaaatatgaatattgtggcctgggctgctctctggcatgctgagtgctgactggtgtatttcctttttcagccagagaatcctggtcaagccctgaacagtccagaaactctgaggtcagcatttctagatcttctgtgcatttgggaggagtcaccattgatgactttatcaattgtaaatttccgatatcaaattactggccttccagtcagtcggttctgatgacaggaaggacgagggctctggaaagtcactttaagctagtcattgttagtcaaatagtgctgtttttgtatatcgagtattgagaagggaatgtgcttggtctgtcttctctc

SEQ ID NO: 59934 - DNA, 1040 bp, Homo sapiens
gtgtgcgcatgcacatgtgtgtgaatgtgagcacgtgcacgtgagtgtgtgcacacacacactggtggggaggcaggtgatgatgggttgtgtcatgaatgcccaagtctggcggtgcatttaatggagtagtccagggaagcaggaggaaactgaggaacagggagggcaagcttgaggaattaaggaattacctggactcacggggaggagctcaaaagacgaattcgatctttttctaaaaacattttaaacagtagtttgcctgactccaaatcaggaagagacagctttacctcatctctcctgcctcctagcctgtgggctccattagcaagggatgaactatcgagtaagagctggcactctggcatcaggtagacctggctgggacctggctgggtcctggctaggccccggctaggcccctccaatggcatcaccatgggcaggctgctaatccccctgggcctcagctactcctccgtcaataaggataataatacctccctcgcagaactgttgtgaaggttgagatgaaatatgagagtgtttaaagcagtgcctgggatgcagtaagcacttcgaatgttaaccagtagtagcagtcatatttttgtggattacctgggaaccaaaccatcatcattgatataatttctattaccagttttaaacagttaaatgacaaagaatcccattttaatcaagacattacagtagagcacagacccaacctggttgggtacttagtagggagaaatagaggctagaaattaataattatgcccaataccagtgaacagctgttttcgcactgtgaccagtttagtacaaataaaaatgtttatagactgcatcttttctccatgcacaatttattgaggtatttcatcactttaacagatgataattgaacatttagaattcctagccttgaagatccagcgaggtacaaaccagaaatggccctggcccctaggtagctaaatatctagaggggagaagataaaaaacacacatggggctggcaataaatt

SEQ ID NO: 59935 - DNA, 1048 bp, Homo sapiens
caggaaccgcttctgagctgaaatccagagatcctactcaccagaagcttctgtccttcagctcagctgacagattacaataagaacatcagatttttcccattccaggtccctttccaacccctctgctcctgctggactttgcctctgcttttgaattccaacatttcagcgatgcgcttgtcaacgcactggaatcccttacttcactctcctgggggattgggcggcccacccatgcctgtccctggacttctgagttctgccagagaaagttacacagttgcctctctatgatcctgatctctgcctcaccagggcctcaacactgcctggaaatcaaattttcctcatcaaccctcttcctctccataatgacttttccaacctcctccacacttcttaaatctctaggttcatactgagcccatccctcctcctctcatttcactctcggcagattatctttccacagctcacgggacagtcgtgcgaaggccattctctgaccttcccactgcccctttgcaaatccgcctgctcttgggcctgtacttttctcatttttctgtttatagtgaaagaggaatcttatttattctctagaaatccatttctgcaccaccattctctcccacctccaatttatttatttttatttatttatttatttaatttgagacagagtctcgctctgtcacccaggctggagtgcagtggcacgatcttggctcactgcaagctccgcctcctgggttcacaccattctcctgcctcagcctccaaagtagctgggactacaggcgtccgccaccatgcctggctaatttttttgtattttttagtggatacggggttttactgtgttagccaggatggtctccatctcctgaccttgtgttttgcccgcctcggcctcccaaagtgctgggattacaggcgtgagccaccgcgcccggccccacctccgatgtaaacctctctcctggtatttccttctcatgagcatttacaagtgctcaggtctctcctatcttacgacaaaaac

SEQ ID NO: 59936 - DNA, 1061 bp, Homo sapiens
taaaatttgatcgtcattgtttgttcccaacaatgatttgccaggaatggtatgcatacttctcttctgccccattcttccttgttctaatctcttcttaaatagttctgtttttcttttgctgaacaggaattcccaagtaaataattctttcttgtgaccgagggtgcagttggtgaggtcttcttgccttctgaatggccagtagctgcttccggactccggaaaatatgtcgcaaatgaagactgctatcactcactctataaacaggaccagaaagtgagcaatttggcaaggtcccctctctcggcaagtctgatggatctcttttttttccccagtgaaggcttgtcatatttataagccagtagtgttatttcagaatctccgaaggaaatgtgcctccgtgatagggaagcaacttgtttattctagacttttcttcactatatttctaacgttgaggaaattactcaaagaggtttggcagagtgaagacagatgagtgagactggattgagtttatggaatgtattaattcaactgatgtttgttcaactccaaatgaaggatccagcatccagggcacagataagtgcaggatattcgccctcagggaacttcctgtcattagggaggctggcacctgcttgcagttaacagaaatgttagcgtagttgctcattctgcttggaagcggagttcgttaccatttcatttaatgaacttttccaaatggaaagaaagctttgtacccgcacgccctggctctggatgtggaggttgagagccctgtgaagctcttatttaaacatgaaaatgggtgtcagctttaggactaagttccactgggaagaactgggggaagggagccatttttaggtggcattagccataccacctttaataaaaaacttcgtgtaactcaatgtatttcctggctggctgcagttacagaaatattaactgtcctaaaatgtttatcttaaagagaaacgacttcagtattagagaatgcacagaaaactagattataagtaaatacttttgttcacattgg

SEQ ID NO: 59937 - DNA, 1196 bp, Homo sapiens
ccgattgcagatatgtgcgtgctcatttgcaaattgcctgtcctcctcctcccctggcccggccgctagaacctacatttcatagactttgggttttgtatctgctgtttccagcagcagagacttgctttagttcttgctctgatttgctgtaacttcaggtgcattcagccaggtgagattgcttattgaacttaccaaagcaacagagtaagagttctggaggttttaatcactgtgctctcaataagccaacagaaggaaatgatctctgggaagaacgttctgcagaatacattacgttccatcttggtatgaagttaggatcctgggaggccaagtgtgaggatcctgctagcattttctttcagtgaattaaaatgatttaaagagcagtgaattaaaggctaggcataatcctatgtctttggcctttaacagttttttttttttaataaaacacagctatgtgttcagtatgcttttatttggcatgaatgaataaaggcttttgtccatgctgtagtgcgctgttccttgtgtaacattccatgtggaaaacttcttttagacaatcataccatgatattttttcttttccttgagaagatggatacttatttttttttctaagaatgtatagtatgtacctttttatttttggtcctggcccccaggaaactcaaaaccacacttaatacagagatctggaaattatattagcccttgtgtgtaccacttgctgtttcttttgtagggtggccttgacttacttacttttttttttggcacggagtcttgctctgtcgtgcaggctggagtgcagtggcatgatctcggctcactgcaagctccacctcctgggttcacgccattctcctgtctcagcctcccaagtagctggggctacaggcacccaccaccatgcccagctaatttttttggatttttagtagagacagggtttcaccatattagccaggatggtcttgatctcctgacctcatgatccacccacctgggcctcccaaagtgctgggattacaggcttgagccaccgcacccagcctggctttctaatgttattttatttacctagttgaatgtatgactttttttttttttttgaaatgaagtcttgctgtaacacatgctggagtgtaatggcatgatctcagctcactgcaacttctgct

SEQ ID NO: 59938 - DNA, 1116 bp, Homo sapiens
tgaggctgaaggtcaggaattgaactagcacatgaggaattcgggtcaggaggtcaccagtaaccaggagttgacagtgatgcggactcagtgcccttgcccaggtattttgttgcttgctgggttcctgtttatgcaggagctgattgctggctgggagcacccctgcacgcccaagcaagagggatccagggtcagcagttagtggcaggagaaccccctgagggtgccttgtatgcagggagagtgcatttcctgtttggtttgggacgagcctggtccaggtgtaattagtaacagaggcttcctccttactcagcaatgactgctgtggtcgacaattaatatggtcaccctactcacgagtacttggttgcagagaagtatttgttatgtgtatgagtgaagatcctgaccaaagatttgaccacacaaggttctgtggtgagtccatggtttacctgtctcatgggcggagcttggctgcctctctttgtgtacttgttatttgaattccaaagaacgttctgcgccacacttttcagagctcttttctcccagtgtgtgttttagatggccgtctgttttgtcattgataagctaattctgtaaacctcagggcagctgcacatgcagcatctgtaattgcacctctgtaattggctggagtgctcgagagactgtacttgcttttcctggcgccccccagggtccgtggcttcacctaaaggcttggtggcagggactggtgagagagggaagaggaagagaggagggagaggattcttggtcttctactcatcagcctggttgacaggggctgggaaagtctgattcttagttgactgccgggaagatggggcttgcgagagtggagggggctgaggtggggtccaggtgttactagtggagggtgtccaggttcttggcattttgaacaaagaattggacaaaacgcacaaacaaagcaaggaaagaatgaagcaacaaaagcagaaatttattgaaaacaaaagtacactctacagggtgggagcgggctgggcataggggctcaagagcccggttacagaattttcttgggtttaaataccctctagaggtgtccctttggtt

SEQ ID NO: 59939 - DNA, 1046 bp, Homo sapiens
tttacaaaaattgtacagtcttatgaaatcttgcagtataaataatcacaggtggtttgtgagtgtttaatgtagatgtatcaaaattcccatgtcctggaggaagttgagaatgccatttgtgcatatgcgtatgtagagggggcttcataatattctttcccttgtaacttgattctatttgaaacacataaaactggtcagggttctttttcattttttctttttttagtggatgtgcagggtaaagtagtgtatcggaaagagagaggcctagacttgaaagattttcagacttttaagcctaagcttgccatgaatgagtatatgacttttgagcatgtcattatttctgtttcccagcgtcgtcttctataaaatggaaatagtcacactcacctacttcttagagttgtcttagggtgagatagaagcctgcattctttatgcctgcttgtccttctagggaatgctctggaattggaacagcatgtgggccaccccttaggataggtgactcttagaaggtgagaggaggcagggcgtcgggtgtgcaagagaatcagctacatcatctttcaggttcctgctgcggtgggtgaattctgttattctgtgcccatggaatgggaggtgtcatagaagtcatagacatcagacgtagagtttgacctgagtgagtcagttgccctcttggggtttgcatattcttacctgtgaaatgcagtaataatactggtaatattattattatcatcaatgaacagtttttaatcatcttatatgtgaccaggcatggtgtcaagttctttatgacatttcttcattcattcagcaactatttaatgaatgctgccatatgccagtcatcgttccaggctctggggatcagtgggatcacgggctagcatggtggctgggacagacagactccctgcctgcatggagtttatatgctagtgcatgacagaaggtaaacagatacatggatgaggtgattcccatggtcagtgctgtaaagacaactaagtcagttcagggggctg

SEQ ID NO: 59940 - DNA, 1044 bp, Homo sapiens
cagctctctagagcttattcctcttgctgaactgaaaccttgggcccattgattggtaactccccattttcccccactgcagtccctgacaaccaccattccactcttcaagtctatgagtttagctacttagatgcttcatctaagaggagtcacatggtatttgtccttctgtgcctggcttctttcacttggtcctccaggttcatgcatgctcgtgcttgtggcggaactgcttcttttctaaggctgcctggtattccactgtatgtatattaccacatgtgtttacccattcatctgtccttgatggttaagctggttccacaaaactcctagaagaaaacataggggaagaggttcaggacactggtcttggcagtaattacgcggctgccacgctaaaagcacagtcaacaaacccaaaactaaaccagattgcatcgaactaaaaagcttctgcacagcaaaggaaacagtcaacggagtgaaaaggcaacctgtggaatggggaaaaatgttggcaaactacatatccaataaggggttaatatctgagaagtttaagggatttccgcaaatcaacagtaaaaaaatgaagaacccaactaaaaaatgggctaaggacttagacatttcaactcggagtttttttttattattttgtctttttgagacagagtctcactctgtcacccaggctggagtgcagtggtgccatctcggctcactgcaacctccacctcctgggttcaagcgattctcctgcctcagcctcctgagtagctgggattacaggcatgtgccaccacgcctggctcacttttgtatttttagtagaaatggggtttcaccatattggccaggctggtcttgaactcctgacctcaaatgatccgcctgccaatcctctcccaaagtgctgggattacaggtgtgagccaccgtgcctggcctcaactcagagtgttagtaatgcagccggcagtgatgtcaagatgcggacacagggacacttggaggatgggagctttgtcccttgtc

SEQ ID NO: 59941 - DNA, 1045 bp, Homo sapiens
ctttgactgttaattgtttaaaatctcacaagtaaaggtggaaaagagttttactgattttctttgggaatggtggaggggtagaagacttctctcctgatggaaagaggaaagatgaggaatatggcttaatgttattcctaacttaccttctgccccttccctccagaattctgtgtgcaagtgttttaaggaaatgagttgggagtttgggtaagtgagatctagattttgggcatttgtagaagtccccggctatctgggggagttgtcactcttctttcagcctagagaaggtgactatgggtgctagtgtgctgtggggcacactcgggggtgggaaagctgctgtggagtgggatgtcctctgtgtgcatcatggggtcgagtgtggccttgggatgacctcatgagaccttgctgcatttccttgtatagttcccttgtctaatcatggcctatttttgcttttccttcttgaaacaaaccatttttctccccttttcctttctagttcaagaagggctgggcctgacccatctgaagtttccctcaccctaagtacttaggaaacgtgctgaagaggaatggacagtcttacccatctcatatccctaattccggtaccccatcagtgaaagaaagaaagattatttggcaagctggattagattgccatttagttatggtgcatggacaaggggctattttaaggttgatgggggaggctttgcttgtcatttactctccattcaccagacattcagtgcccgtcatgtgccaggcactgggtttactgctgttaacaagactataaggcaggtgaggaggatatttaaagaactgggctgggtacagtggcttgtgcctgtaatcccagtgctttgggaggctgaagcaggaggactgcttgaggccaggagtgtgagaccagcctgggcaacatagtgaccctcatctctacgaaaaattagctgggtgtggcagcgcgctcctgtggttgaagctactcaggaggctgaggcaggtggaatgcttgtgacca

SEQ ID NO: 59942 - DNA, 1037 bp, Homo sapiens
atatatatatatattattttttttttcagattgttggattggcagcaaaacaaagtagaataagaaatatttcaaatacagtaatgaaagtaaagcagatcctgggcagaaggtatggaatcaaatgatacttttaaatatggtaataggaacatgttcataaattctaagcataatgtgaaaagaaattagaaacagcatagtttgtttcttcattgctttttatgactgagtcattacagagagtacccccagtaggcagtgtcttttgattcttagtgttggatcttctctgatatgggattcactcagatgttagtttcttgctgacaggtcaatttggtaatttgcgtcagaggtggtaatttggattgttcacatttttagattttttttaactgagaggatttcaaagattttgtgggaatttgaagacttattgacaatgtggttgaattttgctgaatctattacaatttttcgtaatttatgtagacactattgattttcttcctcaggatcttttgtgacactttctgggaacgaacttttccacttgacttacaaatttaatcattagagtaacagctaaattaacgtcttatgtaagaatcagattaatcatctgttgtaagtttaattagaagattaaaacaggcttgcttccccagacttctgtctcctcaaattatagattgctataataattaggggttttcattttcactactgtagtaatacttgatagagtgtttttaaattttcaaagtgctttcacatctattattttatttaattctctcaacatccttgtaaaattggcaacgcaaatactatcattccccatttatagatgagaaaatcaaggtacaaagaaattgtggcattatcctagggggtaaactgggtaagactgcagatcaggtctcctcaccctcggccccaggttcttttctttcaactttgtttagtgagaatttaagtaaaaatgtcctggtgttgatttagaattggatattatagattaaatttatgca

SEQ ID NO: 59943 - DNA, 1029 bp, Homo sapiens
taccgtggtcatgcttggactcctttagcgttagctgcctcatggtccaggtgattttccctcccagcccatctactcaccagacaagggtgatttttacagatccattgttgtaccaactctcagccatgaaagcatttggcctttttgttaccaagccattaggttcttggtgccgtgtctaccctgggtgaactcccaaagttgggctatctcagtcttggcctcatgcctgtttatgacctactcacaggtagcaccacttaacttgctgccaaaattatccttacacccttcctgtaactctcattcccctgtggccttccagccagaaatgcggtccttggacctggcttctcagcaattatccctgagagggaagatcctggagatatcctgagagcacacagagcttccccacaccttcagacttgcaccttgctgtccagaagctgcctagccctcctttccaacccacaatggccagtgccaatagcagtgcgggcatccggtggtccagacaggagacacgaactcttctctccatactaggcgaggcagagtatattcagcgcctccagactgtgcatcacaatgcagatgtctatcaggctgtgtctaagcgaatgcagcaggagggcttccgccgcaccgaacgtcagtgccgctccaagtttaaagttctgaaggcattatatttaaaggcctatgttgcccatgccacaagtatgggtgagccaccacactgtccattttatgatacgttggatcagcttctccgaaatcagatagtgactgacccagacaacttaatggaggatgctgcttgggccaagcactgtgatcagaacttagtggcctctgacgccccaggggaagagggaaccggcattctaaaatcaaaaaggactcaggcagctgatcatcagcctatcttgaaaacagttaaggcatcagatgaggattgtcagctaagaatcagtgaccggatacgagaaaccagtgaccttgaggactcctgggatgaat

SEQ ID NO: 59944 - DNA, 2756 bp, Homo sapiens
ccctggctccttttctgtgtcctcagaaaaaaacatggatgaaccatttatatccagatagtatgaaaataattgctagttcattttcccaagattctccaccaaatggaagacctttcagaaatgccaggggtgacctaatagaaaacgatggagccacgttctagacagctggttcatcctagctttgtcacagatgtgaagcagtttacctccctccagtggtttcctcatccgtaaaatggggatcaataataactcctgccctgcctacctcacagggttgttgtgaggatcacgtagttcatagatgtgaaagggtttaaaagtttaaaagcactgtacacatttaagttattaattcatatggccttggctgaggtaaggcagattggtttacaagatacagaagtatggatatatactgtgacttcattgcttgaatctttcctttgctggtctaacttgactgcttcatggagtttgaaatcttaatttttaaaatccctgtgtggctcattagacgactataagcacaacctgtatttgtaccttaatctcttacatttccactgctgtgtatctgacatatctactagtaagcactgttttgtcaaaccgtctttctctccttcattttactggttcttagtctcctatcaatataaggaaataagaagtgccagggagccgccattgtgtgttacggtttatatcgataatcttcaatataaaatactggccattttataaaatattaaatatatgtaaattctttgcatttcatattatttgggtccctttatatgcctaaattacatctttaagtttcggttgccattggaacattgtggaaacaattcagattatatcagtttcccatccgctttttagctgatttcattcttttctgttatttttttgtctagtatgttatacagggcaagccctagaaacgtttccttttgaggagctttccaagattccttttcctcagatgttgtagacagaagtttatgtagttaatggcatctggtggaagagaacagctttgtttcctctttaactttgggaacactagaggatggtgtggataaagattgcctgcaatagatgactccttttaagcactagccgtgaacagatgagcctcctccacaccccagacacacactggggagagatgaaggtgataagccacacttccgatttactctagaagggaagacattactctctgtcattaaactaacttaaagcttttagtgatttacttagtacttttaggaatacaaataggaatctttaggatttaaaaagttttccaataatctagaagttggaaaaataacaaagagtgggcatgttgggggaggttttattttctatcttgcaggctcgagtgcttagctaaatgctggaaatggacataggtggagaaatggtcagagcagcagtgggagcgtacccagaaccatgagtagacggcaagcgagctgctctgccaagccagggatggaggtgtgaggcggctggtgtggtagaatatgttggaatctagttagaattcctggattggaatcctgtcacagtttgtttcatcagacaaatcacttgcccttttctattattattatttttttttttttgagaaaaagtctcactgttttgcccaggctggggtgcagtggtgcaatcttggctcactgcaacctcagcctcccgagtagccgggattacaggtgcatgccaacatgcccaactcatttttgtatttttagtagagacggggtttcaccatgttggccaggctagtcttgaactcctgacctcaggtgatccacctgcctcggcctcccaaagtgctgagattacaggcgtgagccaccgtgcccagccaattcatgcctcaatttctttatctccggattgagggatttgtattagattttttttttcctagtaccttccagctctaaaaaaatttgaaatagcataataaaagacaaaatgaaaacgaaattttaattgtaatattttctgtcacagcagcatatgtatatttgaaatactggtaacaattttaaggtagcattctgtggtattaatatttattaatatgctcatgaacttctaagtgccacaccagacatatagactctttactttaaaagagcatatatttaaggcattgaaatggatacagctatattcattctcaattgtcttaggctattatatggaaagatatgtgtcaattataggtaggtaggtaggtaggtagattttctggaaacacagaagtacttgacggagagttaggcctgtattctataaatctattaatggtagcaaagtgcataagacagggatttctttgagatgaaaggagtgctgaagaagagcattggaattaatatttggatgtggtattgtgaaattcaatgggtaaagtaaccctaatgtgggaataaaagtcaagggaaaggtcttgaataagtacacagaaaaataggctaaaaatattaaggggagggaaattggaatacagggagacagtgtgcaagaaagcaagccaggaatctgcctatgtggtagacccaaccattactacttgaacccccttagaaaagcttttccagcattccataactcaggttcctcatttataaagtgggaaactcataattgtcctacctacctcacaggggtgttgtgaggatcaaaggaacagatgaatgtatgagcactttcag

SEQ ID NO: 59945 - DNA, 1064 bp, Homo sapiens
gcaggctttaaatgtagagaactaacattatgacgttgtgtcttcacatggatgcgttaggagcttattctccatggagtcagtctaattcagaagatggttgatactgaagcctaagagccaggctgtttggaaagctaattctgtgtccaaatatatcaccaaaaccacaagaagtgctgcatgatttcagagcgcagagaagaaaattgacacgggggcggggtgggcaagcaagtgtattgggaaatatgttaagtgagatctttgtcataaattaataaacctcagaaagtatcacttgtcattttcttctgtcatcagaattttatattttttaatatgcagaaacggcacattctgtattgggctcagatgcaaatgatgtagttattactgtcccgtttgattttggagaaaagcaaaaaaatgctcttgggtaagtatatggggtttatcttactggcttaattaaaggaagtacaaagtcactatatagtaaaaggtaacattgtattttaaagtaccttaggcgataaaattgtatttgtaaataatttagtaaggtaatgatcatttttatatgtatatatttgatgaaatgccaagaggccaggtgtggtggttcacgcctgtaatcccaacactttgggacactgacgggggggcggcgggtggaccacctgaggtcaggagttcgagacctgcctagccaatatggccaaaccctgtctctattaaaatacaaaaattagctggacatggtgttggtgcctataatctcagctattcgggaggctgaggcataagaatcgcctgaacccaggaagtggaggttgcagtgagccaaagtcgcgccactccactccagattgtgtgacagcgagacttcgtctcaaaaaaaaaaaaaagccaagagaacataaaattaaatatggtgtaccttcagctgtttcgatcggaaacattttaaattaccaggttaaattgacatttatgaatctctttgccttaattttgtgtaattaaggtttatgtaggaattacatgtgcagttttagaaa

SEQ ID NO: 59946 - DNA, 1139 bp, Homo sapiens
ggtttattgttgggaatgctatatgggtatgtgtttttagatttgttattttttggaagcttataagtagaccataagcaagatgggctttcacttgaatttgatattatcttcatatatatgtaggtgaatgacctagactctcctgtctccatgatattgcatcactcttacttaataccttattcttatggtaaacctgtcattcagagaactatcatattaagttttggcattactcttcacaagaaaaagaaaagtgatatttgtttgattgtactgagccccgttttatctttctcttgtccctgtgtctgtgtgtttctgtgtgtgtgtatgtgtgtacagagcaagatttgaacttctttgttctccactttttaataagtgtatagaagcaatcagaggactcttagatcaaaatggatttacagcagatgatatcaacaaggtaatgcttttacatttttcttaactattttaggtgtagtttcagacttggaatttaggaaatagctctgggtactgaaagaatattttaatgcatttaagaattttcttagattgtgttaatgaataaggaaaaattgatgaaattttgattaatggctctggtgaactcatttgtatatattcagtttcctagcaaaacagaataattcctttccagtatattttttatctgtaagcatagacagaaagatatttgaatacttgctatgtgccaggcactttttccaagagttttacacatattaacttgttgaatactcacaataactctgaggtaggcactactatttatccccaaggtaagcactattatttatcctagttttgtacgtgaaggcaccaaggtacagagattaagtagcttcctcaagatcacacggtaagtagtagagccaagatttaacccagtattgttcctgtgtctcctcataactagtataccaggctgcttcccgttccttgcttaggaacatatttttagactttcaaaaaaattcaaatgtttagtattttcttttttttccccaaaattatttctcttcattgaacatactctttttatacatttaaaatgagccaggtgcgatggctcaagcctgtaatgccaacactttgggaggtcaagg

SEQ ID NO: 59947 - DNA, 1082 bp, Homo sapiens
aaaagagtaatgaaaacacacacatgcataacatgcctgggctgcacctcagacttaccaacttggaatctattggtaaagttttaaaagcgcttccacatgaattggtttgtgtgtgtctaagaaccttcccatgcaccaggtttttgaactcagatggcagtcctagtatttccttagctcttctctcacagttctgttacctttttcttcacatcctctctgagactccatagctgctgccactatatcctaacttaaagatgccaggaggagcgttagccacgtaatactgaatttggaagagaatctttcagagttcccatctgttctaaccttattttacaaatgagtaaaacaaggtacttagtaacttacctaagttattaaactagagtttggcaaagcctaaagtcactgcagaactccaaatctggtttcttgatataccattctttaggaaactgaggaattttatagtaaattcattaccatctcttacttacaaatataatcttagttgtacaaaagagtttgccatgtttttaagtaggtgattttccaaatgtatttaaaatgcttgattttttttttttaagtatatatagaaagctagccaaattataatttgcgtgttactgggaatggcttacttaccaaaaaagaaaagtagcctttattttccaagattaatagtacatcttagaaacaatgattttaatctaggacatgacatttagaagggacaaatgcattagttatcttatatgccctccttctggaggaaacatttcaagttaacaaagcttcactcctattctctgaattctgattcagtggtaggagaattgaaaactgccctattttaaaaaggtttgtttcagtgataaataagctttggtcctttgcaataattgatacatcagttcatttatgtaaagatgctgaattctcttcatattgttcttgtataaacaggttgtactccaggatttagataaaaaagaaaatggattacgtgatatattagctgttcttactatgaaaaggtaaaaaattaaacttctgttgttaagaaaatt

SEQ ID NO: 59948 - DNA, 1005 bp, Homo sapiens
tagtctatgtagaatacaatgaaagtgaaaaacattatctctgttgacctgcatctgtatataatcttaaaaaagcttacagacatgaaacattttcaagtgacttaatggaaattaactgatgtcagttaaacgtagtggaatagaaatccatgagaaaatccaagaacaccaatttaacaaaatagttccttaatgtttaactttttcttgaagacatgtaactggtttcttgtcataggaatttttagtctaaaattgccagttgaaagatggggaatagaggttttaagtttctcttttttgttttaattgaatagctatttcattagtaaagaattctattttcttattgtagcttggtgtgtgccttgcctagtttcacttgatactcttcaggaattatgtagaaaagaaaagctcacatgtaaatcgattggaatcaccaaaaggaatctaaacaattatgaggtggaatacttgtgtgactacaaggtagtaaaggtaaggcaaatatctagccccttacaagagacctaatcagacttcagtatttcgtatttctgtaacataaaaagaacattaaaagaaaagctcttcttaatgtttaaaattctaaggcatgataaatttatatgtcctatcatctgtgttgccaaatagcattgagaggattttgaagcataaagtgttcttgcattagaatattttcaggtgctcatatccctctacatccaactcttgattatctccgtgtgggttaccagagcaaatgtttgatctccaattgtctttcgttttgttcgtggatcgtatttccccactatcacctgaaatgaacctaccgtttcaaaccaattttagtgttactgactctcaagaacatcaccatttgcatttcctgccatcttgtcacactccagatttagtcaggttctaggttataatagaatggcctggattgcaaagtcatttccagcttttgtttagtaccttaggacttaa

SEQ ID NO: 59949 - DNA, 1596 bp, Homo sapiens
tctagaacatctagagaatgtgtgcccatgatgttgagaaatgagttcccttgtgtctggtgtttgatattaagttatggacgttaagaatgcctgaatctattgctggccaagtaagccactaacctaggtcataaagagttagctttgggaccatttatttccatgatcaaaataaatacatctgggtttaacctgaatcaccatttagtaacatagtcatcagtttcagtacctttgtctttttccaggtaaaactctttagcctcttatcaaacatgttatgccacatctaaattccatattttatgtaatataaggaaaaatagttttatttgtatgatttatacttcatgtgttaggaacctgtgactacatgttctgaactgttagtaagaaaaatggtattggataccttactctttaagatttttaattatttttggtaaaactgggaaatagccgtctgatttgcattttattttcttttgtattttaaggatatggaatattatcttgtaaaatggaaaggatggccagattctacaaatacttgggaacctttgcaaaatctgaagtgcccgttactgcttcagcaattctctaatgacaagcataattatttatctcaggtaaagaaaggcaaagcaataactccaaaagacaataacaaaactttgaaacctgccattgctgagtacattgtgaagaaggctaaacaaaggatagctctgcagagatggcaagatgaactcaacagaagaaagaatcataaaggaatgatatttgttgaaaatactgttgatttagagggcccaccttcagacttctattacattaacgaatacaaaccagctcctggaatcagcttagtcaatgaagctacctttggttgttcatgcacagattgcttctttcaaaaatgttgtcctgctgaagctggagttcttttggcttataataaaaaccaacaaattaaaatcccacctggtactcccatctatgaatgcaactcaaggtgtcagtgtggtcctgattgtcccaataggattgtacaaaaaggcacacagtattcgctttgcatctttcgaactagcaatggacgtggctggggtgtaaagacccttgtgaagattaaaagaatgagttttgtcatggaatatgttggagaggtatgtttcatttgccacgtagtaaatgatggacatgcaaggtttatacttttggaaaattacctttttatctctttaagagatacttggtacattttgatattttcatttgcagatatgtagaaatttattcagatttaggagaagagttcactggcatatttagaaataaaaaacttttatatgaataaaaaatatacgttaaaacaaattgatatagtcatctttcaacaaatacacattcctactagtcaaacctaggatttgtaaaatttaaaatatgacaactgtttttacccaaaagtcctaagaagaaactcagatgtaacacatgctgctttgaaacttgaaagttttaatttacttcatctatttgaccaaatatgattaaatgtagttggcagaactctattttggatcaaca

SEQ ID NO: 59950 - DNA, 1027 bp, Homo sapiens
gaactcttctcctaaatctgaataaatttctacatatctgcaaatgaaaatatcaaaatgtaccaagtatctcttaaagagataaaaaggtaattttccaaaagtataaaccttgcatgtccatcatttactacgtggcaaatgaaacatacctctccaacatattccatgacaaaactcattcttttaatcttcacaagggtctttacaccccagccacgtccattgctagttcgaaagatgcaaagcgaatactgtgtgcctttttgtacaatcctattgggacaatcaggaccacactgacaccttgagttgcattcatagatgggagtaccaggtgggattttaatttgttggtttttattataagccaaaagaactccagcttcagcaggacaacatttttgaaagaagcaatctgtgcatgaacaaccaaaggtagcttcattgactaagctgattccaggagctggtttgtattcgttaatgtaatagaagtctgaaggtgggccctctaaatcaacagtattttcaacaaatatcattcctttatgattctttcttctgttgagttcatcttgccatctctgcagagctatcctttgtttagccttcttcacaatgtactcagcaatggcaggtttcaaagttttgttattgtcttttggagttattgctttgcctttctttacctgagataaataattatgcttgtcattagagaattgctgaagcagtaacgggcacttcagattttgcaaaggttcccaagtatttgtagaatctggccatcctttccattttacaagataatattccatatccttaaaatacaaaagaaaataaaatgcaaatcagacggctatttcccagttttaccaaaaataattaaaaatcttaaagagtaaggtatccaataccatttttcttactaacagttcagaacatgtagtcacaggttcctaacacatgaagtataaatcatacaaataaaactatttttccttatattacataaaatatggaa

SEQ ID NO: 59951 - DNA, 1076 bp, Homo sapiens
catttttcctataacttatatatatgcagttacaaatggaaaattgttaaaaatacaggggagaagctatgttaactttggaatggaaggttttgtttttgtagaatatgttattttcatgcaattctgtaagtctaagatcgtcatctacagttctgctcttaagaacacaagttttatgacacgctcggcttaagaaaccaaaagtgtctaaagtactttatgttaccaaccaaatttggctgctgcactcattaagaatgcaacttaaaaaattttggttaacaaaaagagtaatttgattatacaagatcttgtatactgaataatttataataatctaccactgtctaaaagtgtaagaatcaaaacagccatctaatttagtttcagaattatagatgaatacagataattataggtgacccaattccaactaaaaaatccagagttgacaactccagatatgtagccatgcttgtgtctttctagtcacagctcaacctacccttcagtttgaagcagtgtggtgccatggtgaagactactgattttagagctttgaatctcggttcttattactatgtgacctgtgtgaccttgggcaaggtactcaatttctctacaataatggacataacagtactacttctcaaaaaaaaaaaaaaaaaaaaaaaaaaaagaaacagtactacctcactgagttttggagaggattagtgaattaatacatcaagtgcttagaatagtatgtgacacacggcaaatactttttacatttatatatatatatacatatatatgatttgtatacaaataaatttgctagtatttgtatggtagttttgagaatggtcttcacagttcaaaagtaagttacagattatggatgcaataaatgcttgtgtatattttacaaaactcataaatatagtatctttcatgttgatccaaaatagagttctgccaactacatttaatcatatttggtcaaatagatgaagtaaattaaaactttcaagtttcaaagcagcatgtgttacatctgagtttcttcttaggacttttgggtaaaa

SEQ ID NO: 59952 - DNA, 1075 bp, Homo sapiens
caattcattatgatttgacgctgaatattaacatttatttgtaaatatttcaaagggaactaactacatttccttgggagttaacttactctaagggtcttgaccatgtaagtaccctctatcactgataataaagctaatataatagaaaatttgaaatttattctaaattgtcttaactctctttctcctatatttctttttctgtgtcttcaggttctggagatatatcttcagattctattgaccacagcccagccaaaaagagggtcagaacagtatgtaaatgtggagctgtgacttgcagaggttacctcaactgaactttttcaggaaatagagctgatgattataatatttttttcctaatgttaacatttttaaaaatacatatttgggactcttattatcaaggttctacctatgttaatttacaattcatgtttcaagacatttgccaaatgtattaccgatgcctctgaaaagggggtcactgggtctcatagactgatatgaagtcgacatatttatagtgcttagagaccaaactaatggaaggcagactatttacagcttagtatatgtgtacttaagtctatgtgaacagagaaatgcctcccgtagtgtttgaaagcgttaagctgataatgtaattaacaactgctgagagatcaaagattcaacttgccatacacctcaaattcggagaaacagttaatttgggcaaatctacagttctgtttttgctactctattgtcattcctgtttaatactcactgtacttgtatttgagacaaataggtgatactgaattttatactgttttctacttttccattaaaacattggcacctcaatgataaagaaatttaaggtataaaattaaatgtaaaaattaatttcagcttcatttcgtatttcgaagcaatctagactgttgtgatgagtgtatgtctgaacctgtaattcttaaaagacttcttaatcttctagaagaaaaatctccgaagagctctctctagaagtccaaaatggctagccattatgcttctttgaaaggacatgataatggga

SEQ ID NO: 59953 - DNA, 1032 bp, Homo sapiens
tatacacataactatacacatttgtatatattcactgttaactaaaacttagttttaacagtgtaccttatgatcgaaagtggttgttcaaaaaatgcctgtaaacattcctctgaatatattcctgttattttataatcacattaatattacatactgttacgtttgttttatatgtgagtctggcattataaatgctggctgaatgaattgggctaagacaactacaacagatgtgatcaagaaaccgatagtgattaccagaaattatatttggtgcttactctgatgatgctcttaagttttttacagactatatgaactcctttaattttcacaaccaccctttgaggtagatacatttctaatccccatgtacaaatgagacaaaggcacagaggttagttcacatagctatgaggcacaggcagaattcaaacacaggcagtttggcttcagagaccatgatcttaactgctatgctctgatgtctctccaaaaaagtataaacatgagcagggttaattgtagcagctacttggtttttacgtcaagaatcataaaccacaagaggaaacatgaagtttttgttttttacttttcaagatggagtctcgctctgtcactcaggctggaatgcagtggccctatctcagctcactgcaacctcagcctccagggttcaagtgattttcctgcctcagcctcccaagtagctgggattacaggtgtgtgccacacctggctaatttttgtatttttagtagagacagggtttcaccatattggtcagactggtcttgaactcctgacctctggtgatccactcgcctcggcctcccaaagtgctgggattacaggcgtcagctaccgtgtccagccgaaacatgaagtttcaaaatgccaagatgtatcacagaagacactcagcagtcagccacatttatcttggagaagagttccaggacttaaatgtttgaatagtataaactagttttttaaaaagtctgcctgaagccgaagattaaatac

SEQ ID NO: 59954 - DNA, 1039 bp, Homo sapiens
cttgaacctgggaggtggtggttgcagtgagctgagattgtgtcattgcactccagcctgggcaacaagagcaaaactctgtctcaaaaaaaaaaaaaaaaaaaaagaaaaaaaaatggtagaactaaacccatacgtatcaatgattacattaaatgtaaatggtctaagtgcatcaatgacaagagacacggaaaaaaccaacataacccagtgatctgctgtctataaagaaagtcaattcaagtgattgataggttaaaaggatggaaaaaccatgtaaacaattaaaaatggagtggttatatggacagtttcctaatgataaaaggtctagttcaccaagaagacaaaataatcctaaacgtatatgcacctaacagctccaaaaatttatgaagctagaacagctgaaaagagacaaactaatgcacaattacagctagggattaatttaacatccctccttagtaacagaactagtatatacacattaatcagtaagaatatagaactgaaaatcataagccgactggattaaattgacatttatagaacacaccaccccaaactagcagaatgtatctcctgaagtacacatggaacattcagcatgatcatatctttgctcataaacacacctgatttaaattgacaaacttggatctagtatgataaactgatggctatagacaaaatcagcaccttatttatccccaaagatgttaagtcacttaaccttgatgtgaatacggtggccaaattagaagcggacaattagaatataaaagaaaatgctcaagaattaaatggtggccaggcacagtaactcctgcctgcaatcccagtactttgggaggctcgcttgagctcagggttttgagtccagcctgggcaacacacagggagaccctgtctccacaaaatgttagccagacatggtggtgtgcacctgtagtcctcgctacttggaaggcttaggtggcaggatggattgagcccaggaggttgaaactgcagtgagctgattgtgcccagc

SEQ ID NO: 59955 - DNA, 1660 bp, Homo sapiens
ttttttttttgtaagtagagacacatttcactgtgttggccaggctggtgtcgaactcctgggctcaagccattgcccacctcaaagtgctgggattacaagtgtgagccaccacacccaaccaggttatttgaacatttttaagtactgtattttctctattgtaatattgactgtcatctctgtgcaggttttttagtggttgctctaggttgaaacgctttgaattcttaggtatctaagagtgagcattttctttttttgactgctatactctcaccagttgccagcttctcatataaatattgtaaatgctctcgtttaggtaactcagcttctggagttgagggaacttcaaaatcagaagagctctgggaatctgcatttgtgctaagatttagcaaacttttttcctcgggtatatgtgtctcactgcttagagtagttggttctccagtactaggaactattgtcacatctttatctctgcttttcaaatcagagtaagtatcctttgggcaaattacattttgttccatgagagaggcaggaatattctctttgattgttggtctgtagtcagctttgtccaaggaagtaatatccccactgtttctctcttgggaagataacaaaacagtatcagattggctgtcccagccttgacttccttgttctgttatgtgtgttgactgggaagaattctgggaggagatgtgagttgattctccatcagagtcactgaaaagctttggtgactgagatccccctgccactgtggaggaagggaagttttccaaactctcatctgtgatttcatcatttcttttaaagaatacttcccactggggtacatccccatcagccttttgcaggtgaagtacagagcccagatctccttgcagtgaagctgggattcctacttcttcttcactttcactgttggattcttcacaatctacaaagtttgtgaaacgagagctctgcatacactctgctctgcagcatcctggggtttgtctcagtttttcaggctgcttttctgatactgcagtcattgaaaatacctcagggtgaaaagtttccgggtatggaactttgtgccttaaaggtattggcagaggatcatcaaagagatagtcatcttcctcctctgtgggacaaacaaaacaggtttataggaaacaaggcaaagggagccaatttgtagtatttatctgtacttttaattcttggaattgcaaagaatagggaggccactcttcttcaaagggaaaagatattcttgggatatgctgaacaatttaactgccatccttcaactttttataataaatgccagagtatcagtggagaatatagagcagtcactctgctctatatgtaagcctggctgatcattacgatcatatgcaaaacttcaaaaaaagaaaaaaaaaaaaaacaggtttctgtatctcattccagacctactgaatccctgaggaagataggaccaaataatttgatttttaagttctacagctgatatctgttcagccaggtttgcaaagcctgtgtgctctgcaaatagtagatgctcagtgggttggctgacttaggaaaattaaattgctttttattaaggtttttcttctgtgagcatcttattgacatgttt

SEQ ID NO: 59956 - DNA, 1041 bp, Homo sapiens
aaacactgctttccagggagcttgggtctgggagaagtggccttgggcagagtggacctgggacccaccacaggtcagacttgacacatggtctcaggaagtactttgccttcctgtcttcagcctgtaaaatcaggagtctgctctccttctctgggttaaaacaagtggtgaaaacggtgccatcgtgtgtggtgttctcagctttctggaaatacaccctaagatcagtagaggccataaagagaggctggtttgttatccttgaacattttcttaggacatagagaggctggtttgttatccttgaacattttcttaagatactagtaaatgctgataatagacttttctcatcatcatttctgatcaagttgatcagtagtgtttatacagaaggatttttctctatactttgtaccttctttcattgctactttgatttttctagtgaaggacagaggcaagctctgcagtagtaatcagaacgttagattctgagcaaagctctggggctttccagcagccctatttcgtggttaggattcttgattttcattcctttggtggaaagtcagttactctgccatgcagtaaatacttgaccaaaacacacgagataatgatgatactattttttgaacacctattaatggcaggtattgtgctaggtcccttacatatgttatagataagcctctaaacaaacttacaaggggtaccatcccaattataatgatgaggaaactgaagtttagagacttaagtccctaaggactagcaagaagtaagtgatgggcctgggattctaatctaggcctgtctcatctctgcttctgcatttctgctcatggagaatctaattttaaaacatttagatgacaattccaagactgatatagtaagcctataactggtgcccaaaaaaaaccacatttgtttttgtttcaataattaaaaggttttagaaaaacagttccattaatttcagatgttaactctattatgtaatgcatcctctaatccttacaaatttactaa

SEQ ID NO: 59957 - DNA, 1089 bp, Homo sapiens
tatattatagttaatgcccagctaaattctaacttatttgaaaagggatttgttaaacataagcaactgaccttcttggacaaggaaagcaatatattaaaaaagagaaaaaaaaaagaatctttgagtcccattggtgattctcagctcttactgtggatcagaatcacctggggaatatttaaatgtactgatttctaggcccactagtactcagtgttcaggagatctttgggagtgaggcccaggcattggatatttttttcccaagaggtccctggtgatccccacgtgcagccagcattgagaaccacagccataagagagttctgcttctctttccccagcctccctttatctcccctaacaacctgtttcatcgtagagattgttgatccatgtgattttcctttttctagattaaagatttcttgagctacctctgtcctgtgaacgcatatccaaatgtcattccagttggcacaactatggataaagttgtcgaaatgtgagtagtcactggttgtgggacttggtgtcccccttggtggctcttggctaggacacaaaggagagtttgcctgaatgtttacaagtctagaatctgtttgttttgggacatttctgaactgatactcatttccattttttcctggagtgtttcctttagttccacagtgtggcagaaggtataggtagtgttgtcagcttctcctgggttgcaacccagctccgccacttactaacagtgcagtgtgagcttggccagatcacttctctgagctagtcattctgaatcagcaaaataggaatattgatgcctacttgttggtcttcttaaaaaagaaagagatgatacagggagatagtgtaagaaaagcacctagcaccatgccaagtaggttgtcaagtgtctactgaatggataactgaagccaaaggagaggtgcaatcgtattcatggatgtcttttactacagtattaccattttcttacctcttctttgggtttcatttatgcattcatgaatgattttttttttttttttagacagggtctcactctgtcacccaggctggagtacagtg

SEQ ID NO: 59958 - DNA, 1041 bp, Homo sapiens
catatgagtggaatcatacaacatgtgttcatttcttatccggcttctttcactgaggatgttttcaaggatcatccatgttgcagcacgtgtcggttctttttatggccaaataatatttcattgtatggctagaccacattttcctgattgatgcatcagctgatagacatttgaactggttccaccttttggctagtatgaagaatgctgctgtgaacagtcaggcacacatttttgtgtggccatcggttttcgcttatcttggttctataactagtggtgaaattgctcagtcccatgggaattctgtttgttgagtggacaaggattccacttgtttctaggatttggagtgtgaggaaattgggagaaaaggcacattgttaaaaggtacataaatgtgttctgtgaaggagggctttgttgagctaggtcctaatgataactgctttccattactattttttctttattttctttttagaaggaagagattgttgtgactctcttaccagctggtcactgtccgggatcagttatgtaagggggtcatttattttgtcattttattatatgtagacacatattgtatttgtagaaataaatttttagggtctaaaattaatagggggctgggtgcagtggcacatgtctgtaatcccagtgctttgggaggctgacgcgggaggattgcttgagcttgggagttggaggctgcagtgagttttttttttaaaaaaaaaaaaaaaaagaaagaaagaatacatagagggagatttgattttttttctagtcatttaaaacacatttgttcccaaattgaactagggggactgaggtgaagatcagatttgaaacgtttcttataaaatggaagtcttcatggccaggtgtggtggctcacacctgtaatcccggcactttgggaggccaaggcaggtgcatcacttgaggccaggaattcaagaccagcctggccaacatggtgaaaccttgactttacaaaaagtataaacattagccgggtgtggtggcaca

SEQ ID NO: 59959 - DNA, 1074 bp, Homo sapiens
ggacacgaacatttagtccttaacagtgatgtatttatttcccatgttgtaaaggattgggcatggcttattttttgtcacatttgttccttattacatgctaatgatgggaaccctggtgttgatattactacatgatgttattgtcacatttactgagttttataatgctcagaatttaaaatggtgattaatatttttgcaggtaattcatgaatattgtactttttttctgaacccttattcagaaaaggggctctgccaagtggaaaaaaattatttttcatcattaaattttgaggtagtacttttgtgaatgtatggttttaataagtaggactatagacatacagcccccctttttttaacctttacagctggtaggtattttcctattttggttaatattggctttgttgcttgattatagcacactgctttgccgtgtttaactttgagggtgtgttgtgttgttgaacagaaactgaccttttcagatatttcttctttggtgaagatcagacagttgaagttgaagtattcttcccatcaaattatcctgagggaggactacagagccagtttagtgaggattaaaaaggaaaaaaaaaataggtgaacctttgtaaatgccatcctggactctgccaactgcttttccggggaatactgtggtggtctgtggccttgtcacaatcagggatattggtgaaaggcattccctgaactgggggccgacagcaggctgacttttgagcagtcctgccaccactttgattttttatgtttcttcctgtgtgccatgacttttatgcattgtttatccagctccaaccagggggagacccactcgaaagggtcctccagaatgaatggagacttccatgaggagtccctgtcactgagcagtgacctggtgtgtgcagagctctccccacttactgatggctggagaggcagtagtgcctgcaggtcttgcccttgccgaacagtatgatgtgcagtgtgaatcgggaccaggcctcatccaggctttaatcttttttttttttttttttttttttgagactgagc

SEQ ID NO: 59960 - DNA, 1070 bp, Homo sapiens
agcctgggtgacagagcgagaatgcatctgagaaaaaaaaaaaaaataaaagaaccgtgtatgaagcatccatgtcacagacccatccagactgtgttctgaggcacaaaagttaggacacaggaccacgtttttacaaagactcagaattcagagagagaggggaatgggagtggtagggatggggagatgaaggaggaaaaatgaattcatggaaacagaattgtgtcagaggattatatgcatttacaaggcgtttactccgtattaccaaatctgcctcaagacaggtattattttctttacaattttttctaactgttaaaatatttattacaatgtaatcggaattgtttatatagagagtctgaaacttctctttgccccatttctgtgtttcagacagcaaaggcatataaagccatgaaaaactgctatatacatggtctcttattttatttttatagatatctattgaaatcgagactcctacccagatatctttagtggatgaagcatcaggagaggtaactaaatattaaatattgatttttttaaaaaaatgtggtgctaaaatgattgtttatatttctctttgattttgcagtcagatgctccacccctcagctataccctcaatctttctctttgattttgaatgctcatttaaccataaataaaaatctagtcattgagtggggttttaggggcaaaaaaatccctttgtgattgtgtaagtccatttgggctggactcacaaaactaccgtagactgagtggcttatacaatagacacttgttgcttagggttctagagactggaaatccaagatccagtctccagcagatttcgtgtctggtgagggcccacttcctggttcttttttttttttgagacagagtctcactccgtcacccaggctggagtgcagtggtgtgatcttggctcactgcaacctccacctcctgggttcaagcgattctcctgcctcagcctctctagtagctgggattacaggcgcctgccaccacgaccagagcccagctaattattgtatttttagtagaga

SEQ ID NO: 59961 - DNA, 1054 bp, Homo sapiens
agagccctggaaaggagggaactgctgttagttctggtgtgtaaatcagtcaagcctgccatgatcacctcacacttgattcagttaagcctaagcagaagtgtccctgcctgtcaggtcccccggctcagtgagagaatcgcccccgtcattggcttaaaatgtgttctagccttggcgttcaaaaagaacaccactgactttgtggacgaagtaagagccatcatccccagagtccccagtttaagtgtaccatggcttcaagacagaattgaagattctggggaaaatttagagactgaacctctggaaagccaagacagagagcttttggacacttcatttgaagatctgtcaaaacctaagagaaagcttgctgacggtcggcaggcttctgtaacattacaaccccttaaaataaagaaactgattccaaaccctaataagataaggaaaccacccaaaagtaaaaaagctactccaaagtaatcttgcataaacttgtcatgtcatacagtttgtgaaaggacaccttgtaaagaagccttgaaactaataaaatgagttatacttacatagattcatagggtcctgtttggtaatattcaaatgtgtaagactctttgtaactatggcacagatatactaagtgcaggaaatattcaaaattaggaatagccaaacagacatttattgaaactagtgttcatgcgtgtgtaaattgactttttctttttcttttttttttttttgagacagtttcactcttgttgtccaggctggagtgcaatggtgcggtctcagctcactgcaacctcctcctcacgggttcaagcaattctcctgcctcagcttcccaagtatctgggactacaggtgcgcaccaccatgcctagctaagttttgtatttttagtagacacggggttttaccatgttggccaggatggtttccgtctcttgacctcgtgatttgcccacgtcagcctcccaaagtgctaggattacagctgcgagccaccgtgcctggcctttttttttttttttttgagaca

SEQ ID NO: 59962 - DNA, 1366 bp, Homo sapiens
ctatctctactaaaattacaaaaactagccggacatgggggtgtgcacctgtaatcccagctattcaggaggctgaggcaggagaatcgcttgaacccaggaggcggggttgcagtgagccgggatcacaccactgcactccagcctgggcaacagagtgagactctatctcgaaagtaaaataaataactgcagcattgccagttggaaactttgtcatgagcttacctcacggtgacagttacactgctcctttaaagagtcatttacataatttgttatcaaattattaaccacttttaaatagaataataactacatttgcctccataattgaagcagattactaattaacattttcgagaattaaactgcttgcttatgaagtagctattaaaactaaattgaaatgcaatggatagtttcttgtagatttaaaactgcattgtactgtactttgtctataatgaaaatgttctattcaataaggtatctttttttcttctttttggccaagatggcactaagtaaaatttaaatcgagagatggcataatccatgagtcagccagactttcagctggaaaaatctttagtaaataccttccttctaaattacagaaagtaacttttccatacacactgtaaacagcagacactctaacagagcatcggttatgctccatctcctaacctgaaggactcttgtcacacacccacctctgagaacccaagctcctcagtttttttaatcttttggccacatttcatccaattaccatcataccttttatacgttagatttccaaggaggtaagtgaatcacgtaatgggggtgaactgtacccagtcaaaataaccttatctgactttttctatatttttgatattttttctctaaatattaagtctttctcccaagctcatgtctattccttcctaaaagtcaaattgacatgaagtgaaaaatgatgtgttgcttctgaagacaatggattgcttggcatttgggatctttcctttaaaactgataatgcttccccaattcagttccatctacctgactgactagaacatttactgtggtacattttccaggtttgataggaaaatgctaagcgttgtatgacacagatattcttgctcacaggcactctaccagcctttgaaaaagtcaatttaggctggacgcggctgctcacgtctgtcatctcagcactttgggaggacaaggcaggtggatcacgaggtcagttcgagaccagcctgaccaacatggtgaaaccccatctctactaaaaatacaaaaaaatgagctgggtgtggtggtgggcacctgcaatcccagctactcaggcggctgagac

SEQ ID NO: 59963 - DNA, 1059 bp, Homo sapiens
aaataagatgctaaccgaggccacgtagcctggcctcaactcagataccacaaagtagatgccttggctgggtgtggtggctcacgcctgtaatcccagcactttgggaggccaaggcgggcgaaacatttgaggtcaggggttcgagaccagcctggccaacatggtgaaaccccatctctactaaaaattcaaaaagaactagctgggtgtggtggcgggtgcctgtaatcccagctgctaggaggctgaggcaggagaatcacttgaacccaggaggcggaagttgcagtgagccaagatcgtgccactgcactccagcctgggtgacagtgcaagactccgtctcaaaaaacaaaagtagatacttttccctgcttttactgggccagtgcctaggaagttcagtgcagaagttaattgttttagacatgatggcatttccttcaagttatgagtccagtgaaaccaatcatatcttatcccaggcaggggccaccaaactatggcctgtgggctaaatccagcccattgcttatttttgtgtagcccacaggctaagaatgtttttattttctggaatggttgaggagaaaaagccaaaaaatgacatcattttgtgacatgtgcaaattacacaaaattcaaattccggtgtccctcaataaggttttattggaacatagccatactttttttttttttttttttaggacagggtctcactctattgtccaggctagaatacagtggcacagtcaacagctcactgcagccccaaactcctgggttaaaatgatcctcctgcttcagcgtctttttgaagaaaaagaactagctgggcgtgcataccaccacgcctggctaagtttttcattttttgtagagacaaggtcttgctatgtttcccgtgctggtctttaactcctggcctcaagtgatccttctgccttggcctcccaaagtactgggattatagacatgagccaccactcttggccacagccactttcatttacatattgcctatggctgcttcacactacaaagctgagttga

SEQ ID NO: 59964 - DNA, 1290 bp, Homo sapiens
ctcagctcactgcaacctccgcctcccaggttcaagtgattctcctgcctcagcctcccgagtagctgggattacatccaccaccatgcctggctaattttttcatttttagtagagatggggtttgaccatgttggccaggctggtctcaaactcctgacctcaggtgatccgcctgccttggcctcccaaagtgccgggattacaggtgtgagctgagccttaagacagcttttagaaagacagatctattgtactacattgcaatctaatttttcttactattccatttcttccctcccttcaggttggactagtactacaatagatggatatttttatttctagaactctgacatcatcatttgttaatatttaatgatttctggaactgccattccaaagaagaataaaagcacaactcaagtgaaattgaagtagtcgataatcagaaaagatgacaaaagtccacatgtgacatttgtacgtttctagctagaatgttaaacttcatcctttttttactgttgacctatttgtgggagggatgaaaggctacaaagagcacattcttgtaattttcaaatttttgcctgtctcttgaagaggtattttttcacccttagaaaagggactgtttttctatggactaagtagaagttacagagtcatgtaagaaaatctttgctattgtgtggagagaaattgctgcatttctgtttcttaagtgatggtacatttgtccatgtaacagaacaaaagatccatttggaaattttttttactggtatcaccttacatggtatcactgggaacatttatggaatcaacacttctgtagctcagtgacaggtggtggttgtttaagtgcagagcaatattaaaatgtactggtgactagtacatgtatttctccataagcagagttgccgaatcaataaacatgcaagtttgtactttgatctttaccaggtcagtggattgcttcaaaagcagagttttgtgcaagcactcactgtgctctctgaaagagcctgaggccgggcgtggtggctcacgcctgtaatcccagcactttgggaggccaaggtgggcagatcatgaggtcaggagatcgagaccattctggccaacatagtgaaaccccatctctactaaaaatacaaaaattagccgggcgtggtggcgtgtgcctgtagtcccagctgcttgggaggctgaggcaggagaatcgcttgaacctgagaggtgaggttgcagtgagccgagatcgagccactgcactccagc

SEQ ID NO: 59965 - DNA, 1151 bp, Homo sapiens
gtctcaaaaaaaaaaaaaaaaaaaaagaaagaaagaagaaaatagaatggcctttatgttcttttttttctttttctttcttttcttttttttttttttttttttttttgagacagggccttgctctgttgtccaggctggagggcagtgatgcaatcatggctcactgcaccctctgcctctcaggctcaagtgatccttccacctcagcctcccaagtagctgggaccacatgcatgcggcaacatgactggctggtgtttgttttttgtagagatgagagtctcagtgttgcccaggctggtctggaactcctggtctcaagcaatccacctgccttggcctcccaaagtgctgagattacaggcgacagccagtgttcccagcctgcattcttattcttggatatttcctgggtatcatcttattttttaaaatgtgttgactcttcattttgaatctcgttttgactcttaatcttcaccatctttatttcttagtgtgaagaagatggtagaaatcaactttctttgtgttcataagaagttgagatcgaaacgggtagccccagtgctaatccgagagatcactagaagagtgaacctggaagggatcttccaggctgtgtacaccgcgggagtggttcttcctaagcccatagccacatgcaggtaccagtaccatatttctacctcaggtcctccctttatcaaaaatgttgagcctcaccactgttctgctagatgtagtttttgctggtagcagagatggagactagaacctagaatcaccaagtccagtattctttctggtatatcatttgccacttggtgattaaaaaaaagtttttgacattttcctactaatgatgctggatctatacttttttttttttttttttttttgaggcagactcttactctgttgcccaggctggaatgcagtggcgtgatattggctcaccgcaaactcgcctcctgggttcaagtgattctcctgcctcagcttcccgagtagctgggattacaggcatgtgccaccacacacagctaatttttgtatttttagtagagacagggtttcaccatgttggtcaggctggtcttgaactcctgacctcgtgtggatctatacttctaagtctattccat

SEQ ID NO: 59966 - DNA, 1017 bp, Homo sapiens
ctccagccttggcgacagagtgagaccccgtctcaaaagaaaaaagaaaagaaaaataattggtgaaacagcaatgatttcacaccactgcctagctttcctgtttcagtccagaggcgcttgatataacagcatctttttaaagattatctgaaacccgagggccctaagtcagattttgcttatgtcactgaccactttggatggttagaatactttgtcatttaatattctcgctttttgcctttcttttttctctttctctccctgttcagatgaagtcataacatctcatggtgcaattgaaccagataaagacaacgtacgccaagaaccgtattctttgccacagggttttatgtgggacactttagacttgagtgatgccgaagtggtgagtgagtaaaaacctcttaaattcaactcctgcattcacacattgcttctaagttgattctgagcaccatggataggacacttgttttatcttatagctcaaggagttatacacgttgttaaatgagaattacgtagaagatgatgacaatatgttccgatttgactattcacccgagttcctgttgtggtaagtctcatcgatcacagatgtcgtggataggcgctgctgacttggggactcctgcgtctgttcctgtgttcttggacaataactggtgcctgttttcttgtctaccgtgacctcagggctctgcgtccaccaggctggctcctgcagtggcactgtggggtcagagtgtcttcaaataaaaaactggtcgggttcataagtgccatcccagcaaacattcggatttatgacaggtacatgtttaagctcgtccatgcggtttttatatgtttattttctaagaattacaattagattaggcctttaaaagttactgaatgcaggccaagcgcagtggctcacacctctaatcccagcactttgggaggctgaggcagatagatcacctgagctcaggagtttaagaccagcctggtcaacatgggtga

SEQ ID NO: 59967 - DNA, 1046 bp, Homo sapiens
agggtctcactctatcacccaggctggagtgcagtggcatgatcatagctcactgcagcctccacctcctgggctcaagtgatccatcctcccatgtcagcctcccatgtatctgggaccacaagtgcacaccaccacacctggctaatttttgtatttttttgtaaagacgctgtttcagtatgttgcttgggctggtctcgaactcctgggctcaagtgatccacctgccttggcctcccaaagtgctgggttacaggtgtgagccaccgcacctagcccattagagtattaaaaatgtatataaggttctgtgatggaaggaccaggccctgaaggtccctcatggagcaggtgtctgttgagtgtctgttattaaatgccaggcatagtccagggcacacacctggaaacagtggtggaaaagtaggacaaaaggtggccaggctggggaggagcggccacactgaggtagagaaaggctttagttaagcaacagatgctgggagaaagtgacgtgtgatgcgtaagcttctgtcgggaattccaaggggcccgtcccttgaggaccagagggcctcaagcctaaggaaggcaccaggaaggccctgagctgaggcctgccccggtcatcatggccagagcactgggagcagggggcagggagggtgtggagaggggccgaggcaggcagcagccatggggaagagcctgggttttagtcctaccatgttgggaagctctgcagagaaggacttggaaaactcttcttggtggaaatcactagaaattgtgatggcctgaactacgctgctagcagtttagatggggagaagtaaccagccttgaaattatttttaggttttgctgggaggggcagaggtcaccgcagccctttcctctcccagtttgtggaaatgcagtaaaaagaacacacctcccaaggctgttgaatgaaacctacattgcttatgacagtgtgtaagataaggctgcattgtaggccttgagactcggaatcactgttgttttgtaatgtcatcttt

SEQ ID NO: 59968 - DNA, 1041 bp, Homo sapiens
ctccctctccctctctgtctctcccccctaccttccttccttccttcctccctcgctccctccctccttttttcttttcttttctttctctctgtctctctccctttctctttctctctccttctctctctctccctcctttcccttcccttcccttccctttcccttcccttcccttcctttccctttccctttccctttcctgacagagtcttgctcttgtcacccaggctggagtgcaatggcgcgatctcagctcactgcaacctccacctcccaggttcaagcgattctccctcctcagcctcccgagtagctgggattacctgccatcatgcctggctaatttttgtattgttgtaaagacaaggtttcaccgtgttggccaggctggtctcttaactcctgacctcacgtgatctgcccacctcggcctcccaaagtgctgggattataggcgtgagacaccactgccgatcctctctctttctttctctctctctttctctttctttgttttctctctctctcttctttccctcccctccccttcccttcccttctctgctgtgtttccattctagaagttctttccttcatcccctcgttgctcctgcagagcatttactctgacagtgccccccacccaaggctcgtggctgcctggctgttggatgacagtaatgcatgcactgcacgtctcccccagaggagtaatgccggggaccatttgtagatggatgggaaactgaagcaaagcgtgcttcaatttagattccccaaactgccagagccccaataaaactagacaactgttgttacctttaacagagggtttgcttctattttcatgtgtaacacacaagcccatggccttgactgggcttggaggaggattgttagtgtttaggtattgtagtctctgaggcagatgcacgtgcgtctgctcaagtttaacatcagcagccgctctctcatattctgtgtctgtctttgctgtcgtagaatcccagtgttccaatgcagaagttgcaggatatc

SEQ ID NO: 59969 - DNA, 1060 bp, Homo sapiens
aaagtgctgggattacaggcgtgagccactgcacctggcctggctttttctttttgattataattatcctcatgggtatcaagcggtgcactggtcagctcttattctcaaagtctcgtttccttcatggcctcaggaaatggaaaagtagctcttcctcactgaagggctgggaagctctgcctctcatcattgtataaatgctatcagatatgtctgggagtttggaggctgggatgaccaacttagtgcccatttctgtagctccctgtcaatttaaagttgagatgaaagagagaaaaagaaaaactcttgctgaactagagtaaacaaaaatggtgacgctttctccattatgccaaaataagaatataaattttagcaacaccgtttggaagaaaaaaaagttttgatgtgtagcatcaattaactcccaaaatggagttttggaaacctcattgaacaggcattgtaagttatagaataagtgatataaacttacttaaggattttttggtgaaatagtctggtattttaattttttaaaatgtctccagatcccctcaagtttccatgagtttatctgttttagagactattattattgttgttgtgttgttgttgtagttgtttttgagacagggtctcactctgttgcccaggctggagtgcagtggcatgatcatggctcactgcagcctcccaggctcaagtgatcctcccaccttagcctcccaagtagctggcaccacaggtgcacaccaccatgcccagctaattttttactttttatggggacagggtctcactatattgctcaggctggtctcaagagatccttctaggctcaagcgatcttcccgccttggacccccaaagtgctgggattataggcgtgagccaccatgcctggctgagcaaattactaactgacactcaggacaaatatattttcatccagttggataggcatctacttcaaagcgtccttcccagtcactgccttttattctgtatctctctgtaaccaagcttcttggaaatttggagatattttaaa

SEQ ID NO: 59970 - DNA, 1153 bp, Homo sapiens
agcaatcctccctctttggcctcccaaagtgctgggattacaggcgtgagccgctgcacccagcccgatgtcactcttaagattgatgtgttagttgtatgagactgggctgctgtaatcaacagaccctaacatgggattgaacaacacagtggaagttcccttctcattcatggaccagccctaggcacatgttctgacgatggtgagggagttctccttcattctgtcatccagggtcgagactgcgccatcgtgtggctctgccatccttggggctctcacctatgtctgcatccagacagcacaaaggacaggaaggacatggagaagccacccataggggtttctgggcagcaggaagtgacacacatcacttccgctggctggaactcagtcagtggccacacctggctacaaggcagctggcaagtgctgtccagctgtgagtccagagagagaaacgatgggttttgtggatgtcatcctggaccacctgtaaagcgtttacatggctctgttacattggccctcccattaagtcttgtctgtagtttccatgaatacttctttgaagagatttgctggatgtgctcattaaatttttgccatttccatggctgagaaggaatgtgttcgtttctacttgaggtctgaatgtgccactgattctctctggatggaagctgaagtgtgcgggctttcagaggtggcaaaactgagagccttttctttgtggacctttcaagtgaaaccctggggaagagggaggtgggacttgagttcttgaagaccgaggaatctttttaaagggccacatgatatgcagggctgaatttccatgacttggtaatcagccttgagtactgggagtctgaattagtctttcttcattggatttccagggagagtcttctcttgggcctggatttgccttcagtatctggaagcccgcttagcacctctcccacccaggcacgggggcatctctttctgtcatgcgtctccctccagagtacctggagtcctgtgggacgcagacccctggctaagcagccacagctgactcctgatctgctctggccataacatcatcctgtcacccccagggacaggagtgtcacctgtcaacacttctgtttcatttgatata

SEQ ID NO: 59971 - DNA, 1766 bp, Homo sapiens
aaaaaaaaaaaaggaggaagctaatgagatagaatatacattcccacatttcaaatatggtacaggtttaggagaaccaaaaacttggagcaacccaatatgtaagaagagggactagttagtaaactagaccagaagctagcgaagagggactagttaacaaactggactagaagctagcaagggggatcatcaagattcctctcttccagccacgcttgtattgattcccgggcgtattgttcagccattgtctagagctaggcatcctctgctgctaacagccgtgtaaatatttaaattattggctagtctcagtcacctttgtccaaagctgtagcctcaatagctgtagccacctgcctgcttgatggatctttgatgatgatctttgtccctcactggccatacacttttgggacggctctgagctctgagccttctagggcttgtccatgacttactgctttgcacagagacgatgttgctttgtagatacttcctacaccaatcccaagaggagaaggggcacactaagtatgggttgaagctaccagacccatgatggagctgaaatcctactttagatgaggccgtagtgcagccagatgatgacagctagaagggtgtcttcctgctctggactctgcattacacttgggaaaaaaagagtgaagaaactcatactggaattacacaaatgaaccactgacaaaaactcatttgtgtgacttcttcaaaccctgaactgcaggtgaaatccattatcgaatttgatggtcacatgatcaacttaggtaagatgggtgcccctgatccaggatgaggaccaactttggccagtacaccctgataacctgagttaaccttagctaacttccccaacggtgggtgtgaattctcttccagcagcaggtagtgtgatgaacctctgggttacctttgttttttatcaactgtaccaaaacctcatatttttttcctagtagtgttattccttctagtgaagtgttttgggattccaaccagaacaccagggcatgtgcacacacgtagcacaaagatctattacaattccataaaataggtgaataaaaaatgtccaaagatcgcaattaggcagtttacaaaagacctaaaaattgctggtaattatctgaaaagatggtcaacccaaggaagtacataaatgagagacaacgtagggtagtaattatgtggattttggagccaggctgtctggattcaagtcctgattctgccattattaaccatgtgaccttcagcaaattacttaagctctctctatttcagtttcctcatctataaaacgggaataataataataataatagcacttacctccgagtgtgacagtttacaaagttgatatctgtagggtgcttggtacagtgcctgacacatagtaagtgttgcgaagtgttgcctgctgtggtgatgattatgatggtgatggtgatgatggtggtgatgatggtggtgatgatgttggtgatgatggtggtgatggtggtgatgatggtgatgatggtggtgataatgatggtggtgatgatggtgatgatgatggtggtgatgatggtgatgatgatggtgatgatggcggtggtgatgatggtgatggtgatgatggtggcagtgatggtggtgatggcaatggtagtggcaatggtggtgatgatggtgatgataatggtgatgatggtggtgatgatgatgtgatggtggtgatgatggtgatggtg

SEQ ID NO: 59972 - DNA, 1030 bp, Homo sapiens
ctcctgcctcagcctcccaagtaggcaggattatagacgcacactaccatgcctagctaatttttgtatttttagtagagacggggtttcaccacgttggccggctggtctcgaactcctgacctcaaggaatctccccacctcagcctcccaaagtgctgggattacaggtgtgagccactgcacctggcacctttcctttactatctaaacaaaatggcctgagctgatacatgttcatgggggtttcttggggtcttaagttttcatggtcctcaggcacacccacactgcagccaacttgccccatcaccgggctccttgtgcctgtgtgtccttagggtgctctttttcttcaacatttgaccttgggtggaacacggttatcttcagttctgtgtctctcaccaccctcctcccaggaatcactaaaatccagctattgtgcacagcatttgctgaagcgtttgtggctaatggggagggagggaggtctgattacagagtagcgcagaaaacaactttgaattcagtgtcagacatcattgttcaccaagaggaatttgttactgctcacgcctttctgtgggtcatggcttcctctgcttctgagagtgtctcctgatctttcttctcctcttctctaagttcaaggtcagcccaaatgtcctttctttcatgaagccttccgcagccactatgaccaaaggcgctgacccctgccggaagccctgtagctcttagtgagtgtatctttcccgtgacatctttcccagttgctctcacctcatctccccagccctctgctcgggaagaccctcattctcctgccccaagctgtggctcctagaggtgagttccttgtccacaatcacaaatgggagatgtgggtctttgcgtctgttgcttaatgtgtgtgtagcatctaccaaccagctagagtaaaaggttttattttgctgggcgcagtggctcacgcctgtaatcccagcactttgggaggccgaggcgggtggatcacctgaggtca

SEQ ID NO: 59973 - DNA, 1167 bp, Homo sapiens
agacatgaaatagggttaagaccttttttttttttttttttttttttgagaccaattctcgctctgtcccccaggctgaagtgcagtggcgcgatctcggctcactgcaagctctgcctcccaggttcacgccattctcttgcctcagcttccggagtagctgggactacagtaggcgcccgccaccacgcctggctaatttttttgtatttttagtagagacggggtttcaccatgttagccaggatggtctccatctcctgaccttgtgatccgcccgcctcggcctcccaaagtgctgggattacaggcgtgagccaccgtccccggcctaagacgtttttaagagttctttttcttagaaagattgaagatctggtattggacaaagatgaaaactttggaattcttttaacaaagaacataatctgtcttctaccatccccaatttagggggtaaaaaaaggaagttcttctttgggcactatgttgttgtatctgacttcatatgtctgttgttgaaattgagttgggaacttcccctttgtcagctgtgtggtatcagtgggaaaatgcagaaacattatgacttgcaataagtttttcttatggaaaatttagggataactcaaagctgccctttctgaaatttgatctgttatcaactgtataaatctaaatggaaaaatagattaacgacagtctttgcctgagggacctcctcaaatcaagaactactgtttgaaatgatcaagtgtctgctaagacttgcatctgaatgggtgatgtcaccctttggcccagaacaaattttttccagggttgtctaaatataggacacatactttgccatctttgtttgttagtgcaaatgtacgttatacatctatactagttaaaatcactttattttaacagaaccaagttctactccaagttcaagaaattgattgttgttttctttgaaaacatgttaatgacgttttaaaaatacgcttattcaaaaatcaaacaatagggccaggtgtggtggctcatgcctgtcatcccagtgctttgggaagccaaggtggaggatcgcttgaggccaagaattcaagatcaacctggggaacatagcaagaccctatctcgatgaaataaaaaatgagctagacatggtggtgc

SEQ ID NO: 59974 - DNA, 1098 bp, Homo sapiens
tggtttactcagttcgtagagagattcttgaaatgattgatcattgaaagtgtaaatcatttgcattctacttgtctactttaagatttattatagaaagggacttttgactgacctctaattcattataaaatattaacaaatgaagaaaaagaaaagctgactatgtgcatctcccatttgcaagttgtttttatctttgccgtgaatacttcagtggcggctgcaagtatcgaatgttcgagtctagaatatttttttttttaaagagaggaaaggaaattgcataggaatctgaacctgagccctgtttatgcagggatagaaacgtgtttgtgatagatagctaaatacaaatatgtttttgaaacggtagttctattgccagaaatgggcccaggtgcagatgcaagctgatggattagcttcagtacctgtgttttctttctggagagaccctggacttttatcttctctgctgtaatttctgtttattgttcctcctttgattgatattctaggttgggggcttgattaggacttctttgcttacactgttgagaatgcccctggtacaaagaattcctcatctgtgtgcgcattgatctgagcctgtcccccgacacctttcaagaagctaaagttcccagagtagcacccagaggcatctgtgctgccttcggaagttttcagttttgtatatcagcacattttatatattagaaaggttaatcaaaatttagagatgccccatggactgaaatgttttcaccaagagcagataccatgttaatagcttctagtgggaaaagattaacataatggatgtattgtactctatttaaatgtaaggagattaggaaaactccaaatgactgctctccttggattgcctgtttggatttgaatttagacaatgtgtgccaaatttgggggagtaaatgtgttttatttggctcatgtactgatgatatcgcagtagaaacctaggttttctttaagtagctcaagtttgtaaatgttaaaatttgaaagactctttttctatactcggcctcttcattcccatcagtttaaataaataacaaataatgagcc

SEQ ID NO: 59975 - DNA, 1046 bp, Homo sapiens
gcggggaggggcggggccatctgggaggggctgcggcggtgggcggggttagagggcgggtttgaagccggcagggtggggaaaggcggggctggaggggaggggtctcagaggcgggcggggttagagagctggattgaagccggcgggacggggagaggcggggcttggtggggagggacgaagaggtgggcggggttcaagcccgtggggcagggcggggccggcgggcagggcggggccggcgggctgggcgcggacggtgaggggcggggatggagggcggggcgggacggagggcggggagggggcgggacggagggcgggacggggcgcgggcggggcggggcggggcgtagcgcccgggctccgactccaagcagtacggcgggaggcactagagggagctgcggccgctccggcccggccccgagcaccgcctccccagccagcgccgccgcgatggcggaggacagcgagtctgcggccagccagcagagcctggaactggacgaccaggacacgtgcgggatagacggggacaatgaggaggagacggagcacgccaaagggtaggggcggcgcgctggcgcaccgggcgcgacagggcggggaccgcgcgcgccacggtctcccgttcgggggtggctcccaggactgggggttcttcggccgctccgccccgcgatggcttctccgtggcgcggagcccatggtgaggtccggggcgcgcggctcgcgggagagtgcagtgcgcggggaggcgaggcccggggtgggcggggaggctggggcccgggcggggagacgctactgtcacttgccgcgcgcccccggccagcctcgcccatccccgccggcggcctggcccaggaggcgcctgttgccctcgcccgcgggtggctccggtgggcgccgaggagaggcgctacgcccttccctttgtggcggccgcagcctggggtaggaggtcgccctcctctgctccctgccatccttgttaagtcccttcagactccctctccgcagccgccacccgaaaagaa

SEQ ID NO: 59976 - DNA, 1024 bp, Homo sapiens
aagaggaagacgatgatgatgatgaccaaggagaagacaagaaaagcccctggcagaaacgggaggagaggcccctgatggcgtttaacattaaatgagctatcgcagacccacctgactgtggaatataaaattgccaaatatcctttctcatggaagcgcgtacccgttcgtggaggaaacggaacggcagcccagccgtgggacggacgtggacgtttactgcattcctgtttgccgtgtaaatgttagaaaggaattaaagttattactcggaataaaggatgactttggcggatgtcgcccctgcaaggaggtggctgaaagtggtgtccagatgtccttccgaggactcggcgtatccgccaccagggacattaagaaaccgcacgtgatgtcgctatgctctaacgatcacctcagttctccctcggattctgggaacagatgaaactttttgcatcgcttgagtcatttttatcacaataatcctactgtgaagctgtcgttgagaacttaggttggcacgtagcgtctcaaggtatgcgttctctcaaaggaaagctatgcatcgctgcttcgttgtctgattttgcttagattttgctttggttaggttgcgttttggggtttgcctttttttgttgtcgcttaaatgcaatttggttgtaaagatttgattcctttgtgttcatctgttccgcttctcagcggtccatctcagcgtctcccttcaggaaccgctgagtgtcctctcttaacatccaagccttttaatgaaatcgtactgaaatctgtatcagctaagagtcctccaatcctggtcccattaactccaagtgcctttttgacagtgacaacagacagtccctcgctttttgttgttgttggttttcttaacccctttaatggaactgcctggattttatacagttattaaaggatgtctcttttgctttaaactgcatgctgccaagtgccatttggggtcagcatcctcgtttcaacacagtgtgctctctag

SEQ ID NO: 59977 - DNA, 1066 bp, Homo sapiens
cttacaaaggagcgtggtgtgcttgtagctaacatctctttctcaattccacaggaacgtggctgaagagcggtctgggtcttgtgcaccaggaaggcagccagctgacgtggacatacattgccccccagttggggtactgggtggccgccatgtcccctcccatcccaggtaacacggagccaacacttgcgatgatgcggatcagttgctttggtctttgagggttcaggctaagtatgctcttgaaaataacttcagcagggcgatcacatcttattcaaaaatggttaaaagtctgaaaatgagatgatgtaaagaaggtattttgcgggggtgggggacttctggttggaaatcttccatctagggtaagaataatgcatagaaaatagtcttgagtggctgttttgttcagacagctgccatagggaattcttcatcaaaagcccacagagaccagcaagacctcctccctaattcctgaaacagctgtggcctggtataggcacacatgtagggaaaagcactccacagagatgctagtgggaagtcaccactgggggcaaaaagcctggtggggcatttccaaaatggcttaaacgtaaaccagttgctttgtatctacgagaatcttcccctccatttaggatatgtgcattaatgcatatctttcagaacgtgaccaatagtttattttttttaacctatgttacccccaaaaatattctagaattgttgagttttgttttgttttgttttgttttcaaaatggtcatctcaggagaattatttccagtgatagcttctgttgctcaagctgcctttagaatctatattacttggactgccttctgccttcattagtaaatctctttcttggtggcaaatctttatgctcaaatggcaaatctttatgatttttctttttaaagacatctaaaagtcatgcacattcaagactggtgaataaagtaggtgacttagctaggtcgaaatgtgctgtgattaaaaggtgtctcttgtaaatgaaccatgaaggcagttctaaaatgcaagttcaaat

SEQ ID NO: 59978 - DNA, 1031 bp, Homo sapiens
aagaaaatgacagttcagacaaaaactgacctgagagtgtggtgtggaagaaaacaatactgaacttggatttcaaatatcactgttccggccgggtgcagtggctcacacctataatccctacactttgggaggccaagggggatggatcacttgaggtaaggagttcgagaccagcctggccaacatggtgaaactccatttccattaaaaatacaaaaaattagctggttgtggtggcaggtgcctgtaatcccagctactcaggaggctgaggcaggagaatcacttgaacccaggaggcagaggttgcagtgagctgagattgcaccactgcactccagcctgggcaaaagaatgagactctgtctaaaaagaaatatatgtatcactgttccgtatctgattttgtcctcctgtccctcacactgcctgtgtatcttatttcagacagaactgtaataaggttgtgtgtttcccaatagcatacagctccaggtgggaagctggggggtggttgtggtgggggagcagagttgataacagaacactgataacacgttataaggaagaaagaaaagggaaataaacatgagggtaggggggagtattcagcgcaagagcaaacaacttataatccccacctctgtattcttaaggacattcatatgtcagaacctagcattgtagttgatcataattatgaccctgagggatgaagaaaagtcaaaattgtattcacattcacagagcaggaggaaatgatgctttttagaatttttataaatggccttttcaagttttggcaaagagtcaggttacgtagaagagtagctcccagatggttcaggaggtgtcctggggatggctgtggtggggattggggggacgtctctttgccctcatgcagggaagcttaccttttatctgtttcatgtattagtttctgcctaagaatccattaaagagggggttcaaatgctttaaaaactatgtaacaatcaatgatgtagaaatttcagtaacgcaga

SEQ ID NO: 59979 - DNA, 1052 bp, Homo sapiens
tatgtgggatatctgcaccttcctttcagttttgccgcgaacctaaatctgctctttaaaaaatagtcttcagtgaaatcattattacaatattagcttatctttgtctctatatatcacaagccacatgactaggtgaagtaacccagattggaatactgaggtgggtgattggattatagggataaacagtactacactgtgcccccaaacattagaatgaaagaagggagttcatttctttaccaagtctgtgcgtagatgtgtgacgtgattttagaaccttgggcatcatcttttattttttgaaaaagaatagatgccgtagttcagggcattcagcaaaggaggaattcaacttacctaaggtaatatcaacatatccctaagaaagctgttattggaaataggcctttttacagtggaaatattcagagtcaaggctatggcttagaaataaagaaataactctcaggaaaagtgtctgtactttcccagatgtcaaaatcactcttaggggtgaatggggctttaatgagaccggtaggggaaaagggggtaatgtacctgcaaaaaaaaaaagcgattgaagtgatcacagatagcaaagaacccggagagcatgggacttgtttgggtgtgatgacagttcagtgaaaactttgtctcaccaaagatcttggcagccaggcggtcagttgtgacttttcatggagatgccagttggtgtctgttgccactgtggactcagcatcgcagtggctctgtaccactcctgttctccaatggagtgcaggaaggccgggtagcactggtcctgcccatgggagaacaaccaagctgtgatctcagaacatcgacatttgtttttcagtgttgcctagcaactcaaaaaacaatcttgtattatcaatccattcctaggaatcattaagccttttgtgtttgtctccccccaaaatgagaactttcataaaataatagcatcacatttgttctagtatgatcgggttcagggggcacttttgtttaaaaaccccattcttagggac

SEQ ID NO: 59980 - DNA, 1016 bp, Homo sapiens
caaagagctgggattataggcgtgagccaacgcgcccggccgaaatggtctttttaacttcacatttactatgaaaaatgtaactgccaaattcctggttgtaacagattgcatgtatgcagaaaaaagccaacgtttgtggatagtcattcaaaaataaccaaatgaattaaaatgttttctgaaaactttaagatggacatttcaaagaaaccatatgttttttcacttattatactcaatagaagcctgcatatttcataagacttttgttgctattacattaattgtaatattatctaagtagaaattaaaatattttagttaaataaaaaatctaaagacggtattagatcaggaaaaaaatggggaatgggccaacacatcttaagcacataaaacaatttaataattagctgctatttatgattacagtaatcgatcatctcaaatagtttaatactttaaattatctatttttgaggtaaatcaaaataactgccaattccaaattgtttaacagccagaaatggcacagatagcaacttgtgaatctattaataatttttcatctaaattgggtttggccaactgtggcctgaaagctaagaatcatttttacatttttaaatgattaaagaaaaaaatcaaatgggggaatgttgatcaaggggtacaaagttttagttcttcaggatgattaagctccagagacttaatgcaaagcctgctaactgttgttaataggactgtactgtatacttaaaatttactaagagggtggattcaaagtgttctcaccaccaagagaaagaagatgaaaaaacaatggtaactgtaaagtgatggatatgttaattagcttgatgtatatatcaaaacatcaggtcagacatcttaagtacataaaatttttgtttttcaactgtacgtcaataaatatgggggaaatgaatcaaaaggagaatatctcatgggtcgaaaattacatgaaatttatacgtaagcatccctaa

SEQ ID NO: 59981 - DNA, 1007 bp, Homo sapiens
gggccctggtggctggtttcacagggaaagcaggccgtcagggaagcacgccttcccgagtggtcttcctcctgccgcctttccgaagaggacatggcagtgtcctcctgcagcttctctgccccaccatgaaccccttcacattctcattggagcccatttgttatcacctcctctcacacctccctggatttatgctgagcctttcatctcttctagttctttctcagctctcaaaatcactgaaggctttgccattcaaagcaaaactcttcttaagccctatttctccttcaagtcacaatcttctcccgaaccttggagatacctccccttgccaggcacatgtctttaaactcccttttgtgctgcctcacacgattccttagaaatccctcttgctgagctcagcagagctacagttacgtgacctagtggccacttcttcctaacttccccgcagcttcaccaccctacccggttctgccttcctggatgtcttcatcctttctctggccctctctctgttcattgcttctcaatctccttcatgggttcttcctgctctgcctatctcttatttcaaaaatagctttccactccagctgccttttctgtgaggacccccagagctgctgtctttatttggaactttatcatttctcacttgaataatttcatagcagcctcctgcctgatcgctctgacatcagactctgcacccatggccatactccacctgctgtcagaattgggcaaaaacaaatcggaatctttcacttccctaccggtaactcccacacgctctcccctgcaggcccacacaaatccaaactcattgattgattgattcattggcagggtcttactctgttgcatggactggagtgcagtagtgcaatcataactcaccgtagcctcagactcccaggctcaaatgattctcttgcctgtgtctctggagtagctcagacttcaggcatgcgccaccacacccatctaatttt

SEQ ID NO: 59982 - DNA, 1028 bp, Homo sapiens
acatggactgagcaaatactgaaccactgctacaagggaaacgcagggctgagttcctgcaagcctctggtcacaacattttcatgaaccgatcaatagtacgtgcctttgttttgtgttgtctttgtttaaagaaatcttatttgatatatagattgttgattcattaacattgaactgacagcccatagcaccataactcatgcccgaacaaagctgatcgaacacacatgttttctccataaggcacagtcacaacctcctcctgcttaggaacattagacagcactacactaggggtcatttgaaacggtagaatcatgcctgtaatcccagcgactctggaggctgaggcaagaggagctggaacccaggatgtggaggctgcagtgagctgggatggagccactgcactccagccgggatgacacagcgagactccatctctaaaaataaataagtaaatagcaaaatcaccaacagaatgcttaaagacatgaaaagcttggccctgaatacatctaggggttacaaataagctttagcaagtagggaggtttacaaatacagaattggtgaataatgagcagctactacactttgatcacattcattttgactctgttaacatggtcatttgagaaaaaccattcccatcatatctgtttttttatttttttatttttggagacagtctcattctgtggccaaggctagaatgcagtggcgtgatcttggctcactgcaatctccacctcccaggttcaagcaattctcctgcttcagcctcctgagtagctgggattacaggagcacaccaccacacctggttaattttgtatttttaatggagatggggttttgccatgttggccaggctggtcttgagctcctgacctcaggtgatccacttgcctcggcctcccaaagttctgggattacaggcgtgagccactgtgcccggctgatatctgtactattacaaatgagtcaagtcataggaataatgaagtttaattgagttttgg

SEQ ID NO: 59983 - DNA, 1041 bp, Homo sapiens
cgccactgccctccagcctgggcgatagagccagactgtctctcaaaaacagaaacatccttaaagagatagctcagaacagacagcacagtcagtatcttgcccacaatatgtgcagaagtacttaagagacccatggagaattgtcttgccaatggcttctgctgttcctccagctctccatgtccttgggaattttccacagtgggtatgagagagagaaaaaaggaatcttccaagaaccatagccaggcatggtcagctccttccgtgaactttctcaggaggtcttttgtaaactttctgtagacgcttcgtgatcctcattcaagagtcaaatgttgggaaacaatcggctaattataaaaatggctagcagtgattaagctctcactgtgcacagctgcagtgtgtgggaagcactgtacccttgagatctcactagagctccatgagattattatgggcagggccactaccccatttcttacagatgagaaaactctgcttcagagcagtaagccagaaagggcaaagatgaccatcaactctaggttgtcagtccaaagcccggcactctgaatagcatactatctttttctagttttttttttgtttattttttttggggggtgggagggggttcttaactgagaagcttttagggggaaagggtgctttggagattttgtttcaccaaataaagttagtggaatgcttgcaggtggggaaagatcaggaatacttttgttgctagcaggcacctcacaaagtcaccaggcagtccacccaccaatcttacagtgttttcaagaagttggtatccatattttctggacacagaaatgacaggtcaaggaggctgtgaacttggccaagaccacgtgactggttaagtgaggagcctagaaaccagccccagaccatgtggtcgtgaaatgtgcattctgtgcccactcctcaggaggaatatttgtaatgtaaatgctaaagtgccctaaaatatttcagcttcatctgaaacagaaaagaaaactttaa

SEQ ID NO: 59984 - DNA, 1039 bp, Homo sapiens
aagcacatgtctttccccaccctaattcccatgctctcagctgggcatcagctagtccctgagaacaaagtctgtgaaagaaaaagcatagattttgcaatggccatcctgaagtctcttcaattttcaagaatgaatgaatctctgatggcttacctatgcgcactgtggcaggatgcaggtgagatactccattttgagggcaagcccttctctagcaatgataagcagagccatataggtagctgcctctcttttctaaggctgatgctgtttgagaattcagctgtaactttaccctcttaccacctattctgtctgctcctttgtggctgaaaataatatttcgtgaacaggaagacctgaagaaagtagtagtgtggcatttgggctggggcttcccagctgtgaacttaaacccattggctgggtaatggaatcagtttaatggctctagatccacattaaaaggaaattgaatggaaagtaacatataatataatataatataatataatataatataatataatatatattaatacagctcatgaaatattcctttcagtaagtataaatatgtgtagtaagatgtctagtgagatgtatgtattttttgtggtctgcagcttaaaaagtttgaaaatctctgatgtaaacaggacatgaaagccttctatatttatttataccttgcctggcatgttgaacccttgctctaactattaaatgaatatgaagtcagtatccacaatttgagtctcaaatactagtgtgcaagatggttaatttctaagtttatcttaatatcttgcaagaagtaccattagagtgtgataacttttagaataatgactccatgcaatggattaatttttaaatagctacttcaataaaaggcttaggattttttaaaaatatataaactctgtaagaatgtagcagattttaaaaatccacaacccatgtcacaaattattctcccaccccaaactttgtatagatttctagagaggaaggttttctcaacttacttgag

SEQ ID NO: 59985 - DNA, 1919 bp, Homo sapiens
gccatcctaaggattaaatgaattaaacacaaatgaccctgccttcatttgtttcatcataacttcccggccttactcagactcattaaaatgccatatcctttgtacagtatactatacaagaatgatagccacaggcccacaaaagtatctcacagggccaatactagacgtcaggtaggaggtctgtgaggcagcctgacccaggtgtttccgggagagatggctatgtcagcgcagatgcagctttcataaaccttaaaacatagcttaccctcacaagaatagctttaactccttttgtgaaaggcacacctggtaactgacccagaccgaagaggcaaactgaaaggagagaagttgcccctgaggaaggtggttgactagaaccacctgaaatccccaaacacaacactttgcatgttgtgtagtaaggtagatttaacttggcctttatagtttgagatagcaaggaaaataaaacttttctgaagactattttcatttttaaacccattaaactgcagtctgccttcttctgccttcttcttccttctttctagtcacacataacaccacctgtcaccagccttggtacacctgcattgtaagggctggtatgcactttaggctgctgctggaccaatacagtatatatcagtcactgtcattcatgacgcattagctctttgagaattaatgtagctctttaaccttcaaattacattgtctatgaattttaagctgctatctcatttagtttttaaaagtaagctttttaagagatgttttctattatctgatgtaccactgccttttgaccctgtattttaagcccaaggagaaaaagaaaaacattttgttagttaaatgcctcatttgttaaattcaggcatacctatgaagcaaagagaatttgcctttgggaagttacaagcttgagtttataaaccttggtttttaaattactttacctaataaggaacaatattccaaagtcatcacaatttaaattttaaatagtaacagattactctagtttaaaaataaccaagtttggcaaattagatgtcattcctgtgtatttgtcattaaggttctaaaaagaacagctcttagtgtttttggcagccgaatgtgttgtagtaccagtaatttaatcatgaaagaaaagcagcttttttttttcctctggtatccactgtttttcttctttctccccgtagtataaatctcatgaagaataaattagatccagaaggattaggaatcatattattgggcccatttcttcaagaattttttcctgatcaggtaacatagttgaggaaatatattcattgttattctgttgggatgattacctgtgattgtttgcagcattttctctttctgtacaatgtcctaatgcgcagatatgagactgagaaaacaccgttacatggaaaccttcccagacagagggaatgtgtgttcgaatacggtaacgcagtgccttgatggggagggcagcagaagatgacgcagacaccagtctatacacataatgatacggagagaacagttcggaagtttgaggagtaaaaagagaaagattctctttctccactcccacccccacttttcttctctcaggaagctgttaaatactgtgagaagaggtcaaggtggctgtgggtagtagaagcccctagctagtgaagctaagctcctggagaattaaaacctaagtgggtctgggccgtttcccattgggacatgtcttccactgggctttgataggagctcagttacctggaatagcagaggcatctgggccaacctgaatgtttttgagttgtatctgcatcattggcaagccagttctatatccaatacccatctttctgtctttgttctctaagtgaagcattttacca

SEQ ID NO: 59986 - DNA, 1036 bp, Homo sapiens
ttgaagtaacgcttcagttacatttctactacctttcccccaaaaagatttaacccagaaaaaagtaacctgatactcccttttcttctgtttagatcatagttttaaataatacttagaaattaccagcagtatcttaaaactcatttcagaacttttcctcattcattggtgaccgcaaaaaaaggttgagaatgtaacagatggcgaatagaaagaataactgtatcctgattttgtgcccctgtaagttcccctctgcataaaatttgaatctgtaaccatgtaccttctcagccagaatttcaaaggttatggtgttcatctataaatttcaacagtctaacggagacaattgaaaaagaaaaatgtgttagaaatagttaagggagctaaagcttatactagaataaatgtagaaatctgcaactaaggtttgggagtgataaagggaactgaggaataataataacccacatgtcagcaattgctccctaaatctgagagccaacactgcagtcctagctttggcataagagttaattatagagctaaggctgtattggtaatgtatcagaaaaaggaaagagggttttaagaaatactgttcaggttaaataaacctttctttgacccagccatcccactctggtgacctgctgtgcaaatataactgcacgtttatgatgttacatgttcaggtttatttgattcagcattttttgtaatagcagaagactagatacaattcaagggtccagcaataaaggactagatcataaaatcaaaaaggcattgaaagttaagccaaatgaaaacatgtcacttgggcgtatacattatcagcaaaataatgttggaaatgcagtgaagggtgagcctaagaagtttctagcaagggatggtaaatgagagacaactgtgcattacaaaattttacaaatgttaaaaaatgtcaagtggtttttaagttgctttaccttttactgtaatacatgaaaaacttgtaagggcttgcacaggttgccttgtttta

SEQ ID NO: 59987 - DNA, 1679 bp, Homo sapiens
aacattataaagtaaaattttgcttaaaggtaaattatacagcatttaccttttatttatttattggagggactttaaacactataatatgttgtctgcaagctaaaatgtcatttatatatgtgcagtcattcttgaagttagatgacgatgctcttggaggttctttgatgaatcgtgacagcagattgctcttcataacgatgaaaggcttaatgagaaaaactttaaagaccttttcagtaatgaattacttatccccagccaacccactgtacacaggccttatatttcagtaggtgtttagaaggatggctaatgttacaacattttaaaaggtttatggtgaatagtgaatagttacactgataatacagagctacgtgaaaaggagatatctgtttcatgattgtaggctattagatagtcccattaacagcttggtccacctacttccatcccccgcccccccgccaaccctctgcatttaagctgagtgaggctagataattttaaaagctatattgttttgcaatccctgttgaccagtaaattggttgaatataaattcctctgataaaatcatgtgattatatcagactaatgtaaagaactgcttttacaataaaaataattttgatggtaaatcagagcttaaattgctaactaaaacagtatgtaatcgttgagtctcatgtgtaggatctcttcctactgagggtacctaaaagagttccaaatgcagtacatgttgaaattttctcctaagtattacaactagggatgaagaaaagaaaatgcaagtgtatttgctgaccttggaatccctttacttaattatcattcgtggggttttttgtgtgtgtggtgggggagtgtaggattagtgtacatttgttagaacttcatcttggaagataattttcttaggataaatttaataagattcttggaagtaaagatagagtagcatgtttttctctgttctattagactgcgaccttaagtgcacagactgggtttttctctaccatctattaagcctgccaaatgtttaagaaattatggttttatgtatagttagatagagaaaatatactacatatggaacctaaaagctgttgctatattaaattttggaaatggaaaatctgagggtagaatcctcctcttcacatttataaagtcattacattccttctaactaaaccattttatgtacaataagaaaaatacggcagttatacctctgaagtgttttgtcttgattgtaaaactctctcaattgaatgtaattctatacttgctcttcaaacttgctatgcaaatatgcagtatattgatatattaatattaagtttgctacatggattagtctacagatctttatactaggaaccctgtttgcaagtgtttaagttaaataaatcggcaaaaattagtgtttataatttgaattaaaattacagagttaaaagaactgcaacatgaaacactttaatgggaatagaaggtggtttcataactttctgattacatctctgaacatttaaacattacataaatttaaacaaggtttaaataaaagatcattttctacagtgatccaaaaagcattgtaaacagtcaaaataagcaagccagtaatcactttagaagactatgtactggttttgatt

SEQ ID NO: 59988 - DNA, 1030 bp, Homo sapiens
ggaagagaggggaaagagcattctctacatgacaaatagagcaaattcatgcctgaagaaagaaggacagacagacagatgaacttgggtgagaacaaactgaaagacaagggctggagggagcactgagaattagggggacaaggtgtaagatgaagctggaagaatagcaggccatgttactctttgatactaagagttaggacaactagacttgttaaaaattggtagtgggagtagttttgggggaggtgggaaggaagggaacaggattaaattcacatttgtaaaagataactctagctaattgtggagaatggatatattgaaggataacccagggaataggtaaaaaagacttctctagttctatttcaggtaagcaaagagtacaatttggtccagagtagtgaggtagagaggaaaaaagtgcatggatttcagagatttactcctgaggtagaatgacaggactgggtgatggattggattggcagcggaggggtagaaatgtctaataagataggtgtggctaatgattagatcttagagctttagaaaatgtgtacttagcagctttgctgttgttgaatgtaactgcttgttattaaagcaatttgttcactgtatgcacatcacgtaataagtgggattggggaaataagaggtacctctcagacaggcatgtggagagctatgctgtagcttctctgacatgactttcttcttgtatttccctccaaagagcagtgatgggagacaatctgttatgtagactgatgcaccacgtagaaactgcttagtttttaaatttaaatttagcactagtgagagctgtcagaatcctttgacccacatctattctttatgccaaaggaaccagtccatagaggaattaaaaacttttctaatattgcatgggtaggaaggcagaaatgtgatagctaagatagagtaaaatatcagaagctgtattgaatttaaccttctgtatggggtaaaaagataatgtgttaagtgaattaataaa

SEQ ID NO: 59989 - DNA, 1018 bp, Homo sapiens
ttgattatttgggagcaaagatgttctttccctttgattattcataaatctactcatttgataaactataattattttccttataaagttattatcgtcaagtttatagttttagggtttgaggtttcatgctgaaattctaagaagtggtcattttatctaggaactttagcaaaacctgagaatgactcttagggctaaatagttatctccagctgtgttaaatctatattgttgttgttttaatgtcaaagcacaatataagctcagtactgacagtcttctaacactcatttttacattcagcatttgatctctatgggtgaagtgctcgggcacaatacattatttcagttaaatacaaattggacactttatgcttcagatatttatgggcaaataagaggcagtataaatttttaatttgtttatttgttttattttgctacatttgttctaggttggttcttacttgaaatctccaaaattccctatttggattgttggcagtgagactcacctcaccgtattttttgccaaggtatgcttatagcaggatttttttttaagttatgacatcaggcaaacaagtattataagttcatatttggtttggatctttgtgcaaacttcagtctattcccacaacaaatgaattgttcaaaaatctcaaaaactaatactgaagaacatactgttttcgtgctctaaatctggaatcttttaatcaaaatctatcatgatttagttataatttcttcttctttctttagagctttagcttttgatttttttcagaaatcacttgtgttatagagaaaacaattgaattttaaagttttagattgctttttttgtaagtaggataaaagatttatttaacttagatgatacatgatataaaatgttttaattacagcatctcctttgaaaaaattttaaaatctattaataattcaatggtattaaagtcaaatgctcttttaagatggaatacttcccacaattttaatatata

SEQ ID NO: 59990 - DNA, 1052 bp, Homo sapiens
gcaatgcaaccattaccccaatctaattccaaaatgttttccttacccacaaaaggagctctaaacccattagcagtcccatgctcctcccactcagcccctggaaaccactactcttgtttctgcctctgtggatttacctcttttgtacatttcataccaatggaatcatgtagtatatagcctttcgtttctggctcctttcacttagcatggtgttttcattgttcatctctgttttttacatgtgttagtatttcattcctttttatgagcaaataatattcttttgtatgttaaaccaattttatctgttcatcagttgggttgtttctactttagctgttatgactagggctgctgtaaacattgatgtacaaattttttgtgtacatgtttttatttctctttgtatatacccaggagtgaaattactggtcatacagtaattctatttttaactttctgaggaagtgtcaaactgttgtccaaagtgatgacacttatttatgcattcaatatatttttactattacaaaacatttcatgagtttagcattcatttattctttgatcttatcctttgtttgtttgttttttttttttacttctaccttaatttaaatacacactttttctgaaagaaaggttaatatctaatctcttcaccacacgaggcaccatgtgatgtgatggaaatccatcagagtagatagaagtcagaaaacttaagtcctaattctagctctgtactatttagttgcctgagatgagaccaggcacagatcctgtgtatttctctggttccttatgtataaattgaaggacttgcacagctcacctctaaaatcctcgtccactctggaactgtgattttatctttccctctttctttgttccttttcttttattcttctctgctgttcccaaaccatccttcctactttactggctcaacattgccacattagcacatctaactcatccctcccatcataggacaaaaatactagtttctctgtccatggatacaaaagagtacctattttcca

SEQ ID NO: 59991 - DNA, 1058 bp, Homo sapiens
ggggcaaatattttgttttaagataacagtggggaggtattttaacaaatccatttgtaatttttttaaatgagaaaatttattcattttgacttagaaataagtatatctttgtaagtgcttctctgcttgggagaaaaacattccccattttcctctcggaccaccctcctcaagctttttatggctatttttaccaaaactcaatgaaacagtgatagttaacctactctaatacgtgagtccttctttttagacctttctgcctgaaagatgaaagttcatgtatctttcatcaaagacaaaatattaataattatatattcatttttaaagattgtaaatattaagtaacttattagtctgtcattttttatccatttaaatatatcttagataaagttgttaaatgtatgtgaatatgtagaacaataaataccactgtgctgatatatttggtgatacatttagcaaggccgaatatataaaattgaaaatgtaaggttttccctaactttgtaaattcttacataatttaatgtgaaaagtcattactttatactttgctgtaggaattatttgatttggcaactatattcatatttaattgctttttaatatttattaatagccaaagtttaattaatctcctgctgacgggacatgctgtttctaatgtatgggatggtgatagagagtgctcaggaatgagtaagtatattccttgttatgttgctctctttgatgaataatatttcattggaatacagctgattattattcgtctatttaatggctctacattacctagaggttaagtgttttctaatagaagaatcctttacagttttcaaggcaccataatgttaagaccattaatcttggagccaggcaatcttgggttcaaatcccaaatgtatgactttagtgaagttacttctcaggcctttcattttctgtggtataaaactgggatttatgactcttaatatgtataaacacagtgcatatttattcagagatattactgcactctttgcttaaaatggagcattaca

SEQ ID NO: 59992 - DNA, 3143 bp, Homo sapiens
gtaatttctaggatttaaaaagtgaagttttctttgtgtttaccccctcttacaagaaggccactctattctttaaataactgtatattattgaagaatttactgatgccagacagttcacctaagagatgaagaggttccctgccaagtaggtgttctttcttaatgataaatatcatatatagtgatagttgtcagaaatagcttttggttttagtggctaaatttgtaatgaaaaatttagaaacgtcccaaaactttcctgtttgtatgtatatgttttaatgtataagaaaatttaaaaattttcccttttatgaatgtagttaatctcatcatgataccaatacttaattctttttttcccccagaaaaagatcgttcagaagtttaccagaattaaaagatgctgtcttggaccagtattcaatgtggggaaataaatttggagtattgctttttctgtattctgtattactgacaaaggtgtgttcaagaagatgatttttctgcctttgattaatgttgttcagtgctgtttttcctgcagtgatgagtaattttattcctgatggtgtttttaaattcttagaataaaaatcttttacgttgaaaatgagttaatttctgtttcctcagcactcactcgttgcttaagcagtttcacctctgctcttttggactacagagattatcaataatgttctggttgtgaaatgctgtcctttcttccaaattgtgtttcctttgatccttccgtgtagcacttgaccccttaaccccttctggaagctgtttttgaccttgattccatttcttgattttttttttgaaaaatcactgtgtgagttttctttctataatgtctcacgattcttattttgttttgttttctttgatagctttgtttccttctttatctgttacctcctgctcttttctctcctcctctaaatttttatagtccagaaattttcttccctggatccagtatgccttttatggatatttcatttgctcaggttacctttatatagctatttaatagttccaatatgtccccttctagtcctactctttttccccaaataccagtctcatagctctagtaacgtgttagtctcagttgactatgctattagatctatcatgtctgaaatcaaacttcttttatttgacaaatgttttttgagcgttgattgactctatgctagggactatgtctgtattaataatatgggatgcatttttaatggtatctatttagcattgtaaaaaaatggcacattaataattccattatggcagtgtgttttggcgtttggtcttctgtctgaacctattagatggaatcaagggcatactgtttctagtagggaccatctgacagagataggaccttgatgcatgagggcaagttttctatatgggaaagctggaggacattttttccagcagtgggcactgcaagtataaaagtgtaagggattgagggtataatgcaggtttggggagctctaagtagttgagccttactgtagcataagacaccagagaggcaactgtggaagatgagactgggcacatatgtaagaaaagacttagaatatgaagacctttctatgtacactgtacaaagagtaggtttcatctgctcagaattggaacacagtaaaaagtttgaacaagggagtgacaagatctttttgttgataaaagatatcttaaattgggataggagttgtgatggatggagttggtgtttgtaatataagactagagtcaggaaaactagaaaattgggtattgaaataagagcagcctaaactaggacaggtcatggaatggaaaacaaaaggagtatatttagaaatgtaaataaatacctatttggaatattaaatgtaaataaataagagaacccaaagtgcttagttgtgtagatgttcggagtagctgtgatggtggtatctaagatgactggtttcttataagctcttcttgactgttcagtattctccaactttcttatgctcaaaacgtttgatacctcctctgtttcttcttctttacagccaataaattatcatgcaagttgtccttccttgacctggtctttaaaatggtatccccttcctcagtagtgattgtgtcacttgttgatagtattcatcttgacattatcatagcctgatttgtattgtttaggaggatggcatatgcaagagctcatgcttctttgtttccccctgcgggatttagtcattctttaaaaatcttggttgttaattaatcatctatttaattcttagaaatgacctctaatatgatagaaacaatggctaaagttaagtgaatagaacaatgaatagcagtttatctttgtccttctggaattgatgaggttacaataagtaggtcttcttgtacttatccagtatgtagaacttttgggagttgagtgcccttctgaaggtttaaaaagtatcaggaaattggtttttaagaaaagaaggcacttcctgccctcctaatttgcattttgtcagtatacatttgaatgaccaacatttgtgagaaagtacaatcagaagtaaaccttccattttatgtaccagttaaataattaaaacgcaaattatttaatgttatatctctatcgatattcatgtgtgtatgtatttactgcaataagtttttacatgatctaaaaaaatcagttgccttaacaggctcatattcatttaacttttaaataattcatttaactattaaataatttctcctttctcctattaaaagttaattctctctccttgcccttttaaccaacggtacatatttcacccatgagtgttgtttatatagagcccatgaaagaaaataaaagatatttgaggaactattttttaaagttatctcaaatgcacccccatttcaaatctgagttacttgtggtagaaaagttacttaaataattgtattagtttatagtgtaaactagtcagtttttaaacagtcataattttcattttagttttttaaaataagtcaatgaattctgtttctttagggcattgaaaacataaaaaacgaaattgaagatgcaagtgaacccttgatagatcctgtatatggacatg

SEQ ID NO: 59993 - DNA, 1025 bp, Homo sapiens
aataaatgaggaaacaaacttaaagctgtcattgaacctgtgtagtttgaaagtgttatgcctttttatacatgtttgtttaataattaagccttaaacctaaagattttatattataaaaaggaaggttagctctgatgatattacttggatttatataatctgaaagattatttaaaagtgcaggacacattatgatatgtgaggcactgattatcagtaatttttcatactttataactgccgtagcatagctgaactgaaatgttatttaatcacccttctatattctcagtattatatcgattttagttatattcataataaagatgttgaaatataaattcatgttataatgaagttgaaaataaactgagaattttaagggagtaaggaaatagggaaagttttgattgcttgaaagtatttacagcctgctgtgtgtatcttgtgtcatttatttgccatgtgtagtgctgaaaagtgtcttttatgtatagctgccttggctgtcgaagagcttggctttgagcgatttcatgcattaattcagtaagtaacattggaacatttaaaatacttactctgtggacacattgccactttaagtctgttcatactgtggaaaggttcttagttttacatagaaatgcgctacttaaacataaattttaaatccattgcttcaggattaatttgcctttaaattaaaatagtttgtaaatgtataaactatgctgagtccttaattaactacccagatacgcttttcaaaaacattaaaaagctttttcatcattacaatgaaaaaaaatcattttagcttaatgtttctgtgacctaaacaaatatgaagatttctagtaggataaatattagaattatttatttgccagtatctgttttctataccttttattaagaataccgatatttttgttagagcatttaaactttttattacaaagtaaaaggtaaagatggctgttgatagaattatgggtggcatttggtttaaaatgtaa

SEQ ID NO: 59994 - DNA, 1050 bp, Homo sapiens
aggaataatcttgctagttgatggttttttataattggtagtcccaagtgcttatgttaaataagtgacttattctacccacagagcatcacattaactatcatctttgtggaaagttttcgtaaagagattacgtacctgaaagtacacttcaattgtatgggatacacattttgctttccatatagtattatctataaggtgctgttgcctccctggactaaaatgcctctgtgttgtcagtgtcttttttctcctacctctgcagttaaaatgccttaagcctggcaaattctaatagtagtaacatttgcaaggaataattttgaacatttgaacagctatatgatgcttccttttgaagcctttgaaatatggcctttcaaaaagaacttaacatattttagagtttataatgacatttgaagacaacaagtggaaaacagtcacaaggatgctagtccaaagtgtcactaagattggttttaacatattctccaggttttactgtgtgggtgttagcacacttaataggttcatttaggatattaaaattttgaaagaggaattgttgatcttttgaaaaggtattttaaagattttgtgcttaaagccagtctgtatattgatgtgagaaaatagtaagatctttttatataacattttccattagtatcttaacagtatactgagtgcatactatgaaatatgctatgcagttctgtggtgatacgtcacgttgctataggttaaagggccttataatgcattccctttggtacttcagtaactaatttagatgggcatattatattgaattaccctccagaaaacattttagtaatttttccagtttactttgtatctcattttaaaagttgccatgaagtaaaccatattttaaattttttaaataatgtatacatttgaaatactttgttaactgaaaatttgagaatttaccttagtgacaaatgaactgtatttatattacaatttttattccgtgtaacaatctattttacctgttctttcctttattcccagctt

SEQ ID NO: 59995 - DNA, 1012 bp, Homo sapiens
aggaaacctcttggcttaaatgctgcagttgctaaagttttaagaaagtgatgatcagtgtcacattatgatctttcataatgtttagttctgcatttttcagtattctttttctacttggtggtgttatttggatggctttatttaaagtggtgatattttaatccacaaacacattgtttttctaagacataatttaaaatctatttagagatttttcccccatttttaaaatgcttgattttcatcattaacccattcttactattgttattcatgacagaatttttttttttccagaggaaaccattataacttatgctttggttatttttagaggaagagcagaaggaactcctttgtcataccttgtgtgatattttagaaagtgcttgttgtgaccactctggatcatactgcttggtttcatggttaagaggaaagacaactgaggaaactgctagtatttctgggagtcctgcagagtctagttgccaagtggaacattcttgtaagatatatttttatttcctgaagtttttttcttgttcctttgttttaatgaatctattgaatattttgaagaaaaaattacttaaaattttcataacatgtattcttttccagcttaagcttaattactgagcctcactattttttatttccatatcatttattttaactacttagaagatactacatttttgcaaaaaaaaatgcatctcttaaacttttaaaaatgttctggttaacttctgcttgataataatctcttttgagctttagaactcttatttagaaataatgatatgcttcagtttcagatgccttaatgttttgctttggtattgcaaaaacggatttttttggacatcagaagatttcataaagttatctttacttgcttcccagagcaaagatggggacatttctcctcattgcaagctgtttcttttctttccgaattatttggatatttttatacatatagattattttaaggcaattttaa

SEQ ID NO: 59996 - DNA, 1032 bp, Homo sapiens
gtcaggtgactgggatatagctaccgttgaactacactttgagaagtagacacttcactgtgcagctttttatcaaataaccaatgtaacatcgttgactcgcttaaggggaagtttagaaatccatttgtcttttcttctgaatcttgtacctttttgagttaaacttgagctcctgataataaagtgatgactctaatagtgttaatcttgtgtcacagatgaagactaagggaacagaaccacttttatatttagatttcttttacctgaaggaatctaaatgaaatgtagacttgttcgtgttctacagggctttcactttgtgaatagagcagtaagtttgtgtgcttttcagttattctgttatgtgagttagttcttctacttgtcagaaaatatgtattgtggaagaagaagaattttatgaatctagaatcaagtttatagcagtatactctgaataaataactgcacagttcctgtcaaatgtgaggggaacccatttgacatctttacagaactagtcaaaagattagaaagggagtacacattattttttcccactttaaaattgaagaatgatatgatgtatggttataatgcatttcactaattattgctttaattgtgtaaaggcatttcttttgaagaagctcctgttttcttcggagaagtcttcttggcgggattgttcaggtatgatagctgtcttttaaaacttttgcttcctcctctgttttaatagagatgatctaaaattatctgagaaagtcaagtatcagtgggaattttttttcctgaggtttccttttaaaatgttttagaaagtttcatgaacagtgactccatatttccaaatttggctttctaaccaggggttataagacatgatggtataactaagggaaaaacgtttggcctcttggtaaaacacggtgcatttcctagaactgttaggtggcagcatgccataaagaacagtcttttttttttttttttttttgtagtcttatttagctgtgggcaaga

SEQ ID NO: 59997 - DNA, 1069 bp, Homo sapiens
tctcagctcagtgcaagctccgcctgctaggttcacgccattcttcggcctcagcctcccgagtagctgggactacagttgcccaccaccacacctggctaattttttgtatttttagtagagacggggtttcatcatgttagccaggatggtctcgatctcctgacctcgtgatccgcccgcctctgcctcccaaagtgctgggattacaggcgtgagccactgtgcccggccaatgccatgtaatgattagcttatagaatgtgacagaaagtttgaaatgatagaatgatatggtatttaaagagttctaaaaattgtttgaatttagtagactatctagtcctccttagatgaaaagtcagattcagtgtcattttactaaagtccatactttatcctcctagaggagttcctgggtgcaaaattgtgtgagtatatgtactcttacgtgcatttgggagtgggggtggataggttctatagatttttttttcaaaaggttccttgatccacacctcatgatttgaagatattttgctgttgtgataagtgatcattctcaaagcaaagtacatgaaagattcttttagctgctacttgaattatatttttaatctttcctacttgctttcatttttagggtttgtgtttagtgaatcagagggatctgcattagaacagtttgaaggtggcccctgtgctgttattgcacctgttcaggtaacatagactcctttaccaactccttagagggacattttgaaacgtttcatacttgtcgttttctaatgtctgtactccatatagtaattatgagacataatcaattaactcttaacttttgctcatgtaaattacaataaatatccaaaataaaaatgaattcaccatatcgatgagttgtgcaatagtagccttttgacaatctttattttcaaggaaaaataataggcgttccctgactttcagaaaattaggaagtttcttgacttctttaacacagagatcctattaagtaataacatgttatacactagataggtacaatcactgtaattgtactatt

SEQ ID NO: 59998 - DNA, 1723 bp, Homo sapiens
tgtattgtttagggaatgatatgaaaaagaaagtctgtacatgtttagtacagacccaaccatcgtttttttcccaccctcaaatattttccatttgtgtttggttgaatctgtggtcgccaaacctatggatatgaacggccaactgtagtttgcttttactatttctctttctaatccgaattacacttcaaccttttaaaatttggctactctccctagtgctgtaaatttatatttttagtattcccaatgacatgattaatctagtattttaatttatatctttattcagcagcatttgtaatagttgactactctttgcttctgatttttcctttctaggagctcagttaatgtgcttttctcttatccttctaatgtttatcagtctcctttgctgactcagcctctgctcactttttaaagttcccaacttcattatttttgttttacaagttctcattcactttaactgacatgtttaagatgattgaaattgctgcctctaatcctaagtcctgccctgaactacacacttacatctccgatttctaaaagttgccaaatggttatctcacatttttgagactgaacttggtattcctagaaacaaacactgccattatcttccatgccaaaacatcaacaagcattaattgagcaatagccacagtatgttgtaaacatactgtgggaaaacaatgaccagtaacacagatacaacaccggtcaggcaaggcagatgattaagaagtaaacaaacaataactacagattatggtaagtactggttgtgctaggggatgacaggagagactacttagataggtttgtaaggaaatatccctatgaggaattaacacctaaactgagacctgaaaaataaggatttatctatatggagagtagcggaaagagcatttttatgtagagagaacagtgagcattgaggctacaggtaaagtctctgggatgttctgaggacctaaggtcacagtagataatgattgtaagtgtaaacagagtcagctggattgatagatcatacagtgtcttctagaccacagaaaggagtttgggttttattttaattgcaatgagaagccactgaaatgttttaagcaggctgtgtcaaaatctgatttccatttctaaaatactttctggcaactgtgtggtgaatagttggggactggacaggagggaggaaggaatagggagacgtggttggaaactcaacagtatttaaggtcaaagattatagcggtttgaactatagggtggactggagatgggatggaaatggacacgttaaagatacgttttgaagccttgaagcaggcaggccttatcttagggtgaaacctataggtaagtttgagttttccagagaaatggttagcaggtgtatcaagcagaagaaacatttacaaggggtaagagacatagagaaaatgaaatatctcaggacctgaaagaaaatgtgcccagaatctaaaagggagaatggcaaagggtgaagagggagatgcaggcaggagccagataatacaggaccatgttaagggacttagactctgtctatgtctggagtcctaatctgggctatatttgggaattacatggttataacaaggaatggactgtctgggagtagatgagattactcaggaaaaatatatagaatgaaaggagcatagatcctaaaaccaagacctgg

SEQ ID NO: 59999 - DNA, 2215 bp, Homo sapiens
aattacaataagttgtttatttgatggctaatcattattctaaatagaactttataatgacttattagaacgctctgccacctttaatcatgcagaaattctttaacaggattagttccatcagtaccatttcaaaataaaggatttctttctttttttcgtttacagggtgcagttagttatattttggatatgtagctcttcaaggccttacactgattaagattttaaggcaaccaaacatatatttttgaagttatcgcctctgaatcagaggggtcctgttactggttttgatatgttaactgttgtattcatttgtttgttctttgaggccattgctaaatattgctgtggcagtcctttgggattgtgggaacaggcacaagacactgctttgctgcattactaatgtgacatcaactctggctttatttcatagtctgtgatcgtgtcttcagttgacaactgcagtctcattagttttctggaagcaagatacagatgtaagatgtttggcatgaatatttatacaattatgtctagagatatttcatctataaaattatattgattgatcaagttaaattcttttgatatggttgttaaaacaataagctgcaggagtggcacatagttgtttttaattggcttgacatttttagataattctcttctacaaatccctgttcgttttaaaaaatgcggggtgttttttttcttcttctttttttgggcagttttaattttaaaggcaataagccatgtaatttaagggcttaaagttggcagggttttattttaacgtgaaaatttattcttctctctgctttcctcctgctcaattgcctatagtactttttaaagaatagcatataattttcacttccttagctcattaacactatttatcctccccccttcccacaaactacaccagtattccaagctcttacagttgagagtcagtagggtgggagggaagacaaacagtaaatataacgtagcataaattacacatgtacaataaatagtttgaagatgaggaaatacagagttctgggtggggtgtcctggtcaggcctcattttaagatgagatttgagcaaacacttggagtcactcagctagtcatgcagaagtcggaagaaagagtgctccaggcagaacaaatggtagttataaaaaacttcacagaaaatacacttggtctgtttaaggaacaagaaggaagttagtgtggcaggagggggaataaaggaaaaggagagtaataaaagatgatataagaaatgaaatggcccaaatcatataaagctttctaggccattagaaggactttcactcatcttatacatgaaataggggtccttcgaaggtttgaagcaaaggagagatactacttgacaagtttttaaaggactgatctgcctgctgtgtttgaggatagactgtagtggattgggacagcaagatcagataagagacaatggcagcagtccaggggagaaaagatgctatcttggaccagagtagtggtagtggagatggtaagaagcggacagagtgaccacaaccaaacagaaccaaaataagaatcagctagacctaacagaagtagtatttcttgtataaataaaaacattttgacttatttggaatttattttcttttcaatattgattgcttagctcagtgtttggcaaacttctttaaagggtgagtggcctttttattgcctctcagctcattaatggtattgcagcaaaagcagccatggttagtatgggtgtggctgcattctaaaacatgaaagcagatgagggttgtagtttgctgacgcctgagggagagtgtaaactcttatagccatttttccttcttccaattattttccttcttccagttattttattgtttctcctaaagactagtcagagagagatttatttttgctatttgtagcagtacagtgggtgggttttttttttctttttccccaggggaagaggggcgtgtaggtgtagttgattgaaattagagctttgggctttcagtgtagcacaatttttgttacgtaatatgaaaaaaagatatttaacaaataacttaggaaaattgagggatccattaaaatataaatataaaatatattaggagttaatacagttgggttaatttaaggtttaaaggcgtgtttgggtatttattttaa

SEQ ID NO: 60000 - DNA, 1044 bp, Homo sapiens
gcctccagcttagcccagagcagtgcgtagaggaagaaggtattcctggagtttagaaacacgccgacgccccttcccaatacaaaaactaccaccccaccaaagggtcccagacagttcagaaaggtcagaagctacttccaccgctttccgtgcctgtttccgcctccaatttcacttccggggaggggacttccgggccctcagccttaaggggcgggagttaaagaggagtcggaagtggcaccagcacttccggtacggaaaactcgctgctgccccaacctggcttgacaggcttggtctctgcaagtggctctcagccccttcttctttcctgcctcaccttccaattcgtttgccgccgccgtcccgcagctgctgtttccggagttgccccttccccatgttccggggcaggagtccgcaaagcgaagatccgcccgccggttcctcatcatgtccgaactgactaaagagctgatggagctggtgtggggcaccaagagcagccccggtctctcggacaccattttctgccgctggacgcaaggtaccctggcggggctctcacacttgcagccgctgcttcttttgccctgcgagagtccgcctgtgacgcctctcgctccagcccctcgcgtgccccgctctctgccccagtcgccgtgctcagcgctgaagctggactttctagacacgccctgccttgccttggtggggagagtttgagtaggagaatggttacagctgccactaaatacccgcagcgctctttccatcctccgggctgcccttcggctggggaggaggagagggtggccccttgctgggttgcagggcgtgacacggaagatgcgccccgtgccccggtgtcactttctcaaggggtgctgtggccttccgcatctttaccccctaacagagctgtctattggtggtggttggtctatttttggtgagaaggagggacgtccaagggaaagtccaagtggctaattccaaaaagcagttttttgtttgtattgtcattatgtggttagg

SEQ ID NO: 60001 - DNA, 1033 bp, Homo sapiens
gaaaagatgattcttcccaaatgcagttatcagtggatacatttcagaaattattttgtcactgaaggacatttgaaatgaatcatccgtacttaccattgactaatacgttttttttcaggcagcttcaaagagtattttaaatatgatttcctggctatctgatttcggatctaagagtatcagacttaggttttgctgttaatgtcctaggggcagtgtgttcactcttttattctgagttaaacagaaggcaagccgggagcattgtgctttggacagagctgtgctgcattcttaggggacactggctataaatccagtctccctagaggttaacaatcaaagttctccccttattatagtcaggcgagtgatatgatgatgataaattgcttggacgtgactggcccaagcactagtgtgatgaattatgttgttcggggcatgaccgaagatcttctattgtcagctggcaatgctaagtattggcagtattcataaatagccttttgccaatggtggtctctgctttacatattaaattctctgttttcacaggttgtggttcttagtcatctgtgtcctccactgaattcacttacataatcagcctttttttttttcctgttccctacttattaaacgggtgggatgtgctcacttgtgtatggtaaacactgagttctttcttcacagaaactgttaaaagagtaattattagttctttttactaaatccagagtaatagcaacttatcttgcagtggcttaattgggtaattatttggtgtgtgaagagcactttgaagagaatattggtaaatattgttaatttcgtgctcttttatgtaactgaaagcccattgcgaccacaaaatccttggtgttactgtgtacccacaaaatttctttcctgatgtggcttactattttccaaattatttgtttgttgatttttaaaaacattttttaaattttcataaattctcaaagttatctcatgtttatgccttgacaattcgacatgtctc

SEQ ID NO: 60002 - DNA, 1043 bp, Homo sapiens
tgttcttttataagaaacaggtgatgcatattttcttttttttgttgttttttgagaccaagtctcgctcttatcacccaggctggagtgccatggcaggcgcgatcttggctaactgcaacctctgccttccgggttcaagcaattctcctgcctcagcctcccgattagccgggattacaggcgggtgccaccatgcccggctaatttttgtatttttagtagagacacggtttcaccgtgttggccaggctggtctcgaactcctgacctcaggtgatccgctcatctcggcttcccaaactgctgggattacaggcgtgagccaccatgcccggccaacgcatattttctttggcccacattttaggtgtttattaataagtgttggtcgacgcccaaaggagaaatctcagaggtcatggttgttatactatttttaaaggtctcccacaggatgcttaaggaacctatagcagtggattctgcctttagtgaaagtggaatacagctcatcatccttgtctcaataataaccccatttcctcattggtgaaatgggaacaataataataaaagtggatttcgtctcaaagtacatccgacggtccggtcttccactgtttttgatgactcaccttctgttgatcccttgcctacttcaccggtacattaggagatttaattaaagtgtgtagaggatctaagctcttcagagaaacacacagcattattatggcagataacacttctgatcttccataatctcttgaaggtaatgaaaccagcaatatagaaagctgagggtttaatatagtcagagttttatgaagacacatccatacaatactttattaatagtggtcatcattgtggccttgagagttcagaattcaattcctaggaactttctaattgttctcagcattttgatttaacttttttcctgtcaataaacacaatcgagagatcagttaagtattcaggtcatgctggttttactcaactttgaaggctttcctattttgttttcaaactatgat

SEQ ID NO: 60003 - DNA, 1042 bp, Homo sapiens
cagaaatttgtttgcttgggtagtggaggaacagtagaaagatcagttgtggccacgagtgatggttcacacctgtaatccaggcactttgggaggccgaggcaggcagatcacctgaggtcaggagttcaagaccagcctggccaacatagggaaaccccatctcctaaaaatgcaaaaattagccaggcttggtgacacatgcgtgtagtcccagctactcaggaggctggggcaggaaaatcccttgaacccaggaggcggaggcggaagttgcagtgagctgagatcgtaccactgcactctaacctgggcaacagagcaagactctccctcaaaaagaaaaaaaaggaggaaagatcagttgcttcaggatatttaatttagctaaaaagtgacaaatgaaacagtactgatacatggttagtttggatgtaagttattgattctgaatacttttttttaattacaattactgttgatttatccaagaatgcatagctatgattaagagatacaattaagttaaagaaaagtgaactgaatatcaaagaatatttccagtagataaggttaggactaactcaggcagaggactcccagtagaaggggtgggaggcaattaacaccacgcacgtcacttagatctgcagtggggatagattctgaagtcggcaggattgtgagatcgtatctctagttttattgatttgccttcttacatgggtatatgttcacagcctcccaccccttacggacaagagtttatgtgtgtgttaaatattctgattgtagttgtttgtttgtttgtttgtttttagaaaaaagaaatcctctttttagaacatctcttggtggtaccatcagaaatgtcttccttaagtggaaaagtccaaaccgttttgggccttgtagagccaagcaaactgggccgtaccctgacccatgaacacctggccatgacctttgactgctgttactgtccacctcccccgtgccaggaagctatttccaaagaacctatcgtgatgaaaaatttata

SEQ ID NO: 60004 - DNA, 1109 bp, Homo sapiens
aatgaatgacaaaataaataaattcattcacatactgtggtggatctattttgataaatttcacaacctataaaatatattccttctcactcttccttagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggataggtaagtaggctgtcttacaaatggatgcaaactgccatataattaatgcatgatcaaattaagaatctacagtaatcagtcaatgcaatactaatcacgcagagaaaaccactaactatatggaaggtagtatttataaagtttcacaactgacatgaataaaagtcaatgctgccatttttgtgtccctcctctgtgtcagatagtgtcctaggtatttcacataagatatttcgcataagtcatttcctttaatttactcaatcctttataactcataacaggtgtcactgtctacttcatttctttgtctcatgggatgctatcaaagtagctgccaattccacttgctcaatgtttaccagtagttggagtaataaagttatcacacatataaagggagggaatgtcaatggtttcacccagagaagaaaaccgcaaatataaatgttcacatttgtgtcacttgtggtttgaatcatctgaattttggaaaatgcaattataaaaaataatagtaataagtatagcatgtgttgggtagtatcatgcattagtttcctattgctactgtaacaagttatcacaaactgggtgcccctaaacaacagaaatttagtctctcaaagttctggaggccagaagtctgaaatgaaactttgtcagggccccgcttcctccaaaggctgcagggagaatctttccttgcttcttccatagcctcagatccagctgttccatgg

SEQ ID NO: 60005 - DNA, 1082 bp, Homo sapiens
tcttgactgtaactccatgtctgtcctacttttcaataagcattcgctgactgcttccagtaggtttgccatggtgctgggcttaccgaaacaccctgcaaggaagacaaacgacatctctagcttacagataaagaaactgaggcacggagagggaggcaaacattgctgatcatttgcccagagtcatcagctaataaacgtcaaaagcaggatttgagcagcaagttcagggccactggctcccacctggccctttgtagtgacttgttctgcagccccaggatgttcagacacacacagtgggatctgaatataaaaaggcagagactgaaacagtggaacattccagttcgctccgaaaaaggagaagagccctgcagcttttgcaaccccttctgaaatcgcttgcctggatccccatcgtcagggccaagctgaacacccacctcagcccttcccgcattcaacacttgactcgaagcagggccttgtcaattcctctcaattcctactgctcctctccctctgctgacctcttatcattgccaagactctttccttacactcgggtattgctaggtttccatgggcatgaacagtggagtcatctttctgtcaacttttagaatccttacagtttggaggccaggtgcgtggctcacgcctgtaatcccagcctttccaaggtgggtggatcgtttgaggtcaggagtttgagaccagcatgtccaacgtggcgaaaccccctctctactaaaaatacaaaaattaggcaggcatggtggtacacacttgtaattccagctacttgggagactgaggcacgagaatcacttgaactcgggaggcagaagctgcagtgaactgagatactgccactgcactccagcctgggtgacagagcaagactccatctgaaaaaataataataataatccttaaagtttgaaactatctttgaataaaaatgtacatacgtatttttttgctctgtgcggataaggggtttgggaaacagaggaaagatctctgaggctggaaggaagctgtgtgtgtagctgaagctacctaggccgtag

SEQ ID NO: 60006 - DNA, 1036 bp, Homo sapiens
gctccgaaagtgctgagattataggcatgggccaccacacctggtctgctccataagtggaacgtcattcaccttccagaaaatccatgggcgatggaggaggggaaaataatacagtgctgtctaaaatctcatgatactggccgggtgtggtggctcacgcctgtaatcccggcactttgggaggccaaggcgggtggatggcttgagtccaagagttcaagactagcgtgggaaacaaggcaaaactccatctctacaagaaatgcaaaaatgagccgggtgtggtggtatgtgcctgtaatcccagctacttgggaggcagaggttgcagtgagctgataatgttccaatgcactccagctgggtgacagagcaagactctgtctcaaaaaaactcacgataattatagattatcatgccataatctaaccagagcacagaaggaatcttagaggtacaagccctgtagagtttcacgtaacatgatttggttaaggggtaaatatgttaatattaaagtgatttgctctacagggttcctgggcaaagcatgttaagttccattcagatgcccaaccctgaccaggctgaatcctttgcctggagtgctttatctttgtgaggtctggcacattccaacagagcacctgctcagtgtgtgatatctgccgtggatatgagatggggagtagcagtgctcaggccagatagttaccacccctgtttagatccacacacctcctttttctgtttggggaaatgcaaatcaccctgctagtggattaatcccaaagccttctgaattccaattcaccattctctgccctgcactctgacacctataggcctgaacttagattaaacgtgatgtccagctttccactgacatggtgtattagtccattctcacactgctataaagacatacctgagactgcgtaatttatatagaagaggtttaactggctcatggttctgcaggaggtacaggaagcatggcggcttatgcttctggggaggtctcaggaaact

SEQ ID NO: 60007 - DNA, 1033 bp, Homo sapiens
ctcagtacatggtcaatgggttcattagtaccccaaactcagcatcacacattttgtccaggtgacaaatctctacatggaccccctgaatctaaaatgaaagttgggggaaaaaaaaaagattagaatgtactttttcttgatttacacagtgtgttaattattacagtttttttcaagttgagttgtagtctcacatgcagctctctcctaatttcatacttagacattcagatcattgaattgtatctgcaaaattgcagttcttttaaattagcttgccagagcgctgtgggtcctgttcaggggccctgaggccaggcagtctgtgactctgcttgctccttgataaactttcatgagtagcatttattttaaatcatccaagaacacctcaagggcaaggatccttaaccttgatcctgggccgtggtgattcacaaaggcttatcctttgtagatttaggctcatctttcagggagctcagtttgatatgcttttctctcctcgaactctgccattcaacattttttttcccatatctattctcactgagtgctaattttagttcaggttgcacctgtgtgtatgtgtgtgtgtaaaccctctgtagccctagtttatagcctttttcaataaaatcacatatccagagaaattgtttttccacatgagcactttttcagagtgttttccagaactctgcctgctgttctaaagtcaacatcagttgccctctttagaacgcttccctaatgcaatggttctgaaatccctgaatatattgttacaagcacagttctcttcagaaaaagaaaccttggaaatggtggatctatgcttttgtttttcattttggagcttggagaagtttgttgacctcacgtcatcatcagcctccagttgaatctgttaaacagccaatgtgaatagtatctatataaaaacacaaagtaagcacagaaacactttttcaggggaggtattttgtcatattgaaacagcacctgtattggggttttaaaattttaa

SEQ ID NO: 60008 - DNA, 1803 bp, Homo sapiens
gctgcatcaggagaatttggtttggatattggcaaaagcagccaatattccattgcacatgtataccacaatttgtgtatttcatttgcctatattgggcatgattgttatttccagtaggaggctgttacgaatacagctgctgtgaacattcatttatggacgtccgttttcttcccagaagcagaatggctgggtcatagaataggtatataataacttggtaagaaactgccaaacaattttctgaagtagttgttctgtaaaagtaaccaggcaaatgtttcagccctgaagatagaaaatgagctataataaatgaaaagtagaaatttacaagttagaaatttagatagaatttctatcactatagaaagtcagcttctgtcgtttctacttagccacagctaagtcttagcaaatcttaggaacatcaccgaacatccatggactcaatttccttaggtaattgaggtaactgggtgacctgtaaggtcccttccagaccccacattctttgatttttggtggaattgtgccaaatggtaatggatagaaagacacctctgtgtacatttttatcccatgggagttgagcagcatttaatatactggacacagtaagaaaaaatctagaacataagatgcagaggcaaaaggatgaggctgctacaaagtatatacttttgtgtgaaaatcacatattctttcaaaaaaccattgtaaggtgatacaggactctactcgtgtgtaaaaagttatatacctatgaatagctccaattctgttttaattataacaaataccgggagatgcatttggatggtttgaggaaaaaaaggttgcgcatccactgtttggaatcttgtggcttgttttgaagccagcgtaacaaaacatttgcctctattacttttgcagtactgctgggcaagtgttttgtctgcctgggctctctctagccaggagagaagaaatttctgtttcctcccaccagacagagtcggtagccccagggccatctttgcgctagctctggtctgtaaatgtatctaaataagccttgctataaatctttctctgttaatcttctagctgttcccaaacttcagcactgcctggtgaaggtgtacttcgccaaagactgaggagtcatggttcacttggtggaagctgtctgataaatagaggatgctggaaaagacagattgaacgtcagtgtgagatcgtgcactgccgtaatctgtctttcaggttaatgagaattaggaattgggaggggaaaaccagttggagatagctccgaaccaggtggtgatcagtggtggaggtagatgtccaatcggtctcggtcacccttcggggtccaggggttgtgagatcctgacccacccagggcaggacaaatgccctctgcttgtcactgcctttttggaagggactctgaggagtgtgagcattgaaaagtacacagaagcccatggaatcgtggagttaagacagtggaggtcacttaggccaaactcttgacctgggtggagtccttttcacggcctccctgagctggttgtcgtctggcccctgcttgaatacccccagtgacctgggactcaccacctcaacatagtcactgtataggactcaggcattccagaacattccttgaggactcagtctcaccacaccagtgctgaataacctttcttccatgataagaagaaagactaaagctagcttggggtaacagctctggatgtttttttttcctctccccaggtggggatgggtgttggacacaataag

SEQ ID NO: 60009 - DNA, 1048 bp, Homo sapiens
aagcagcttcacacaggagagagctaggagacagatcagataggaggtctcctgcaccatttgaaggagtttggcctttgttcacaaggagacccgaaagcctgggtgggttttaagcaaaagagtgacaagatcagagtaattttttcaaaatgatcactgctacaaggaggtaaaaagggaagcgcagaaaacaggaggcaactgcaatcatccaggcaagagctgaaagtggcttggcccagagtgccaaccacagacaggatgagaagtcgtaaaatgctaggtatttattcgaagcgggagagggacagagtttggcaaagaattggatgtaggttgggagagaaggagaggagtcagggctcactttatattttagctgagcgacttgaagaatgatgttggcattactaagatgggggaatattgagagtgaacagatttgaaggagggggcagtttggggatagttaaaggtgagctgcctccagatatctaagtggagatattcagtaggcaggtggctctaggcatctggaggcaggattgagatcttggctggagatagagatgtgttgttggttgataatgatgagtctggaagagatcacttagcaagtgagtataaaaagaagagaagtacttcatacaccaagcctggaggcaccagcagcaagagaagagactagcacaggaaactgaggaggagcagccagtcatgaagaaaaccgagagggcgcagtgtcctggaaaccaagggagttgagtatctccagaagataaacgttgttcgctttgcccactgctgttgatgactggagtaacattaagagggagaggttgcctttggagttgaggatgtggaggtcctagcaaggccaggagctggctttggtgacgaaatggggctagaagcttacccgtgatgggtacaacatggataagcccttgaagagtttattccaagtgaaggcaaataaattgcaattgctggaagaggatgtagggttaaggaatggtgtttttaagaaaggcagtagcacaat

SEQ ID NO: 60010 - DNA, 1052 bp, Homo sapiens
aataggaaaaacctgaacaaattcttaggatgccaatattgtcacaaagtctccatgcagaatgaagttgtttgacaaagtgtttccctggtgatttggctgcagatgaaaatgtctttggcaataaaatttcatgcccgagtctcagctctgtgctctcatcagtcaacaaatgacatatcaaggatcccttttgctgtattagttaatatgttggcagaaatatgtgaaacattgttattcccctccagttctgtgcatagatttgtttctacctttaaacccgcattaattgtaccaaaatattttgccagctataatttaatactaatcaataggattgccttagaacagagataaaaggttctttattacaagggttctcttacttcaccagtattagaagatataatagtaagggctgctgttttgccatcgtttgaaaatggtttgagggaaatttaaggattggtaaggcaattagtagtgaagcatattttaattatagtaactggataagctgctttcagctttatggattaatacgttattgtttaataggccggagtcacgtgtgattttgatcacacttctcactgtagccacagttttattagcagtggtgttttataacttaataatttatacataatgagttcagaagttccatttacatgatatccaagaaataatttaccccatacattaccactcgtcaacaggaaagaagtccttcaggatcacaacgaaataactgtccgagattgttttgcattaaaggatacttttaataatgagatcattttacactgcattatgttatttctgttgatgccaagtctgggttttacaaagtcatttaaaacacaggaggaagatgaatcacaataatttcacacatatttaataagcatgaattatccactgaagtctacatccattctttaagttgtgaaaaccataaggtgtttgagttaatgctctgttgtagaattttctcgtctagcgcggccctcctccgtgcaccccaccattcccgccaggcctcctcg

SEQ ID NO: 60011 - DNA, 1917 bp, Homo sapiens
gatcacagagttaataaaggcagataggtaactctatgggctgttttgcatactgctcactttatgttatgtgagtgagagtgaatatgaaatacaaggtgtttgtcattttaattcttggaaggaggagaagtaaggcaataagagttccaatatacttgtttctaacctaattttgtatgtaatatataatttatatattttaagtcatgcattcattattataaataaagcttctgcccacaaagtactaagttaataatctagccaattttttaatgtatgagcattatttatgtactgaaaataacttttacatcttcaaagtatctactaggaatcattgaagcaaagggtagctatcatttttaaggcaatgatggtatttcatgtctcagtaacagatcacatcttccatgctcttctataaattgttatttatgtgtttgaagtcatccagacaaatccatatcacccccatagctgggcattactgagttcatatactgtattatgattattaaataaactagttctgtacagattcacaactgtccttcaaggtgatatctctacatagccgtgctgttttacaaatcccatcattatgaaaatattaattttttttgtctcctaagtaaagtaagcagtaaacacttgtacttatcaaaaaggacttgttaacatttcacctcttaaaattaacattttaattataagcattggtagttttttgttttgacttgttatttaaagaataagcatgaaattttactgtacataaattatacttcaataaacctggcttttagaaggcaaaggaatgcataactattggaaaggttgagactggcgaagaagtatgcataaattcaaaacggaatttacaaggattttgtttgatgcggtggttagtcttttggaaataggtttaagattagtgcttttacatacataatatatgatttcagggtccatttagagaatatttatctgtatgactagaagagaatgttacaaattgaattttaagaataatgctctaattttacataacgccaagcatgatgtttctttgtttacctaccatattaaaagacatgccatcctggatatcattaatggccaaaaaacttaagacgaaagtggctcttcccccagcatgcagcagacagtctatgaaaaatcactgataggaaaggttagagactcaaaaatctatcactggtaatagattcctattgctaaccagagtccaaggtgagaagctggcattggtgcagtttctgcctgcaagatgccctctgtgggtctccgcagagcagcacgttgtttttctacagcttctctggattatcctgtttggttttgcatacatttattaccatgtcccttgcctcttttcctcctccctacctgcctgccttagctcatctcactgtttttttcagtaacgttattacagagaaagtggatttcagtattcctctctatcaggtgatgcgtcaggtgacagagaaaatcagaatcagactgaaatcagactgctgcctgttatcaattccatctctgtttccatatcctaaaaaaatcaagagcagcaggatgtttttataaacctgtaataccaagtttatgaaagttagctgaatcttagattgtcagcgctaaaaggaatcctgtgggacacttttcacacttggagcagccagcttgtcagagggtcctgggccaggttccaggccctgctgcccgctctgctacatggatcaggtttctgatgccttaccctgctcagagccaaactgtacaacccagcccgtgccttcctgctctcctgcctggatgggaagtcggtctgctgtgaaagtgggcacgactgctactggatgtgaacctgggatgaatatccctggg

SEQ ID NO: 60012 - DNA, 1052 bp, Homo sapiens
aaagtcagagctgaaaaaattagcctaccaagaaaggaagcagatgggaaaatgtgtctgcttttgccattgctctacatcaaggaaaaatagtagtcatcatagtcatcttctctcctctcctaaccatttgtgactataagcttaatgttggatgggcatgcagtataagtatacgctacttgccaggtcatggaaactacatttaaaaaatgtagataatttgtttccaaattggtggaactctgtggcatttggtagagataagcataaatctggagcaaagcattaacaaaatcgtgtcctaaggattcctacagattcaactgatatgaagtcatcataaatacttacacacacacacacacacacacacacacacacacacacacacgcactctctacatatcacacatacactctcagggaagcaatgaaaaattaccaaacagggaataacataagccaaaatttgcaagactcagcagaaacaagaaacacagatctacatcccccatgccttataacattggggtgcagaatactgcatatagaaaaatacatgtgagctatatagagaaaaacgttgagcaaagagtcagcaaccatcaaaaacaaccagaaagatctgaaaaataatagaataacaagaaatgaaaaatataatcattgcaattaaaatttcagtagataggttaaaagggtattacacataaatgaagagagagtaagtgggccaggaacagtggctcacacctgtaatcccagcactttgggaggtttgcagtgggtggatcacttgaggccaggagttcgaggacagcctagccaacatggtgaaaccccatctctactaaaaatacaaaaattagctgggcgtagtggtacgtgcctgtaattccagctactaggaggctgaggtgggaggatcactttgagcccaggaagtggaagttgcagtgagcctagatggtgccattgcacttcagcctgagtgacagaacgagagccttcctcaaaaaaaaaaaaaaaaaaagagagttcaagaataa

SEQ ID NO: 60013 - DNA, 1094 bp, Homo sapiens
cagtgggaaaagtgtaaaccaccatcaaagacagaaaatgaggtcactgcagtgtgcctccttttatttacagatctaggaaagttaataatgagggagatcagaggaaggggagtagaaaggagacaaaataggaatgctcttgaaatttatatctgaggacctttgtgactgcactgagaaccagggaaagcagtaaaacttggggggaaaaaaaaccatgttcaattaaatcctatttcaaatgttttatgatgttcaaattttatagaattataaagttcaggaaaccatagaaatgatctcattttccttgttactttttagatgatgaaattgagttccaaaatgattaaatgaccaacccaagacgatctagctaggtaatatattttgctcacaggatcttctcaaccactggtccctctgcctgaaacgtgtcttctatacaatactcatcgtccttcattgcacagttaatttccactgttctgcagattttaggtcttttatcactttcctttgggagtctaccctgatcactgcccccacatctcatcaaggtcaaataatgataataacagaaaacaacctcatctaatgttcattgaatacttattaatcatgataactctatgaggtgaatactgcttatccccattttctcaaaggagaagctgaaatacagggggattaagtaacttgctcaaggttacagttttaatatgtagtagagccagaattgaaacccaagcatttctcactgcaaactccaagctcagtcctagtctaccagttattctattatcagaataccttgctcctcctttagcatttattgttctcatatatttatatttatttgtgtggttatttgattaatacgtttttttctactagaatgtaacttttaggctcagattacgtatctttttgattcaccaaattttgcttagagcctaagtacctgatatctggcaggctcattgaatatagttcatatgtaaagtagaggtgataatagcatattttggccaggcacagtgcctcatgcctgtaattgcagcaccttgggaagccaaggtgggcagatc

SEQ ID NO: 60014 - DNA, 1033 bp, Homo sapiens
cttgaattgtagcttccataatccccacatgttgtgggagggacccagtgggagataattgaatcataggggtgggtttttctcatgttgttcttgtgatagtgaataagtctcatgagatctgatggttttataaagggcagttcccctgcacacagtctcttgcctgccaccatgtaagatgtgcctttgctcatccttcatctgctgccatgattgtgaagcctccccagccatgcagaactgtgagtccattaagcctctttttcttcataagaagtttaatttataaactactcagtcgtgggtatttcttcatagcagtatgaaaatggactaatacagggatcaacctgtgttattttgtagtcgggcttcagtctgttaatgcatattaaagggtatgacctttctctagaatacttactagtatttgtctcttttggacttgaggatggactcctggcttttcttggctcatcatgtaccaactgactgtaatcagattggccaggacagtctttaccaagctttctgcgtgatcccttctttgtctttgttttattagctctagactcaggctctaattctgttgcccatccaagaatgagcccttctccagggagctcttatccactaagtggaaaatcatattagcatccaaatctgaggcccaggaaagttttagagcatggaagcagaggcagggtgatgtcaggtctgccagctatttgagtgacaaagcagaaaaattactttctactcaaaggagcacgcgttcatgttgatgttctccatttacttctatcttttttacatttattttgtccttactatattaccagaatttattaatccagtccccctttgccaagccatatgtactaaatgaaaccatgtgtttatgtgaatagtgatcccatatttccaaattttccttttcttgtctcttcctgacgctggtctctagtgttctggaattggctgccaagtgtgtaagctcaggaagttccccttgttactgtccacagag

SEQ ID NO: 60015 - DNA, 1088 bp, Homo sapiens
tttcaaggtgatatcacctcgtaaaatgagtcccgaatcttggaaagagacaatttgaaagacagcttgagagaaggtttctcgcttaatgcatggaccatcccaattcttggctgaagcattgtgaaatcttccactgtttataacacctgtcagataacattaggctttcctatgttcttggaagaatctgtggcagtctgtttttccttgagaatcaaatgagaaaagatggtcattcatgaagaccaacaaaagagaagaataaagaaaaagcaagaaaatggatttctacgttgggtttgttttgttttgttaggggtattttcccacctaagactttaagtgagagaaaagcttttctatttttgaaagggcatgagggtttgaaataaggaagaatggatcttgaaagaattgattgtgtcttaaaggatggaaatgcgcttcggattcctacagtgagacaaggattttttttttgtttcttttctccttaatttttttaagctgtcaactaagatgacgtgtgtgtttcagactgtttatgtgggattatgagcatgtttaatctgttcttgtgcattcccaatagaaactgcgtgagtggtgtgatcttttaatagaatgtgtcttgcaactaacaaatgtattttggtgctaaattctggataattcctaagaaatgtaaatgttgtcaataaaagtttttgttttgaaatacttataatcttggagctatattattttaagttttctgaagacagtctctgcttcatttttctaagtttagttgagacagggcaacaagaaaaaatactggccataaagtaaaaatattctctataaatttttggaacatggttagaagagaactgcaaatggggaaacagctccttgcaggccactgtacacatgcatgatacaagacgacttgggtttactctggtttcagtactaagagtattgagtggcttttactagaaaaattcaggacctgcattataaagtcagctactcccaacttcctacccccatttttattttcttcatgtagattagtgtgtgatacagtttgcctcaattac

SEQ ID NO: 60016 - DNA, 1003 bp, Homo sapiens
ttaaaggtgtaataagagaccagatttcttaaaaatccggtttttggctttgtgcgatgtctcacacctgtaatcccagcactttgggaggcgagggcaggcagatcacttgaggttaggagtttgaaaccagactggccaacatggtgaaaccccatctctactgaaaatacaaaaattagccaggcatggtggtgcacgtctgtaatcccaggtactccggaggctgaggctggagaatcgcttgaacctgggagggagagattgcggtgagccaagattgtgccactgcactccagcctgggcaacagagtgagactctgtctcataaaaaaaaaaaaaaaaaaaaaaaaaaaacttgagtctttattgtgccagatgaggggagtttttccatcaccgtatctttgccctgagtgttcctgcatcacagtatcctctagggcagaaggatggtgatggtgggccacgtgggagctgagctggcaatagagagccttcagacagagctgctgggaatggacccagaaagacaaggccgggttacatcccagcagagatacaacctgctttccacctcacgtccacgtgtgctgccttgtctgtctggaatgctctttcttcacatctttacctattaaatgcccagttattcttcaagtgtcaggttaaatatcgcttcctcagagatcttttcttggaaggtttccctactgcccatcaactctaagctccttttatcatctttctttagggcctctactttcattagtagtaattttaataataacagtggctatcacttctttcccaggtgtcagacattgtatgccttgtatgtactgtatgtaagtttctcactcaatatttattggtgtgaatactacctgtattttagtagttaagtatgtgtttttttctcctgtaagagactgaagtctttttgaaagcaagattccttcttgactgggctttgcacatgacatccccagtgtcttatata

SEQ ID NO: 60017 - DNA, 1034 bp, Homo sapiens
attgatttttattataaatttgaactttttaaaatcaaaataacatttttaaaaaacatacagcacatatatatggcatatacataggacttgttcttagattactcatcttagaggtggcttctagtgtcagttttctcatggcaaatgacctcatcccacccacctcagcttccccatctgcacagctcaagtttcaaactagatcatctctgagggtcgtcccagcaatgatttctaatcctcagttctttatttttctaggaaacatattttattgacatcaattcattatttttttaattcaatttaattcttaaatttgcctcccatctggatttgctttatcgatttttttaaggcaatagaagacaatgatgaccctgaatacaaattgttacgggaaaatggatccaagataaaattaccagatcaacctttttattccatattttatggaatatctaatggatgtttggcagtaacttattcttacacacgaattcctgacagtttcgattcttcagacttattaatcagtgtagtcagcaccagagcaattttatgagacttaacagtcatcaaaaatttattatcagataaatcagagaaacaacgagcatcttaataggttagagaaagtggcatgtaaaggatcatttaagatggtgctttttgtcagttgtgcgttatatttacaaccaatatctaagaacttactcataatttcatgcaaatagtcagcagggtgatagttgctgtcttaggtcaaccttttctctttgtttttctccagcagaatgttgtgtttggtgtaactataaggctaagactgctaaatagacacacaataggaagcatcatttcccaatgttaagcctatagcatttattttaatgcagtatctccattttcttctggattttattagagttgtcatccaaaattaagagttactgagctcagccctttcccttgggaacaaggtgctaaacttgagctctttgttttgttttgttgtttcattttttcct

SEQ ID NO: 60018 - DNA, 1023 bp, Homo sapiens
taagccgcatacttcccctttattaaaaagaatccttacttatatatttatcagtgtctgtgtgttgcggatgtgtatttgtctatctttaaactaccatgaaaacatacttttggttttggcacttaaaacgcctatgaacctcctcctccttcccccaccccaaccgcttttttctaaccagttaacccattacctaaatgagaggaataaagaactaaaaaacttaccggaatgttttcttttcattcatgtctatgatcggcgttcacagtgaccttcctcagagcacgtcctcaagttcttctgagtctagggcagagaggatggatgatctgatttataggctctaatggactccaagaggagacatggatacttgaaagaaaacaatgaattcagtgtgtcaacagaattaaaatacttggagatgacttagcttcatgaagatgggaacttgttccattaagcaggaggggtgtggctggtaggatggtgaggtatagttcttcagagattgctctttggagtaacattctgggcattaatcacggccccttcatcatgtctcaggtggaagctgctgtctcttcatctttcgtgccttccacaggggaacttgttggctgatgtcactgagttgccggttaacatgaaattatgagcttggttgggtcgttgaagcttacatcctacatgctccactgtgtttttaaactgtcgctgagttatacaattacctgttaactctttatttgatggtggttgtctcttcgacctcttttatttctttgaagcagaattatgatggaatactcatcacttaagtttccagaaggtagatttttttcccccaggagaggcagtcaagttgaagtcagcacccttgacaagattctttgtgaaagggggtaactcacactttgcacatttccatcaaggaacgtggataccaactgcaagccattttaaaagctgacaagttaactcttgtcaacaagttaacaaaagaggtttgacaaa

SEQ ID NO: 60019 - DNA, 1045 bp, Homo sapiens
ctgttatttatagtaatgcgttttttttgtgttaggactggtaagttgcctaagtagatccttgagaggcgggatagacattttttcccttgagtcatatagttaatttgctttcatttttcttgagtcctactgttaaatttttgaagtacaacagtttatgtccttggtctgtgcttgactgtggagtaatactagacaataaggcatcctttatttatattagctttggtatgttgtttttgcttttctcagatttctccagtcctaaagaaggttatgtacatttatctgtgtgtttacatacatggttatatggaaataattgctttcagatagttgtggttttcttttcattgtttcttctgaaatattcttgttaaacctgagaacaagtgaaaatgtttcatgaaaatgcattaaaatgcattgttaatatataacctaaaaactattggattggtttatttttagcatgaagaattttgaattcactggaatttaagttacagttgttgcagtttttatgtagacttggcagttatgtcacttatacttcttaattatctttgtacatattttatatgacataatatctgcacactcaccatctccagcctctgtagagaatgtaacacatagcaccaaagtaataaaaatataagccccagagcgggaagcaaagctgaaacaagccatttttacatataacttaagtttaggttctgtatagtaggttgatcccttacttaacctttaataaaattggattcaagggtatttatatgtaaataaaaaaataaagttaatttcgtttcatacttccctatgagcaagtgtctagtaatatattacaatgacatttaaacttcagtatttgtcctattggctgaaaaaattcccatacttttttagcaacagggtttgaggttagacattaaaaagggaaggttcttaagatgaatattaagattacgtgatcatatgcacagtgatgaaatcagtctgtatttgtttgacctcttgtctcctatgaaggtatcta

SEQ ID NO: 60020 - DNA, 1765 bp, Homo sapiens
acatttttgttttctttttccttactgaatgagagaagctggtaaggaaacggtgggatgtggccaggtgataggagcgcagacatagcagccattgatgcagacagagcttagagaaggcgtcatcaccacgcatcacactgagcaagtctgtgcggcccctgtgcccatgaggcttacagtgcagttggaaaagcagaccaaagggaataaacgtgaacaagataattgcaaaatatagtaagtactgtgaaacaaaccaatagattctgggagaaactaaaataagaaggagcaacttttagtggagacatccaggaggcgtctctgaagaggtgacagcaaataagttacgttttgggaagcagaggggagaagagggtattgggtaggtgaagaagcgcgacagcccatggtgtgtttgggtgatacaagtgagccaccattgtctgatggaaagggactggaaaagaaactggattgctgtaagaatgattttgaatgacattggggtttttctggtttgtttttgtttttgagatggagtttccctcagttgcgcaggctggagtgcagtggtgcggtcctagctcactgaagcctcaaattcctgggctgaagtgatcctcttgcctcagcctcctgagtagctgggactagaggcatgcgccaccacactcggcgaattttttatctttttgtagagataggttgtcactgtgttgccgaggcttgtcttcaactcctgccgtcaagcaatcctcctgccttcaagcaatcctcctgccttagcctctcaaagtgttgggattacaggcatgagccttacgcccagccaacataattttttttttttttttttgagatgaagtttcactctctgttgcccaggctggagtgcactggcatgatctcagctcacttcaacctccacctccagggatcaagcaattctcctgtcccagcctttcgagtagctgggattacatgtgtccgccaccatgcccggctaattattgtatttttagtagagacggggtttcaccatgttggccacgctggtcttgatctactaacctcaggtgatctgcccgcctcagcctcccaaagtgctgggaatacagatgtgagccaccatgccgggccaccactttttttgttgttactttattttacaatttttaaatacagttgtataaaatttgagccatgagtctgaccattctgagaaggcctacttttgtttctcctaagatgtgccatttaccgttttaaattgtcatcattggctaggggacctggctctccattagattagaggacaccatttgttcacatttgttgatgtcagactactaccaaacaaaaatttttgcccttgtgaccatctctttgactttccagatcaggataatcaaataaaatgataaatacaaataatgtataacatgtcacatatagtttatttactgcctaaggttgttattttgtgtttaaaatgattcttgctactgagtataaattctgtgtacccttttttgatgtcaatttttattatattaatgctaaggaatattagaatagtctggaatttgggaattgatagtagcaagctggaatttgggtatggaaaatgctgtgtaaaccagtagcaagaagtgccaatgcttggagtcaagccagggcccagatattcaagctctatttctttttcttttctttctttctttcttttttttttttttttaaataaattgagctttgg

SEQ ID NO: 60021 - DNA, 1044 bp, Homo sapiens
tctgggtatgatgaagggtgtaggtgtatatgtgactgatttttattcttcatattggggagaaatgaagtttattttgctctcctccctcattctatatattgatattatgattaatagcttttgacaccaaactattttgaaatatgagtcttttatgacgtattttgacagcagcaatggcatgcttttcgctgttgtaacaggagtaaatgacaggggccactcgctcattattttatacccaagtaatcaaccaaagatgtcatgtccagaaataacactaaaatgtcaaccacccaaatctcttgcaaatagtctcattcagagggttggaatctgccttactggcagttttgaaagatacaatttgttgaagacagggagccctaagtgatttctttctctctccgagatgccagatgggtgttgaatgaagtccagtttttagtttttctgtagataatttttttaagtttgtggtggtgtttcggatcttcatccgtgtgttctccctcctctagccccccacggctacccacagcctggcagcggtatggttgccttggtacctgttcctgaaggctgtctgcaatgaaatttggttgtctaaatagcacgacttgtcatctaaaagtagaagtcattagcacgatgccgtttggctagtggtatcttgaatgctgttttaaaaattttcttattttatcactttactgttactgtttactcatgtcatcactggagatttcagggcctgcttcacactatggatccggagtgaaaaatacgaaatgttctccctaagagtttcccagaacttgcgccaaaaacagtggcccgagttggacattttgtatatttttagagacacagattttgaaattccagccgttgttacctcgcgtgatcagtaatacttgcatattggtagcggcaatccatgattgaacagccttctgctgtttctgagggaaatgaaatttctgccagcttctgtttgaactttaattggccttcactgtggtcgtgaatttgccagaa

SEQ ID NO: 60022 - DNA, 1029 bp, Homo sapiens
tgagacaaatcatgattcactacaacagtgttgcagtcagttatataaattgccaatgaaacactaaatctgtcactttgtgtgttccgacagtttagcaattggagtcgtgttggaagagggctgactgggaacaaaagaagctgatatagtggcagatgcaattagcaagatcaatggttagtgttaaaggttcattgtttggtcattttggttgactgaattgaaagcaattgctatctaaaagactttgccagctgtaatttgctataagagaatgcagaaaagttagttgcccaactttataacatcttggagactgttatttctcaacttgctgtgttcctaggacagtgaccaaaagattcagcttgttcttctcattcaagctcattcaagcttttaatagatactctagaatttctgcatgttcagtatatatacgttttttactttagctgttcacctacttctttcacaaaaatttttgggtccgtgttatagcctttataacagttctttgaaccctaatttattacagctttctgttgcttcagactatgagagttttcgctgatcactacttgaactatagcaaacaccactttgaataacattgggttttctgtttttgtttgtttgtttgttttgcgacagagtctcactctgtcacccaagctggagtgcagtggtgtgatgtcacttcactgcaccctctgcctcctgggttcaggcaacactcctgcctcagcctcttgagtagctgggattacaggcacctgccaccacgcttggctcatttttttttttttttttttttttttattgtcgtagagatggggtttcaccatgttggccagactggtattgaactcctgacctcaggtgatccgtccatctcggcctcccaaagtgctgggattacaggcatgagccaccatgcccagccgggttttctattttaataagatttatataactttgcatttcagtgccttaaattgaccagtttttagaaatgaatatagg

SEQ ID NO: 60023 - DNA, 1117 bp, Homo sapiens
ctgccgctacgtgaagaaggacatgtttgcttcccctctgccatgattgtaagtttcctgaggcctccccagccatgctgaactgtgactcaattaaacctcttccctttataaattatgtagtcttgggtatgtctttattagcagtgtgagaatggactaatacattgcccaatatctagaagcatttctattatacattttgtccagttacttcagaatgccagaagcaaaagtctggattaatttttgataactgccaatgtggaaaggtataattatttttctgctcttttcttacccatttacacaaccgccagaggttatttttgctcaggtcattccctcaaccctgcattcactggctggattccatagcagacatagcggtattaggatgcatatcagacttcatgttatgtacacatgttctttaagaccattttcatctttattcttggtattaacaagtttttaacccctagaataatttcttggtctttattgctttttaacttatctgttaatgcactattatagccgagaccaactgtattagtttgctgggtctgccataacaaagtgccaaagactgggtgacttaagcaacagaaataaattttcttgtgttcgtggagattagaagtctaatgtcaaaataacagaattggtttcttctgagggtttaagggaatgattttttctagacctcactccttggcttgtgggtggcccttttctccctgtgtcttcactgtgccttccctcagtacctgtctgtgttcagctttgcccttcttgtaaggacaacagtcatattggattaagatccactcatatgacctcattttaactaaatcatctctgtgaagtcaccatttccaaatagtcacattctgagatattgagggttaggatggaattcagcccataacaccaaccatttctcatgtttcttactttttgctgctgagccttggtgtaaaacttgatatcctgtgatactgttgcattgttcacctgcttattcatgtcatcattctttttcattattgcaacaataagtcaagttaccttaagccattatttttcatcttttcagaaatctttgagaaac

SEQ ID NO: 60024 - DNA, 1033 bp, Homo sapiens
gaactcctgagctgaggccgtccttccaccttgtcctcccaaaatgttaggattacaggaatcagccacccacctggctaaatcttttaactatttccttaagaaaagatgtagtgcgattattaactatgtctagaataagcagactccaaatacataataaaaaagttaatttttttagactagatttttgtttcggggtaattaccttccccaacccaaggcagctttatgttgttaacagaattggttttcttgcctaaatcctattactatgaaaagaaggtctagcttaatagatagagcagtaagtgacaaggatgttctttatggaattgtaaactgtgccactttcgcatgaataagattgactttgtcaattgatcactaacatttttcagattagttttaagctagatataattacagacatatcttagtttttgtgcagaatatcgtaatttgcagaagagtttcatgcacttaatctcagttgtataatgtaggcaaggagagctctctggcctctttttaaagatgatgggaccaagggagattgtgacttgcctaaggccacgttattgacatggcttattatagacagaatccagtttttagttcagatcttcctaattcaaaaataagcattcctcccaatggtatacccatcaatgtgtcaaaactgagccaataaaaaggcctaatttattattaggtgacagattgctgtggttccaaatatatgccttaattttatttgaaaaagaaaatgttgggaatagaatatttgtacccaactttgaattttgacttggattttattgcatgctcctacgttttaattctgcattaatatttcttttgccatacttcacaaaaaatcataccatatcctttgattcccctggccttcactgataatcaaaaatgactcccgtcaagtctcctacatgatattttttaacaagttccattttatatattctatttcagtgaaatctttagccccagaaaatgttttcagcatggattt

SEQ ID NO: 60025 - DNA, 1018 bp, Homo sapiens
tagaagagaggacatagaggatgagagtttctgtggagcaccttttaatgtgtaaatatgttgacaacttgttttcttctgtttagctcagccttagggataacgacctgatctcgctgcctaaggaaatcggggagcttacccagcttaaagagctccacattcaggggaaccgcctcaccgttctgcccccagaactaggtaaggttgctgatgaatgaacttagttctgggtttcatgaataacaattatcctaatgtagcaattctgaacaacctctgtcctcttcttggcaactactctccacctaggcacacgatgctgatcatttgagaaccatttgtcattgaccagagttagctgttacaggtttgaccttcccggatcctgtgttctgcagctgtagtgtcccctgtcttagaaactgctgatgaaagatgaccccgctcagctccctgcgtgatgtagtgggaaaagcatgggattagtagtaagagccttatccctggctcctcattgactagctgggtaagctttctgggtcttggttggttattaataactttaagtatcactcttactttttaaccccttaaatttttattgacctggaaaaacttttaccaaatagttaaagtagttgttatggctacttgaacatgttgatacctctgcgggtcgtgaatttgcctctctcctgatcccatctctagtaggaattgttaaatatgttcttgctgggaatggatcctactcctggccgctgaatcctaatcctgtttctctgccaggtcgttcctatttccagggtgggtttatgtcccccgccagaaataacctccaagccagtaattctgttactgcttcgttccactgcaaaaggttcacgagttcccttatcttttcttgtgcagaccctccatagcctctcatttcttcagtcctttgaaccacattgttttctcaaactgcgattatttgcttttctactccaaaataccatcatttttaagaaac

SEQ ID NO: 60026 - DNA, 1050 bp, Homo sapiens
tctttgtcattgtaaatattaaataaatgctttttttaattaaaaaaaaaaaaggatgggcatgggggctcacgcctgtaatcccagcattctgggaggcctaggtgagaggattgcttgagcttaggagtttgagaccagcctgagcaacatggcaaaaccccatctctgcaaaaaatacaaacattagcagggcgtggtggcgtgcatctgtggtcccagttacttgggaggctgaagtggaaggatcgcttgagcctggggaggttgaggctgcagtgagctgagatcatgcctctgcactaaaacctaggcaacagagtaagaccctgtctcaaaaaaataaaaaataaaaataaagtataaagtgactctaggatcatggcactgtcttacactttcagcgtctgaaacagaggtgcccttgatagtctgtatgaatgtgtctttggtgtcatgacatagatttttgtccccctgcaacagcatgaacaggctgaacactttgccacgaggcttcggctccctgccagctcttgaggttctggacttgacgtacaacaacttgagcgaaaattctcttcctggaaacttcttctacctgagtaagaaactttcaattctataaatctcctcaaccttgtactttgcgttctgagagggaaatttatttgccaggacccaaactccaagagaaattattggacagagataattttttctttagagactccttttgaatattccttcgtagctcagcagtatgtgcatttgatagatcgttatgtgacaccattgggctgaagtggacttagtaatgtcatattaacattctgagagagattatatacctaaatgagatcaagcctcacatttagctaagagacttgactttctttttaaatagcatgccaaaaaaaaaaaaaaaagtatcttcctatgttgctattaattctttgtaggatatttgcccaggatattccaaccaattatttattaaaaatatttattaataaaccagtaacacaattttaaaattttccagccagt

SEQ ID NO: 60027 - DNA, 1050 bp, Homo sapiens
ggtaggtgaattcgatggcccttttgaagttatgtctttctttgctttgaaagaaaaacaaaatgtgccgctgccatcccttgctaggagttccattcccagattcacactcagcatttttgtttccatagtggtgccaccgaacatcgcagaactgaagaatttggaggtgctcaacttttttaataaccaaatcgaggagctgcccacacagatcagtagccttcagaaactcaaacacctgaaccttgggtgagtatcagtggagcggaaaggatggagaggaagagagtggaaggggcatgccgggtaaggccaggggagggattccttttatattattgcacagaaatggatttctaatttctttttatgttttgggtcttaaaaaaattttattgttttaatatattctttcagtggcctacattagtgcatatttgagagctaattgagaggctaattgttggcgcaataaggaagttaaatttttattgtattttctgtccagtaaaattttatctcagttctgctgaccgagaagggacttatttgcatagcatgaactggcggacaagtggtaatatggctgatttctttttcctctctgtgttaaattggaatagtttacaaagcaccttcgtgccgtggagggaagaatattttccctaatgatgcttcattcatttatgcaattcttctctttagctgagaggtgacagtcctgtctttctttatgcaaaggtgaagagaggagttttgattcagctgaggttgcagaaccagggagcagtaaataataataatgataatctatttttgtgtattgctttgcagcacttgaccctctcaacatttgtgaggtacggagggcaggttttagtgctttcattgtatacagaggaagccaagccttttcaaaggggctaagggcctggctcctggtcacccctgaggttagcggccaagctgggaagatggttctgggtctgaaggctccttcagaccccattgttatggtctgggtctgtgtccccagcaaatctcatg

SEQ ID NO: 60028 - DNA, 1078 bp, Homo sapiens
tggtgattttcttggtaatcccttacacacagtgaataccattcatttacacagaagtgttccatggactgtgcacctaagaaagaatgtacatttgcagccacactgtacaggtagggttcatttgcattcctgcaggtatcccagagggagggttctggaggaactttgagctgtctagattacccgatgaaaacttgttcttttatcaacggccacttccggagctcgcgcaggggccgctcactagaccactgctccctgcccgtgtgccccagttcagagtaatctgtattcttcacagtcccttcttccagtgaaagcatctcttttacctttcaccaagccttacctctaaaaggccagtgataccttagacatttcagaaagctcaaaatgatgactcaaaactataataagcaacgtgcctgtccctttacttttgttcccctgggagttatcaattggtcgtcttgaaatggctagctgcttaaatattttagatgtatgtttggcattttacacacacctttgtggtggttctaatcacaggtgctcccgggtctgagtttaggtctgactgcaggaagcaggttggtctcccagcctcctggggcacccctggaggaagcagatgggatgggaagtaaacctgactgataagagacatcacactttctcaggctgagttccacgcccctgttcatgttcttagttatctggatagtcttggtatcagagtttacgtgaaccatggccaagcttatcacccacagaaatgtttgtagaaagactgaatagcaagtgggatagatgaattacagtctatggaaactcctgctgctgccaatttacagtttgtgcttttaagataaagatgcctttggcttttacatttgtattttcaaatgtatatattctagggaaggaggaacctttcaggtccccagtggctgattttcacctttgatctgaatactagtattcatagcatgctactgagttgactttttgtatttctatataataacagtgtatcgatctcttgctaatctgatgtaacctttgtgtgtgtata

SEQ ID NO: 60029 - DNA, 1012 bp, Homo sapiens
gtaaaacttttcaaaagtgtgggtctctgaatgtaattgtttagttttatacttttaactgccatgtaaaaccttttcctgaggtattggcagttttgcctacaatttcaggtcttcactgtgaccatatctcatcatttaatgcatcggaaatggccaggcaggtagtaaacctaagttttatggcaaaatgtgggttttttttttttaatatacactatttcctattagttacagcttatgtatgaatttagaattataacaaacaagaaatactaagataccttctttggtggtttcaataatttatttatcaaagataatattctaagtacatagaatttaatacttttaaattttatgcagatgtatacattgattatctaccataagtcatattataaacaaattaagcagcatatttcacatgaaaatactgcattcttaaaatttgtagatccaattataatgaagaaaatttagcagtttttaaaaagcataatacattgaaacctttttatgcagacataatagattgctgggatgattgagaagaattaactgtctgaattcctgaggacgaccttcaccactcttctcagaccttgctgttcttaagtctgtagttattccctccttcatagattatttgtcatgctttatgcaaaagttcttgtgcatggcttgtatgaaattaaaccatgaggggggaatatgtaaaataaatggtctctgtgtcatgaatttatcttgtgacaatatcaaaacaacttgctgttcgcattttaacagagtgtaaatgtgtttataatacagaggctttgatcaataacttatttttttaaattactgcacatttatcagtttgcttctctgccatcattaaaagatgagagttaaaaaaatatgcatagtatctttgagtctaacagctattaattaaacaatatctatctgatggtaccggtagtcaggttaccataaaaaagcactggcagttgggcatgtgttg

SEQ ID NO: 60030 - DNA, 1040 bp, Homo sapiens
ttaaaaacatctttcagatcactgtagtttatttctttttacatcttcacaaagatagaaatctcaggagtcaatggatcagtttcttcctccaggcattataatattaggttaatttagaggagcatatttatatgtggagttacattgtgttggccattcaggagactgactgtgaaagaatccaaactttatatttctgccttgccagtttttttttccttttcttcactccatttgagacactcttgacctaatccagtaaactctaattaatagtcttggtaaattctgtttcaagccatcctgagtagcgtcactgacacccgatctgtttcagtaaggtcaaattagcatcctttactatttttctggcatttaaatgaatgactttgctatggtttttcaagtgtttatagtaaatatgtccatttgatggaaatataaatatgcattaagtgtaagtggctaggcacaccctgctgtcactttttatggtaatcagtgtctttcactttctgttgtttttaatagggaccagctgacaacgccacattaaaaccacagggactcaaaagataactcccccaccccctcacccggcactgcttttatcttgcaaaagtattcatgtttttctcttagtatgccaattacaccgttctctgacatttccacttatgtactcatggaaggaatgaatggtttactcaaactgggacattgatttggggacactgttgactccactgacttaagatctacagggttattgaaacagtgtggcacgtggttgacttgccttttcttgccagtggttttggccttgacatgtctacccagggcagtaaaagtgaggcgacaaggaagctgaaagtgggatctgtgattctgaaattcctcaagaatctgggagcagaaattcctgaacttttaaatactgcagttcataaaaatattaatgtattgtcaagctaattgctgttaatgctccaagactattatggtgcccctatttgaatttaaacctgggagcttgg

SEQ ID NO: 60031 - DNA, 1060 bp, Homo sapiens
tctcaggtgtttctttatagcaatgccagaatggactaataccgatgaatgaatcaagaatcaacaaatgacaaatctccagcctgggcaacagaatgagaacccatttctaaaaacaaaacaaaataaaacaaaaaaacatttaaatcaagcaagaatggtgctgtgagcctgtggtctcagttgcttgggagtctgaggtggggggattgcttgagcctgggatgctgaggctgcaatgagctgtaattgcactactgcaccccagcctgggcaacagagcaaggtcatgttaaaaaaaaaaaaaattgtacatagagggacataatacaaaacaattgcccctgcaatcttcacaattgccaaggtcacgaaagtcaaggaaagagaaattctcagcttagaggagacgacaaagacctgacagctacctgcagcgtgaattctcaaccagatcctatttcttccctaaaataaatgattgggacatttggagaaacttgaatgggggctaggattagatggtcctcatgtactgggttaactgttttaatggttgtattgtggttatgtccatttttgcttgtaggagatataccatagactttatggggcatcaggccagcagcttaatctcagtggttcaagctgggaaaacaggtttttgtattgcattttgaacttctctataagtttgcaatggtttgaaaaaacaaaaaacaaaacaaaaaaaaaaacatgcggccggactcggtggcccacgcctgtaatcctagcactttgggaggccaaggtgggaggatcatgaagtcaagagatggataccatcctggctaacatggtgaaaccccatctgtactaaaaatacacaaattagctgggcgtggtggcacgcacctgtagtcctagctactgtggaggctgaggcaggagaatcgcttgaacttgggaggcggaaattgcagtgagctgagattgcgtggctgtattccaaactggtgacagagtgagactcagtctcaaaaaaaaaagcaaaagttgtggtcagtagaagtgatgc

SEQ ID NO: 60032 - DNA, 1035 bp, Homo sapiens
tttttcaggacacagtgcagaccggagaacggtaatgtggtttgcaatctcagtgtttgaatggtggtctatgtaacttggtgttcttaacagctgtaagtgaggctgggcgcagtggctcatgcctgctgtaatcccagcctgactcatgcctgctgtaatcccagcgcttccggaggccaacgtgggtgggtcacctgagtgaggtcaggagtttgagaccaccctggccaacatggtgaaaccccctctctactaacaatacaagaattagctgggtgtggtggtacatgcctgtaatcccagctacttgggaggctgaggcaggagaatcacttgaacctgggaggtagaggctccagtgggctaagatcacgccattgtactccagcctgggcgacaagagtgagactctttcaaaataaataaataatgaaacagctgtaaatgcttaagtctttagggcgtgtcaaagatgcctatgtaatttattatatgtttgtattctacaacgttgtgcactctttgttaggaggatgaaaataatagataatatgattgaaataccatgccatctatgcatggagtgtattaatataatacacgcacacatttaccacataccaggcattgtgctaagccctctgtatggattaatctttcaaacctcacaatgtattgtcattatatagttaataggtaaggaaacagatttaaggagcatcattaacttgctcaaagtcacccaggcaataagtggtagagcccagatttgaagccacacctgcagacgtcggaagcagtgttctcagcttctcctgttttgccttactggtttctgacagtcatatgcacataccctgtggaggagatgaagataacggctaattcagcgagcatgctgagtgcctgtggccacccggtcatgttctagaagccatggtagctgtcctgtctgggctaatgattctgtaacaatttaggaatgcattcagggacactacctatgtttatcccatttgaaccagggaaaca

SEQ ID NO: 60033 - DNA, 1052 bp, Homo sapiens
accccacggtttgggacgctgattgggccgaagttggcgcgtgcgcagtagacttggcgcaagctcagttgatgggtcgaagcccagagggctgtgggcggaagtggggaagtttgtggcgtgactgtgtaagggagggtggtggctcagggtgggtgttgcgaaagctggaagtaaattgcttccgaatgtttcgcttgtgtaatagccgctccactcgccagaagttgctaccctgagcccgtctccacaatgtgcctctgagggaccttgtggggcacgcagtttcccgccctattaagagcttctccaggcggggattccggcgcggtctgcgtttccccagcgccctgctggaaatcttttttgacaggtttctaaggctggcttttagcctttttacttgtagctagaacctacaagtaaaaccctactattttaaaagtcatttgaaaacaccactaaagcgatgtgtctttcccaactaggacttttacatttgtgaaacatgacgttctggcttccaggaatctcttgctttctcttccaaaagcaaccaaattttaaattctagagaaactgttgccctctgcctccctatttcctgacccagtctcagtcacccagcaacatcctgtgcttctctcaccaaaaaccctgtcctgagagactattttatactatggaataaaaattggcaccaggcacttttcttctactggtcacctaaattgatgataagacggatgccacacatatgcatttatatattgtagattgtagcagggatcaaagccttaaggagatgtggtaaaataatgtaattatatctccgaaccaattggataaaaaaaggatctgcactcttaaattcgaaagcaggtatttcttgcttaaaaaacattccagatgaaagagttattcctccattagtcttctttgatctggaaccgtccttggcttttatgtttattgaactagacattatttaagaatacagaccaggtattgtgtggaatatccttcaaagtaagtttgatgttccctttcag

SEQ ID NO: 60034 - DNA, 1080 bp, Homo sapiens
atgagaaaggtgtaatagttgactggaagcagagcaggcaacattgcccccgcccatctccaccttttaaaaattcactttacctacattctccagaatgtttccccaaaagcaaaggctgcaggatcacagcacaaactacggtataaaaaagctgcctggtgttttaattgctgtaggttaacaggtatttctgaatccaaatgcaaatgttttttgatctacacgtggaacatttttcccctttgcaagtgaaggtgacttctgcatgtattttcagaaaacgcttcattcttaactgtataaaaagacaaagcttttccgaccaatgtcatcattcaaattgtctccattttaatgtatataccttagagaagaaagtgtaagtttaataatgaatgactccttcctaaaggtgagaaatggaagtaacagcaattcaccattactgggcaagtactgtggaactctgctgccaaaccctgtcttctctcaaaataatgaactatacctacgatttaagagtgatagtgtaacttctgatcgtggatatgaaatcatctggacttcatcaccctctggtaagacatttgcactttgtacaggaaagcactgtgagaaaaacatgaggtgtctaatagtaaaaggcaaagtaactttatatttttagctacctgtgtacctgattagtttatgttaagaatagagattttaacattgaaagtacagattacttttttttttttgaaatggaatctcgctgtgtcatccagcctggagtgtagtggcgtgatcttagctcactgcaacctccacctcccaggttcaagtgattctcctacctcagcttcccaagtagctgagattacaggcatgcgccaccatgcccagccgatttttgtatttttagtagacagagcgtttccccatattggccaggctggtctcaaactcctgaactcaggtgatccaacctcccaaagtgctgggattacaggcatgagccaccgcgcccggccagattactttaaattttacatttattcattatttctgtttataaaagaatatatattcata

SEQ ID NO: 60035 - DNA, 1061 bp, Homo sapiens
atatgatactaatattgctccctttccatagtagccaattccaatgtaaagttaatataccttacacattgtattaagttaacagtaactttatacattgacttcaaggacttcatcattaaaaattcctggaatggttttccttttacaaaataggactttatacatggttgtatgttttgcagaaacaagtttttcccataggactcatgagtagaaataacctttcacagtgaaaaccgcttttctttttttaattgctagttttcctttagatcatagctatgttttggtttttcctttttaatgaaggagtatggcaaaacttgattcaaaacatgttttctggaaatgttagtgttgctttctaaacttcttttccaaataagatacaaatatgatttatctatattcagtatatactttctgttagtttattgaatgtttttattaataaatactgtaaacactaatccatgaaataaatcatctgcagcctgatgacaatatagctatatgattaataacgtgtaataacttgtacaaatacaagtaaaccacaatttctatcttttaatggcaaccccataaaggctaatgaggttgttttcgtaatgttgactggacattgttaatttctcttatttttaatgcaacttttgacaatttgtgtatttttatgtaatgccaggtactgatggagttccccaaaattgaatctgtacatccacaaaaatatgcaatggatgtagaaaataaaattcaagaaaagaacgttgaaccaaatattagctttgatggcagcatacagtgttctggaaaagatgccattctttttaagcttgaaactgcagaagaaattcacaggaaaaatcaacaagatagtgatctctctgtgaaaatgctaaaagattttcttgaagatgacactgacgtgaaccagtatcttttaccaccaaagtcattgctgcgatatgctcttctgttagacattgttcagcccacttgtagaaggtccgtgtgctttaccaaagggtaggttttaaagatctattgatcct

SEQ ID NO: 60036 - DNA, 1083 bp, Homo sapiens
tattatcctcttaataggtgaagatactgaggcttaaagacacaaagaaacttgcctaaatcacgcaactggaaatagccaagctaggatttaaatgcagaattctagcagagaaagagagaaagaaatacacaaacagatatccatattctaaatcttcatcaggacgtatgaacacacacacaaaataaaaaattccataagactgtccctaagatagctttgataaaaaataaaataagaatgcctaatgctgaatactgtgtggcttagtggaaaaagatttgtagagaatgatatagttaggaggagacttggaaaggggaaatgagtgaggcagttgaagtgcataggtcttatgacaagcctatactttctggcctagtgcaaaattgtaaaacttaactctccttttagaggtatctgtagcagaaattatactgctagtgttttgcaggataggatttgaaattttattgagtcaataatgatgaaaattagaagctttcaaggagggctaactataaagcaaaggaggctcagaatgggaagacaaatttagagaggattttcttaggctaattttagggatctttgtgagttaattattatatatattatactatatgttataaaatattaaaataattatatttttacaagtctttaaaaaattcagttaactagatatagagtactaatgtttatgtcacttctcattttttcattgacttttccataaatatgtcagaaatgatcacctcataagttatgagaaagcatcagtaaagaggaccgtaaacattttatagtaaggaaccattcatgagtggtcattcactcaaaacaaatgtatgtaaaacaaaatcaaagtctttgttgttcacacctgtaattgactgcatcacatgtgtttctattatttcttgactttttaagtagtttatatcttttgacttctataagcatgtgaataggttactttcagctctacattttttgggcgtatgctagctacttgatgatctttagaagactttcataaggtagtttaatttttagtttttcttttgattattgttg

SEQ ID NO: 60037 - DNA, 1015 bp, Homo sapiens
taaactagttagcggtagaactggtattttaacctaggtctacctacctgaccttttaactatgctatgttgccgttgttctggttagaactactaacttccttggatctatacattaaataatataataagcagcacaaaaggaataatattgaacttcatttttgactgatttctagataaggttcataatggaatttttttattgtggtaaaacacaacatgaaatgtatcatttaaactatttttaaatgtatagttcaatggcattaagtacattcacaatgttgtgcaaccatcacccttgttcatttctaaaactttttaatcatctcaaacagagctctgtacctgttaaacaataactccaaattccctttccccccagtccctggtaaccttgattctgctttgtctttatgaacttgtctactctgcgtaccacacataagtagaataatacatttgtccttttgtgtctggcttatttcacttagaataatgtcttcaaagttcatttattttgtagcctgtatcaatatctcagttctttttgtggttgaataatattccattgtatagctgtacaattttgtgtatccattcatctgttgatagacacttgagttgtatcaattacctgctgaccattgtgagtagtgctgctttggatattggtatataagtattgtttgagtccttacttttaagttttggggtatagacctagcagtggaattgctggatcatatgataatactgtgtaactcttgaggaaccaccagcctgttttccgcagcagcggcacaattttccattgcatgagcactccgtttcctctacctccatattctccacttgttattccattttttaaaaataatagccattctgatggatatgaaatcatatcctattgtggttttgatttgcattttcttaataactaaagatgttgagcatcttttctttttctttctttttttttttgagatggagtttcgctcttcttgcc

SEQ ID NO: 60038 - DNA, 1001 bp, Homo sapiens
ttataaaaacagcgccctcggcggggtccagtcctctgccactctcgctccgaggtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaagtaaggctgcgcccatgcaagtagctgggcctcgggagggggctggagggagaggggaacgcccccccggcccccgcgagagctgccacgcccttggggatgtggccggggggaggcctgccagggagacagcggagagcggggctgtggctgtggtggcgcagccccgcccagaacccagaccttgcagttcgcatttcctcctctgtccccacacattgcccaaggacgctccgtttcaagttacagatttcttaaaa

SEQ ID NO: 60039 - DNA, 1060 bp, Homo sapiens
tttgtagactctcttcccactcgcagccgcctgaccccacccaacacaacccacgagcaattctaaaagttgcttaactcacgtctaaaaagtgcaaaacttcagggctgcgcgtaaagccctctagtggcgggaagaccacaggttggagcttctcatgattagaaaaatattaataaaaccccttgagcgattttttttttttttttgagacggagtcttactctgtcgcccaggctggagtgcagtggcgagatcttggctcactgcatcctccgcctcccgggttcaagcgatccttgaatgatttctaagcagttccttgggacataaagaaaaatcttttaactttttactttgtttcccaaatgttgcacagttttgcaacacattgaccttctggtttcgaacggttacaattttagattgtggtttgccaaagtcaagttgcttaatttttacaaggccacaaaaagcgcaattatgccctgcagtttaaaatggaaaacgtgttggaagataagaaaacttagtttccaactggaatggagccagcaagtttcttttcttctttgcaaattctattgtgtcattaaagttcgatggaagtatcactatgcacaactattttgtgatctaataagggtgaaaaggagccatctgtccccttggctaaggggtattaatggtttctatgggcttcactatggaatgtagatacagacattctggcaaatgtggtggctctggacagaaataataggagtctttgtattcccagggaagctttgcaacaggctacattcttactgaatatgtaatgatgtaagcacggttctaattggacacaagtatttgctaacatccgttatctaatatctggcccagacttgagaagtaggtaatgtaaaaagtttttaaagctacaagcatacctcacattttaaaagtcctttcttgattgggttcttgtgttctttagcactcttgccataaaaaataataacagtaataaacccaaggctgaaaaactgaattttaactaaagggtttttgtgcg

SEQ ID NO: 60040 - DNA, 1287 bp, Homo sapiens
cccagctaatttttgtatttttggtagagacggggtttcgccatgttggctaggctggtctcgaactcctgacctcaagtgatccacccgtctcagcctcccaaagtgctgggattacaggcataagccaccatgaccagccttaaaaagtaattttaaaatatcactggtaaaatgtggattcagtcatgattgagtgcagtttaccatgtgtgtggacatttatttattttaaaattgtctgatcaccaccttgagtaaaacacaagcagtcacaattaaaatatattagtgagcaggagaaagcacagcatattatagcactgaatgatttataaacctattccagggtcataaaatgtgtcaacggcttttctatagtaaggagactaggttcagatggttaatctaagacaaataaatgagataagccatacacttttacatcctccatgtcctgtcttttctctgttcaaaataggatgttgacaatgcgtctctggcacgtcttgaccttgaacgcaaagtggaatctttgcaagaagagattgcctttttgaagaaactccacgaagaggttagtggagtgactttcggggaatgaatgagggtaaggcagcccccacggttggcagagctgaccgtctgtctgttctttttgcaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaaggtaggaaacaaatcagtgcggcttcaaccaaagaaaagcattgtgttctcaaaaccccatacctgtgtgtgattcctaaatatcctctagctccaatgcaaagctggctttgacttcttgctcatattgtgtttgccaccacagcctccccaccactcacatcacctcctttatttatttatttattttcttatttatttatgagacagagtcttgctctactgcccaggctggagtgcagtggcaacatcttggcacactgcaacctccgcctcccaggttcaagtgattctcctgcctcagccccctaagagctggaaccacaggcaagcaccaccatgcccggctaatttttgtatttttagtagagatggggtttcaccatgttgaccaggcttctctcaaactcctgacctcaggtgatccaccctcctcagcctcccaaaatgttgggattacag

SEQ ID NO: 60041 - DNA, 1034 bp, Homo sapiens
cgccaggcaaagcaggagtccactgagtaccggagacaggtgcagtccctcacctgtgaagtggatgcccttaaaggaaccgtgagtaccaaccctgcagtaaaagagggaaaataatgacccattctgctgactaggctcatgatgatacctgaacaaaatgttgagtgagtaaaaatgtatatcataatgcaaagaaaatgagttatcaagacagactcaaaagggacttcatggaactcttgaaggttttagcttgcctatatcattgcttctaatatgaaggacttggtactcgcattctccacctaaaattagagtggtcgccatttgccgctaatggaaattattgcagaaggtctgtaaatggttctgggaacagctgggtttttctgagaaataacaccagacatctttctcaccccctgcagaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggtagggaactcagacttggatgcgtgaactaatggtgaccatttgttaggccctgtgccactgggctctaagcagtgtcacatttaatctttagaaagtttctttgaggtaactgctttccactttttgtagaggaggaatttgaattgagagagagtaagtgacttgctgaaaaagggttaatcaacagcagagctgggatttgaacccataactctgtcaaagcctccactcctaactcctgttcatgctcctgtggagaaaatgcttgtagtaacatattttaaatgtactaacaagaccagtcatgggaaaatgtttctgagacaaatctctagtttatgatttaaaacagtacgttttcttacgtgacgaaaacaaa

SEQ ID NO: 60042 - DNA, 2122 bp, Homo sapiens
catctgtttataggatttctctgcctcttccaaacttttcctccctgaacctgaggggtaagcattttatttccctttaggaaaaacgtcagctgcttgtaaccactgtgtttatgtcaaagcattcattttttttaggatatctgaaaaaatgccatataagagaaaactctataaaacatctataattttcgaacccaagtacactcttgcattctatgctttaagttaaatgcaaactcctttttccttcttcctgctgcaagtactatctcatcctgatgctcaagagtgtcagggcctgggtttccaaacagagactaccctaaaattatttggcgagtagtactttacacaattgcctctcccccacaaatcataattgtttcagtaaaatggttacttggtttttccaagaaaaaactcgtttttactcatttttggcctgtttgtttatttagaaactaatctggattcactccctctggttgatacccactcaaaaaggacacttctgattaagacggttgaaactagagatggacaggttggtatcttttaaggaaaaaatagggtaatctcagacaggagttgatatattttaaaatcagtgaatctgaatctcagatacagctggctaatttgagaggttcaggtttcattcatgcctactaaaaaaagaataggcttcttcttccagcagtacacacagccaactaattatttggctcctggatgtgaagttgagatagcagtcttcctgtgctccagaattagtgatttgctttggtgcttaatttgaagtgggagtaagcttccttaaaccacttcctaaagcagctacatgaaacagcttcactagactacctcaatatgaggaatgttttgatcctggacatatggtgtcttcctacctccatactttatagattcctaaacccatctatataatacaagcatgtgccatacgatcatttagtttcttattacctccctatgccaggaaagaaatagttgcaatttattgtagtcatcatgaaatcttcccttgcacataaatttaaaatgtacctgctgcacattttaatatgtcttaattgcttttaaacttggctgtattgtgtacaactattataccatcttttataaacacagttttttaagaaatttctttttgtaagttacaacattccactggatccttatattgcctgtagtggaagagggtcttgtgtgtctgccccttctagttttcactcatgcagaagcaacataaccttctgatttgcacaataaattacatatatttagcaggatttttatttgccgtgatatataggataatttagtctttggcatgtggcattatatttattttggtttttttttttaaacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttggaaaaactcttttgttgtgttatttattggataatatctaaacaattctctacttggtcctattagttaatttgtcattacaatcatgtaagttgataaattcaggttatttatgcttgagatgtagttcttaattttgtcatttttgatagacctcacttctttttattattacttaaaaacatttacaaataggtggtgtcgaataaaataacttgtaccaaaatgaagataggtctctctaaaatgagctcaggtctgtgattttaatcataacaaacagacttcctaaaattaaaaaataaaaactttttttagtacatatagcatatgagtaacacaaattccactttgggagttaaagcatagg

SEQ ID NO: 60043 - DNA, 1466 bp, Homo sapiens
taatataatgcagtaggtgattaacaatgtctccaaacaccaaaggaggtggctaaagagtattttgagatgagccccaaaatttggtttgaccaaagcttccccactcattttgcaatgatggcaagtcattcaatccttctcatcttcattttttctccttataacatggacaccatatctgactcatacaaatttttataatttatgaaaattattggcatggcctttggtgtgaggtagggactcaaagaatatttctttcttactatttataccagccatctccaccttcaccagaccgataataaaagcatgctttcttggagatctcttctaaagagaatagctgcattaccagtatccattggatttctttctgtggcaggtctctatcaataatatccttcccatttttctgtctcaaagactgcatgcaagaaaattatatacttaagcaaaaagttcttgatcattcgggaatgaaattcttctctgagtatggcagtatgcctgcttctgattaaattcacttttaatagtagctgtgatgatattttggttgaatttaagccatttattttcctcttatgtctacatttcttcatcacttaataattttattttaacttcctgcctcattcttacacttttttctctctcacttatacgatatacttcaaggacgtgaacagttacaatacccagtctttcttacctgttgtcttgcctgtggggtcactcactcaattttattttaaaattactgaataactacttcatgccaggccctgcaccaggctctgtgagaggacaagaaggattattgcctcttgtaggagaaaacagatgtgcatatcattaattatgatggggtatgataagtattacaatgacaaaagctatgaataaagtgctacaaggaacagaagcagggataattaaatccatttcagtggaatctatttcaatgtacaatagtctcccctaatctgcagatatgggaagaccccctgtggatgcctgaaaccattgatgatattagaaatatgtaattgattagtaaaagtaacaaaatatactgaaataattaaatatacaatgtggggactttatatgctattttaataaaacttacatatagttaggacatttagagcttacttttttttcccatataatatcctatcttaaaaatttttctttagaacatcaaaacagaatctctagtatcactgatatggatttcagaaatattccaaatggtgtgagatcaaacagcatagtgatacccatgttccagtaaaagcttaggagaaaaagaatgtttgcgggttttcttttgtggagaaaattgtagacatttccaagttaacacatctgaagtttctggttcgacatctgtgttgccatcctaaaagcacgtgtgaaattttacaacaatcctacctagattcacgttagcc

SEQ ID NO: 60044 - DNA, 1080 bp, Homo sapiens
gaccctgagtagtagtcagaggtcaaaggacaagaagagaggactgtggtggaagccaggtactaagtgagttgtcagtggttcaaataccctcaggggtcaaatggcaaatgttgaaatagctcttggacttggtgatgctttccaagaatggtttagtggattttcaggtaaagaaaaaggacaagagttggttgcactttgaatgaaaggtaaggcaatagatggaggaacacagcagaatgggtgatttcgtttgtttttgattttgagatggaattgagctgggaaaggactgtggtagggaaaggggaaatattcaggagagagaaaaatcaagggatgggctggatctcagaggagatagagagggatgtgatggcaggtggattattcttttgtgagaggggaggcatttctttctctgagaaggaaagtcagggtggcttgtatttacaggccaatgctcacccagctgcaccatgtttctctgaaaaaggagcacagttaaatgagaagttaggagtccagagaataggcaaagacaataagaaacagtggatgcctagtgtagccatggagggaactgggcatgtaatagaattgccaaggtatataaaaggccctacaaattggacactatgaatttaccaaggcaccaaaccacccgcatgattttttttccagcactcctcatgagtcaggtataggaatataggatgccaggggctgtattgctacattatggcagatttgccaggtgacaagatgtcagtggatcagggaattgagagggctgtcaagatgtgacaaatgctacaagtgggcagaaaaataatcttgcacagtgacatgtgaacagagattgtgatcttctaatgaagcaattagagaagtattggcagaacagttagagccatctccactcatgggtcggaggcttctcatgctaacccgactacagagctctagcagaacaccatgagggtcgccatggtctctcccataacttatctctttgggggcgctctcaactgtatagtttggcagttctgatgtgaacaggtcattttttctatt

SEQ ID NO: 60045 - DNA, 1438 bp, Homo sapiens
agggatgcctcattgtcagagtgaatttatagacaaataaataaataaataaataaggaagtgacacatagaaattggcagtgaggtacagaaacagctgggttggttacaggttggcgtttgtcttatttgaacacagtttgaacacttagcagtctatgagtcgttgaagtatggccgctgggattggccaaaactcagctattgttataggcacatacttctaagttagcttttcaatcttgtctgactattaagctaggttacagttcgtccacaaggacccaaatatagaagtacggagtcctcaggccatatttagtttgctttaacaggtctcactcatctgtttccttgagccattaagcaggatctaaatcagacaccaatttggtgtcaactctttgaaaagctgaaaagtgtgtttatcattgtctgtgaactcatatgcaactgcatttgttggctatattttttcctgctagcatgtttttagcataaaggtcataaactggcaataataatgtatcataaacgcaggtagtctcttgaaattcacattcgtacgcattacatcacggcaaatgcgtggggtggaaaaggaccttctcctcctgtctgcccggattgttgtaattgcctcagaactagtgtccccttccagaatctattctcaaaacagcacactaagtggtccttttaaatacaaactccatcctgtcctctcctccagtgactcctcagttcactcagtgaaagctgaagtcctttccgaggctggtgagtcattaaaaaatctggtccccactgcttctctgacttcatctctttcaattctacttgctcactgtgttccagctgcatggaacttccagttatttctagaacatagtatgctctggcgccttgtctccaacagtgttctcttcctggactaagggtctttcatgagcatcccccagatacccacctagtctacttcttgcttccggttttcggcttccggcttccggctgtctctcccttcagcctccactcctatccctactttccgcttcctctttctttgccctattttttcctgtaccacttttcaccatatgacaccacatatatttcacagtacttgttcttatctatctcctcctactaggcagcgagctccatgtggacagagatgtttgtctgtttcatttactgttgtgcctggaataataatggcatatagtagaaactgactatttgttgggcaaattcctttttttttttttttttccaaacgaagaccatgaggcacagagaaattgcagtgatttgcctaaggtcacacagttagtaagtatacaacttgggacttgaacccaggacgccttcccgcagggttgtttttaggacagagaggatctcacgctggctttctgaattctttccttgtttt

SEQ ID NO: 60046 - DNA, 2762 bp, Homo sapiens
aaatgtaaaatacagcttgttattttatcagcctatcacacactttcattttctttttatctttcatatgaatatttgacctcttccaagtttttttgtttttgtttttgtttttttttttttgagacggagtcttgctctatcacccagctggagtgcagtggggagatctcggctcactgcaagttccgcctcccggattctcgccattctcctgcctcagtctcctgagtagctgggactactggcgcccgccaccacgcccggctaattttttttggatttttagtagatacgggatttcaccgtgttggccaggttggtcttgatctcctgacatcgtgatccgcccgcctcgccctcccaaagtgctgggattacaggcatgagccaccgcgcccggccccctcttccaagtttttactcaaaacttcattctcaaggaggccttacctggtcatcttaatttgaatagtgaaacacatactccttatctcccttgcctgtttatttttctccatcccactttctttcatatgattgtacaatatattttacttattcgcaatgcttattgtctgtcatctccattagagtgtaaactccaagaagtactcaataaatatttgaatgaatgaatgagtgaatgtattacagcattgctgttataatatctgctgtattgtatatttttccattttcacttaatagtctgtcaggttttcatctgtttttcataattatactttttgacagttacatttgagtgtatagaattaattatacaataatggattaaatcatgcgcctaacgacattttgcttttatttgtttctgttcaattcgtggcttagtgtaataaattcctggaagaagaattacacctttaaaggatgtaaggattttttagggtttttttttttttttttttttttttgagatggagtttagctttgttgcctaggctggcgtcaaactcctgggctcaagtgacttcctgcattagcctcatgagtagctgggattacaggtgagtgctaccatgcctggcagatgtaaggatttttttttttttcaagacagagtctcgctctgtcacccaggctggagtgcagtggtgcgatctcagctcactgcaagctccgcctcccgggttcatgccattctcctgcctcagcctcccgagtagctgggactacaggcaccccccaccacgcctggctaatttttttgtatttttagtagagacggggtttcaccgtgttagccaggatggtctcgatctcctaacctcgtgatctgcctgcctcggcctcccaaagtgctgggattataggcgtgagccaccacacctggccagatgtaaggatttttatggcacttgctcataatagggaagtgagcatttctctccctccctctctctttctttctgacaaatacttttgtgcccgtatatataaatgcattgtccttcaaatactttaggccctgtccttgaagcagggtaacctggggcattaatatataaacaacaattgcaataaaataatgagataagtgctaagcagatgtgtcagaggacagacaggtagggagaattagagaaagttttctgtgagagatcacagcatttaaactgagcggtgaaggacttaagtaggcataagtggggaaacagcatgagttagaggacagagatctgaaattgcaagacatctgttgaggcatcaagaagagggcttgggccgggcgcggtggctcatgcctgtaatcccagcacttgaggctgaagcaggcggatcacgaggtcaggagatcgagaccatcctggctaacacagtgaaaccctgtctctactaaaaatacaaaaaattagctgggtgtggtggcgtgcacctgtagtcccagctactcgggagactgaggcaggagaatctcttgaacccgggaggcagaggttgcagtgatccgagaccatgccactgcactccagcctgggcaacagagcgagactgtctcaaaaaaaaaaaaaaaaaaaaagaagaggacctgaagtgtagagtgggaaatgaaggcggacaggtagcttggggcattgcactgggcctcagatgctttgctaacatgtttggattttagtctgtacacaatacacaaaggtgttgtttaaaggttgtgtctcattcctttgtagctgggtaacctcagataagctacttaacctctctgactcttagttttctcatctgtaaagttggaacagcacaactacttagctagattataaaggaataaagagataatggatatgaagttcttagcaggatgcctgatgcacagtggatgtttacaaatgttcatttttattcctagtggtttatttaaaattgtacttttttttttttttgagacagagtctggctctggagtgcagtagcaccagctcagctcactgctcagcctcccaggctcaagtgatcctcccacctcagcctcccgagtagctgggactacagtcacgtgccaccacacctggctaatttttaaattttttgtagaaacaaggtcttgccatgttgcccaggctggtcttgaactcctgggcccaagcaatccacccaccttggcctcccaaaatcctgggattacaggtgtgagccactgcgcctggcctaaaattgcacttcttgcagaaagagaaagtaagatattttcacagtatacttagtatgatttaatagaacaagaaacccaaggt

SEQ ID NO: 60047 - DNA, 1087 bp, Homo sapiens
accaatcagcaggacatgggcggggacaaataagagaataaaagctgggcaccctagccagcagcagcaaccggctcgggtccccttccatgctgtggaagctttgttctttcactctgcacaataaatcttggtgctgctcactctttgggtccgtgctacctttaagagctgtaacactcaccacaaaggtccgtggcttcattcttgacgtcagcgagaccacaaacccaccagagggaacaaactccggacacatcatcacctttttctgtctcaccattcttaccttacttcagtcattgttatctcttatagtcagtggcaagagccttctggtaggtttctttgttaccactcttgcctctacaatcagttctcatttacaaaggtcagtgatcttttaaaaatgttagataatgtcagttacctgctcagagttctctggtagcttcctatcctacttaaagggaaatgcaagtttttttattgtggctcacaatatggcttcttcctgtgtgtctgatatgattatgatctccagactcactctcttgaattccaggcttcttaaatctgaacgctccaagctcattcctgcctctgtagctatatggtactctttgcctgggatactcctcacccaggtatttgaaggtctggatattcatcacacccattcaggactctgttcaaacgtcattttctgagacgctttacctaataatcttctgtaaaaaatatccttcttgggctgaatgcagtggctcacgccagtaacccctacactttgggaggctgaggcaggaggattccttgaggccaggaattggagaccagtctgggcaacataatgagaccctgtctctacaaacaataaaaaagttagctggcatggtggtatgcctgtagtcccatttactcgggatgctgaatccagaggattggttgagcctgggaggtcaaggctgcagtgagctatgactgcactcttgcctgggcaagagagtgagaccctgtctttaaaaaaaaaaaaaaaagaattaaaaaaaatgcatctttaccctctcactctgtttctttgttc

SEQ ID NO: 60048 - DNA, 1052 bp, Homo sapiens
acatgcagtgtacctcaaactaggccccagataattaagcatcatggaaaaaatgcatagtcatgaacattaagaagtcaggaatttggaataaaggaactgtatcatttattctctccttcccacttttttattgctttgcaaaaagcagacacttttccttgtcttactgatgtacaaaccttgcttcgttgcaaaatattctgaaaagtcctttcagatctccaaaatcttattacctatttaatgctttaatttgaagtgagatatatatgatgggttttttcatagtgtgaacattagttttatttcgaataactatattttcttgtctatagctatgcataacttgtgattcaaaaaacatcacttaataactttactatttaaaatgtctgtattaaatcattggctaggaaattggtgctcttttatttctttttctattttacagggtcatcctaaagtatgtgaaaaattaaaggctcttatggttgaatggacagatgaatttaagaatgatccacagcttagtctaatatcagcaatgattaagaaccttaaggaacaaggagttacgttcccagctattggctctcaggtattttgggaatgaagttgtgtgtgtgctacagtttgtttctcttaaatagctatatttatttgaatttttttcttcattcccaggtaatttttactacttcagaggaattttcgttagctaattgtgttagtaactagttgtattgctagttagtaatactagttttctggcattcagaggtgccagaaaagtattataatggaatattaatgtgctctaacctctctacttctttataaacgaattggtttaacattttgcagtttttgaaattttttggtatagtttttgtttgtttgtttttgagacggagtctttgtttgtcgccctgggtagagtgcagtagcgtgatctcggctcactgccacctctgcctcctgggttcaggtgattctcctgccgcagcctcctgagtagctgggactacatgcacgtgcagccagacctg

SEQ ID NO: 60049 - DNA, 1024 bp, Homo sapiens
aataaatcatctaagttcaactgcagaactccctgtagattttaaagccacttagttacttaagttattactgtgttttcatcagactagatttttgttagggcatacttaacaaaaacctctgaagatatatttttctaagtatatttttttcatctgagtacagaagaaaataatgtaaaaatattaagaaaagtgataaagtcacctgactcatactgatgcagttctgttagcactaacttttgatgtaaagatagaagtaggctagcagcaccgctaccgtagttggctgcttaataagacaagtgttattgttacatttagaacctgatgatagaaaggaactttgaataaaaagtgcagttcagaaacatgcggcttcacatagcttatttctgcgcttctctactggtagagatttcttcacacaccataaaagttcaaatctgtctaattgtgaagtttgccaaattgtgaacaaaaatttatgtaaaccgtaaaacttatttctgaccaggcatacctgtagttttcagaagtgtctgataattaaaacattatctaaagaaaattgcaactagagataggtcagaattgagagtgtttaaagttgtattctgtgaacaccaaaaagtttttttcttctcagctcttctaaaaataaatgcctggccgggcgcggtggctcacgcctgtaatcctagcactttgggaggccgaggcgggtgggtcacgaggtcaggagatcgagaccatcctggctaacatggtgaaaacctgtctctactaaaaatacaaaaaattagccaggcgtagtggcaggtgcctgtagtcccagctactcaggaggctgaggcaggagaatggtgtgaacccgggaggcggagcttgcagtgagccaagatctcgccactgtactccagcctgggcgacagagcgagactcaaataaataaataaataaataaatgcctgtgcatttgtttgacaacacgaaatccagttaagtgaggaatgtagaa

SEQ ID NO: 60050 - DNA, 1124 bp, Homo sapiens
ctgctagcagtttctggtaactggcagaatggttggaaatgaggttggtaagataggctaaattctgatttgccttgaatgctatgcaaaaactgagaggccacagagcccataggcttagaagcttgtaattccagaagtgtgaattgaattatatgtttgttgtgtattcccttatttacacaatttaatagaggcagtgatatactgtcagaattaactacttgtaatttggtttacaaaataggatttttgagcatttatatcgttttatatatatatctgagttcctgaagataacatcctgacacttgatccaaaaggaaatgataactctaactattaatagatactacagttttttttttaactatttatgtttaaagtagtcatctctttctgtctcccagcctcttttctggttttggagtttttttaaacacgttgaaatcttctctagtctgtcttctctgacttgtgtaccatatgcttttagttgaacctcttcacacaaacctgggagggtgtgcctaggctgcctcctctaagtgtctagttgctctctgtgttctccaattctgattcatttccctctcccttttaaggtggaagctgctgcagtttggatttcttctttcagaaatctgtgctagattgatgagaaaggttttgcaaattcttagggtgggtgagaggaggagaatttgataacaaccctcaaatactgtgttcctcttttttgttaggctgcagaacaagcaaaagcaagcccagctcttgtagccaaggatcctggtactgtggctaacaaaaaagaagaagaagatttagcaaaaggtgcgtttttaagtccctgatggtgggaataacataagcctttattttttctctgagatatttaaaggtaaaataaatagaactttatagcaaaaagctgaaatctgctttgttgccctcctcagtattctttgctttactcttgagaggcaattactgtcacatgtatcctttcagtctatgtttttatgacagttttttactataccgtgtatccaaaaacaatatcaagtgcttttttgtgtctaacaaatttgttttttgtagatagtacacgggaaatgcca

SEQ ID NO: 60051 - DNA, 2638 bp, Homo sapiens
gtggtgcgagctcggatcattgcaacctccgcctcctgggttcaggtgattctcctgcctcagcctcctgagtagctgggattacaggcacccgccgccatgtccagctgtttttgtgtgtgtatgtatttttagtagagacagggtttcaccatgttggccaggctggtcttgaactcctgacctcaggtgatccacccgcctcagtctcccaaagtggtgggattacaggcgtgagccatcgcacctggcctaacttttctttttcatatgtatctatgtagaggtcattgtaaaaatgcaaattcattaagaagtcttacagaatttatacattatatatttttcttaccagttgattacagtgtgacaagtacagtataacctcagggaggatttttcttgttcaaaggttgggaccgtttctctagtgtgtagtcccagacttgaaagcagtgttctccaagcaacatgtcagatattcagaaggagccatttttactaatcatataaaagttttttgtttgatttacaaaccctgctgagtaggataataaactagaaagtggggccgtggagaaaaagtgatactagtggcaggcttaacagtttcaggagacatagctacatagtcggtcaaagtagtgagagacagtttactatatttctacataatattgtgctttaatgaatcttcataatgatgagtttagtcatcaagcaaagtttaagtcataatctcccctctaggaaaacagaaaaatatgttcaaatctagaaagatttgtatttgtaataaaatatttaaaatttttaaagagcttatatgtataggttgatatgctacagttatttggcaaaatatctcattatcgttttttaatgctagatagaagggatcaaagaaaattacaaaccacaagatgcttaggtgttttttagtttataagaattttaagaaaaaaaatctttgtcctggtcatctttttatttccagcagctcctaatagtgagtcttataatacatactacatatttatagaataaatgatacagaaatatatatgttaacaataaagagatacttcacttctctttcaagagaaggcttgaacagcaaaccagaaattacagatctttaagaaaatggtgcgctctcatagttattgccagggtgtctggtgtcatttttatagagacagattggtgagacccagtctttcaatgatgttttctatgtctgtgagaattcaaaaacatgtcaaccttgtttaaatggcattgcgtagtgtgctgactttttaataacctgggctggtaatgatgttttgtttgtttttggactatttttttgtcctgaatcagttcctggagaggatagaattgcttggagttctgttcaagataaggtcaaggatctcatgtagatcctggagccatttcatctttttttttttttaagtcatatagcaatgcagcttcaatatgagttttctagtttttctcatgtttttcactctggacgatctaaaagagaaactgaagcatcagagcctatgtagtggggttgtagttctcaagcgtggagaacaggtgcaggtgctagcatgatccccagagcatcattcttttgaggaaatagaagtctatttcacttagcctgtcaaagagaaatagctgccctatttagcttgcttttggtttggagatacagtaaaatattgtgaaatccctttgttatatattgtatataaataatatatttttttacacacacatagtattagttcctgtgagaaaaggggttgcaaacttgcgcgtcaagagctgttagaatatgaagtctgccatgtttttcttatgggtaatggccaatgcagtgctatcccagctttctacttgtaatagctcaagatataaaaagcaaaatgtctgcagcagatgtttcttttcctttataggaaaatgaatcagctgtagaattttgcttttggtgacttgaatggaatgattatatttcttaggttggaaattaagctatttctgtgttatacagaagcacacaacacggagtacccaagtgattggacttcatgttctcggggtaaaatcactggcacaggccagatttcagtagtatgggctagtagagcaagatagattggcattcaaatccaggctttgtcatttattagctttctcttttacaaaagtttttaatctttccaaactaccttatttataaaaagggcatatctcataagattgggagattcattggaggaaatgtaatattccatcaagcatattcaatagtttaataaacattatttcccttccttaaattgccccctcctgtcttcctttccatcatgattcttaatatttttatgaattgattgaccacattgatgcaaggattaaaaatatagaaaggaagtttgtttagtagagttgtatatgcctttcagtagtatttggaggttgttatatagctactgttatgttaaattgtttttaaagattgctttggtgagtaggagaaatctgtgcttctggccaatgaattgttgatccctcaatgaccactttttaatgtcaaatgataatattatataactagaaaatacaggctgat

SEQ ID NO: 60052 - DNA, 1074 bp, Homo sapiens
aagctattttccttttacacagaacatagtttttaaattttaaataattactttgcttaggattagtagtctttatttgccctgcgtacctatatatagtagcataaccatgtaaaaaccatgcatggagaaaggtttgtaattattttagtagtggtcatggtaaagtagatctgtttggattttttaaaaaacataaatacatatatacttatatatcgtatagatgtgtgtatgtaataatggtttcattcattccattggtctgtacaacaaaagattctgaaatagatctgtgtcactggtttgaggtaccttccagcctctcccaaataggaaaatagagaaaccactagtcttcctccttccttttatgaccaactgaaacactggtagaaagaaaatgtggaataaaccctaagagtcccacttagaagagcagctgtgatacagctgagctctgccttactgaaacagctgctgtattcaccatgggcaagtaggaatgacaagttgttagtcataagcaatgccatcttgagatggatagtacacttgttggcatggctaagctaaagctgctccgaaacaaagcaaaatcctctggcatgacataagaggtggaagaactcacgcattgtaagtttaaatgtggcttgatttcttctcgcttaagagaatctctgttagcagttggttggttggtttatttatttatttaaacagggtcttgcactgttgtccagactgaagtgcagtggcgagatcatagctcactgcagccttgacctcctgggctcaagtgattctcccacctcagcctcctgagcagtttcaaaaatatataggaagtactttcaaggctctgacttcatgcagtactagagagaataaatacatgggacactgacaacataaaagcaaaattggagtctccataactatgaatttcaaaagtttgtctagttgataataaagtgaaaacataaagttgcctaaaggttggtagctttttatattaactacttaattcctgtaggataaaatggaccagttgctacagatgctgcaaag

SEQ ID NO: 60053 - DNA, 1366 bp, Homo sapiens
ccagagctgcttcatcttgaaggtaaaacttttctatttaccttgcaaataaagagtagttagaggttaataactggtgtcctgttaaagaatgggttttgaggataatattaaaaatggaacatttctcacttctccttgacccaggctcactctcatatgcagttgaaaccttgggtagaatttgaattcttataattttctatccaaacgaagtgttctgttcaacattttagaacctggtaaaatgaaaaatggcactttaagattttcagattaatattttagattaagttgtcaccattatactttaagaaaatcaattttgggttctgtagactaaggttaaagaatgtatatttttattactccaaattaaatcttttattccttaaattatacaaatatctatcaaaggttcacatttttttttcttgtactttcttatatttcttcacatcttgtcattttagcaatgtgtcaccagatgggacctctcattgatgaaaagctggaagatattgataggtaaaagaacatgggtgcatttatgttgtgtaccttctttcctgaagctatcactgtactgcaaagtgggctataactgccttttaaaaaaaaaatattgtggaggaaccaactctcattcacatatcttgtgctagatgtggagaattagactcatttgtccttttttttaaagtgaggatttgatcgacctttgcaatatagtcaaaaggaccagcgtagataggtcgttttaaaaacaagggctagctatgtaattctctttgctgaagtggcattaccagagctcacaaatgacccatatgttagtaactagggaaaccaagatatttctggtacagtcaggtacgataagacggagttcccttagcacagcacgtaaaccttaaacagtttgggttgcttcagggctaaaatgcaggatatttttgttataagtgaaatttttaataatgtctactagtactactttttgccatttttgatattttgatgtatcattatttagagcattatatcattttagtaacagctatgcttcaaattattgtgtcatgtttcagaaaacattcagaactctcagaacttaatgtgaaagtgatggaggccctttccttatataccaagttaatgaacgaagatccgatgtattccatgtatgcaaagttacagaatcagccatattatatgcagtcatctggtgtttctggttctcaggtaagcttttagaagcccatgttgttttaaattctcaaatgcacagtgaggtgtggtagctcatgcctgtaatctcagcaatttgggaggccaaggcaagaggattgcttgagaccaggag

SEQ ID NO: 60054 - DNA, 1033 bp, Homo sapiens
acttccgttttgtctccaggtctcagcttccccatctataaaatgggggtaatagtttaccgacttcacaggttattatgaggaataagttactttgtgtaaagcatacagcacagtgcttggaacatactaaataccccttaaatgttagcattattgtaatcattctcaatttacagttccaccgtccacccagttgcctggggcaaaaccatgcaattcaccaatacttctttctcttatctctgcactgagctgtctcccaaccatgtcacccaatgtgtaattatttgctaatctcctaaataactctttccaattaatagcactgtatcttgccaacaaatactcataatttcttgcctaatatccatggtctcccagcttctaatcttgcccctatgaatccatctacgctactgccatttaaagccctttctgaactttttcattatccctaagatggtatctagaacaagcattcttcgaccttggcagtgtcttcaagtatgtctctcgctgctcccctacacgctttcaacccttggtaagtgtgctgctggaatgccgatacataccacgcctttcacacctcccatctttgctcactccatgggtaccatgccattccaggctaccacatctctgacgtgacagaacatcttcctcactttttttctactggctaagaataaccctcttggaaaacttcctcaaaccctgaggctcctaaggtacaaggcatatatcttctttatttataaatcatgttgtataaaattatatttttttatgtgtttgcccctactactcagtaagcaccttgaagctaaagaagactctcaggtgtctaacacagtgcctggcacatgctgactgtagtaaactaaaatcagagacaaataaatacataagcttcagtggtctcaaaatactaacagtaattgtcacttattatcaccttataatactaccatcgctacaggtagctttagaaaaccgtcatcagtgacaccttccccaactaacaata

SEQ ID NO: 60055 - DNA, 1660 bp, Homo sapiens
gtgtgcttccgtattttcaaggaaataaaagaaatgaggttatgaggccttcccttccactagtcctttgggaccgttcttgtcaagaaccctggtgatgcccatactgctagactcccggtcagttcaccattctcctcctcctccatttgacagttcgtgattccctcctcttttctgaaatgctttcttcacttgctggtgaccattctcttttcccttctgcctcaccgccacttcttctcagcctcatttgcctcttgcctctttatcttctggacttcaaggtccagtgcacagtagatggactgcctttttctctgtttgcagccgctccccaggggacctcatgaagcccggtgattctgaatgccgtggatctgccgaggattcccagatgcgtatttctcctccgtacttccccacaggacagcaggcttgaatagctgattgcctatgcaggacaacaggcttgaatagctgactgcctatgcattctctttgcttgccagttttttggacatcaaacttgacagatccaagattattactttgatcttccccacacccctcccacccccgagtctactatggtcccatcatagtattctgaaaatcagtgaatggccactctaccagttatttctaccagtttttaggttctaaacctcaggcattctggactcttctgttcattatcatattttgaaggcattatcttcaaaatctatctagactctgaccctttctcccatctccaccattactgccgtggctcttctgctggtcggctctctcctggtggatcgtaataacctgcagtcagctatcctggtccagagggagcccgttaaaccctgtggaatcttatcacgcttctgctcagaacgagccagtgtctttctgtctcactcagagtgtaagctacagtccttattgtggccatcaggtgctgtgtgttctccagccccctccccaccaccgcagtcctgccggtgatcttagctgctctcccctcggcaccccctgcggccccctctgccgcagcactcgtggcctgctgttccttgaacatgcttggtgttttctctcctcaaaggcttctttctgtttacctgaaatgtactttcctagggaatctatctggctcactcgcttactttttccacatctttgcttaagtattgccttattggagaggcaccctaccataaactagaatcccttgccccagctgctctttgtcctccgtattgggctttgtttttgttcttaccagttagaaccacttgacacacgatacatgtgtttgttacccttttctaccactagaacagacgctccatggtggtatagacttatttccgcaaaccaccccccccaactttttttacacaatggttaaataacacacatatttttaatgcaatgcctgatatcacaaagcctaaaataacaatgtttggcacattatagctgtttagtaaaaggttattaaatgaattgactatatgaatgaatgcttagtaaatagcttttccatttatctgtagttgctctataaatcagtattgatgtaattgagtgtttttcttcctccacagtacaatggtcagttccgttcaaggaaacacatatcccagccaggcgccagtatata

SEQ ID NO: 60056 - DNA, 1060 bp, Homo sapiens
aagtcaaacttacaaaaactgttgtgacaaatgttatgtacatatattgatatgtaactgcattagtggccattttgaatcacagtggtgatcgtgtgaatatatttaacactgtgttaaattaatttacgttgctattttattttaatcataaacaactaccatgtttcttaatgttttgtgtaaatttaaggtaattatactatccttttaaacttcaagaaaacaaagttgttagcgtatttacatgaaggcgcattatgttgtcgtgtgtttcagtttcacattaaactgaaccttttactaattgtgagctaaagagatatatatatatatgtgtgtgtatatatatatatctacatgtctttctgtagcctctgcatactactggctgtcatcacaccagcgtacagtagctaaatttttggtgcaattatagcaaatgataatgttcccttttgaacttttacattttggcatgacatttcagagtattgtgggaccatgagacaaaattaagtacgatcacattctttatttctcattttaaagaaatgatgttggtttaccttttcctagttgaagatagtaattaggtttctaagctgtatactgtgtttattggtggcagtgacaccaaagatagaggcaatggatagaaatttttaaactggaaagaaaacctgaattacactacattttcgaagtctcttgtaattatttgggatatcaacaaaatttgattcgtctgtctaatcccttgctagtattttaaatatgtctttaacacattgtatcctttaattcttcattaaaatggaaataagtagatgtttcaaagtaatctacattcctggctttgcttaacgtttatataggtattgttttctttcacactggatttttgggttgctctttctggccttttaaaattctaatggaattattttggcttcttacttgggaatattttcaaatgaatgcttttcttttaattcatgcgaaaaatgttttccactgacattgtaatcttaaatatttacgatttccctggttgggc

SEQ ID NO: 60057 - DNA, 1011 bp, Homo sapiens
tatcatctacctctgcctaccttaactatccctgccattcagcctgaatagttcacctatgtcactgaatggacctgggtaccatggtactgaaacttgggtgcatgatttctagcatgtagttatagcagtgtactttctgaacgtaacctgggggtactttatctccattcgtatctggtgagccttttgttctgagtgattttatcaggaacatctgcattccaagtagaagcgcttcagccatagtactttaactttcattggtgttgatttgaaaacagaaaaataaatagttgtaactctgggacagatactgtatttgtatactgcttcaaactaaaggaggtaagtagcatcagactacatgaaattttattcttgatgttcttgtatgcaaagtggcatcttggtcttggtgaactgaaaatgttaatgtcaccagtatactacacttgccgttctttagctgttgtattgctgagatgctagagtactatggaaactagtagtttccatcttttgtgctggctaaaattgtctaccaagtaaggtgcaaaaccagcagtgattttttttttttttgcatcacaaatatttggcctagaaaaatgccattatatactgcttagttacaagttattaatataaataagtattaaagtagacattaaattcaaggaaggttgtttttttttttaaaatcggcttttttcttgtgttgtcagttaaatttatctattattttatatagttttataaaacaattccacaaataaagaatacttgtttttagttttcctatttgcactttagaagattagataccatgctggcatctaaaaagctttccttaaagtttatattatttaatggaatctgatgaagaagttggggcttacttcaagtactaagtaaactggataaggcttttatacttgttgagggggaaagacaaacttttccggttgtttatcagatttgtgtgttgtctccctttgtaaacaggta

SEQ ID NO: 60058 - DNA, 1045 bp, Homo sapiens
agtagcatgatctgaattactgtttaatgtcttttgaaaatgacatttctaaatattcatggcttattaatcaaatgctgtttataattcatttgtttctcgatgtttattccaagagctgtcatttgagaaatgtaaaatgctatacagaatgcttaaaataagagaattctgaacattaggggtggtttccagcagatacctcttggatgttggacttgaattgctataattttgatgaaatgatgctcacaatagaatgcagtgaatcctgctgttaatgcacagttgccttctaaaaaccagaatgctcggcaaaattgtacaataaagaggccttaggatatatggggaaaactgggttagaggctcagcaacccaaaacttcaacagtgacatacccaagaataaagataagaatctaataagagcagcacagtttgacacatgttaaatggttaataaatatggcactttaccttggaaaagacctgaagtgtgcctgtagaagtgggcataggaagggttgcagctcatgaattaaggtgaagctgtggaaggagagtcagctggaatcagagggtgagttctaatcccaggactgggtaagtgtgactcagtacttgcagtgaacggaggctgctcactcgtgttctgtgtgttccgatgctgggtgtggttttccacatttcacctagcgttgctcctggatgagaccatgcgtaagcaaattgtgaaatttgcgttctgctcatattccttgtagttctgctcatattcattattaatttcctggaacaagtttgtgttttccaaacaaatgtgatatcaatattgactttaaaagacactttgtggtggagaatgagtggctatttaccatttatttctacccagaaaaatactctttgtacttctaaatgaataagaattgtggacaacctctaaggtacaaaactctttcttcccccttaccagatcagaaatgatccccactgaacatgtaaacacatttagattcaaataattattttatgtgttttgc

SEQ ID NO: 60059 - DNA, 1070 bp, Homo sapiens
gcaactggaaaaaaactggtcctggtccgtgccaattgggaattgttgtggttgcaggaagtgagaaaaagagttacttaagaaggggcaaagcttttttggttagaaacatttagaaagaaaaaagatgaagccacgtgaggctcaaccctagagctatgttctaatggtgtcagcaggagctaggaaggctgtcagaggagtggaaggtgtatgcgttggcctcatgttttcgtgggcagaatccaggcatcatggtcctgctgatgaagggagggccttgggacatagtgacttgggagagtcagttaaaggaaagttacccatcgccttttccatttcaagctatttattctgcctctgagacaaagagattgaacctggagagctagagttagaatctacaactctgagtcatcatgcaggacctgaaacagaccaaaaaaaaaaaaaaaaaaaaaaacaaaaaacaaaacactagctccttagtgtgcatagtagctgcagtaaagcaacaaataatgccaagccgcttgttgaaattgcacggaaagaaaaactgatatgtttcaaataagcaagacataatgaatagaaacgaacagtgtagaacccgttattagtcatttaatccctgtagaaacgccacgtgaaggcagtcactggactccattttcaaatggtatttttggctgtgaattcctttttcatagagttttaataacccaattcacatggcaaggagggattaccatagtgtgtataagtaaactggaatttgtttttcttcacggtaattttcttttgtgttcttagtaatgtatgtagctttaaacaccattataagtgataacaagagttgttaaatgatttaatgtaaattttagtatatattgccaaaacatacataagcgtgtaagaaggcaaaaccaaatttatcccaaagggtaaatatacaggtctgtttcctagaatatcaataggacgaggtgtttgctatggcatggcttttggggtaatgattacacaggcgtatcattgaaaaccctcaaatgctggcttgcatctgt

SEQ ID NO: 60060 - DNA, 1076 bp, Homo sapiens
caatttctcattagtcataattaattctgtagcaatttaattaaaattataaatattagaatatggtgaaacatatttgaatatattgtaacatcagcagaaaaaggctacaaagtaaaagggtaaaaagcatttaccagtggttttatctttccagacttttagttgtatagtttagttaggtaacgaaccttatctttaagaagaatcactggtcttaaggaaagttttcttcttgatatgtttctgtgttaggctctaaagcagaacagcagctaccttgaaagaatttttgcagttatatatagatgaaggttccattttgttaataaaccagttcaccattagttagtcaattaactagtcttctggcccttgacattatcaacttatttgaagtcagtgatatgttacaagaggattggggaaatgacatgccccatgaagttagttaattttcccccggaaactggattcatgttagcctttggggtaagggctgagtcttgatccagtagtacaggaaggggtctgtccataggggtcattggctgtgcgtggcagatgttagtgggatttcccatgaactgtgaaatatgaggttgctgttggttctattccatataaacttgttgtaaagtgataaactagctcatcttatacagtacatcaaatatttcaaagacagaatctgttcttccttgcagtttcctaaaacattaattggaacaaaagttaactgtgggctgggcgtggtggctcacacctgtaatctcagcactttgggaggctgaagcaggagggtcacctgaggtcaggagatcgagaccagcctgaccaacatggagaaaccctgtctctactaaaagtagaaaaaaaaaaaaaaattggctgggtgtggtggcgcatgcctgtaatcccagctacttgggaggctggggcaggcaggagaattgcttgaacccaggaggcagagactgcggtgagccgagattgcgccattgcactcagattgcgccattgcactcctgcctgggcaacaagaacgaaactttgtctcaaaaaaaaaaaaaaaa

SEQ ID NO: 60061 - DNA, 1112 bp, Homo sapiens
gttagtcttctacttttaacttccttctgtaccggaaagtgagaatgtcttcagcgttgtaaattttcactaggcatcatgatttttttttagatcggcataattcccttctctcatgaaaagttcctcagattcctagtttgtgatactgtttggcatcctccagcactcttgctggtcatgaaaagtggaactggaattggaggagcatttatttttttcctttctcccacaaaagtcataggaacataaactttttggaattctgaaagtcctttttgaaaagaaaaataaacagaaatgaaatcaagtatgaatcacctgttttgaggtttggcggaggctgatgtgggcccatgaatcactcctgttgtgaatctgggtaaagttaggcatatttatggcacctagttttacagtaacctcatttagaaattgctttccagttcataagggcttttgctttgtaaattgtcataattttaatttattacggagaacaaagtgttaaacataacctctaggcactgttattagaatgaatgaatattattttcaaattgtttatgtgctataagagattcaatacataaagctatagttatcttggacttgttattaagattattgcagctattgaggttgtcttcaattcccgtagaaactctttggctatgggttgagaacagatacatgaatgaaaaaatttcatttatcattgtaataaacctggaaaagctataattcttaatcttttgtatttagtactttgcacaaatttatagcctattaagtgaattagtttttcatatcacttcttttctcctaacttcatcaaaagaaaggaaaaaaaaatctctaagtttagttgtcttagaagtttattttagagccaaaatctaaacagataaattaacttactggaagaaaaataggtggggaagagtaacaagtcctgcttggcatggatgggtagaacatttgtgctgttcttttcaagagattgtgcaagaattgctaagtgtataaattctttgatgctgccaaggtcagggaaaaatatgtacatctgcaaataagtactggttatcaaagttaaagcagctttgatg

SEQ ID NO: 60062 - DNA, 1117 bp, Homo sapiens
gttttctatttggataaggaattattccagggtcgtttataaaatgttttttaccccaccacagatctgcaagtgcaaccctgtcatatatggaacagctatttgttaagtttatttatcagaattaaacataaatcagaataaataaaaacgtaaaacctggaatccccccttctgcccataaaacaattacaaatcaccagattaaaagaagacttgggttctgagccaaactggaagtgagagccctggcaatagttaattatgatatatgacctcggatcaaatgtgttagactttttgcctttgagcactggtttaagtttctctgccttgtgggtttgtgaggaagcacataaaggatgtaagggaatagaggatcccatctctacagataatcatctggcctcatgcaaccagcatgccacttgttggagaagtgtgttcaaaactcatttctggttcgtgcacctgtggcccttggcggcaggtcctgtaacacacagcctgaccactgatacagaggaggcccctgggactgctttccttataagggtcctgcgccttggtagaatttagatttggagttgcagagactcaactcaggaaagcaagtctttaacctctttgaccttggttttctcacgtgttaagctcaggacgtggaaccggtgatttctcatgcctttgatttttaagagtatgtggaatagaattgtgcataactgtgaatcacagtcactgtagaaccacagggctggctggtagctttcggaatctgttagtggctttctctttgctctttgaaagattggtgctgttccatttcatgatgccagaaagtcatgttgggaattggtgttaatttttctgggctcaaaaaatcctgtttcttgactatttttcctacttctttccataatgtgagctattctgcaaaccaaagcactttagtaaaactctctactactagaaatgtgtttaacattattggtgtgttttcaacaatacacatcaaactttgagagccactcttgtgagtgaaattgctgtggagtatggagtgagaagttattctttgatctattttaggctacttgcaaagaaatataataga

SEQ ID NO: 60063 - DNA, 1063 bp, Homo sapiens
tcacactactaggaagagccccttgtgtcttcggtataatactgggtcatgactgatatgctcttcattccctgtattatattttgcaggacattctaaaggtttgggggagaactgaattctaacagatggtgcacactgctgttgtgatcacaaaggcctgaggcagaccacttcagtctaacatgtcattaccaatttaatagaaatatttcttgttggactagtctctaacaaatgtacattgtttgtgagaattggtcttactgaattctgaaggtatttttgtccttactggagtgacagcataatattttgacaaatcaattcaattaaacaacctactgattaagtcagacagacgaactgatttgttttccagattattgattgccatcactgaattccatacaatttatttgacatagtaagagtatagattgttcacaatctagatcccaagagacattaaatgttcttggttataacatttttattctgtagataagaaaatggaggcccagagatctgtatgaatgtgtatgtgtagcactgccattcaattagctgtgtgtgtgcatgtgtgtgcatgtaggtaccttatgtgtctgtctgaaatttatctgctattcaaaatacttctgggcagggcacagtggctcatgcctgtaaccccagtacttttgggtggatcatgaggtcaggagattgagaccatcctggctaacacagtgaaaccccgtctctactaaaagtacaaaaacttagccaggcatggtggcacgtgcctgtagtcccagctacttgggaggctgaggcaggatcacttgaactctggaggcacaagctgcagtgagccaagatcataccactgcaccccagcctgggtgacagaatgagactccatctcaaaaaaaagtacttctggccaagcacagtggctcacgcctgtaatcccaacactttggtaggctgaagcagaaggatctcttgagcccaggagtttaagaccggcctgggcaacatggagaaaccctgtctctacaaaaaaatttaaaaatta

SEQ ID NO: 60064 - DNA, 1029 bp, Homo sapiens
tccgtcttctgacagacacctgcttaaatactcattagactctcccttcacagtacgtctgcaactatgaagagcctagggtgcttaagttgaccaaaaactcttgctaatttcagtaaaaacaaaaaaaggaccaactgtctctatccatccattcagtcaacaatatcaactgagtgctgctcatcaagtgcgtgtctctgctgggcaccagtaggaaaacgacaagtaaaacaaccaatgtccttgccttcaaggagcttaaagtccagggggcaaggcaatttgaatcaaataatcacataagcatagaattacaagctaataagatctttgcatgaatgtacagaatactatgagaatgtagagggggttgacatcttcgagaattagaagggtcagaaaaggtgtctctggggcactgctacctgagctgaggctcaagggtgggaaggagttcactaaaggcagggagagggaagctctacgtggtagaagggagaaggcccagcttaagcagttggagaataaagtaagagagggaggagaagatgaggttagagaggcaggtgattatcaggcaagatcatgagggccacgctggggatcttttctctttctactaagagcagtgggatttctttcccacaagaggcatgatcagatttgtgccatttaaaatccactttggcaggacagttgaagacagattggaagacggctagagagaagccagggagatcagctaggaagtacttttacccaagcaaaagatgatgctctcatgctaaggagctgaagatgggagataaggaaaatgaatgaatctattagatattggggaattcaagtaggtaagtgcaaggacagaaacagaaaatgaaacccaatgtaatacatacacgttcccgtgttctctcattcctgaacatttccatgcatttctgaagttcagtcttcagtaatccgatctgtgataaacctttgttttcatgtcagtgccagtgtacttctatttcttggtccagt

SEQ ID NO: 60065 - DNA, 1048 bp, Homo sapiens
agaatttggaatttaaagcttacattatctattgttttattatgtcacttgtttcataaggcagcttttattggttaagttcaatattcagaggaaaagtaaactgaaggaccctgaagcagatcctttttgaaataagattggagaataatataaggtaaaacatgtaactggggctgttgaagtggagatttggctaagtatgacaaaaatgagaacagaatacagagaaaattaactcaataatatctcagcacaaatcctcgaaatctgcaatgaacgtatcttttgattcctaagtcatgaaagaagacagtctttcattattactttgccatgtaatagccatttatatcaatttcacattctactttcttctatccttattccatagctggtgtgagttagttttcaagacaaactggaagtcccaattttaagtaacacctcctaatttgtaagtgttggcttcagtaaaaattaacaacctcactctgtaggtcaaacagaacccatctggaagccaggttatgctcatggttgacatttgtgaccccaggtatagggggagaagaagggtaactgaggaattctcacgtgttaagaggctgcatataaaaatgataagtgttgggaggccgaggtgggaggatcgcttgagcccaggagttggaggctgcagtgagctatgattgtgccactgtactccagcctggacagcagaccgagaccccatctctaaaaaaaggaaaagtaaagtgataagttgtcaaggaggtcagacaagaaacagggtcctgcttcacactttgataagtaagggtgcagaacatttcaggaggaagagaagagacagccagggggccaaaacagaattcagcaagcaggcatttaattgtgatcttgggagaggagtttcaagaggatggtggaagtcaggcacagatgcagtgagttataaggagcgtgtgggtgatgaaagtagaaacaagcaaatatagcctccttctagaaggaggaagtatggccacaatcacttgaggagaag

SEQ ID NO: 60066 - DNA, 1034 bp, Homo sapiens
ggcgcctgtagtcccagctactcgggaggttgaggcaggagaattgcttgaactcgggaggcgaaggttgcagtgagctgaagtcatgccactgcactccagcctgggcaacagagtaagattgtctcaaaaaaaaaaaaaaaagagattttttgggggtcgtctttagaagaaggcccaatagggagcaaaactcattgataaaaacaggaagagacagtggccagcgtaggatataggagaaccataaaaactgtacaaatttaacttgtctccagcactttcagaagcccagatagaacatttgaggatttctcctagtctttcaaaaatgactcagtggatttcagcgtgtataggcagtgtttgatcatagatgaattcattatttcctcccagccctccaaaatacaaggctagagcaacaatggatgttctataatgatttagtttctaaagctgcctttgagtacattctgattcaactctcctggtgtttcctttcatatacaaaggtagcactggttgtgtattatttaacttcgtctttttctatgaagtcttcgaagaactcatcctcagaattaaaacagcaagcagcaaaaaggaaactttagttacagccgaaacccactttgacttgagaataaaattaggatacttctgtaaaggacttggatttctgttcttattaggtcacagcaaaaatggtattttaaaaggctactaggagtagatgaatgatctcaatgagaaggaaaagctgacagtatatcagagagaactagaatatagcaggtttgccatttggcatggagagaaatcgagaatgtggacttgagccttgttgacttgagccatggctcttccacctaagtgactttaggtacattgttttctatatctgagtagcagggataacagctctacctattaggaatacctcattggtgatagtcatcttactttgtggttgttataaggatttattgagaaaaattcatatacagtgtttcacacagtaactggcacat

SEQ ID NO: 60067 - DNA, 1021 bp, Homo sapiens
ttgaatctaggggtggtactggctcattctccctattctagaccatagccattctcatggccacagaaacaaggagactcaggaacacagaatcagtgtgtttcacaacagtcaaacaggcattttcttgggggctgtcttcaataggaattaccaagagaagtatccatttccagaacaactagaattaattccaagtcctagctttgatgagttgtggcttctgaagtttggggtagaaggtcttttgtgattaggccttggtttgtactatatcaacagaataacttttcaactataactacattttaaacctttctaccacatcaaatctgtattaggtataagtcaaaattagtttaaccagctacttgattgaagggagaaattgtttcatttttttattctagattatgattttaaattcctgctcatctcaggagttttctagtttaaacctatatggaagatagtaaacatgattataattctctttataggagaacctccatttctaccagaatcctttgaccgaattcttctggatgcaccctgtagtggaatgggacagagaccaaacatggcctgtacttggtctgtgaaggaagtggcatcatatcagccattacagcgaaaactcttcactgcagtatgtggtggtctgtttttgtgaaacaaagttaacttttgctactttgatgtttaaactactgacagcaatctccatagcagcgttcattacaatagccaaaaggtgggaacaacccaagagtctgttgacagatacatggataacagaatgtgctatatccatacatggaacattattcagccttcaaagggaatgagattctgatacaggcacaacatgggtgaacctggaaaacattatgctcagtaatatgaaccagacacaaaaggaaaaatgctttaagattttgcttatatgaggtagctgggaaattcacagagacaggaagaagaatagatactaccaggcattgtggggctgggagattga

SEQ ID NO: 60068 - DNA, 1017 bp, Homo sapiens
acactcactgcgaaggtctgcggcttcactcctgaagtcagggagaccatgaaccgaccggaaggaagaaactccagacacatctgaacatctgaaggaacaagctccggacacaacgtctttaagaactgtaacactcatcgcaagggtctgcggcttcattcttgaggtcagcgagaccaagaacccaccagaaggaataaattccagacacatacatttggttaatggatagaggttttaaattagggatgggagtatggtggaaaagaccataatttttcatgtttttctcattatttttatgactgctttggatttataattttctttttttttttctgcatgtgtgtgttttgtttctttttagggagaagttatagcactggataaaatcttcaacaaagtagaaaaaatcaaacagaatgccttattgttagggctgaattccatcagggcattttgttttgatggaacaaaggcggttaaacttgatatggtggaggacacagaaggtgagctattttgattttcttatttttaattgacagatcatatatttgtggcatacagtgtgatgttttgacatgtatataattttgtatacaatgtggaatgattaaaacaagctaattaacatatccatcactgtacttatccttgtggtaatttgaaatttactctcatagcagctttgaaacacaaaatacattagtatagtcaccatgctgtgcagtagatctcaaaaacttactcccgtccatctgaaactttgtaccctttgaacagtgtctcccattccttggtcctccctcctcccccagcctctggtaaccactattctttctatgagtttgacttttttagattccccacttaagtgagatcgtgtaatatttgtccttcactgcctggcttatttcacttagcataatatgatgtcttccaggttcatctattttgttgcaaacaacataatttctttttgttttaaaggctgaatggtattccatcgtg

SEQ ID NO: 60069 - DNA, 1040 bp, Homo sapiens
tacagctcctcacctgtcacctgtcaccactacagcctgtcaccacgcttggctaattttttgtatttttagtagagacagggtttctccatgttggtcgggctggtcttgaactcctgacctcaagtgatcctcccacctctgcctcccaaagtgctgggattacaggcttgagccaaaatagttcttaaaaagatagagcatcttatgtttgacaggctattggagaacgtttctggaaacatagtttgtatagaccatggaatttatacagactaatgttagatttcctatttttcagaggcatgggcataagaatgacagaaccagtatatctcagcccttcatttgacagtgtactgccccgttacttatttttacaagtaagtatgtataaaagtaaaatatttagtgacattgaaacatacatcagtgaattatttgaaatctaggatattttaaaatttaagattttttctgtggtctacttacatacactgatctacctttggttaagcagtaagaaaaaactttacaagcattctcctttcttttctttttctcatttgatttttaaactactttttctatctttctttgcccaaaggtgatttaataactgattaaaatgactgctttccatctcaaaatactaatccctgaatattgcatgcatttgatatacatgtgtggtgttccattagtaaatcatttgacttgttatagtctgctggtttggtagtattattataattcacaatataagatgaagttactgaagaacagatctgttaggactcttggcctatgtcacactcctggtaactggtggtatctgaactcaaacctaagtccaaatgttgtgtgctgccccaccttctctgtccagtaataataataattattattattattttgagacaggctctcactctgttgtctaggctggagtgcagtggtacaatcgtagctcactgtaacctcaaactcctgggctcaagcgatcttcctgccttagcctcgcaaatagttgggaccac

SEQ ID NO: 60070 - DNA, 1035 bp, Homo sapiens
ttttcgttggaggtgtccttactcagactagaggtaataaaagatgtaaggggaaaatgtagatggtgatgaaagacatccagtggctacttttatactcgcataattgttcaggcctcctgaatctccatttctacttagaatttttctcttcctctaactttcctgttggaaaatttagaaccagtgattattctgttattttattcttattcattcatacagccataggccagtcttcagagtttagcataggagatacaaaattaaagaataaagataccttacttcttggcaaagtattcaaacatcaataaacgagacaaacatgaaaaaaaatgcagtgtggtaaattatttaacagatatgtgtaaaaatataacgttggctgcagcacaaggtatacttggacgtaatgtaatgatgagtaggaatttgggtggcatgctagacagaccgaatagaagggacgtgttattctaggcagaagagctaatatgcaaaagggagaggaatgagctagtttggtacttttagggaagctgaaaatagttgagcttggctgtgtgttagtttgcttgcgaggagtgaagaggagatgagattggaaagacaaccaggagaaccttatcacagagggcctccagtgttgactaagacattaaactctctagagcaaggaatgggactcactgaagggtttaatccacagatgtatcttagcctatatttttgttttctgcatcaacaaaattaactaccaatctcagcattttccatttttgtaactatatttatctattccagtggaattagatatattagaataacaggcccaaagcgccacctcacaccaactaaattagattggggtgaagaggcctgggcatcactgccaaggtaaatcgaatgtgcagccagtgttaagaactactgatcttactttatgtgctcctttcccgtgtctttcttccagtatttccacattctcatccttttttttcctgtagcattttagagtctcatgcgtcttat

SEQ ID NO: 60071 - DNA, 2367 bp, Homo sapiens
agtgatgtctttaaattttatttattattgttatattttctgtcacccaggctggagtgtagtcctgtgatctcagctcactgccacctttgcctcccaagttcaagcaattctcctgccccaccctctggagtagatgggattacaagcacctgccaccatgcctggctaattttcgtatttgtagtagagatggattttaccatgttggctaggctggcctcgaactcctgacctcaggtgatctactcgcctcccaaagtgctgggattacaggcgtgagccactgcacctggccagttatttctagtgttacccagaattaagaacaaatgaaatacagttttaattgtagttctttttcagaaccatgtaacagtaacatcttaatttcataatttaatcatttctttccaatccatgaatttcatgttatcattttgaacactggttgccaattgcgtatgattattgtcctttacttctgactgctcagatctcagatcttgtggctcacatttctctctttagcttattctgctcttttttttttttttttttttgagatggagtctctctctgtcgcccaggctggagtgcagtggcgttatctcggctcactgcaagctctgcctcccgggttcatgccattctcctgcctcagcctcccaagtagctgggactacaggtgtctgccaccacgcccggctgattttctgtatttttagtagagacggggtttcaccatgttagctaggatggtctcgatctcctgaccttgtgatcctcccacctcggcctcccaaagtgctgggattacaggtgtgagctactgcgcccggccccagcttattctgctcttaactctggactgtaagcaggtttcaaacacactaaacttaaacttatcatctatctgcatcctgtcttccagaccattctttgtttttgttttgttttgttttgtttgagacggagtgttgctctgtcaccaggctggagtgcagtggtgcaatctcagctcactgccacctctgcctcccaggttcaagtgattctcctgcctcagcctcccaagtaactaggactataggcacctgccaccatgcccggctaagttttgtatttttagtagagacggagtttcaccaaattagccaggttggtcttgaactcctgaccttgtggtctgcccacctcagcctactgaagtgctgggattacaggtgtgagccaccatgcctgacctggctaacttttttcttaagagatgggatattactgtattgcccagtttggtctcaaactcctagatttaactgatcacttctccttggcctcccaaagtgttggaattacaggtgtgagtcattgcacctggcctaaaacattctgatttactgtaactgatagtaacagtagtgtcttttttttttttttttttttttttttgagatggagtctcgctctgttgcccaggctggagcacagtgacccgatctcggctcaccgcaagctccgtcttccgggttcatgccattcttctgcttcaacctcccaagtagctgggactacaggcacccgccaccatgcccggctaatttttttgtattttttgtagagacagggtttcaccgtgttagccaggatggtcttgatctcctgacctcgtgatcctcccacctcggcctcccaaagtgctaagattacaggcgtaaggcaccacgcctggcctaacagtagtgtcttaacctaacatttcctcatgttagggacctacctttcaaaatggtgcattattggtgagttttaccatcacaggccttcagtattatgtgaagcatcatagtgcaaaagtgaagcaaggagcaggattgtttgcaaatgacctgggtcttcatttgagttgcttcaagaaggagccatctggtactgtccttccattcctttctcccaacaggattatctgccttcaagttttgcttatctttaaactagtggcttccttctcaccactgcaggcatgttgttttctgtagatgcttggtaggtggagcttctagctgtcaccaaaatttagaatgcttagtgccaggcagtctgtttgttcctcactgataaaggttcttgtactttaagggataacaaacagggtaatacttaaagattagcttcattagaggacatgtagccaagcttggtggtgtgcacctgtggtcccagctattcaggaggttcaggtaggaggatcacttgagcctgggaggtcgaggctgcagtgatcatgcccctgcactccagcctgggcaacaaagcaagaccctgtctcaaataaataaggagaattatagtgagttatactaagca

SEQ ID NO: 60072 - DNA, 1104 bp, Homo sapiens
ctgaagagattttcattgtacaaagagcagaaacagaatctgctcaaaagaactgtagaagccggttgaaaaaatgttaaacaatgagtaattgtgtaaaaacttgagagtatatgtttgtctttgtgacacatgaaacgtttcaattttaagcttacatgggatttttaagtgagaggaagaaacagatcctggtatacataggtggggaaacttacagatatgaaaacattttgataaaaagctaacttgattggtacagagctaaaaaggtgtgtaaaacaggctttttaaaaaacttacatttaggttataatttttgcctagattaatatttgggtctcctctcccctagatgcaatataagtgaccaactttgctggtgtttcctgcctacccatctcccacattcttttacatgagaactagacagagaatcaatgataattgattttgttacttaacctaggtagccttaacatcataacatttctttctgcattttaagtctagtgatagatattcagtgaatgattctcattaatgagctaactaataatcattgttgaaagcatgtaattgcagtaatgcagtagtgttaaatgtttatgatttgctttctttttgtagaacacaaagtaattatagtgggactggataatgcagggaaaaccaccattctttaccaattgtaagtatgggtgtttattaaacagttttcactagttattgaaactaatgtgtttacaattaataagagatgcattataataatgacggaaaaacttaaatatatgttttttgttttttgtttttttaattttaccgaacacaatctatagaaaagtgagtgaaataaacatttgctaaacccttcacaaacacttattgttttctgccctcgaaagaaagaaattaatattaaataaataaagcgcatattagaagtgctggggtgaggtgataaagtggatttcacttagttcttaccccacttgggtttatgtaaataaattgatagctctaggaagccattgctaccctcctgactaatagctttggaattttttaacatagccagacttgtcaaaagaaatgtgatca

SEQ ID NO: 60073 - DNA, 1580 bp, Homo sapiens
cacccaccccccacattttttaaaaaatgagttagggcctctctctcacccaggctggagtgtagttgcatgattctcagtacagcctcaacttcctaggctcaaagcagtcctcccaccttagcctcccaagtaggtgggactatgtgcatggctaatttttattttttgtagagagacaggttctcactatgttgcccaagctagtctcaaactcctgggctcaagcagtcatcccacctcacctcccagagtgctgggattatatgtgtgtgagccacaatgcctggcctatatcttcttattttttaatatgcaaactcccttttttcatgtatagctttaccaacagatttctcctcttttttctggtgtcttgcctttatttaatttcacctgaatctccagtatataatgcctaagtatatatgtttcaatctggagcatttatggtggatactgttttataaaattgtcttatttttaaaatgcatttatctttttctttcaaactagcttttctttctaagagttaggagattgtggtatacacaagtaagcaattattgactgtttagatgaatgataatggagtactttgaagttttagtgaaaaatattattgaaattagtgtaagtttcttttcaaaaattgctttttactaccagcatttgaaaacaaatcatagtattatgtattcgggcatcacttaaaataaaacaagtggggcacagtttttatttgttgaagctatgagttattttcttactgttaacatttggattttactgcttgatgtggttcagtattataaaagctgtttatggtgaaaaagcagtagatgttttatagtaatgatgatgccatgtagagaaagtacttagattacttgagtagttttacagaaaacttttcagcatcccattcaattttctgtctttccttttaattttcttctagttcatcattcttgttgttgatagcattgacagggaacgactagctattacaaaagaagaattatacagaatgttggctcatgaggtaaatttttaaagtaaatctttaaaaaacagtgtagtaaagtatctgtacgttgcctttgcttttttgcaaagattaatgtgatatgatgttggctattttatgattaacacaactttatgtactaaactgatgaaagtcttgaggtaaaaaaaaatgttcattactttttcaaacttaaaaaaccctaacacattaatttgtagattactactgttattgtaaaaatttttcaaagctaaagttacttaagcatgcctttaaaagtctgataaattgagataagcaaaaggaaaacttaagggtcttttccccaaaagtttcaataactgaaaggttttttttttgttttttgtttttgtttttgttttttttgagacggagtcttgctctgttgcccaggctggagtaccgtggcgcgatcttggctcactgcaacctccgcctcctgggttcaagcagttctctgcctcagcctcccgagtagctgggattacaggaacccgccaccacgcctggttaatttttgtatttt

SEQ ID NO: 60074 - DNA, 1038 bp, Homo sapiens
aatgttttaccaaaaagcaataaactattgaattgagttttcataatccaaatttttttctttgttgcctttatcatatactgagaaaaaaactgtaatgtcacctttcttttaaaaaggaagcttgaaagaaatttcacattttctgcaaggacttaaacctgagctctcagctttctgcaagagtatgtcttctttattattaggaggtcttttgggaggcatatttccagacaataaacagttgagacaaatgccacatggtctattcttccatctctaacaatttgaatgtgggtattaggccaagaagaaccgaatgttatttaagtattatcctgtttatatcagagaacttatcctcaaatcaacctcaccttcttagtttttctcttagtatttatcagaaatagcttgcagtaatagctgtgtgtaggcctttttgactcatacttttaagactgagtctaagtattccattctttagaattgaggaggataaggtgaagttgctattgactttctccagtcgttaagtttcagttaattttaaaaggcggggagtatttgcactcttcatggcaaaactggcaaagttgtatcttcaagatgagactgaagcaatttcccacaaactgattaagaatatttaagagaacattccatttaaaaatttcacttattatagtgtgacttgaatgttgacactgatgtatataaataatgattgtgctaccagcctttggttaagacctaaaaataataagtacgctttcagtttttaagtataaggtttttaattaaaaatacttctatcttttgtttaggttatgccaaggtctagagtggatgacctcccggattggtgtgagataacttttttgcttgaaagagactgctctatttattctgtgacatgaacattttttcctagtacctttggctgctaaggcagcagcatgtttaatttataacaacacaaacctctgagagcaacacttgaatcaagtgcagctgaactggaacataaaagatttt

SEQ ID NO: 60075 - DNA, 2795 bp, Homo sapiens
gtttaagttgttatttgcatggaaattaagtaggctgtttatttatctaaaggaatcaagtccactcttctgcctgcaacatttgttcaaaaactaaccaaggtaaaatatttatttgaaagcccaactttgatgttaaatattcttgaataaatctgttattttaagaatatcacattattcaatgcatataaaactatcagaagttagtaaatcataccagcactaaaaataagacaattggaatatattttagcatcagtttacaaacaactttattatcaacagaaattttagctcttttctttgcaagatatatcacagctgctttgggcagtagctgaagccgaagtatgaacagtccattttgtttcttaaaatttgaagtcgtgtctgtcatagcatttttactaccagcagtatgttacttaaaaaactacatggctttccttgaatttatttgacggtattatgtaatagacttgaaacaattgccatctttgtagttatgccttgggttctaaaatgttataggaaactgctgaattgaatcctagcttttagaatattaataggagactcaaagttaatattcttaacaacttaaaattaaaaaaagtcataatctatcaaaagtttatttattggatggcattaaaacatttttgaggcagttgtctaatatgaacaataatctaaacaatatattccttaaattaagaggaaagacaagtgtcgtatttcgatcctgtttattcaaatgtgtgattttgctgaaatgaaagggataaaatgaatacttagagaataatacttcatttttgcagtactttttaattttgataaaaaagatacaaagttcataatatcaaaatatgtgttcaaaattggtattttaattttaatatttttgtaagttgatttaaattttgctcttttttcaggtgtgcttggtttattatatttagtcaagttaatttagtcgaatgtggtaacatttttctgatttatctttagttggagcacacccttgaactgaacagtggccaaaggaaagctttctgggctttggaaagtagttgtttaactttgttttaagccgttttcttagtgattctgtatcaagtagaggataagtgtagtttaacttagtttttaatataacccataatcaagaacatgagcgaaaagcagacataaatcgatatggatggtttgtggtgtgtgtgggatgtgggggaattaagaaaatgccatttacctaagcacagtttgcctgaatttctgcttggttgtgttgtttaccgtaagtactgagggtagtttccctaagtctgtcctgagaaaaagcatacttagtactcctgtatttgttcttatgaaatgactatctgccttcttgtatctagtaagattggctggctcaattttcttctgtcaaattatatggttattttttatattaccacatcagcattatattaaaagtgtttttaatagttgattgtattttgccaactactagtatagactcaaatttgctatttaatttttaaaatacaatttattttgtaaatcctttaaaaaatatttggttagttttggattagaaatgatttatgttagccatgtgttgaagatgaaattggcatcagtgtagacggtgctgattgggaaaagttcatgattaggaaattcatgtaagactttttaagagtattttttaggttttcactcaatctttcctgtcacagtaacgtgaaaactgattattctttactccaagagaatgttttaacccaagcaagtatctaatactagagcattggttctgacattcattgtaaatcagtgaactgtaagatactgtctaaaaaatgtacatttgtaattagtgcctttattcatattttgaaataagttcttagttttatattatacctgttctttagaagtcatgttagcagctaattatttcagtgatgaaataatttgtgttttatatcccccttcacctccatgtattggttagcacagtttatagtaagtgaaaagcaagggacccacctacattaccttcaggagactgttctaccttttaatttgaaaacaaggaaattaaattttaacagaaatcttttaagtatgttataaccaaagtgttcaattatccttgcaagttcaaatacagcatttttcttaattttgagcgtgtcatgtccttcatctttaaacccatcattcttattgaagcccatttgagaactcttagaattaatagaaccttttataagggaatatatggaatattttttattgttaatgtaacttaattccttaaaacctggaatattaatatatataatctattaaaagctgaagattaaatatgtaatttttgcttttagtttcttgtgttagtatgcttaaaggtatcaatacttttattctatattcattagaagaaaggtaataaatttaagtttcattgctgaaaaattttaaatgagtgccaccccatagccatagtcattttgattaagcataatttaactttcattatagcataaagagaaaataattattttagtatggaaacagtgataggcagtgctgtaaacaatattctctgaaaagttgtgggggtcacaaagaaaattttaaagaatatagaagcttttttaaaaaatctttttagtgtagtttcttagaacaaattataaacataatcattctgaataatcaatttttatttagtccttaactatgtaaaaccgtatcagtagaaaaatgtg

SEQ ID NO: 60076 - DNA, 1788 bp, Homo sapiens
aaaatgtgaatgaaagcagtgaatttctgcctctcctcgtatttagggtacttaaaattactaaaaaatactgtctttttaccatacagctagatggcctgtattattcttaatgtggccaaaggagtgaagactgattagggttttagaatttggaactgtagtcacataaaggcatcttttgcatttcttaaaccagtaatctacattttctcctggaaatggagaaatatgaaatgtgctgtgcatagcttttggaatagaaaacaaagttttaaaagaatggatatgttttcttgcacaacttgtaaaattttaattaaaaaattacctcatttttcaatccataaggtgctttgctcaagtttgtgggatgtttgtaccatcccataaaaacccccttcacccaaactgtatttgaaatatgcaaaattcataactaagggatagcattccttggagactttgttttgttttactcttgtttaccagctgggccaacatggtagatatatgagattcacatatggtttcattaaagcacataggaaagtgctcagtcaatatttaattagtttaattagataagggaaaggagaaatcctaaatttgatggattcttttatactgtgaatatatttccatcagtgttggtaagatatcaaatgactatcagttgatcccagtcatcagtgacttatttgcatatttaagccctattcacaagagaccataatcattttaatcttatattttccctcaggaaatttagggactctgaagcccctattttattctcttggagtaaactgttgagtgtagttacaaaaacttttatttatgacttaaaaaaagtttagctgctatttcagtgaaagtgtaaaataaaacggtcatgatttttttcaattacagaatagttacaaattttaccatgttcatctattccacagagcatgttaaaaacaacaacaacaaaaacctaacagcaattacaaccttggtgttgcgtttattctaatcagagtgaatgattataatcacactttgctattttaacataaattggtgctttagagcattaaagaggaagcagcaggccctgtactcagtatttattatttcttgcctcagaatgcaaaacaactttaaagtgtctatattcatatatatgtgcatttcttaagatttaaatacaaactgttgttactccttaagcttcaggctttctgcgaaagctctaagaatatcttcattactatgcttggtcaactggaagatggtattaataaggtcagaattaggaattggattgctctgtgggtcctccggtattgtgcagaggaaagaaaaatgtctttcacaccacaaactgtgtgtctgaaccccagccaaacaaatgtgttccattggtccaatatataagcattaacaacaacaacaaaaaatttaaaacaagtaaattaatgcattcacatgatcacttcttgaaaatggttcaaagcatgttttcctgatggtgggattgtttaaatgacatgttttaaagtttttaatactttattagttatgaagtgcttcttttatatgttaagtttaggttgccagtactcataatttttatttctgcaattatgttataatgagttgtttgcatgcctacttaacccaagtaaaacgatgctgtttgctctggaatgttcatcttttagacaggttttggctcatttccaatcatggtgcaatatagtgtaacattcatttgttttcattcaacagttttatttt

SEQ ID NO: 60077 - DNA, 1043 bp, Homo sapiens
tactctattgtctttgaaattcttttttttttttttttttgagacagagttttgcccttgttgctcaggctggagtgtactggtgtaatctcggctcaccgcaacctctacctcccgagttcaagcgattctcctggctcagcctcccgagtagctgggattacaggcatgtgccaccacgcctggctaattttgtatttttagtagagacggggtttctccatgttggtcaggctggtctccaactcctgacctcaggtgattggcccgccttggcctcccaaagtgctgggattacaggcatgagtcaccacacctggcccaaaattctttatctggtgtccattctgtccaggttttcccttacctcactggctttcctttctaatttacctgcttggtacttaaaaaaaacaaaccaacccagaaacctccctagcctttgaaaactggaatactccttgggcgcttttcttcagaccagctccctaagagaccttacatggtcttgtagcttaaaaatattatgttgacaacttcaaaatttatatctccaggccttgcccctaaactgcagtcttgtatatgatatttgcagctggatctcaaatctttcactcttttttttttttcttttgggacagagtcttgctctgtcgccgaggctggagtgcagtggcgttatctcggctcactgcaacctccacctcccaggttcaagtgattctcctgcctgagccttccgagtagctgggattacaggcatgtgccaccatgactggctaattgtttttgtgtatgtatttttagtagagatgggatttcaccatgttggccaggctggtctcaaactcctgacctcaagtgatctggccacctcagcctcccaaattgctggaattacaggcatgaaccactacgtttggtcaacccttccatttcttaaacttagtttccaattatttccaaagctggatcctctcagaatcttccctaagtcaggtaaatgcagatagttgttcaggccaaaaatcttggagtta

SEQ ID NO: 60078 - DNA, 1070 bp, Homo sapiens
ttagcatgtttccgaagtgatcctaagatcttaaatgggctaaagatgtttcaagttctctaacatccttttattgtgataaaatatgcataacataacatttagcatcctaaccatttttaagtgtagaatttaagtggcaataagaactttcgcattgggccaggtgcagtggctcacacctgtaatcccagcaatttgggaggccaagatgggcagatcgcttgaggtcaggagttcgagaccagcctggccaacatggtaagaccctgtccctgctaaaaatagaaaagttagccagttgtgctggtgtgcacctgtagtcgcagctactcaggaggctgaggcaagagaatagcttgagcctgggagatggaggttgcagtgagccaagatcatgccactgcattgcagcctgagtgaaagagcaagactccatctcagaaaaaaaggactttctcagcgttgtgcaaccaacatcatcctctgacttcaaaactttttcattatcccaaagtgaaattctgtgttcattacacaataattccccattccacattcccccatcccttaataaccactattacttttcttctttatgaatttgactagtctaggtacctcatataaatggactcatataatatttgttctttggggtctggcttatttcacttagtataatgtcctcaacattcacccatgttgtgccatgtatcaaatttcattcctttttaagactgaataatattccattgtatgtacataacacattttgtttatccattcatccatcgaaagacatttgtctaacctcctttcttgatatgattttaacaaaacaatggcatacaattagtccatatgttcaatccaaaactaacttggaaaagaaaattatgctagcaagtgaagaataaaacgcattccgtataaatcccttaggccacattcatatttcaagataccatatctacatgactagaatgcagatacacttgagattttgtttacctgcatatgaaccattcaatactgactgctggctgaaaattaacttttacttgctc

SEQ ID NO: 60079 - DNA, 1032 bp, Homo sapiens
tacaaacttagactgtagctaccgctgacctaatgaacctggttatttatatgctgtctttttgttcatttgtctggtcaaaagggcccactcaccttcctgtgggcatagctggcgggagcaagtctggtatttcagctgacttctccttttggctttctcttctccttctccttttgctatcttttctcttcaattcattgaaaaatgtctatatataaattacataaatgcaatctgcattgcaaaatatcccaatgaaaagtatatatgaaataatttttggcaaactgagtcatgttcttagtggatatgggttcctgtgatttcaaggaatgctgtcctgaacttttaatttaaaaacattcaacctcctaattattttgccagtccgtagttttatgtttaagattgcccaaaatgtactgcctgtccataattctttcaagaattattgcttctgatattagccattttaattctatttactatttatataggtcctgggaatatacacctttgaattttttgttgttgtcatttagccctttaatttgctaattccaggaaacaaaaattgaactaagagacataccactgtgtctttgcactttttttcttggtgcttgtttggagcagaaacaggagggtcattttagtttttttgtcatacaagaaaaatttgaagaatattttaatactttgaaaactgtggatgccctgtgaaaatcaagttgacttgtgaggttaaaacaaattttatttcacattttagtttgagagcattcttgctatattacaaagatattgctcagtgctttattttcatatgctggttttgttaaactagcataggatattatatatcttgtataatgtacagttgtacctactttgattcataacttggctttaaagtttttatgtagctttaaaaaaggtggtttttttgttcaaactgaatgaattttatgaaaaccttttgttttacgtgaagtgtgagtaaatatagctcctgtatcagaatcttgt

SEQ ID NO: 60080 - DNA, 1940 bp, Homo sapiens
aaaacctagccattatatctcatattctttatacataagttggagatgatacatgttacacatgtctgtgtgatgtgtgcttaaaacatatgacatttcatgatataatttgaaatatctttgtaaagttcaatttgcataatttttatattagttaaccttttcctccaccagggtaacttcagttggaagatgtttctactgtcaatcgaattttttaattcactgtgtgagatagaaaaagacatggtttctatatataaggggtgtgatttacaagaggctatgtgcatgtgtataacatggatacagtgcgagggacaaaccaatacttgtggttgcacaagggagccggggaagagtcccgcggaggtgtgtgtggtgggaaagttctccagggaagacaacattcgattgtcttgtggttgctaaaaggacgcttttgacgccagatgggcttgagtccaaatcttggctctgaaatttcctcgttgccattttgaccttgggaaaaaatattaactctcgaacctccatttcttcatctgtaacacagcagtaaaattactcatctctctagtcataataactgttgtcaaaaatgtctgttctctgaatgtttggtgggtttcagtagaaaaaataaggaagttggaagtgggaagttaaggatgtcagaggcagagacaaaaaagggcagggcaaggcatggaattttctctgaaaactttacttaatctcattaagtgttggttattgatgaatctatatttcaaagtaccagacataaaaccatatcaccttcggtctaatgatagtcaagtgcagtgctactgttgcaggtctgggaaaaattcaggccaatgagagcctttgatggccgtgggaacagtaaattgcagcagtgctgcaattaactagaagtgccgactgcacctccagcaggctcagacttgcatggctgcctgctggaatgcaaagcttttctcttattcacaaccctcccactcactcattgatagcctagggccagatctggatgtggaaaacattattccaataaaaggtgcgttaaaagaacactcaaggagtttattttttaacaaactcatgttgtgtaaaatgagatgagggtctcagaaacagttttcttttcttggcatgggctgaggacactaagcgaaattctgccgcgtcatctactttgaagcaagaaaatactttgaccttattaatgtacttgtttctagggataaataaaccaccttaggagattacacaattcccttggatgataagttaactttttttggataatgatgctctgtgtataaaggaatccaaaatgctacctgtgtgttagtgaattaatcgaaaaggtaagcaatctatgtgtaagaaaaagacacctgttctaagattgcatcaatgaatagaagataagaaatgtcaaaataaaaaatgcatacaaatctttaaaaagcattcagagttcagagtttcctgggcatttcatattttgctttttttttttttttctccagaactgtatggaggcctttagtgttttggttgagtctagccctaaacatatgggcaatagaagtggacgtcttcatggtgttatttgaaagcaatggaaccagtccttgttcctgcatgaacttgcaggttgtcattaacttacagagtcatttatttgggtttagttaatatatcttggaaaatgtgaaatattgcaaggaggaggaatggtcatccatatcttctgcatttgaaacctagaacaggtgtgctaaaaagacaggtatagtgtccaggtttcaatggactgggaaaggaagcctttggcaaggcccctggttagatcaagaacagcacaaaatcacagagaaagagagaggtagagagagagagagagagagagagagtgtgtgtgt

SEQ ID NO: 60081 - DNA, 1998 bp, Homo sapiens
ggccttgcacacctagccgggtgttgaattctcccatgaagttgacagttggcccaaagtgctgaaatttcagacttgagccaccgcacccagacaggttttttatcagctgagtgacaaactcagatgggctcttcaaagggtctctctagtgtggagagcagctaggaagggcaggtctagagatagaccaaattcagcactactggatcaataaagatggaatgtgatgcaggcttcagataagaggaggatagctaagataattctcatgttttccaggtgctttagggaatagaaacatgagctcaaccttagacttggcgagtactgaggtgctcatgggacataccagtgaagacagcaactctcccaggactggggctcagcagggagggctcagatgagttcaggatgtcaaatcatcgaggtgtatctggtggtgatgggaaccagccagtgagcaggaataatcagagaagagcagagggtcaaggtcagagtcctagagagctggtctgggaaggggaaactgaggaatgggcccccaggcgggagatataggaggagccacctagagtgagaggcagattaggaaaagcatcactaggacagatcagggaattcaataagagtggttttggtggaggaatggtggctagctggtggcagattgtggtagggtagtgatgaagatcagagaaggatgcagtaaggtggatgacgtgccagccttttaaaaagcatggctgggatctgggtgtggtggctcacagccataatttcagcactttggggggctgacatgggaggatcgcttgagcccagcagtttgagaccagcctgggcaacaaagtgagaccccatctctacaaaaataaaaataaaaaaattagcaggatgtggtggtgcacatctgtggtcccagctacactggaagctgaggtggaaggatttcttgagcccaagaggttgaggctgcagtgagccaagattggtccaccgcactccagcctgggcaacagagtgagaccctgtctgaaaagaaaacaaaaaaaagagtatggttgggaagtaaatgacagagagggagtggccagaggggaacataagagaagagagggttttttgccggcaaaggagatttgagctcatttataggcatgggggaagacaatcagtaggtgcataagtgagttgagaatctatactagcaatacaggaaaccatgttaggatcactgtctcaacaaaaatgatcacagccttccaaaaatgcaacttgactttaaaaaggctttcttttatcacttgcaagaatattgctgtgacacctaataaaaatttaattaaggcttagatgatatcacgttttatgtaacctgaagtccttaaatccatgaaatcactcaaatagaatcaagtttgttggaaagagaatctcatcttaagaagtggcagcaggaaaaatgagtaagttccattttattttatcagtgaagtctggggctacgaaatggttctaacagcataaagaaataacagctgcattcaagaccaggatatgtaaaataatttgtttagtttcagccactttttaaagtcaattttacaccctgaaagaaaggcaatcctgactccattgttctttcgccaataaggagatcgggaattacaataataaatagaagaaagaatgttgtttttcctcactgtaattaattttatggctcttgcgaagatgaatttttgtggtgattaaaatagtcccttgcacatattaggtactcagtaagcatttgtgaaatagggactttctagcctttatttgtgtttaaggaatcagggaataagttcaaaattgcctttcaagaaatttttggaactctcttctcactaagaaactgtaaagtcttataaaagagacattatttattttctccaagtattgcttgcgaggtgaattgaaggttttttttttatcaacagttgttttata

SEQ ID NO: 60082 - DNA, 1127 bp, Homo sapiens
ttttgcttttaggctttggcatgataacattatactaataaaagtgatttttattaaagataactcacagtggaagctttatacacacacaaacacacacacacagacacacacacacacacacacacacacacacacactcacacaatgtcagctctccttataataaacttggtttgccagacatcatcatctgccagtttgatggtctgtgatgaacttggacccagagatgggcattgagaactttctccaaaaagttcacgttgagtttgagaagcattagtcaatcactgtaagcgcagcaaggattcaggctttgttcagagttttgatgctcatttcgtctttttacatccctgtctttcctggccctgacagctcaacactggcatttcacacatttcatctgctttctccataccgaaaataaactgtttccagacatgaataaatgggggaaatcaaaacaacttgtactaaaaatttgagagttctgaagactttttatttattttccattacttcttatttcacaagcgttcttaaatatcttttttaattgcatccttgaagatacatcataccgtggttacagggataaagaaatcaatcattgctgaaatcatttccttactggaaatcatcagggaagatagatatgtacaaaataattagaatcatgcaaactgagtttctgctgtggctcttttatttttaaagtgacaaataataatagtcataatttattaaacacttgtatggcagatgttcagccatgccctttaagtagactattttattaaactttcacaagaagcaacaagttacctagtttacaactgagggagctaaggtgtacaaaattaagttacttgcctaaagttctacagctagcaagttacagagctagtcaagaccctcactaaataggaagtcattttattatttatttcagcttcccacaatataattaacactattcactttttagatttcaatgacaggagaaaaccaaaatggcctagaactaaatcctctctcgctgtcctctacatctgcaaccgacacacttcttaaagctgtattaatattaaaattgcaaactgaacccaatcaactgaggg

SEQ ID NO: 60083 - DNA, 1010 bp, Homo sapiens
aagctttactgtactcgaggttctgccctctcattactggtatgaatggatgcaaagatagcctctttggttttgtgtttttatgtctttcctacgtcattatcatctactttgctacttctctgccatttagcctctcagggtataatgggtagtaaaaaaacgtcgaaagtacctccaagcatctgaatattcctgtgaaagttctaattgaaggttgttactttctgtttcagcccttgatcatctttggaagcttcataaagaactgagaccttaaaaatggaaaatttagaaagaacaaaccattaatgtagtagtaagcataaagttggttttcacagttgtgtaacagatttctgtaagctctctttctggaaatacacagtcttaacttccagctgcctgacacatgatgaacacctacaatatgatgcccttaaatcctccctcaatttcctaacaagcacatggctaccattgccacattcctgattattatttcagccatctcaaagattcttatatgcttctgctggcttcacaaattcacactttcccccctcatttatacttcattgccaatgaaaaaaataaattactggaatggatacattgcaaaaaaattatcttgtaggtaatttgtagttttcttggctctttagaatgattgaaaacaaaggaaattagatgtattttttgggaggtggaactgaatagcaatataattgatttatgtagtcttagggtattctttatttgtttagtggcttaaacaacacaaatttattgtcctgcatttctggaggtcacaagtcctcaaatcaagttgttgaaatgctgtattccttctggaagctctaggaaagaatttgtttccttcccttttgcagcttctagagctcatctacatcccttggcctgtggccccatcttccttattctaagccggcaaagttgcatttctctgatctttcttccgtgggacaccgctggctaaatctcctgtt

SEQ ID NO: 60084 - DNA, 1055 bp, Homo sapiens
gttgtcaacattaataaatacattgtaataaaatgtctgtaaaatatcagcattaaaaatattagaaagtttcaactaggtttaaacaagtcatttgtcaatgcctatttagaaattaaaactgttatctgggggctgtagaacccgtttcaatgtgatacgtggctttgtaatgtttttatttattttatattttttgaattgaattgaaaaagctcttttttaacctttattttgggtttgggggtacatgtggaggtttgttacatagacagattgtgtttcacggggaatttgtgtagagattattttgtcaccgaggtaataggcataatacccgataggtagtttttttgatcctctctctcctcccacccgccaccctcaatagtctccagtgtctgtcattcccttctttgtgaccatttcttctcaatatttagcttaataggtagttttatatgagatttggaagcttagtctagtcatcttcatgtgcattaaaataagggagtccatgtgcccaggagttctgccaacgtttagcaaactattggcacattctcggaaatagcaaccaatgtcttgcaatgtctgcacctgatcaaaatgtaatgtagtttattcattttctgactctataaaattagcttgaaaagaaaatgttaactctatgccattgaaacaaaaaatatgacccttatttttaaattcatatttagttacataattacccagtcagtaggtagagaccactactagtgtatattctgttgatttattttcaaaaaatttaccctctgtttaataaaatacatttgttttccttgaaaactgttttagtgtatttactctatcagcatatactttttgaccttgacactttattcttctttaaatattatttcaaaacataccaagtatatagaaattaccaagatgaagcatatttgtggttaattcaaaacttttaatgagaaactgcaaaccttaagttaaaatatgtaagatatttttatttcttgtaagttttttgttgacatttgattataccc

SEQ ID NO: 60085 - DNA, 1129 bp, Homo sapiens
ttagagacagggtgggggtgattgggcttgggtcggcatccatgagttccctccaggctgttctctggcaaagagggctatgatcatgggacatacttgttccctgggacaagtcaacccaaatgtaaaaaaaacacaccatttgttgcaccctgggacacgcttttaaattttctctgggtctccttgaaggtcaccagtgtgcgggaaagagtctggactgtttggttcactcccgttttccacatatctaatctttatgctgattcaaatgattacaaaactcctaacagaacagtttgactattggcaccaaagaattgttttgacaggaaatctcctaatacagcaaaacggtcggtacaggttcaaaacaagggtgttcatgctgtgtttttatcatgtgctccaaagtgcactgaagttcacgaccgatgtttgtccatggagttcccagagtgctttgtggcagagatttcgggtggagggagcctagagatgccttagaaatgataaagaaacaaaacaaaacaaaactcttctatgggatgctggctgattccatgcttattggatggcacactcaacagagtagtttgtgggtctgtttgttttgttttgtggattatggttttagatttaaagggagtgtgtatctaatccagctttccactactggaatgttgggattaacattcttcttcgtcttttttttttttttttttttttgaactgagaccttgctcccttacccaggctgtagtgcagtggcacaatcatggctcaatgcagcctcaaactcctgggttcaagccattctctccattctctctcctctacctttggagtagctgggactacaggtgtgcaccacagttcccagctagagttaccatttctttaatccagtgtttgtcaaagtatgatcctttgcacattgaaccagaagtgtagttttagcaaatctggacttgacaaaaacatttgtaaaatatcttataaaacgttatataaagtttactttttactagaaaatgtacatgataagaaattccatttcatttatttggtatcacaaagatctatttccactgcaaagtaagattaggggtgtttggtggcatgcagt

SEQ ID NO: 60086 - DNA, 1727 bp, Homo sapiens
ttcccttttggtcacctgagacttggagagacatcactttttaagtggttgctttttttttttttttttttttttgaagttcttattagaagaggcacaggaatgttgaagagctgcttcaaaggtggaagatagaacattccatgcctatccccaccagctgccactatctaagaatagcctagttcaggccgggtgcagtggctcacacctgtaatcccagcactttgggaggccgaggcaggtgaatcatgaggtcaggcatccgggaccagcctagtgaacatagtgaaaccctgtcttcactaaaaatacaaaaaattagcctggtgtggtggcaggtgcctgtaatcccagttacttgggaggctgaggcagagaatcgcttgaacctgggaggcaaaggttgcagtgagctgagatcatgccactgcactccagctgaggggacagtgtgagactgagtctcagaaaacaaaaaacaaaacaaaacaaaaaagaatagcttagtttatgcctcatctcgttctcaaaagtttggaccttctcgggggtgtgacttgctcaccaggaaatgggctgcaggtattacctggtgttaaccttccttgatccaagaccatataatatttgaaagtgtgagtacagattatctagtgtgtatgctcaaaaactaggccagaaacatgaaaggaatcattgagcgtgttgatcattctgagatagtgctaaaaactgaaatgtgtctgtggaaggggataaaaatctaaagtttacccttctaggtatattttacctacacataactttaaatactgaatgcctcctgtaaacatgttccaatttgctctagcataattttaaataaaacctccttagttgtctcattcaagttctctaaggttactgttttgccatataaaatttcccatataccttacattatatttgcttgtgatggtaaaaaagtaggtatcagcttcagtagagcctttgtcaaacatccaagccatgagaggtgctaggcttatggattcacagacagaacttaagggatctttgaagtcatctcgtttcaccttatagttgtgaaaactgaagacccagagaaatgaaataacctccccattgaagccagagcctttggtgagtgagccaggtagaacccagtactcttgtctctagttgagagctttttctaccatgccaagacacatacagtcttttctatttttagttcattaaaaaagaaaattattttatcaatgaaaatatattacaatttttctgtgttacagatcagtatttaattctgtgcaaatatggatagtgaatagatcgatacatatttaagagtgtatgttctatgtaagcaaattgtttctctttctctgaaatgtctgtctgctgtgtctcaaaatatttccctgaagctatttcttttctctatataggctccactctatcttggcttattacttgtgccattttctttcgacttagtttatttttctcaaactgattccacatgttactttcaatcacagcatctcaagactttggacgaacagccctgaagcattttgcttctttggtattctaaagggaatttagtctgagtgtacagagctattagagctgagctgctgaatgctttatcttagtgggttttttttgcctgtttttctataagccagttgatattttaaaaagaaatacaaaaactt

SEQ ID NO: 60087 - DNA, 1629 bp, Homo sapiens
acgaggtttcaccttgttggcaaggctggtctcgaactcctgacctcaagtgatctgcctgccgcagcctcccaaagtgctgggattacaggcgtgagccaccgttctcagccaggacaactgtgtctaaatgttttacccagaggacacccaattctgatgtccacagaaatgctctacaggctggcagaggctctggagctagacatatgcctctgcctacccattgtgaattgagagatagtgttccagtgtggttaaaagcttatcgtaacttgtactttatggggctgtccctggagggtagggttatgtgtgtgtgttggtgtagagaggcagtgagacacacatcagtgaaagctttgtttacttgctatttttttaaagcacaggttctgggatcaggaggaaggagatggtgttggaggtgaggcttccttctatgagtcatgattccacttacttgactttagccttttggagtgtccctggggttgggtttgttggaggcttcatttgtgaccagtactgtgtgtgttttcactcagtacagttttgaatagatgctaccacatttactttacggcttagttgtatggaactcaagaagaagggataaacgcttgtcaccttggagagtatatatgagactcagcttagtgatttcagtggcaaaatccagctcagtgtttcaaaaactaaaacatgttttgaaagcttataaagttggtctccagtgccagaaattcccattttggactggcttcaaggcaatgaaagctcagacactgactcattgaactatttccttattaataacatagtaccaagcatttttgagggttgaaaaaataactgaactgttgtccaaaacctttgagcctctcaaatgcaaagctttttaaaattcttaattttgagacttttgtgatttcaaaggaaatctgatctatctatctctttatatgttgtttattcttaactcatccaagtgctatttggccaagattggcttatgtttaaaaaaaaaatctcttaagtcattttataagctgttcagggctttatttctttagaccaggaagttgtaaattgccagcattaagcagaaggtgtgttgttgagtgctagttttattgaaaaagaatgaggttttatgtatttttgagatttgctttattgacaatccaccccaaaatatcatttctcttagatatactgttagaaaagtctcgcctgaagaaaaacaaaacaaaaacaaagaacaacaacaaaagacataaagtattgcctagttagaacaatgacaatccaaattattttgatgaaacataagcacatttagaattaacacagggtttatcaaagagttatgtaagagtaaaaatcaaaggatttatataatttttattcatgctaataaaatgtcattctgagggcttggcattgttatacatatttattaaactgaatacttttcatttgatatgggcagaaaaaattgctttatccaattgctacactgaggcaattaaggataatttaaaaaattcaagacagtcaatagaaaatgagggagaaaaaggaactaacaagtcttatctttgatttcatgtgaaaagattgatt

SEQ ID NO: 60088 - DNA, 1046 bp, Homo sapiens
gcacttaggttgattccatatctttgcaattgtgaattgtgctgcaataaacatacatgtgccagtgtctttatgatatagtgacttcttttccaatgccaccaaatcttaagtttgtagtaggttgtgaaagactttaggtctgggggagaaagttgggacaaactaatgatggacacaatataccattttatgagtttttagctttagatactagggtaaattgagtgccttcatttaattaaggcttttacaaatatacctttttgtagtgcaaataatctgtgtttattgcaaaatttggaaaaatgggtaagtaagcagaataaattaagagacctatatccttttaataatatgggggcacttgggagaccatcccgtgatgaagtgtgccagagatccaggccaccccttggcggggcttaattctcaggaccttgctgcatttgagagaaaggagagtagactggagtttcactaattttatcgtagagatcttgtctgtgctagattgagagtcttcggtgatggaagggaagataggactttttttttttttttttttttttgaaacagagacttgctctgttgctcaggctggagtacagtggcccaatcttggctcactgtaacctcggcctcctgggttcaagtgattctattgcctcagcctcccaaatagcttggattacaggcgtgtgccaccatgtccagctaatttttgtgtttttagtagagatggagtttcaccatgttgaccaggcttgtctcgaactcctgacctcagctgattcgcccacttcggcctcccaaagtgctgagattacagatgtgagccaccatgcccagacgatagggctttttatcattctaaaaagaacccattcttggctgggcatggtggttggctcacgcctctaatcccagcactttgggaggctgaggtgggcggattgcatgaggtcaggagttcaacaccagcctggccaatgtggtgaaaccctgctctactaaaagaaaaaaaaaataaataacaacaacaa

SEQ ID NO: 60089 - DNA, 1051 bp, Homo sapiens
ttttggaaaatatgtcagctcaatttggaagattgctaaaccacctaaaacagagcctgtttaaaaaataaataaataaaaaataaaaaaaaggctggcacggtggctcacacctgtaaatcccagcactttgggaggccgaggtgggtgggtcacctgaggttgggagttcaaggccagcctgaccaacaaggtgaaatcccatctctactaaaactacaaaaattagccaggcctggttgcaggtgcttgcaatcccagctactcgggaggctggagacatgagaatcacttgaacccagaaggcagaggttgcagtgaaccaagatcacaccactgcactccagcctgggcgacagagagagactccgctgaaaagaaagaaagagagagagagagaaagaaagtggagagaaagaaagatggaaagaaagaaaagacggtgtgcttttgtttgctgaatgatgggattcagagcagccagtgttgtcttctgcaacccgcaaacacccatgggaaggagagcttgtctggttagttagatgactttggatagatgaagagtacaaatgcatggcaggaaaaaggttttcaaggcatgatcggttttcctttgtgagctgaacttggactcttcagaagtcctgaggacgggccagcttggcaagttttctccttttcagcttccagtgtgcactccttctttccactctcacctctgaatgctgtgtggaggcgctgatctgcctaagacccaggctgtgagccaagctgtttttaatgaccgtccttaagcttcagcccaacagctgttttacaggtgcacatgattcagcaactagctcactgtgagtgtatgatttaaaaggtgcatgtaaatcatttgaaaaggtattttaaatgctccagtgggctcgctatttaaaggaatccttcagcaaatcttttttgaaagggaagactctccttctaatgccagtaatgatcaccgccccctaggtttggccttatgtatatttgatagatttaaagtggggtgagatatattttc

SEQ ID NO: 60090 - DNA, 1025 bp, Homo sapiens
ccaagagatatctctccgtccgcttggctacttaacagcagctgttgtttgaaccataaagtgaattattcattaagtcagcctttttgccagctgactggctgctgactttctgaaaaatgacattgatttcttaagatcctcaaataagtaatgaaaatcaaccgtctaaattcattcaaccttaattgaataaataccgtatggattctcccacaggatctcaaaagcaaaccaaaaattgttcagctgaaattaaacaatctttggctgtataaaactaatgggagttgaaatgcaggaaattccatttagcagtcaaaaaccccagagcatgccagacttattcagagcattgcctccatcttttgttcagagaatatacagagaaatgttgagtatctgaatttctaaaatgattgcttgggtaaagaggacctgcttggatatgtacctatttaaaaagcatttatcttggaaatacgttgagctgtaagtgagatctgtagaagaataggctagttgttacttgcttcggattttccagaaggaaataagacttagtcatgaggggcacattttaaacaggtttacctgtttttgtctggccagaagggagtcaacctaaggaaaagtaattttaattttaatttttttcttctttttttttgttttgatgatctcagctcactgcaacttccacatcctggattcaggcgattctcctgcctcagcctcctaagtagctgggattacaggcatgtgccaccacgcccagctaatttttgtatttattagtagagacagggtttgaccatgttggccaggctggtctcgaactcctgacctcaggtgacccacccacctaggtgtgtaaacttggaattctatagtttctgtacatttttttagaaacaaatttctgatattatagccatcgttttcagaccttatttatacaactagttagtatagactgctgtgtagcaaatgaagtgtggggagatcgcagtgagaacagagtg

SEQ ID NO: 60091 - DNA, 1029 bp, Homo sapiens
attaaaattcagatttttaacttagagtccttaatgagatttaaaaagagtttttggctttgaattttaattatattttttcttaataagctgtgcctatggttaatttctatatctttgtgaaaatgttgtcattttcaattgatgaaggtgttttgattaactttcttcaagatctgcgtatatatatgtatatacacacatatatatgtatatatatactcacagatatatgtatacacatacatatatatgtatatatatatactcacatatatatgtatacatatatatgtgtatatatgtatactcacatatatatgtatacatatatatgtgaatatatatactcattgctattgtgcttcttgcaatgcactaattactttattgtcttcattattgtcaaggaatttggtaggaaaagaaggatatttgttcaaagatactttaggctttccacttctaattggaatttctactttctatttagaagttaaaatctgtaagtagaaacacacacaaaaaattgctttggtagaccctacagaatcaaaagacatacgttttaggtttacctttagagaaacagcagttttgccagtacaggaaaaagttataatactggaattttccctgtgatgatgaattgccagtctgagaggaagtggttggggaatggtggcccaccagcctgaaagcccccaagaacaaccattaataagcactctttggttgaacacccatcattatggggactgagctccctgggagagcgccattctgcctccatttgacattcagaattgtcagtaagagaatgaatggaagtgtataaactcttcctgaaacagactgaaaaagtcttcatttggagtaaagaataaggagctaaaattagaacatctcattttttcaagagagttttataggtgaaactagaatcatgataattactttgattacgctaaaaagtaagacttgggatattttatgtataccatgttttaagtgccaaacattttcaat

SEQ ID NO: 60092 - DNA, 1081 bp, Homo sapiens
ttaattcatttacagacaaacacaggcttggtgtggtgatgacagtgagcagtgaggcatcaatactgtgcctgctctcaaggaattcattgtgtaagagcttttttttttttttttgagatggagtatcactcttgtcacacaggctggagtgcagtggcacaatctcagctcactgcaacctctgcttcctgggttcaagcaattattctgcctcagcctcctgagtagctgggactacaggcgcatgccaccacttttggctattttttgtatttttagtagagatggcatttcaccatgtttgccaggctggtctggactcctgaccttaagtgatccacccacgaaggcctcccaaagtgctgggattacaggcatgagccacctcacctggtcctgtgtaacagcatctaagtgccataagcaaatcatcccagggccatgtgatatgtacaatcaaagtatgcaggctgtagtgtagcatgaaggagagtgtgatgaaactgcttgggattgagagttggggtgttgtcaaagaggcttagcctagaacttggcatttagatgggggcttgacagattgagaggagttcacctaactgatgacctgtttatgggaagagggaggggcatgctaggcagagtaaatttcctctgcagtggctgaggtgtagaatgacatctccaggactgtctcatagggtgaccactggttccagtggcttggggccgagaagttttctggaacgtaggatggcttccagtgttaaatatggaacagttctggacaaactgggatgattggtccctctgactgtgagttattctttattatggttggagctatgaagcggagggaggagaatggtcagagaacagtttgctaagtacagacatttgcagagggtgcattttaggcagatttcagggttgctcgaaggcctcaaaggtggtgttatttcttaagtttctgtagtccttagcactgcaaatcacaaaatatgatcttgcttgtaaactaggtacaacagaaacaagcaagtaaacttgggcaaaaaagcgaagaccacccaaatga

SEQ ID NO: 60093 - DNA, 1034 bp, Homo sapiens
ctggggtgcagcatcaagaaaggagaactgaatagaagcagaggcgtttactctctgcccagaactaggactcgatggatattgaaagggaaaaacacatccctattcggctaaaagcccagactttgccacgacaaaatgcaaaaaatctgcaccccctaagtatgtaaagacttttaaatttcttcgaaaaaggaaagaggagaacacagattccaagaactctgtaatctctcctgtggggtgctgaattttcttaatcatttataaaataagaaatctctttgattgggggtatattaacactcctgaaaatacaatcccggtggttactgtagctgtaattttgtgattcagccaatttttctactttctaccttaacagagggagaccacaaagtgtcaggtttgaatcagtaaaaagagggcagaaggatggcccaggggactgtttggtgggtactcacccagggctaagagctgccaggtactgtgtggatgctcttttgtttggtccacagcagccttgaaagatttgtgtccctgtgttttctgggcaatttcaatgatttttttacacgagggcaatttcagagttaggttttagtattttcctaaggtctcccattaatgagcattcaaaccctgctggtattcaaatgcaagctttgccaggcttacagggttgatcctctaggcttgacgttgctctttctagcaaaaggaaagacaaatgacacttgaattatgtagtgattttgaacagcagcagcccatgagtatccataggagggtaattgtggggtttcagtctggctcataaaagacttgttttgaatccagggttgcatactaagaacactgcttttatttcaagattcatttattttgttggggttctggggattgatggagattattgggatctaaagtcctcaagtagctccttggcactgccactagttgcggaaacaaaaatctacctctgaaagtttggaaagtgtactaggccatttttgccttcctataaagaa

SEQ ID NO: 60094 - DNA, 1037 bp, Homo sapiens
aattgaaatgctgcaaagcacacatgcctggagaaagagagaggcagagagagataaatagagagagagaaacgagaagcaccttactgattcccgttggtgtcagtgatgacagacaacctgaagccactgctgtgaatcttaaactgccctccctgagtgctgattgggctttgtcagtagggagcaggcatcacagtgcttctaggggggcaggggccactgggcagctaagtagaataaagggaacaaggctgatcaaaacatgggacccttccagggttgtgcacccatttgctccttgtagactcattcatgcccctcctcaggttctcttcatgcagtaatccatctctcaacctcctcagggtatcaagaaatacctgtttccaagttcccctgcgatgcgatcaatctgaaatttctctttccatcttcctgaagtattatgtatctgcctagttctcacatgaagaaaccgaattccagttttaaagagggctctattaaccactattttggatcgattactccctttgccctcacacagacttcctccgaacagaattcatccgaacaaatagtagaggaggtttccacttcctcaattactagcacataccaaatttgttttcctgagttcatgaaagttaacttgactagagttctaaggatttcaaacttttcagttccatatttctttttcattctcgtatttaaagatgatcactgcacttacatttgatgagcaaattcaagtgggcttggagtcatgcaggtaaatagttccggtgttaaaagaaggagaaagacagaagaccacatagcatgagttatcttaagaggttttctttctggatgcaggagaatagtggggcatggggaccatggggaccataaggagaatgcccagcctaacaggacagccattacccagctgtggaggattaggggcatgtaggaacctgggcccaggatgccagatctcctagtttctccagagacatccgaacgcttacatattggctattcattca

SEQ ID NO: 60095 - DNA, 1028 bp, Homo sapiens
agccagggtaacatagagagacagcgtatcaatttaagaaaaaattttttaaataatgaagctcaaccaaataaaaaagaatgaaaaccaaattgactgttttaggggcaaactttgactccaataactggtagaatttcttctcatgattgtaacaatttctacagatatagctagctgatatcttatgcaagacactggttttagaggtgtgatgaagtaactgggtccagtgtagattgagaaattacaggcaagggcagggtcaggacccacatcttctatttgtagctactgatttgggcagaccctttcccctgcaccccgacattgcaccttttctgctggttcctggtaattgatgcctggtgctatgaactgaattttatccacttaaattcatatgttgaagccctagcccccagtgtgactgtatatagagatagggtttttaggaggcaattaaggttaatgaggtcataaggacggagtcctaatctgataggattggtgggcttataaaaagagagagaaaaagacatccctctccattcacacacattgaggaaaggccatgtgaggacacagtgggaaagtggccatctgaagaccaggaagagagtcctcacaagaacctgattatgttggcaccttgacactgaacttccagcctctaaaaattgtgagataatgaatttatgttggttaagtcatctagtctatggtattttgctgtggccactaagctgccatggcagcacaggcatattaagactatatatgtggaaaaatgttctattacacaacatttttccaaaagggatcctcatgaaacttccatccgttgaacacctaacctgccaatctgatctcagctatgagtgtagggtactttttaaaaaagaaaacaaaaatctcttttcttttcttgcttttttttttattttttgttttttcttttgaggcagggcttgctctgtctgctcagtacagtcagagctcactagagccttgaattcctgggctca

SEQ ID NO: 60096 - DNA, 1077 bp, Homo sapiens
aattagtgtgaaaatggatagcaattaacataggaaaaatatgtaaagaaggcaagaagaggtgtaggcacactcagaaatctaggagtatgacctgaatgagtctgatagtctgttgccccgagaaattgtaatggggtatgttttgggaaagcatgatgtggccttaaggcacagtcatatatggatgtaggtgccataaatttactgcaaaccacctggactctgtacgctttgaccaagtcttcaaaaaatgtttcataaatttattttctaccatatgaagacgtaatactttttttgtttggctcaaagttaccattcccccttcttttgaatagttaactgttttccatagattttaagaaattagttagcaaattcagtcgattttgtttatgccttttatgttctttaatattttacttctgagcttttgttttctattttgtcaagcctcttaatccatttattgggtcttcccaccaccattttcttgaatcttttttttttctttcatgttaaatatttcttaaaggatgaaatccaagagcacataatgtttacactgtagtaattacaccattgtttcagtattacatttcttttcttttttttttttttgagacagagtcttgctctgtcacccaggctggagtgcagtggtgtgatcttggctcactgaaagctccacctcccgggttcatgccattctcctgcctcagcctcccgaatagctaggactacaggcgcccaccaccacgcccatctaattttttgtatttttagtagagatggggtttcaccgtgttagccaggatggtctcgatctcctgaccttgcgatccgcctaccttggcctcccaaagtgctgtgattttttctttgacattgctttttatgacaatgcccagggttctgttagcctttttggttgcagaagagtcctttgttttatatactatttggggtcatttattatttaataaaggatgcataactaattagtgacacagcaaagtttctcactcacagctaaccaaaatagctcttcttcctgcattcataatctcaatt

SEQ ID NO: 60097 - DNA, 1028 bp, Homo sapiens
agaaaaaacaaatgaaaaccagaaaaagaaaatacaaatgataagctatgggtttccagggatgatataactgagacatctatgagtttcaagtgagagttgtttaagactatagaaaaattgttgttcaaagtttttcttgaggatgtcagaatttctacggttgtgtagagaaggaagagaggatcacagagaggaagatcctgagtaaatatacagatgaggagaatggtagggtatatttgggatagtaaataattgagtttgagttatgtcaatggtatctttaccaaaaaatgtggcatgttaagattggaaaagtaggttgggacaattttacaaaatgccataagggatagttcgagtcattagtccttaagtaataaactttaagaagatgaatatagatgtgtgtataatacattaaagtgtagaaagactgaagttagtacatttaactggaagaatattgcaactatttgtgtgaaaaatattgaagcccttggtgattttgttgcttcaacccaaggaaaaggaatcatactattggtaccaaatacagagtcaagaaacactggctttagggagaaccagtgacttcaatagtgaaacttaaattttgtgtgaaaataaaaaggaatatatctaaatgaaattgctcacaagaagtatgtcttttgacctcatcggatatatccagtatagtgccaggcatttaattaattttgttgaagggttaaatgaaaagggaagaggaaaattgaaaggtggccccaataagccatgaatcatatcctgtccactcatgtcataaaatataatagaaatatggtgattctaaaataccgacattaggcatgttttctgaaatttaggtgaacagtgttctattgaatttttcaaaaagttaactatgaaccatatgtgcttaaaatgtgtacacacagtgtaaaaataatgacagctttgcattttcaatttctcaaattgttttatctttaaaactcatgtcagcaattcagccaata

SEQ ID NO: 60098 - DNA, 1008 bp, Homo sapiens
ccatgtagaatgaaagaaacggaagggataagttcctctggaacaggctctataatcattattctttttttttcctaaaatcaaaatgatctaaacagccatgggtcaaagagtgaacattcaaatacttcagagcactagagacctaagcagcctggagttgtttcaaatctactttaactctgcttctgacaagtggtccctaatgtgtagagtaacgatatctcctaatgctgcaatttctgtgccaatgcttattttacatagctacaatgaaggagctaaatgtttccagtatgtattaaatattttagtgaagatccccaaggcaaatgagaatttgtagccttgcaattaagaggaaagcagaattactagtgaataaggtatttttcttggttgagaagaattactggagttcagcattttagtgaacagctgttactctgggataactatgatttcataacagttgtaaagcctattgttagtactagagtctgctgtttacatgggacactgctgggtactgttgaggaaaccaaaaggcatgatctttgtacccaagaaaggtagagatagattgtaaacaccacccataggaaactattcataatttccacctcataggtaggcaacagagtctgttggttaaagggcaatctatgaaataatatggccttggttcacatcttgtctctgctatttacagctttgtgtcttcttttccttagctgtcttatctgaaaattgggtatatcaatcacacctatcttaaaaaatattatgaggattaatattatactttaagtgcctagagcagtccttagcaaatgctaaacactcaatgaaaatttgctacttttatatttgctaaggaatgctctatgatttaggagtattaatactgcatatcatttttcctccaaattttgcatttgaccttgtctggagcacatcgcttttggaatactcaggcataagctgggctcacaactcattgtgaaa

SEQ ID NO: 60099 - DNA, 1032 bp, Homo sapiens
gatggtgataaaaagtaagggaagaaaattatgagtatttaaacagccagcagcagcagaagagaaaatgaagcaaatgaagaggcaaggggcaggtggaagagaagaaagaggacaagtactcagattttaaggcaggaaatagtctcaaaacaaagagagacaccaaccatgccacatgcagaaacgaatcaagtaggagaaataatttaggcctaaggacctcaagcttatattctatatgaattattaatttgtaaagctaagtaattgttttttatgtctgattactgagatatattttgttttaatcttgaaacttgaaaatccaagcagatttatagatgcatgtgtttaggacagaagctaggcaagaaagtgttaattggtgctatgaaattattataagtattgagcaaacaacctactcttctaaatgtagggtctgtttctttcctacattaaaaaaagcgaaattaattcccttcttaagttactctgaataaaaatttcagaacaacagttttgcagttttccatgtggctggttttcagatctatctattcatttctgtcggatactcggcagattgttttcttattgtgccttgggattcgagttctgatgggcccactgagcgagatcagtgctttgaattgatctagaggcatttgtctcctgtgaataagtaatttagagttgagagtatatgtaacgcagttgaagttaagagatgtcttatttcaccaagaaataggtcatttgaatccggagacactgagtgtgcttacggtaattactggaagcaggtggtcttcacagctagtgctgactttgatgaaagagacctcatagtctgaaaatagcccatgtcgtgttgcgttctgcagggaaaaatgaaaaaaatttaataaccgactttgaagtgaaaaccaatattcggtcagccctcatttattttccatggctggttagagatactattactattttaacttgtttctgtagggaaattgagagcaggatcttttt

SEQ ID NO: 60100 - DNA, 1035 bp, Homo sapiens
ctgtctcagagaaaaaaaaacaaaaaggaatataatataattagtgaaggcctatatagatactggttaatttcaccattatcagaataatattttttcagattagtaaatacatagttatggttaataaatctataatgattgaatgggatttattcctgacaagatctacaatgatagaatcccctaaatgactcgatgaggcttacagatgtaaaaacagattattcacacgactagagaccacctatggaaagcagcccaaggaaagttttcaaggtacaagaacaaagctgttgattacaactgatctcagaatttgactctggttttactagttgttaaggcaaaatggagtggccgtgtattcgctattatttgagattcaaagaacaaaatatgtttgcttctcttacttgattcttttaaatgaaggtgtctttctcagtcccaaattatctgcataaatgaccacttttctgcaaaggcagatgagcagatgagtgctatttatagtagaatcacatagtaagcaaaggagacattgtatgattagctcttcaaatggctacaaagacatgtaaataaaatagttaaaacatatacctgaaggattataaatcattctactataaagacacgtgcacacatatgtttattgcagcactattcacaatagcaaagacttggaaccaacccacatgcccatcaatgatagactggataaagaaaatgtagcacataaaccccatggaatactatgcagccataaaaaaggatgagttaacgtcctttgcacggatgtggatgaagctggaaaccatcattctcagcaaactaatacaggaacagaaaaccaaacactgcatgttctcattcataagtgggagttgagcaatgagaacacatggacacagggaggggaacatcacacacgggggccggtcagggggtggggggcttcgggagggatagcattaggagaagtacctaatgtagatgacgcattgatgggtgcagcaaaccaccatggca

SEQ ID NO: 60101 - DNA, 1049 bp, Homo sapiens
ccttgatcatgttctgatggcaaatgctgtgtgtaaaaataaataaataaagtagccaggtagaaagatcaatgtcccagaggaaattattttattttattttatgtattattattactttttaagacagagtctcattctgttgcctcggctggagtgcagtggcgcgatctcagctcgctgcaacctctgcctcccgagttcaaatgactatcctgcctcagcctcccaaggagctgggattacaggtgcatgccaccatgcctagctaattttttgtgtctcccccaaacccagggtgtagactttccttaatctcctttcttttcccttgatgtttaagtcccaagccatgtttagataagtttccttatctagctattgtcccaggtaaaatccacaccagagtcttgactatcttgagtccaatggcacaagcttcttcaagtgggcaccctgcgtcactgtcttttgtgtgaagttcagactcttcgtgttccaattcaatgtgagcagtcttaactcagagggcacactttttactctgtgtatgtttttatgttttaagtgtacacgtttgtaaaacagatatgttgccgacatctaaatattaaaatatttcaagtaaaaatatagatgtgcgttttttccttgaggactcggaaagccctggaagcccttgtcttgcaaatattgcctggaaaattcactcaaagtgtgcaccctccaatttctccctcatgaatttcttctcttacccaaggcacacagtagcttatgtagaaaggaagtttgaaacctcttttttaaagtggaggtggattttacttatcatcttcatgctgttagttgactgcttccagattttctacagattatgattgtggagatgggggcaggaggcatgttaggaattgatcgtttgatgatagctcaccttgactgtcacgctgttagatgcattgctcaatacctggcagatgagagttcaggagctgtacaataaaaaaagatggaaataattgtgcaaattgttactgataccctgg

SEQ ID NO: 60102 - DNA, 1054 bp, Homo sapiens
gtttcaaccagaatggtgaaatgattgccaaatttaattagatattaatcaacaatgatattgtcaaatgtatatttaacagtgcatttatttgtttttctctagattttatatctataagactgcttataaacaaagattttctaaaactgtataaaaacaaatatacagtaaagttttttttcagaaaacaaatagtaagaggaaaatctgtttccaaaattatagccagcactaaatgaattcatggtgtgcctatatgtgtgataggtttgcagcatctaacatcaattatattatctgagaatctattactttcaacatcaagtagccttctttagaaccaggaactccctgtctcttctattcattcaatagcactaaactgatgttattttttggtttcgtatgtctctcttttctaatacctttgactccctttctagtcttttatctccttcccatggttttgtccatgaaacaagaggatcctactacctttcctccctgtatgaaattcagatctaacatatagttacctgctttgtttttttccagattcctgtcttggtcacacagataagttcaaccaatcatccagtgaaagtcggactgtccgatgcatttgtcgttgtccacaggatccaacaaattcccagtacgtagaagaagggcagtcgcaatgagtgagcctctgtgggggtaaatttaaaggagattggtctatggcagctgtacctgaattaaaaaaaaaatagctaatcgattagctgattaatgcttgttaattctgttgtttgctttataactccgattgggctatctctgtcacccttgagctaactcaggtaaagacaaattaaatagtgaagccaaaaatgtgtaattttggactctttttcttggttcttttttctttcttttgatttggggtcttactctgtcacccaggctggagtgcagtggtgcactcacagctcactgcaaccttgacctcccaggctcaaatgatcctcctacctcagtatcctgagtagctgggaccacgggcatg

SEQ ID NO: 60103 - DNA, 1082 bp, Homo sapiens
aagttttaccagtgtcctgaaactttgcaagcaatgagggaatgttgacaggaaaatctaaaaggcttaaattagcatttcacgctcaactaaggtttatgttttattgaatgcctaatgacattattatttcagagaattagaactacagagagagattttaaaaatgattctggcaaatgcattttttatttgtagctactttatttaacaactccaactagctaattctgctaatgcattgcacttttctgtgggaagcttgtagccactataatagtgtcatttgtatctcaagagtctctcttctcctgagtcttcatgctggaaatgaatcttgtggttatacgatacaggctatttccattaaagagtactcagtaaacggtgcttgtgctggactcgatttgaaccagaaaagaaataagatacaaccatatggagccagtcattaagcattggcaacacataaatagggaaatgttagtgaatcattcatttgacaattcagacaaaatataatacttacacaatatgagtaagccaagttaggagatttctcatatagtctctgtgtgaatgttatgctttcaagacagaaaaataaactagatcatggctaatcatgcctcaaggtactcattagtctgtgttcagttcagctagagtggatattgatcaaagaagattcttggtgtttccatatgatcacattgtccctcctgctgatgctgatcaggctttctaaaacatgcagtatttgcactttgcaacacatcgccttaagctttcgatcacattttctctctgtgtgttaatccgctcagatttaatttttcttaatttttaaaaggcactaatgggtgagtattgatctattggagttgaatcaccatcgctaagactgaacgtttaattcaactttattttggcttattcttgaagaagacccatgagcgaaatatatttttggaatcacatgaaagcttctagtattggcaggggtaaccacaattctaattacttgtttctgacagaggtatctctgaaatactacataaatgaccatttggaagttgtcg

SEQ ID NO: 60104 - DNA, 1011 bp, Homo sapiens
ttttaagcagtttaatggtgtaaacagtgatagtgtgctatataaacacttttaatgagtattattaaaggaaacaacagacagcaagtgagggaccaagtcagactgatagaatagtgtttgcagatgaataatggagatgattttgaaggtgttgagttgatgggtgttataaatggaaggagagagaacatgaagattcaacactatatatgcattttacatatgcttacatagcttttgctataaatatttttcgtctggataaaaggggtgtgctctgaaattctaagtcagtttcaggaaaagcaaattttaagaaaaaactacaagtctaagagtgcttctgttaacataagatgacattaagtgtattttatgaagcagaaaattgcttcacacccaaattcttaaaattcgtttttttgtgctgtctttaataagacatagaacattggtacacatgagctgcataacagtctaatggaattagcatttagtaatttgatattttgtatgcctgacaaatctgatgtagaaaaagcaaggaaatagggaagaacactgttttatgaccagaaccatgctttaaagtggaatgaatttactaattctttgttggcaatctacttaaggacctgagcttggtgcaatcttagaaactgacccaggcaagctcacaaatttataataaagagggtataacaagaattttaaaagaaaacaaagctttctttatattaaaggcactactaaatatatatatgtaatttttaagcattgttattaacttagactttgagagacgaattgaactcagctgtgtgtgtgtgtgtgtgtgtgtgtgtgtgtgtgtgtgtagttaaaattctcaagcatgaagtttttaaaatattaagggtatcatcttggtaaccttgtagcaaactctataagccttgataaagtttttccactgaaatcaatttacttcaactgggaataatcatccttaagagttcagatgacaag

SEQ ID NO: 60105 - DNA, 1014 bp, Homo sapiens
ttcctggaaaaacgttcataataaatatcctaggacatttcagacttccagtgaaatttcatataaaatgtatttcagaaatggcatcttcatttgatatcagtaattgagatattatcacgcattgccttgaattggaaatctgttattaagttctgttaatgtgcttcgttttcttggaagaaagtagacaaccttctcaaagttacaaatgcattcttcaaagagctgctgagtgacaagctagaaagcctcagggactagccagacctcaggctgctgctactgccgtaacccctcacacgtttaagccttttcaaactgtgcagtttattttctgacatggtgaaaaagaagacactgaaatatctgatggtgatggtattagcagcaaattgcatagtatgaaagatctagttaaagctggttcaaaggaacccctgtatgactgcaaaatagtggaatattgttttgagtattagtctcattgtcttatgtctcagagcctgtatgtccataggtgtggagtgtttacatgtgtatacgtacacatgtatttatagaatattagagctagatggaatcttagagataatttagttctatactctcctaacacaaaaggagagactgagtgaggctcagaagagtggaatgacttatccaaggtcaaagagtcatagttctaagaataactctttcttcttttcacatgtaagtgaagcagattcattcagcaggtctcccagcttttctccgcttggctttttttccttcctgtggagtcagttgccagagtctgcttaaatcactacctatctgacatgctgctggggtcatgcggctcacagtggctggtaagcagctgatttttggaggtgataatcataaatttactattattaaaactgaccactgtttacaaaatcaaaacagatccacaatgaccatggtttgtgatatgcagacgcgtggatttaagatttttgaattattagctacattagaattgtt

SEQ ID NO: 60106 - DNA, 1010 bp, Homo sapiens
aatttattttcttctggaatttttatgtacataatttgatgtttgcccatttaacacagtggtgatttcactgtaatacaaataggtattcttttttaaagaacatttttctgttttattatgatggctttgtaaacatcattttaatgtttgtattctattctattcaacattcattcaatagctttatattgactgcctcttatgcagtcaagtggtaactcggaatgcactgagagcctaacatgtgcctagaagtcaaaaaggacctcttttcattcagatgaagactgtgtgttagttttctactgctgttgtaacaaattgccacaaacctagttacttaaaataacacacacttgtcttacagctctggaagtcagaagtgctaaaatcaggatatggacagggctggttccttcgggaggcttcaggggataatcgtttccttgccattttcagcttccacatgccgcatgtgttccttggctcatggtttcttctcatatcattccaacttctgttcccaccgtcacatctcctaccactaacgttgaccctccagcctcctttttgtaaggcccccttgtgactacattgggctcacctgggtaatctaggatactctctgcatctcaaggtccttaactgaaccacatctgcaaagttcctttttaccgtgtaaggtaacattgacaccttttggagattaggacatggacatctttgggaggccattattctgttgagcacagagtgcatcaaatgtgagatgcatcacacgcttccaattaaactctaacacacccttgactgcaagatatgtcccagtttcaattatattaaaatgtaacccaatggatatcttgagtatttcacagtgaaatccaggcttcactaaacacttgtatgagttagttcctgtgctaaacagcgtatataatatggtgaaattgaatgatgctaggccgggagcggtggctcacgcctctaatcccagcactttggga

SEQ ID NO: 60107 - DNA, 1090 bp, Homo sapiens
atttctcaggccctgtgtaaatcagatacgacctcctcagtctcctctgtaaaaccccatgcatttcattatgaaatcagaagccccacttgggagcccctctctctcttcaagagagagagctattcacttttctctttcttttgcctattaaacctccactcttaaacccactttttgtatgtccacatccttcatttccctggcatgagacgacagacctcaggtatttaccccagacgacgacactgcttcacttaaatattttcactacctttgacaggaaggatatttagtatgttctccagagagaggtcatagtcaaggctgcttacgtgatggctaagagcagaggaaggggtcatcctgtaaactatgactcagctacctcataaccctgggcacccagtgatgttcctcccaaggtcttttcccttgacatacttgggtctagttaggtgttgccagatggcctgtagtccccagactggcatgcttggggaggccagctttttcctgggtgtagcatatggccattgactctgatcttcctgactctggcaagctctgaatcttccattctcctacccaccacccagccaaaggaatctctttatagattggagaaaactctcctagtgtttccggccatgattctttggctatctagaatcaggagttctgtcctttttatctcactgtgaaaaccatcgaaatgctcttaagtgcttaggcttctggaagataatagttggaaaggtaagtattttacttccaaacttcagttttcttctctgtcacatgcatgaaatgagctgatgagcacagagcaaactctttgatgaactggggggaaggaaaggagagaagcaaagaggcagtacagtgagaagaaaagaaagatagattcacaacttggtgaaatggtcacctgtctcccaataagctatagacagaaaaaaaattacttggtgcatggcttgagtttccaaagaaaaggaggaatgaactcacttttgactaagtgtttgaacactaagcttagtgtcaaataatgaacctttgtggttctatataaccattttcttat

SEQ ID NO: 60108 - DNA, 1027 bp, Homo sapiens
gtgtggcccactgttgtaaatattcttgagaggcaagtgcaatgagtgagaattgatcactgaatgtagcaacatgaaggtcattaatgatttttggggagcagttttggagttgccatgggggagaaagtttggaagagaatagtgatggggtggaaaggaaaaagctattcactaaagtgaggaacagtgggggaaagcagataggggctgagcatgaagggatcaactagaattattacatctgttgggatttattttccttattggccacatagagccaagttcttaggcagatctgaaggaatgctgcatcatttattttctcagtgactagcatttaatcacttcatttaaatatttgttgttttattcaaaatcaattttgtacttccctgtttaagccttccgaaaatccatcttgccaaaagaaatatgaatcctttgtagggttactgtggctcagagacaaaaagattccttttttttttattgaattattcgtgttgcccagtctggcaatgctctgaatctcatattgtaataagttaatattttattgtactgcaaacacaataatgtggtgtttggtgttaactataaaaataattggattttatatatacgtgcctgtccaaaggcaaatgtgattgtacaaagactttgtaaataacagtacattgctctgtgatgttccttgaacagttgttttatatttagctcttatattgttgatcttctgtatttctatctggattataaattcttgaaaggcagagtgtatatcacgcatatctgtcatagcaaagagacacgtgtgtattgaatattatgacttttctgttaaatgaatgttctcttgcttaaaaactgggagtaggccgggcgcagtggcttacgctgtaatcccagcactttgggaggccaaggcgggtggatcatgaggtcaggatatcgagaccatcctggctaacatggtgaaaccccgtctctactaaaaatatgaaaaattagccaggcttagtgg

SEQ ID NO: 60109 - DNA, 1432 bp, Homo sapiens
gtattcactggaggaaaactaggaaataaaggcatatacaaggagggaatacttgaagggggtataagtggatgtctttgctgctgttctttctctcatttcccttttccttaggaaattgatctgtcatattttcaactgctatctctactggtgactcaaatagatatctcttctggatccgctacccagacactgaggatttttgcaccatcctaaacttcagatctccaaacccaaactctgtctctcccaaccagattaagtctcattttctgccttttatagtacccttcttctaatcacccaggctcaaaatcattgactatttctgcatatctgtacatctttatatttatcactcaccatggccacttattctggattgtgagtagatcaaaagaatagagagatttttaatcaagtgagcctaaatatgcaaagcaagtatggaggagagaaggaaatgaagtgagactctcaggtcacttccatggaagacacagatggtagagttttgacttagtggcaccgagatagatctgtttcagggcaagatagaacagtgggagagatcccggctgggcgtggtggctcatgcctgtaattccagtactttgggaggctgaggtgggcgaatcacctgaagtcaggagtttgagaccagcctggccaacatggtgaaaccctgtctctattaaaaatacaaaaactagccaggcatggtggtaggtgcctgtaatcccagctacttggcaggctgaggcaggataattgcttgaacctgggaggtggaggtttcagtgagccgagatcgtgccactgcattccagtctgggtgatagaaagagactgtgtctcaaaacaacaacaacaacaacaacaacaacaacaacaacaaccaggagaaatccccacattccttggcctgaaaatgtatttgtatgtacattacctgttaacttccttaatattggtatatcaaattttgatagcgttttgctttcaaagttttagaaaagcttagtattgaaaggaatttgcatcttcaaatttgcattttctatcacttcattttggtatcctggtgggtttacatgcaaaacacatctatctccaggctgtctaatgtgctactgtcaattaggggagttaactgtcatgtgttgtgggctgtctttccccggtgacatttaaacggagatggcatcgctatttcagatactgaagttgtgagcctagcattgggtaggagattggatttgctctctacgactcattctaagattaggattttctaacttgatagtgattcataagacaattatttcataatgcatttctactattatatagtgtgcacgtgataggcatacattgatttggacttttcctatgacaacttggaaggcagaaagttaagcacttaaaa

SEQ ID NO: 60110 - DNA, 1048 bp, Homo sapiens
aacatagcacctggagtatagtttttttaaaataatgtttattattcacacttcccatttttgtcgtgtttctgtcctcatccattgcttctggtcttcctcacctctcccgatgacattttattgaaccctgacccctctttttgtttctctaatagctgtgcattgcctctattcattatatatttcttctagcttgtaatcatggtagaggcaaagtggacagtccatttattataaagatttcttccctctgtctcctgggagagcccctcagttgtaccttctgggcttctttgtgttgagcttggtgggaatccataagccatcattccgctccacctcagaggccattccttggatgcatctgtttctccttgatcttggaaatttccagtggaacatgcacacattttgcagtgtttacggtgagttgggacagtgctgtccgttgtcccaataatataagactgttttggtttctactgttttcggaagccagattcatgctccctcctaccttgttctttagggttatagatatcattaccctctaggtggaggacttggcaaggaggagttgaccactgaccattggaaatctcgatacccaccattcgcagcatgctgggctcctctccatccacttccagttccttcctttcttcctttccattcccttcccttcccttcccttccctttcctttttttttttttcagggtcttgctctgtcacccaggctggagtgcagtggtgtgatcccagtctcccaggcttaagtgatacttctacctctgcctcccgagaagctgagatcacaagcacataccataatgctcagctggtttagttttattttttttgtagagatggcagaggggtctcactatgttgcccaggctggtttcaaactgctggcctgaagcaatccttctgcttcagcctcccaaagtgctgggattacagtcatgagccaccatgcctggctcacttccagtttcacttagcttaggttgtgccacctatcagaagtggccaaggaggta

SEQ ID NO: 60111 - DNA, 1083 bp, Homo sapiens
gcagatggaaaaaagaggttatagcagagaggtctactctccttaatcagtagtttctggtctctaaaagcaatgagccagccaaagaacaaatgaaaaaagaaatctattgactagaaacccctttaaaagaggtcttggctgggtgcagtggctcatgcctgtaatcccagcactttgggaggctgaggcaggcggatcacgaggtcaggagatcgagaccatcctggccaacatggtgtaaccccgtctgtactgaaaatacaaaaattagctgggtgtggtggtgcgttcctgtaatcccagctactcaggaggctgagacaggagaatagcttgaaccagggagtcggaggttgcagtgagcagagatcgtgccactgcactccagcctgacaacagagcaagactacatctaaaaaaaaaaaaaaaaaaaaaagagagagagatcttatattaaatctctgatccatctaaaacagcaacattctgttgtgttagactcagcatagctttgtccttcaaggggagacagtccatcagtaaacacataattctgagtgacacctatgtgcctcttgctacaactagggttgagggctagatgtcagagaagttgaggtttctatatgtagaaagtctgcagtctagcttggaaggtgccttagcccattcaggctgccacaacaaaataccatagacaggataatttataaacaacagacatgtatttacttatttatccacttatttttatttttacttttatttttatttttgagacagtctcactctgtcacccaggctggagtgcagtggcgcaatctcggctcactacaacctccacctcccgggttcaagcgattctcctgcctcagcctcctgattagatgggattacaggcatctgccacaatacctggctaatttttgtatttttagtagagacaggggtttcaccatgttggccaggctggtcttgaactcctgacctcaagtgattcttccacctcggcctcccaaagtgctggaattacaggagtgagccacggcacctggcctagttatttatttatttagagac

SEQ ID NO: 60112 - DNA, 1484 bp, Homo sapiens
gagtgaccagccggttctagcttcgttccctccagttcccgcatttgcttgctcacatgctccctctcacaagcagtggccaggagcaggctgagtgaaaggagtcactccagttcccacccctgaagggggtctaggtcaagggaactagcctgtctcactttggaataaaatactttgatttcttctaaggcttgttgttatctgtcttgtgatgctataccagagtcaagttggaatttgttaccttattgctacaaagagtctgttttgtcagtcttatgatctttattttaatgttaatgtggtcaattatgtttcaactccaaaagggagaaggtataatgaggcatgtccaacttcccttcccgtcatggcctgagctagttttttatgtttctttggaatccccttggccaagaggggagtccatttagtcacttggaggacttagtattttatttttggtttacacatgaaagaatatagctaaacagagaaagggaacctgccaggaagcaagtggcatgaaaaaaaagagcaaaggaggccagcctcctggcagtggagggtgtgaatttcgggattaggtcagattgtacagactactgaaacccatagagagcaaggtagatttcgtgtagagggaagacattgctaagtcactgttcaaaggagaactggattcctcatcagcttcctttctcctactgaaaagtcagactgagagagaatctcatgccaaaacctgttagaaatttccacccgttgttattgccagtggaattaagttaagaaaaatctaaccagagccagaccgaaaaaagtgataagacacgtcacacctccctctgagtctacttcctgtctcagagacggagggtgtgtggctaccaaaatactgaataataaactgtgaaacagccagagtaagatccccacgtgtagcccatctctccaccagaaaactcagggaaagaaagaaggctggggagcagtgaggccctgcctcctgtgaggcttaaactccacaggaaaaattctataagttgtaggggaccaaaagtatgcaccccacaatgactgtagacgactaaaatatgccacccaaaaaaaatgcctctttggcataaggatgagtttgagaaactacaaacccaagagatgttctgaaaacagtagaagttacccttttgtaagggaaatttacatctgtaaagggaatctccatttttaaggatatcttcctgtacaagaaagagaaggatgactcttaatcacaagagactcttatcactgtgagatgggattattcccttgaccttgaccccctttgtgggcaggaactagagtggctcgtttcaccaagcctgcagtccatggacagctaagtgttaacagctcagtgaatggtgagggtgagagcctcccgcacctgccctttttgacacctgagttcttgttcagtgtccaggaagaatcag

SEQ ID NO: 60113 - DNA, 1049 bp, Homo sapiens
gagaccccgagttagagaacagaaggatcctgctgcagtctgtcatggagattgcaatctaccctggagattgtggtcctccctggggattacagttcaccctgagggttacagctgatggttcaaagaatcaaagggtgtgtcagggggctggttaagaagtcctacctgaatactgcaagagccctcagatgaatctgttttaggacatgagtagggggctgagcacatcaatctgcccccagctatggctgtaagaagtatataatgaatagagccaagggcagtgaatactttagtctgtcagcaatcatcaagcgtgaacagatttaccttttgtttgaagctcagaaaagggaggaggaaaaaatgtgagcactgcaaaatcacacttagacaaaggaaaagggaaaaatacacagaagttcacagaaaaggcctacaactgaaaatgatccaatgcaggatccaggggagaaaaattaggaagccattagatatccttaatacggtcaaggcaaaaaactccaagtgatcaatttgtagaagtaacaaatactataaagagaaaacatggctgggcacggtgtctcatgccatgcctataatcccagcattttgggaggctgagcagagcagatcgcttgagatcaggagtttgagaccagcctggccaacataatgaaaccctgtctctacaaaaaaatacaaaaattaaccgggcatcgtggcaggcacctgtaatcccagctactcaggaagctgagacaggagagtcatttgaacctgtgaggcggaggttgcagtgagctgagatcacgttattgcactccagcctgggcaacagagctagactctgtctcaaaaaaaaaaaaaaaaaagaaaagaaagaaagaaagaaagaaaagagagaaaacaggttgaaatgaaagccaaaaaaaatcattagattagttaacgctctttacttgcaaataagtaaagaaaaatggaagcaagagaggagaagggatttattgtaagaatatgaggtgattttcaggcttgag

SEQ ID NO: 60114 - DNA, 1038 bp, Homo sapiens
tggagtgtcttatgaagaccaaataaatggttcgtgaggaactagatggaaatagtctctcatgagatttgctttgtttatacctctagggtggagtgttagaaaactggagccagaaaaagaaaataaaggcagattttagggcttacagaagttcagttgggtatttttgttttctgtttgtttgtttgtttgtttttagaggtaagttctggttctacaatccaggctggagtgcactgatgtgatcttggctcactgcatcctcgacctccctgggtcaagcgatcctcccacctcagcctctcaatagctggaatacaggcacataccaccacactcagctaatttttgtatttttatgtagagatggggtttcactatgttgcccatgctggtctcaagcgattcgcctacctcagcctcctaaagtgctggggttgtagacgtgagcccctgcacctgaccaaaaggatgttgttttcatactacagacccctctctgggaggcaatgtgcttaattttgtgttaagtggtgaagaactcttctttctgattataattaaccatttggcagagtatttggaaatgctaatggtcttcgatttacaccctcaagatagatctttttgcccagttgggattaggcctttcccactagggcccaggggcccagggacaggctctgccagctcagggagtccttactgggggagagtctcttctctctttctctttcctctctctcatgacagattcaataatacatgatggtgtttttatagtgaagatatagtctcaattgggaaaaaagtttgtaaaagaatactctaaacgactgggcacggtggctcacgcctgtaatcccagcattttgggaggccgaggcgagtggatcacctgaggtcaggagttccagaccagcctgactaacatggtgaaacctcgtctctactaaaaatacaaaaattagccgggtgtggtggcgggtgcctgtaatcccatctactcgggaggctgagacaggagaatcgctt

SEQ ID NO: 60115 - DNA, 1346 bp, Homo sapiens
agcactttaggaggctgaggtaggcgaatcgcttgagaccagcatgggcaacatagtgaaaccccatctctacataaaaatacaaaaattagctgagtgtggtggtatgtgcctgtattccagctattgagaggctgaggtgggaggatcgcttgacccagggaggtcgaggatgcagtgagccaagatcacatcagtgcactccagcctggattgtagaaccagaacttacctctaaaaacaaacaaacaaacaaacagaaaacaaaaatacccaactgaacttctgtaagccctaaaatctgcctttattttctttttctggctccagttttctaacactccaccctagaggtataaacaaagcaaatctcatgagagactatttccatctagttcctcacgaaccatttatttggtcttcataagacactccaacacatgcgatgcaaatctaatgttgaaaaagatttttttttaatgctatttgcctgaccagagataacaaacaggataccttattctggtttctgatttctcttttataggaaatattttcatgccatccatagaacaataaaggaagccaaatgaaacctctgcgcctcgctccctgaatccaagcagcgatgccgctaccccgtgttaaggatccgtttctgatttagaagggcctagacataagctcatgaagccgagcatccaaaagcaaaactcaacatcaaacatgtctcgaactatgacgtgtactttccaatttaccctcggagtgggaatacttctgtcatctgtatagcatttaaaggaaaaatgcccattaaggaggagaaggtaagagtaagcaaatcgtttttgcacatctgaaaaccctcctgtttcaaaaacttgaaacagttggaaattcagctggccagaaagatctgaacttagactcacttcaaagcaacccagcgaacactggcattgtttgtttcctaggggctccccttgctccttctgtccgtcctctgtcagaataagaacttcaggccatgcgcggtggctcatgcctacaatcccagcacttcaggaggccgaggtgggcagattgctcgagctcaggagttcgagaccagcctgggcaacatgacgaaatcccatctctacaaaaaacagaaaaattagccagacatggtggcacacacctgtagttccagctactcgggaggctgaggtgagggggatcacttgaatccaggaggacaaggctgcagtgagctatgatcatactactgcactccatcagaccaacaccctgtctcaaaatataaaaaataaaaattggccgggcaccgtggctcacgactg

SEQ ID NO: 60116 - DNA, 1160 bp, Homo sapiens
agtacagtggcgccatcttggctaactgcaacctccacctccccggttcaagcaattctcctacctcagcctcctgagtagctgggactacaggcagccgccaccatgaccagctaatttttttttttacttttagtagagatggggtttcaccatgttagccaggatggtctcgaactcctgaccttgtgatccgcccacctcagcctccctaggtgctgggattacaggcgtgagcaaccacccggccttattgttcttatattaaaacaaaagaacctagaaaaaattgcttggttaaattgtagagaggaagggagggaaggaaaatgaaggcttttcttctttgttctttaaaagtccaagcactttctttcagaatcaaaatgtagagaggcagtcagtcttggagcatgcttttgcattttaggatactactcattaattcagttttaaagcattcactgggttgagcacaattttaaaaaggttctgactcacccagatcctgtttgaagctcaactcattttgattgaaagagatttgagacaagaatttcagaagagaaaaatgtgtgttacacctggacatatatacacatgtaacagggattgtattccttctagtctaagacaagagattctatggtaaattatttaaaaaaattagttttttttctagcattgtattgtcaccagaaagaagagtgctgaattctctgtttctgcatttcccaataataaatctcctaggagagataactttttgcagttgtgccccccacccattttctctgtggcttgctttatttcccacatatgaatacacacacagcagatacatcatgcacaaactttttttaatgtgtaatctgtaaatctaggcccattaagttttcattgaagttgggaaactgttgaggacttacttttgttcttcaccatgcgtgcactttgccaaggatctttggtaaccaataaaacgatcatgttcactctgaatgtatttctttgtgattaaatggaaaagagtattcatgaactgcttaaacagtatttttataccaaaacatcaacgcataatgaaaaatgagctatagttgttccaaatgttcagaatagcagctttgcatttacagtcatattttggcaaaactatt

SEQ ID NO: 60117 - DNA, 1041 bp, Homo sapiens
cggcccgcgccaccagcgctgcagagggcggccctaacgtccccgcccccgcgtgcgcgcccccgcgcccgttcattccggcctccgcgcgccgccggctcccctcgcgcccacccccagcacacctcggcggcggcgagcggcgcgggggagggggacggggccccggaggtaggccgggggcagccaacaggccgcggcagcgcgcacgcagggctagcctcgcccaggcctcctccctcacgccggccgcaggacgggcgcgcacgccaagtgacgctccgaggaggaagcgcagcccccttcccctccctcgctgcccctggcccagcgggagccccccctccccccagtgcgcctgtgcggaggccctcttgattatgtgtgccctctccgggcgcccgcgttagcggccgggtggaggtggggagggaagacgctgaggaggaggaggaggcggaggaggcggtggaggggaggtggggggaatcagcaaggacatggctcctgactcctgtgcggaacgtgagtgactgagcggcaaagcccgagtgagcgagcggtgggctgccgggccgggcggggggcgccggggcgggctcggggggctgtgtgggggggaagcactaatcggcttgcatgtgttttttaatggtccccccaactccctcttagatggtctctagcgaccggcccgtgtcactggaggacgaggtctcccatagtatgaaggagatgattggaggctgttgcgtttgctcagacgagagaggctgggccgagaacccgctggtttattgcgacgggcacggctgcagcgtcgcggtgcatcaaggtaaacacccaaccgcccgccggggcgcgccggcctgcgcccaacggtcaccgccgcccccacctgggccgcaaccgccggcgcccccgccccgtgccgcggccgcgggagggacgcggagggtccgcggcggggcgcggggggtgtgggccgcgcatgtgggagaaagtgcgtgtggcccggactgtcatgtgattccgctctca

SEQ ID NO: 60118 - DNA, 2857 bp, Homo sapiens
caacctctgcctcccaggttcaagcgattctcctgccgcagcctcctgagtagtaggattacaggcatgtgccaccacgcctggctaattttgtatttttagtagggacagggtttcttcatgttggtcaggctggtcttgaactcccaacctcaggtgatccgcctgtctcagcctcccaaagtgctgggattataggtgtgagccactgcgcctggcctaattaaaaaaaattttttttttttgtggagatggagtctcactgtattgcctagactgttctggaactcctgggctccagcagccctcccaactcgacctcccaaaatgctgggattacaggcatgaaccattgcacccagccttgatttatttagatgaggtaacacaaaagagttgcatttaaaatttttacttgttaattaagtaagctgtatatgtgataaataggatgtgaactgttttacttctctgtaaagaggtagtttacttgaatagtgacaggtggattaatagggctttgaaagggtatttgatttttccatagttcttcgaatcttaacattttaacacatttcatttttcaacagcttgctatggcattgttcaagtacccactggaccgtggttttgcaggaaatgtgaatctcaggagagagcagccagagtggtaaggactatttatcaaaaacattaaactttagtgagtaggttaggaaattaggaactgcactcctgttgtggtttgtggggttgtcagtcatttcttcaaatatcataatgtaagagataatttaggccaaatattgacttggagtattaaacagattttgtaaaactgaaaaacaaatggaatcaagtgagtatattttggatactttgaaaacaaaaatacatagtcatatttgggctttgttaactagttacagaatcaagaaagcttgaagaagtttgaaggttacactggctaatcatagttaaaatataatggaaatagaaacataaggaagttacattgataattctcttaggttttgtgtaatgggaaaaaaacccaataattttagtgactatcatattccttttactacatctttgggtgtatagtttaacttcgaacactcactgatttcaggcattcagtccctttggcaaaccaacataaaaatcttttttttttttttttttttaacttgggtggttaccttatttcagaacttttctaaacctcttataagaatgaaggaggtgccgggtgcagtggttcacacctgtaatcccagcactttgggaggccgaggcgggagtatctcgaggtcaaaagatggagaccaccctggccaacatggtgaaaccccgtctctactacaaatacaaaaattagctgggtgtggcaagcacctgtagtcccagctacttaggaggctgaagcaggagaattacttgaacccgggaggtagaggttgcagtgagctgagatggtgccattgcactccagcttgggcaataagagtgaaactctgtctcaaaaaaaagaaaaacaaattacaaacattagctgggcgtggtggcacgccctataatcccagctatttgggaggctgaggcaggagaatggcgtgaacctgggaggcggaggttgcagtgagctgagatcatgccattgcactccaacctgggtgacagagcaagactctcaggaaaggaaaaaaaaaaacaaaaaggaggtaggccgggtgcagtgactcacacctgtaatcccaccactttgggaagccgaggcaggaggattgcttgagtccaggagtttgaaaccagcctggtcaacttagtctctacaaaagaaaaattttaaaaattagttggggctgggcacagtggctcatgcctataattccagcactttggtaggctgaggtgggcggatcacttggggtcaggagtttgagaccagcctggccgacatggtgaaacctatctctgctaaaaatacaaaaaattaactggatgtggcagcgcgtgcctatagtctagctactctgggggctaagacgggagaatcgcttgaatgagggagccagaggttgcagtgagccaagattgtgccactgcactccagcctgcactccaaacagagtgagactgtttcaaaaaaaaaaaaaaattagttgggcgtggtggcttgcacctgtactcccagctactctggaagctgagacaggaggattgcttgaacctgggaggttgaggctgcagtgaaccatgactccagcctgggtgacagagtgagagactgtctcacaaaaaacacagtgagggaggtatgtttatcctttgtatccacaagcatttttcccatttggatttctgaaaatatcagaaatagattttattttcattagttatgcaaacctaccatttaaaatatgatagttcctttttaaaatcttattatatttattgatttattatttattccaagacatcttgttatagcaaattcctttcccttggtgttgattatggaattagactgaaggtagagaacaaacattttagcttctttacctaggcatatagcaaaagcagaagcttttgtgtttgcctgggcaatttttgagcggtagaaataatgggctgggtgctgtggctcgtgcttgtaatccttgcactgtgggaggccaaagtgggtggatgacctgaggtcaggagtttgagaccagcctgagcaacatggcgaaaccccacctctactaaaaatacaaaaattagctgggtgtggtggtgtgcacctgtaatgccagccacttgggagactgaggcaggagaatcgcttggacctgggaggcagaggttc

SEQ ID NO: 60119 - DNA, 1044 bp, Homo sapiens
attactttttggtgttaatttttatttttttcctctgtgattaatatttgttctgtatttcagctttccttgtgttttttttcttctaagactataagactaaatctttgtatatcttcttattgctttttttttttttttttttgagatggagttttgcttttgtcacccaggccagagtatagtgacagtgatctcagctcactgcaaccttcacctcctgggttcaagcgattctcctgcctcagcctcctgagtagcaaggattacaggcgcctgccaccacgcctggctagtttttgtatttttaatagagacggggctttaccgtgttggccaggctggtctcgatctcctgacctcaggtgatccacccgcctcggcctcccaaagtgctaggattacaggcgtgagccaccatgcccggcctctctcattgctttcttaaataatctgcatggttatcgtattaggtcgtttatagattcacttttcctttccttccttttatcttcttttctgtttattttcttcttcctcttctttccgtctcctctttctcctctctttgattttattcttctctgttcctccttgcgccttcctcctccctctttcttctctccccttttactttcccttgtctttcctcccccttcctttcctttttaaaccagggaccttcttctgggtaccatctgcttgctcccatctggtctgtttgctccttaggcttgctggagcatcctaaggaacatcccttcaccattatcttggagttttcttcttgcttatattggattccctgtttttctatccccctactcccctgtttctttatatttaagaaggcacatcttctggcagcttcataggaaaaggcgcatgagaaataaattagggttttgcatggttgataaaatgggattgctatcttacttgattgtttgacagaatacatagaattcttggttggaaatcattttccgtcagaatttgaagatatttctctactgccttttagctttcagtgttactgttagc

SEQ ID NO: 60120 - DNA, 1942 bp, Homo sapiens
gttggaatttgaggatttagaattacacttttatgattcttgtttttcttcagctgctcctggtgtctctgagtgtagatttcttccatttaccctctctaggaaattaagctttgcagttttctagggcaggtgagagccagttacgcgttagtatgtagtgaataagggattgttttgattgcttttcagatggtatgcaattcctgttggttagcctcatctgaaaacgtcactcctggatacatagaacatcactgcgcatgtgcatctccccacccccgatgcctggtgtctaacgttcctccagtttctggtgctctgatgcattgcttttgggcttgtcttactacagcagctttcttcggtcctcagtcatttaccacttgtcatatgtcctttctagtttccagggatattcttttttatatttatggctttatgccatttatctcagttgtcatttggcgtttcaagaaggagaggtggtagtgtttaagtggaattaactacttgtgtttctgatgtggtcttttatatttcttacagggttttgttttaccaagtactagtcttcagtctatcctgtttacttgattttttcccactcaactcacaaacatttttgaatcatctcatgaattctgctttccatttacatttttgcccttttgtcttttcctcttcgctgttaaacttcctgaaaaaataaaactagttgattcacttcttcaaatgcctactgtgttgttatttttccccttgtgcttaatgattgagttataactcagttattataagtaatagtttatgaaatctgtatttgatataacactttcatcatggacactgtccattttgttcttcagtgactcttaacataaaagatccacgtacaagaagttcttttaataataaagcatcaggaaaattatctcccttgcgtatctggtatatttcctcctttttgatagatctgtgaaatacattctgtttgtctttttgtcctggttaccaggcagcctagaaccaaatctggtctttagttacatcagctatattaatatcattattagtatatttgttccctctttctccttccgtggggtttaggacttcacctcttatctctgtttctctgcgtgttgatttcattctctcatactacagactctacttcatgaggctggaaccatgactgctggcagctcttgtttccagccccttttaccagaagaaggggctctctagaagaatcctggaaaggactctgattggcctgtcttggatcatgtgcccatcatctctgtggctggagtggggagggtactgtgaatggcaaccctcactagaactacatagttggagtcaggggtaagagcagtttccataatgcaggggggtgggtgctgtttgcaaaacaagggggatgcttatgaagcagaaaaacaatagatgtctatcatactggcttttattatttttctttttttttttcttttttttttttttttttggagacagagtctcgctcttttgcccaggctggagtacagtggtgcgatctgggctcactgcaacccctgcctcccgggttcaagcaattctctggcctcagcctcccaagtagctgggattacaggtgcctgccaccacgtccagctaattttttgtatttttagtagagatggggttttgccatgttggccaggctcgtctcgaactactgacctccggtgatccacccacctcgacctcccaaagtgctgggactacaggcgtgagccactgtgcttggccttatttttctttttttaattgttataatacttgtcctttattgtagactgcctcaaatccttttctaaaaattttaggtttaagtatattaaatatcctaaaataacataaactcctattcattcactctttaagggtgcag

SEQ ID NO: 60121 - DNA, 1042 bp, Homo sapiens
tcgtttttgttgcccagactggagtgcaatggcgcgatcttggctcaccgcaacctgtacctcccggattcaagcaattctcctgcctcagcctccccagtagctgggattacaggcatgcgctgccaagcctggctaattttttatttttagtagagacggggtttctgcatgttggtcaggctggtctcgaactcccgacctcagctaatccgcctgcctcagcctcccaaagttctaagatttacaggcctgagccaccgcgcctggcccatggcaggaatttaaaagttaaaatgtactttaaaaaaattacttgtcctctgaagaagatcacatgtcatcaagaacaactgtttgtgaagaatgttctgaaatattcttggggggcaactaggacaaatgctgctctcacattttcagtagttttgacgttgcagggaagatactacatttttgataatctgaaatattcattacctgtttctttttttttttttatagagatgtgaactttgtccccataaggatggagctttaaaaagaacagataatgggggtaagtgcagagatttcttgaaaaaaattttattgaaaactgggacagtggagtattttcaaatatttggtagtttattttattttatcaaattaaacagcgttttctactcatttttaacagtggtggctataatttataaatccttattgtattgacccacaatttttctactttgtggacaaacttaagcattgggtattttatgcagtatgatctattaaatacatacttctaatttaaattcttatgtttttggctgggcgaggtggctcacacctgtaatcccagcactttgggaggccaagggaggtggatcacctgaggtcaggagtcgagaccagcctggccaacatagtgaaacctggtttctactaaaaatagaaaaattagccaggtgtggtggtgcctgcctgtagtcccagctacttgggaggctgaggcaggagaatcgcttgaacttgggaggcggaggttgcagtg

SEQ ID NO: 60122 - DNA, 1031 bp, Homo sapiens
gggttcattttaattttttcccccatatttatgattctcagacagaaacctgactcttaatatttttaatagtttacttatttgatcaaagtgaccctgtctcactttgtcacccaggctggagtgcagtggtgcagttttggctcactgcagcctcgacctcttgggctcaagcagtccttccacttcagccctctaagtatgtgggactacaggcacacccatcacacccggctaagttttttgtattttttttgtagagttgaggtttcataatgatgcccaggctgatcttgaactcctgagctcaagtgatctgcctgctctggcctcccaaggtgctaagattacaggcatgagccactatatgggcccagccccatcttgtggctttaagactaaaatagttcaagtagaaaaggagcaaaggtagaccaaagaaggaattatttagatataaacatttcattagcctagaataattttagaatatggtaagatatgtgcccaactttcccttcccacctggttagtcaactttttcaacactattgctgaataatctatgttttccatagtgatttgaaatattatttgaatcattactaaattattgaatacttgagtttgtttctggactttttatgtgttcctttggtgtgtctatttttatcctggcaccacacacactattttaaattattgtggctttatatgcattttagtacatggtaagacaaatattatcatgtatttatttttctagatgaacattaggactaataaaagcacaatttagactgtattagagttacagtgaaatactgttttagggatgaatatatttttacaatattgaatctttcctgagatagaacacacacacacacacacacacacacacacacacagttaattgaaacatttcttagaatgaagagatagacactaagttttaaattcctgacttatgttcatgaaacatattactctgtttgtaaaacaagtcttgtgtctacaaattgttcact

SEQ ID NO: 60123 - DNA, 1065 bp, Homo sapiens
ttgcctgagcccaggaggttaaggctgcagtgagctttcattgcaccactgcactccagcctgggtgacagaacgaaaccctgtttttttttttcaaaaaaaaaaaaaaaaaaagaatattgtaacattaggtttcattttcatttcttccattgctttttactgaaaagcacaatttatgtttatctcgcttattgtgctgtgacttaaagcacttagagttgcaaatttagtcttgagtgaatgcatgttttccttgtaaggttatgtaatctgcatccatgggctaaataccatcacttcggccctttagaggcatggcctttccatttgtacctgtgacagattgaaaaagtaaaatgaagtgttaactgatggggtgggattgagggggaagagaatgtatcttaaacttaatatctatttggagacataaaacatgtgtacatcttcatcctaatatgagatgtgtgaagagtttgttttaagccataaacataactttaaaaaaagatcagttgcaggttggggtgaaatacacttggtcacagctagaataaagctttttattttctcatttttttcttaggagatgttattttctcagagcatgaatgattggaagtaaattttatttgcttatatatacaggtactgtgattttagtatatcaataaatatacttggcttttattttcagcgctcagtttgccggactgctttgtgaagaagaaggtaatggtgccgataatgtccaatactgtggctactgtaaataccattttagtaagctggtaagaatttctcttggatttaatgaaatgattatgattagttttgacaatagaatgacactgttttattaaaaaaagcatataacagttcctttttccttgagtttttggctggagattgtgtttagcatgttctttattggaagtaaatagatctgttaatagtaattttaaaagattttgcttgcttcggtgtatttgtaaaggtgaatattctaaagtactctcatttagaatatatattaatattaggccgggtgttgtggctcac

SEQ ID NO: 60124 - DNA, 1604 bp, Homo sapiens
gggaaaaatatctgtttaataatttaataagattgtataatctttacatttgcatggaatttgaacttctttatagtcatttttatctagtttacaccaattcgatgtggtaccaacttttaaacacctcaaataactctcaccttcatacttaattatgcaatggtacaagtgttttaaacagaaatgtgtgatgctttttagtaatgctttgaaaagtgcatgagtctaatactgacatttcctttaattttttaatttttttctttatttgctctatcaaataaaatgtgcaggaattatttattgaactgcagagataaatttttagaaaactgtataccttaatactgatggtataagattaaaagtctttttgcttttcctagtggcataaagtaacacttcaaatatttacctttctattcttctagtcttggcacccttttttaatacggcattttctctttgtattgaaactttttatttttaagctgatgttgaaaatatatagtagcttatttgaaaatagatgatctgttttcacacattttaattaatttacaaaaatatggcattaatgtttagattttcttttataatgcaatggatgatatatgaatggtgtctaaactggattatatagattgaaatagacttaaaaatttcagtagacattaaaaatactttatagttgaattggtttaagcctaacaaaaagatttgtttaaaaagttttatatacatatacatatatgtatatatattttcttttttagaaaaagagcaaacggggatctaataggtcatatgatcaaagtttaagtgattcttcctctcactctcaggataaacatcatgagaaagagaaaaaagtaagtggatttgttgttgctaaatttgtagcacatctacttaatagaatttttttttgcctttttagataaaattacattcttgatagttaaatggagacattgaaatatagaaacattttggctaataaagagtatttaatgaaatgataggtttaatgccatatttgtgaatatggttttacccattgcaactgaacatttagattacaactttactgaaagcatgagggaaatttcttgcatgtgttactgtggtcatcttgcgaaatctttaggtgacttcagcaataatagttcgttgctatatattattaactgatttcttcgcctgtaagtaattatcagcttttttcctttataatagaacaattttgaagttctatatattcttggctattttttctttttcagtggtgctactggtttattaattttttctagtggctacatgtcatgtcttttgtttgagaatattttgtcttttaattaaaacactaaaagcttgcctaaatactaatctgtctttttctgacttgcctgtttttcccgcttacatttttacttgctttataggaaatactttttaataaactaaaaaataatactggaaaatcatttgtacttaatttgttctttaatatgttctttaagaacatattgccattagctgagcatggtggtgggcgcctgtagtcccaactacccaggaggctgaggcgagaggat

SEQ ID NO: 60125 - DNA, 1837 bp, Homo sapiens
ctttatcatatactaaattttcatatataattgactcttttcctgggttttccctttcttaatctgtttaaatcaacatatgtttttagtgacagtcattagacttctttgattcacatttgataggctgttcatatggatataagccatgcacagtgtgttccagtgaacacttgtaatgctcattgcaggatacatttcttgatgtatcacagaggaccagagttctttattgttccatgatttgctttgtatgatttttttacatctctatattgtatgttttcacacatgtacatgtgtattttttgccttttactctcatttgttttgcaagttgttagggtttgtttgtttacttttttgttattcaggatcattcaccattaaattatctcagctcttataaccttgaagaacaaagcccagaatgggaagtagaatatatagagtaaaggaggatagaaaggcttcttaattatctttgtagggagaaaaacattgatataacacttaaagaccaggatcatttcaacttcatagactagagtgtataaatttgttattttggtgtgtgtagttgcccattttcatactgctatgaagaaatacacgagactgggtaattttatagaaaaagaggtttaatggtctcacagttgcacatggctggggaggcctcacaattatggcagaaggcgaaggaggagtaaaggcaagtcttacgtggcggcaggcaggagacaatgtgcaggggaactgccctttataaaaccatcagctctcatgagatttattcactatcatgagaacagcacaggaaaaacccacccctatgattcaattacctcctaccaggtccctcccatgacacgtggggattgtgggatccacaattcaagatgagatttgggtgaagacacagccaaaccatatcaatgtattaacttacaaaaatcctaatattgttattttagtttttttaaataaatgaggtctcactctgtcacccaggttggagtgcagtggtatgatcacagttcactgcagcctcaaccttccaggctcaagcaatcctcccgccttggccctcttagtagctgggaccacaggtttacaccaccacacttggctaattttttattttttttgtagagatggggtctccctatgtttcacaggctggccttgaactccttggcttaagtgatcctcctgccttggcttcccaaagtgccgggattacaggtgtgagccagtgtgcctggcctgtattgttattttgtttgtgctttctttagctcccatgacccaatcgtgtattctagtctggtttcagttacactgttgctttaaaccactccacgacttttagtggcttattaagcggtgggctcagcagggatgatttatctttcttccatgtggtatctgtcgggtttactcatgaggattcattaagctggtggctagctgggtgttcagtgttggtcttattcacatgtctggcgccaggcgctgctggctataggctagagtacctcagttcaccctgtgatgtcattctccatttggcctctctatgagtagagtgtggaatgattctttacatggtggctgataactgaggtggcagaggtggaagccatgaagacttcttaaacctccaggttcttgagcttatacaccatcacttctgccacatcctgttgagtaacacaagtcataaggttaacccaggttcaagggagtggagaagaggatgtcttaggatgagaagagcagtgataacccgttgcagagaatatggcatgattctttggggagtcattatctg

SEQ ID NO: 60126 - DNA, 1997 bp, Homo sapiens
aaaaagtgtatattttgctgaatgtaaatgtagcaaataattacagacttcagttgtttattagtattattttaggcttatcaagaataaaaaagctgaacttacctaaaaagaaactcacactagtattacttgtttataaaacaacacaatgatcagaggaagtgatttttgacagaagtatttgttaatgttttaaattactagttataaaaaaatctctgttgcatatatggggttatagttaaattaaaattggattttacttatattcgtttttagaaatataaagagaaggacaaacacaaacagaaacacaagaagcagccagaaccatcacctgcattggttccatccttgactgttactacagaaaaagtaagttttaagtatcatattttgttttatgtaataagtagttattgtgctgattttcacctctaaaaactgttttcattccctaacttttcccagcttttcaaccacatatcaggcacttagaattctcatttctttttttttttttttttttttttttttgagatggagtctcgctctgtcacccaggctggagtgctgtggcacaatctcagctcactgcaacctccacttacctggttcaagtgattcttctgcctcagactcccgagtagctgggactacaggcgcgtgccactgtgcctggccaattttttgtatctttagtagagacggggtttcactgtgttagccaggatggtctcgatctcctgaccttgtgatccgcccacctcagcctcccaaagtgctgggattacaggcaagagccaccactcctggcctgaattctcatttcttaccttattctaccttctgtttattctgtgcttgtctccaaagcctgttgttaagtaaggataacaagtgggaaccatcattgagacagagaattttggctgtgggtggacttcattcatctgagattttgaattctggccttgccacttactgattgagtgtttaggttaattaaccttggttaactcaattatatcatttgtaaagtgggggaaattattaatgaaatggaatgacagaatatgtgtaaagcaattagaacagtatttggttcatagtgagaattagtaaatattaagtagtattaggattattatcttgtggttaatatgaaaacagagggagactgggacagaataaataagttgggaagtgcagtaggagatgagtctagggtgagggacccattatgcaaagctgtataaaccagtgtaaggactttgtgtttagtttgatcgaaaagtgagctactggaggtttctgaattgagatgtaacgtggtctgacttaggttttgaaaggacctctggctgctttgttttggacaggctgtggaaagtcagaatggaagcagggaggccattagcaaggtatgcaatcgtccagagagagatggtggtaaaaacagaggtagtgataggtgatcagattctgaatacatacaaagcccacctgactttcttacagataagttagaggcatatgagaaagagaggatccatggatgattccaaagattttgggtcagatcactagaaggtatagagtcactgttaacaaagaggggaaagactgtgggcatagcaggttgaggggaaagaaaggaattcagtttgggatgtggttttagttttctattgcagttgaaattactacagtataccagtttaaaacaacataaacttactagtcgttctgtaggccagaagtctgggtggactcagctgtttcctctaattagggtctctcaaggccaaaatcaaggtgttggatggtctgggttcttatctgaaagaatctgtttctaccgttcgtcaggttattggcagaatgaatctgcttatatgcttggtcaggttattggcaaaatttggttccttgtgattggttgtaggactgaggtgcccacttctttgctgcctgtcaggtggggatcagcc

SEQ ID NO: 60127 - DNA, 2297 bp, Homo sapiens
aggctacttaaggttgttctacagctcactgttttttttttaatgtactcattcttttggtgatttatgttgggtagtttacatgttgtagtctcaaggttggcttggtacaaagtttgtggtttttatgggacacttgaatagtacattattttattttaatattttaaccagcacattatgttttctaatggttgaaggcatagcacttgccatcaccaatgcagatgacagagccttgtagactaatctgaggcaaccataccttttgtaaataatcatagctgctgtttctttggttacttgttatagagtcattgtttaattttggatctagttttaaatttttgtttgaagtaaataatttttgtttccacttaatgctattgtataggtatattggtgttgcagcttatcttaggactaatagttggccatgaaataaaaatgacgtgtattctgaattagccttttaaaagattaagttgcccgtaaatcacaatgtagaacaaagtatgcagtacttcagagactctcagtacagccaaatatctagttttatctccagtagaaaacaacaacaacaaaaaaagaacttacatttttcagtagagcaccaaatgaagtagttggcattttgtggtccaatttacattaaaaataagtattattatatacaagaattacactcagagcagtgagatgttcatactatgatagacatttagaatacaaaagtgaggaaacaagattttgtgaatttagtcttgggcttactcatagtgtgtctttcagccatctcccacctccttctggtctccttttacctgtcttcgattttgagttgatcattgtatgtttataatggaattccctagtgccatattgtcccaacagcacattatggaacaagtacttttaaaatcatttttaaacctggaattaaaatagatgtttctctttgaatgaaccctgcattgccttagttagtgtcattatgtgtaatttaaaaattgttaacatctaaagctaaaattcatttttttcacattaagtctgattatgttctgaaacgtaggtttggacatttaaaaaatgttcagttacagttttaatatgattttttgtcactgaagtttgattgttttattcattgctctctttgtaatactgtttcttccaaatgtcatgttttcatgggtttttatggacagatttatacttgagggtttgatcaagggtgttctgttaaataagtgggaaaaatgaccatctctaatgtagattgtcatgtggaagtgaatagcgtatttccatttgtagtactctacccaattttctctccattctttatttgatacatgagcaaaaatacatgagtgaagaacaccactgtgttttcttagatgacttttaaacttcactaggtcatgcaaggatcagatgtgagaggaatggagaacctcaggatcaactcaagtaattggaaaaagtatttgaaaaatgaggtggggtggtttccaaattgacctgcccagcatggaaaaggttcatatttctaaagtaagccatgaagtttcatcagcttaaatgtaattggtttgtaaaatgggattttttttttccttttaaacttactttgaaacgtttgttcttgtttgtggattgtagtttgttagaatagtggagtactttgtttttatgaaatatttcttctatttaatgatgaatatctgttattggcactgagatgatgggggctggggatggcaacagggtgacagaaaagcagcaagatttggttttccaaacacttaatttcttctcttattcctctttttgaaattgtttttgctaaaaatgccagccattttgaaactttattttattgtcatgttctcgtttttcatattcatctgattgtttgtgttgagtggtggctgtatgtgggaaaattcacttttgcatattttcagatttttttcatttttatagcagagattttagatagatacaataaaaaagtattaacttatccaacaaaaatttagtgccgattatgtagcaagcacttagtgaactttatgctgtgcatgcctcagatactttagtgaacttaatggcaacatcaaaatctttgcccttatggactttataaacctttgatttcaaaacatggtgattaatgtgcatctggtataatacactttcatgtagtcattttattcaccattatttgggtataccttgtattaaaaatgactgctaaaactggaaactatacaagtcttcatctt

SEQ ID NO: 60128 - DNA, 1034 bp, Homo sapiens
aacaaatgcagatcaagggaatgattgagaaccatttttagggatagttataaaatcttacctttgcgatatataactttttcctcaacataacaattggaaaaatgatttctgtttcaaatctttctgtttttttttgcaaaggggccctcacctggtttccttcaaaagttttgctctgtcctccgctagccttataaactcatggatatggtcctctaatggatttgtagcaccttagttcccttattgtcaccttcctgtgttgaatactaaagcttattttaatttcatgtctaggaagtgtagacattgttaaaaaaaaatgatgttgcttgacaaatgagtatcttcagtattactgtgtcacttcataaatataactaatacatacttttactagttgttgcaatttgatcctgaaacagccatctttaaattatgtaggctttttcttttcttttctttttttaaaagtaattataatagacttaaattgtttttggatgattttcttaggtgaactgacttatttttagaacagaaactttgtgtttattctgcaagttcttcttattaatgtggcacccattgttttctgtaactaaaatgtaatcaactctttttccttccctttttgaatcaaaatgttagacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaaggtattagtgatgttttagttaaaatacttgtgtttaagatggttaataatagttatgctttgtaaaataattggtttgtttttgaacttataactaatggatgttctagattattatatgatta

SEQ ID NO: 60129 - DNA, 2203 bp, Homo sapiens
acagggccttgctttgttgcccaggctggagggcagtcatgtgatcacggctcactgcaaggttgacctcctgggctcaagcattcttcctgcttcagaccctcaattagcttttgcctccacctttgtctcccaagtagatgggaccacaagcatgcgtcaccatgcccagctcatttttaaattttttgtagagacgggttcagcctcctgagtagctgggattagaggcacacgtcaccacccccggctaatttttatattttcagtagagtcgggggtttcaccatgttggtcaggctggtcttgaactcctgacctcatgatcctcccgcttcggcctcccaaagtgctgggattacaggcatgagccactgcacccagcctaagtttcttatatcttagaatggtatggtggggtactcatgttctttaaagaaagaataagcagtgatggctgatttctttatgaagttccatgaaaattggattgggagaatgtgagatatagattagattccatatgatcattattttgtcaaatccattttctattatggtagattcagctgaacaataacaatcactagtatgtcttaaagttaaaacttagaactcataacctaggaaacttcttaagttcttattgtatattgggaacattttcaatcataccttcaatattcaaaaaagaagttcccctagacatttagagtcagattatagtcttgttaggtcttcttgcatgactgtggaaaggagactactgttctgtagtccttcctcaggcatacatgaggtgtttgggggagaattgcggaatgttgctgtggcaaaaggtaggtgaaataaagcgcatcttatatcttaataattatttaagtaatagcttgcaattccacagtaaacatttaataccatctataaaatgacacatgtttttaaaggtaattttggggataaatttgacaagtcttaatatacgaatgtcctaagtgttgtagttaatttttttaaactcttctctttaatgattatatcatgtctgctgcttatgggaactttagcatccaatttttctgtcccccccaccccccaacttttttttttttttttttttttaaactacaggcagtttttcaggaactccaggcagtgtaaagtcatcttctggaagttcagtgcagtctccccaggatttcctgagctttacagactcagatctgcgtaatgacagttactctcactcccaacagtcatcagcaaccaaagatgtacataaaggagagtctggaagccaggaagggggggtaaatagttttagtaccttaattggcctcccttcaacctcagctgttacttcacagcctaaaagctttgaaaattcacctggagatttgggtaattccagccttcctacagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcaggtaggggtttgcctattattatttttctccttcactcccaccacctcccttcttctgtcccaaaacgttttcaactgttgttacgataatacttgaaattaataaatgacatttaattaaagtgaaatttctcagtttttaaattttctaatggaaaatacaaaaatatcttaaagtcttagatgatttggtgtttgggaaagatgttcggcactaatttgattttacttaattaaatgtaggctaaacaatctattggtcattcattacttacaaaacacttagaatttatttcctatttttgtttcacctgcacagtattttttttttaatgcagaatttatatttagggtgtgagagtttttaccctttggtttttgttttgttttgagctccctttctctaaacttcaattttagtaatcattttctaaacgactcctcacacagatactacttgaattaccctatcctgagacatttttatatcagtgataaatgat

SEQ ID NO: 60130 - DNA, 1003 bp, Homo sapiens
ataagtaggaaggagaaaatgtatacagtcatcctttggcatccatggggacttggttccaggacctcctgcaaataaatacccaagtccaagatgctcaagttcctgttataaaacgtcatagtattttcatataacctatgcacatcttcctgtgtacttaaatcattcttttctagatttcttataatacctagtatcatgtaaatgctatgcaaatagttgttatactatattgcttagggaatcatgacaggaaaaaaagtctgtacacattcagtacagactcaattttttcctccaaatattttctatacaagggtgttgaatccccagatgtggaatcccacagacacagaagacaactgtattatgtattacatcatcacaagttgtttttcatgatgctgtttttaaaagattgactttcttgaatgacaggtcgataatttagtaatgtcgaagatgacctttgtaagcacctgttgtttaaactataacattcactataatactaactcctgaggctaggggctgtttctgacatacaccactgtatccccactgccagcacagtgctttggacatagtaaacgttaaacattattttaagaaatgaatgaataccattagttgtctcgtgagtgtatgtcatgtggttagaagtatgctgtatgattttgtacttcccctctgagtgtttatagctaagctgtaagacatattactttatttgtaaagcttttcttttcttttcttttcttttttgagctggagtcttgctctattgaccaggctagagtgtagtggcctgatctcagctcactgccacctctgcctcccgagttaaagcagttcccctgcctcagcctccctagtagctgggactacaggtgcgcgccaccacactcagctaatttttgtatttttaatagagacagggtttcaccatgttggccaggacagtctccatctcttgacctcatgatccacctgcctcagc

SEQ ID NO: 60131 - DNA, 2215 bp, Homo sapiens
aggcatggtggcatgcacctgtagtcccagctatttgggaggctgaggtgggaggatcacttgaacccagtgagccgagcttgcgccactgcactccatcctgggcaacagagtgagactttgtctcaaaaaaaaaaaaaagatctaaagcacattaatgtatcatgttgcgaatcatactttctcccattaatgaagccttttattctcagacacttgttatacagattcatttgtaagcccttatgtcttttcctcactctttgtaataacacagatacattccacacactcccattaagatttgtgagaattctattctgtttggttctccccctcatgtcccaattattagcttataatttttgtttttgaagttctaggtggcctacttaactacacttttaggtgaatttccctccatttttctggcctatctctttttttacccttgagtcactggcaatttcttcactgatttcctttttccttcctctcaacagaaatttccatgcagtatcggcatgatggagcttgcccaacaactagtaagttgtcaaactgggttgataacccgggccttttgtctcctctagtgctctttctagtatgttatgccacctcggaacctctaaattttaatattccaaaatgcaagtttttcttaattgaacagatacttttctcctgcaaagataatgtactgctttgtcttgttatagatccatattacagtcaagttgtgtacaaattttaattattgttggtcttttaatatggtgcttttgttgcagaattgtgacttcacctccttcttgaaataatgtgtttatttttttaacattttgttttctattcttaatataatttttcaatatttgtatatttgcactaggtggtttttttcattaagtcttctacatgtgttgaggctttcttatactgaagtctaggaaatgagaatatttgatagggttagatgatataatgaggtttttctttataataaatattgttaagtgtgccctaaggcagatttacctatatagatttgcatcctacagtgactcacttttagcaagacattacgttgacataaatgtcttttaaaaagtgatttgaaatacatatttattactaaggaaattattgtcgttatgacaatataccttaacatatctcaatttagttggtaatatgttggcaagtggaatacaatatttaaaaatttataccatgtaaaaatggagccaagcttgcagttttaatgattcaaacaatgatatatgatagacttactgaaattttattatactaattcagtgtatggctatgtatttcttttgtgtgtttgagaatgatcttaacctgaagtccttttttccttacttaaaagcgttctcagagttgctgaatgcaatacacaacggtaagttttattagaatcttctctagtggttcgtttatcacaaaggttgccttttgtagagaatctcgattgaaagctagcatgttctattgattagatgaaatccagtgctgcagtgagtcaattgttcagcaccttagtgaaaaatttttgtagattgccaataagaggctgataggtcaatatggttcatcagtttggcttttattgtttctttttaaggcaaaatgataatagtgttttaagtttctgaaagtctttttatttttacaaatggtttttctagttcttttgagatctctcttgccagtgcaggtaattattggtacctaggggaagaatttgcttggaatgtgaattttattttttagggtttgggtttattaatatatagaatactttaattattttacccctgtattccacatagtgaataaatggaagatagtcttttaaattacatctggtttgggaccaggttttttacagtggagttgtatcttttgctgcattgggttctgaaatcagcatatcaggcaaatactatctttgtaatgtaattatagtgaagattattcttgcaaaaaatgtttgaaggtttcttcagtttccccaaagaacattccttaatcctttgatgttcaaaaattctcgttttgaggctagtgtcaactttgttgattttctttttcagttattaacagatctcatttgttcgagactgtttatgttcgactcatttgttcaagactgcttgattccaagcagtttttcaatacattttca

SEQ ID NO: 60132 - DNA, 1443 bp, Homo sapiens
ttcagctgaaggaatgagctattcagataatgtaacgtttgacctgatacttaaagaatatgtaaaattttgttatttggagatacagggatcagagctagattcttagtctgaggtatgtacagttagcatgagcaatggcatagaatgagaatacacaggctgtgtaaagtaatatatatatatatatatgtatatatatatatatatatatatagcgtgtgtgttttatatatatatatatatacacacacacacacacacacatttatatatatatatatatatattttttttttcttggcatgttttacctccaagatactgatatttgatatgaaaaataacaacattagctattagtccaaggagttgaaagcagttggtgttgagttggaaaaaagataatcaaacctgtactttaggaagtttcaactggtgggtagcatgtaaaaagatggaaaagagctaatgctgaaacagagtaacccaatagttttttgttacaatctaaccaaatttattgatggcctgaatgaggatcctggaagtcaaactgatgagatgtgtattacccaagaagaactggtaatgacagtagctggaaaggatgggtattcatttactaacacaatatttaggtagagatgtttagcacagaattaaatagagcttgggcaccaaagagaattgaaactaggccacttagggggtagtaactgaaactctgagactagtataggctgaaaaatgtgggtagagaagacagaaagaggttgaatcaggtttattttaaaatagtgaagtcttaataggtagaaaggagattaaggattaagattcaaggagtgatatttcatagatcaagaatctggagcagatgggaagagatcaagtgaacatgtagaaaaattaagtttgaaggaagacagagaatcactgtggaaacattcactgtcagaaaaccccccaccaaaccaaattagttttctaaaaccttcataatttgaattaatgaatttttaaattattagaaattttaaaaatagatttccccccaaaagaactgattctttcaggtatgtgtagtaacttgaatgtgtttacaaaagcgttttctttttagtgtacttcagaatagggctttaatgattaaataagagtattaaataatacttaaatatgcaacggttatgcatctgagcgagttattttattttaaattctcagtgtcgcctgagaagtgatctctttcctctcctcttgtatttttttgtccgaaatacctctgtcctggagttactgtttgtgcctgcctgtctgtcattttctctgcctattccttaactattacataaatcaccaagtgctgccttctgaacattttttctaatttactaatttgaggctttctagacatgacttttgtatttaatttttctt

SEQ ID NO: 60133 - DNA, 2106 bp, Homo sapiens
gtgttcagtactactaccgtctttgtctggagggacataatttttaatccagattgtgaaatagcctcctaaaaaaaaatctttgtttccactcatccccgtcagtccctttgctacataagagtcagagggatgatctttttaaaaagtgagtcatactatttgcctttggtgtcttcctactgatcttagcaaaaattcagaacacctgtacatggcttacaaggccttatgatctgttccttcccctctctccaactttgtcttttaccagcctctccacaaggctttagctgtattacctgttttttcttctttcaatatttctgggtcttttggacaagtttttctgtcttactctttgtctagttaacacctacctaacctttaagccttgtcttaaatatttttttagacaggtctttcttgcttcctagtatttcactcttgtggtacctttttctcttccattatagtatgtgttggaatttatattcatgtatttgttttaatgtttgccttgctccttaaattgtaaattcccagagagctaaaatcttgtctgtcttgcttgctacattatcccagctcctagcctcattcctcatacctactgagtatttgtttgatgaaaggaaggaaggaaggaagggaagaaaaggaaaggaaggaatcagtatgtcattgccaccctctgtaccgttctgcagctttgtttctcctccctatcctgaacagatgaatttcagtgtattttcctagagctcatgcattgtaacatttagctctgtttaattcaatgaatgtcaccttgattttagttaaaaacagcatatgacttaagatgaaaatagagtgaagttaaatagaaagcagatacagaagaatttaaggtggatgttgtaccagtcctacctgaggagcaaggaagttgaagggaatacattattttcattttcaaagaaagatttagaattttaagctttcctgccttgataggaaaggaacattttgctctgttttttttgtgtgtgtgttttttttttaccagtaaactgagtaccagatattgtttcaaagtgtgattactggattgcacatttagctgcgtaatttcgtatgtaagtatacgttgatgtaatataaaaacaatttaagttttgagattgaaggtccttaatcaccacgattttgcttctcaatattattcttccaagatgttttactgcatgttgtgatggtaattgcaactttcaaagtgtagtagagacattagaggacctggtagttacaacagtgtactttcctgacttacagatacatttttaatgaaagcattaacaccaaaatggccgtagctaccatttattaaaacttactctgtggtaggcattgctagagcttttttatatggatattctcaaaatctcacaaaaagtctttaaggtagccattatctttgttttatagataagaataatatggaggttcagaagggttaagtagtttgattaagggtcatgtaggtgacagatccagcatttgaacccagttttgtctaagtcaaaagcctctgctgtttcaatttcagcatgctgcctccagctaacttttgttttctaattttagaaattggagactccctgtgtagtacacttttcacccccaaaataactaatcagcattttatctgcttttttttttttttttcctttttttgagatggagtcttgctctgtcgcccaggctggagtgcagtggtgtgatcttggcttattgcaacctccgcctctcaagtgattctcctgcctcagcctctcgagtaactgggactacaggcatgcgccgccatgcctggctaagttttgtatttttagtagagatgggtttcgccatgttggccaggctggtctcaaactcctgacctcaggtgatccacctgcctcggccttccgaagtgctgggattacagatgtgagccaccgcatctggctgcagtattttattttctaagatactctgaaaacactgaattcagtagaaactcaatatttgttgaattatctatggagtagcaacctttaaaaatgcatatctttttctctg

SEQ ID NO: 60134 - DNA, 1113 bp, Homo sapiens
agccaaacttgtttctttttcttcctttcctttctttttcttttttggagacggtcttgttctgtcactgaggctggagtgcagtggcacaatctcggctcaatctcaacctcccaggctcaagcagttctcccacctcagcctcccaagtagctgggactacaggcacacaccaccatgcttgacaccacacccagctaattttgcatttttggtagagataggatttcaccatgttgcccaggctggtcctgggctcaaagagatctgcccaccttggcctcccaaagtgctgggattacaagcatgagccacttgcaccaggccattcctttgaaattcttagagcagtttataagattctctatcttagttttctaagtttgccctttgtgatctatttttgtttgtttaccctttaaatggtaatgttatttagggttctgtctttggttctcttctcttgatcatgctgagaactttccctgggtgattccatttttgttccttggccttgaccattgtgttcatatcaagagttgtaagtaaaatacttatggggccacataggtaacataaatgagtgacatggtaagggatgatggagatgctgatggattaaagtctctatgccctgttcagagctctggtcagattgttgctcttttataatatagtatccagtgttggcaaatcttcagtttttcaagagatattaggcatctagagttcttaatgggaaatttcttatttctataataattatgagcaactggttaaaatttcaaccatagtgcagaccaatagtaagtatttttagtttgcaggtttacttactgtaacttaccatgcttctcactcctagatttatgtcttcagatctgaatttcctgctgggttttaggcttatcccattgtgttctatatgtaggagttctgtgtcccacaggcatctcaaagaccatgaccctgaacctcttaatttgtattaggaagtgatttcatttataggatacctgtgagtttgaatcattatttcaccacctactagctcaccaaaaaagttactttatttctttaaagttctgtttgctcatatgtgaaatgggagta

SEQ ID NO: 60135 - DNA, 1571 bp, Homo sapiens
ctctatgctgagcatgattttctttttttaaaaaataagcacttttaaaaaattaacttgtttcctgttaacttatgctcatcctcccaccctcttttctagaatgaatagcttccaccatttcccaccttatttctggcttttatccccatggtgcctctcaaagtgttttcatcaagtctcccatgattttcacctcctgtgttctctggagtaaatggagctgccaactcatagcccagttcatcatgtcttaatcgttcctcctctcctacccctgcagctgccccatacagtcagtcacaaagtcctgtctgtgttatcgctggaatgtctctagaatctaccaacattctttattcccacacctgtctcccaccaatgtcatcagctcctcttttggtctcggaatttcaagttgggcctgttccattttaatttctaccttgtcggctttctagaacaaggtctcttcctacttcagacttcctcagtgatgatttctggggctttagcatttgccttttggaaggcccattaggtgatttttatggaactctaattgcttcattcctctatttaagaaacgttttcttgctcttagaaactcctaaaatccatgacatattttttacaaagctctttctgctatcccctgcttttaacaaaagcctttttgctaaataaaaatggtgtaggttcttttagacaactgcttcatgagaagtcagtgtttatttgtttagttactagcacaatattttttaaacagcaacaataagatttataattggaggagggatccaggaggaaatgcaagtttactgattatgtgtgtctgtgacaaatttgactgctaagttatatttaaataacatttgtttttttgcaggtatttataacagcaatgatgtagcagtatcgtttccaaatgtagtatctggctcgggatctagtactcctgtctccagctctcacttacctcagcagtcttctgggcatttgcaacaagtaggagcgctctctccctcagctgtgtcatctgcagcccctgctgttgctacaactcaggtaagttgttacactatcatgtgacaggtaataggtgggtttctcatttttaaagtgagttttgttggaggagaaacaaatgacatagggccttctataggaatttatgaaatacctcaatttgtattaatgtattagtgaaaatgataggtatttttacatggtattcatgagagaggatggatgagtgtatgggcaccaactaattctttttaatttctgggttttaaattttgtctgaatgatataaaatatactttcaggggagcttttattctttctttaaaaaagtaggacccacaaaatatgagcaagttttggactcttgtgatttttaaaattccttttataatttttaaaattacacaaaaaatatatgaaatctttttaaagttttaaaaaaaaccgtgtaggagaatgtaggttaaaagaccgaatgaccgcttcaagcactacacatttttcctcctagtgggagagaacagtgtttgtaaataatg

SEQ ID NO: 60136 - DNA, 1830 bp, Homo sapiens
gttttaaaagagtcatataagagaaattgtaatcctgttttataaagaggacagtgcagggggaaagctgtacccaatccccctgtattacaccccccttccccaaagataatcatttaagatttccaaagtattttttttatttatttgaaattatgtatgattttattttcatttctccaaagctctagtagtcttttaatggtcaagaaaatggtcacagggacaaatgtctaataatgaacaactagttaaaatagttgtttataagttcctgtcaacttgagctttatggatgcgtgcataatttccattgcgtgtgttgttaggatatatatacgcttttccggcaagcacaatgttaggttattttgatgcatttgtgtgaatggcacagtgagagcagttgctattaaaattacgtattagaatcaaccccagatagttcagcacagaaaagcaatggcatgattagtagtatcgtctttgaagatgaaagtgaactatttggtgaacctcccaacttgatatagaggagtttgactactttagcagagtttttctgtagttcatgtcactaaaagtgaggtagccataacaggggtttggggttagagagggtgaaaggataaatgaaagaatagctcctataaatggttttatctctttttaattaagtgcaaccatatgctgttgatagttttatatccttggacaaagtctcacatgaacattttcaatgtgcatttctcttttctgtctttataaaagtctgtttaattaccctctggttacttcccggctgaattaagtaaaaatccccatttcttctcattcattatgtctgtgagccagggggttggcattagggaagtggtagagaagagaagtttatagctagagggaaaattccacttgacatgtgactcaactgaagaacaaagaaatcatagttgtaagtaacccaggattcagttcaattaaaatctttactatttatcccctctccatgtttcagaaagatgggtctcttacaaatgtgatcatccagttagatttacatgctgtgtactgagatacctacatctatgtttctgttcagcagtaaatgctttctgtcttcaagctgaagcttatttagcctggcttatctggtgctgctgtagcaaccatcagtctccaggcaactgaggcacgttgacctctcagttgaactgagtgctgaactacttcaatttagctgcctgagacaatagtaatggtgttgaatgtgaaaaatgtgaaattttctaggcaatgtgcaaaggaaaggatacagaaatatttagatagaattgataggactcttaaaattggggatgcacttagcaattgaatcattttttacaaaacgacaaagtttattcctgtttcactctcatatagaccctgtttgttttcaagtcttacattagttgtgtttagatagtcacatctagtgttttatttagggttgctctaagtagttgattttagagcaatgcagtaagataaatgggtgaataaaaattatcaatatttaaaacgtaattctaggctgggcgtggtggctcatgcctgtaatcccagcactttgggaggccacggtgggtggatcacctgaggtcaggagttcaagaccagcctggccaacatggcgaaaccctgtctctactaaaaaattcaaaaattagctgggtatggtggttcaagcctgtagttccagctactcgggaggctgaggcaggagaattgcttgaacatgggaagtggaggctgtagtgagccgagatcatgccactgcactccagc

SEQ ID NO: 60137 - DNA, 1033 bp, Homo sapiens
attctatctaaatatttctgtatcctttcctttgcacattgcctagaaaatttcacatttttcacattcaacaccattactattgtctcaggcagctaaattgaagtagttcagcactcagttcaactgagaggtcaacgtgcctcagttgcctggagactgatggttgctacagcagcaccagataagccaggctaaataagcttcagcttgaagacagaaagcatttactgctgaacagaaacatagatgtaggtatctcagtacacagcatgtaaatctaactggatgatcacatttgtaagagacccatctttctgaaacatggagaggggataaatagtaaagattttaattgaactgaatcctgggttacttacaactatgatttctttgttcttcagttgagtcacatgtcaagtggaattttccctctagctataaacttctcttctctaccacttccctaatgccaaccccctggctcacagacataatgaatgagaagaaatggggatttttacttaattcagccgggaagtaaccagagggtaattaaacagacttttataaagacagaaaagagaaatgcacattgaaaatgttcatgtgagactttgtccaaggatataaaactatcaacagcatatggttgcacttaattaaaaagagataaaaccatttataggagctattctttcatttatcctttcaccctctctaaccccaaacccctgttatggctacctcacttttagtgacatgaactacagaaaaactctgctaaagtagtcaaactcctctatatcaagttgggaggttcaccaaatagttcactttcatcttcaaagacgatactactaatcatgccattgcttttctgtgctgaactatctggggttgattctaatacgtaattttaatagcaactgctctcactgtgccattcacacaaatgcatcaaaataacctaacattgtgcttgccggaaaagcgtatatatatcctaacaacacacgcaatggaaattatg

SEQ ID NO: 60138 - DNA, 1085 bp, Homo sapiens
tcttatgctaagaggtatctccttggaaaacgttgttagtaattttactgtgttcatttgtgtgatgcaatgcagaagagagaaatttgagtcagcaaaagtcctgggttccaggagttttgctactcacttgtataaccttgggcaggtcttttaatttttgtgagcctcaatgtttccatatgtaaaatgggaatactttaagtacctgttctacctgctatacagatactttatgaggttcaaatgcagaccataaaatactttagaattcatggttattgacttcaactgttactcttcagcctaattaccagtgagaaattgtacaggaacacttcctgtattggaaatagtattaacaatttctgttaaaactcatataattcatgctaacatagataaatgaattttagccagtatatatattcagctgtggattaaggtctttcccagttccaaaattatttcaatagctgcctttgtcctacagtaattttttcccagaaaggtaagagctatattgataagatattaaccagttaagaaacctacttagaatttgttggttaatctatacagtcctgttgtccgatcatgagtgttcagtgatggtttaactacacttcattccctcctgctactttatggaaactcaattgtggggcattttggcattagcctaaacaatggttttgaatacgttaagctcctaacaattagggagcagtttggagcattgaataatgtggaatgatgcaattgaacctgacagcttcaacagtcagcctactcatgggacctgaaagttgttcacacttggtttcacctctcatcacatgctgagtattgaagccttactggcggtagctgacacagaaatgggtctgctatcagaatatgttcttagtaaatataaagtttgaattgatctggagaatatgtgaacctttcaattgttccctaatccatgtctaatgttcattcatgtttttgctggaaacttttctaatcaaatatattgtgttcccaaattcaaacaataatataaattggatctagaaacattcaagtccttacattct

SEQ ID NO: 60139 - DNA, 1717 bp, Homo sapiens
aagactgtttcttcctccttctaattaattttccatttctaatctattaaatgtgtagtggatcttttttagaattgtatctacagtaagagtaaattggctctacaaaagctatttttaagtattaggatctgagacgtcaacagatgggactggtaatatctgttttttctgttgaattgtttgtatttttcttattctatattgttttattaatagctaagattcccaaagaattgacttctggagagagaaaaaaatcttaactgtatctctgtttatgaattgtgtgttttatgtgccctctactactaaatacatggtaagtgaacagcacgatcttcatgttgaagttataacttaccttttcccgagggacagttgattgttaaacaggactgaagagtaccaacttactgactttgtctgcatatttttaataagaggaaaaacaaaacccagaaattgacagatttaatttacacattaaagtgtgaactataaaatacacgctttgagataatagaaagcaaggatggtacatcccagaaactgtttccgtgaaccataaacgcacattttcatgctttgtaagtgggctgaaggccaagatgcaatgtcatgatgtgagtctgtccagaaatacagcttcttctctgtgttattttgcttacaactactgtgttgtcttagtctcttgtgtgcagttatacatatccaaatgtcccccatcttttgttcttgttattcagcttctttacgatagaagtgctttagttctttgccgatattttcaagagttttgttctgaaataactgcaatgattttagtttataaaagcttcagtttgatttcattcatgaaaaagaagaacaattctactttaacatttgtggttctgttaaatctgagaattatttcaggccactgagagtcttctgtgagtaacagcattttgtatacaagagatttgcctccaaaatgtcaaattttaaggtcataatattcttggaaagtgggagagagcatgcacatcaaagaaagcatttttattacagtggattacgcaatactttggccagcctccttagcttcatctgtttaagggttcattttcgcttgtttggcacaggtcccagtgaggccttcagaattgtggttagcaacatgaatgaattacaaactttggacgagctcttcagttagtagagctggcttgctgccaaaaagacagtgccttatatggggtcagggcaaagctgtgattcgttgagtcctgcattgtatagaaaacatacttgggatgcctgtttgctttcttttaaaataaaaacaaaacaaaacagaaaaagcagcaggcttccaagtctatcaaaataggaagtaacaaaatagtgtgcaggttttactaatgacagagttaagcaatggaaatacagctccctgtagctaaaatactagaagtaaaagttggacttttgacctccttagccagcttgtgatatgagagattgaagcatttggttagatacctgttgtcttcctgcttttatgtttcagatggcttaataagattaattagtctcatgtccacatggttgctgtgccactggggtttggtatcagctagatatgttgaaaattaaaagcaggaatagttaccttccaacgtgccagttcttcttttttaaaaatttgtagttatggccaggcgcg

SEQ ID NO: 60140 - DNA, 1008 bp, Homo sapiens
gtagttacgtaacttttttttttttttttgagacggagtctcgctctgtcgcccaggctggagtgcagtggcgtgatctcctctcactgcaagctccacctcctgggttcacgccattctcctgcctcagcctcccgagtagctgggactacaggcgcccgccaccatgcacggctaattttttgtatttttagtagagacgggggtttcaccatgttacccaggatggtctcgatctcctgatctcgtgatctgcccacgtcagcctcccaaagtgctgggattacaggcgtgagccaccgcgcccggcctagttatgtaacttttaaaaaattgacatgttgaatggtaaaacaagtaagaacgaaatttgcttttcagaaggtcacaaattttgcttatattcttaggttggagaatataattactagatctattagaagggaaaacttttaatatattttcacatataattcatttatcattgtaattttttccatttaggcaaatactctatctggatcttctctcagtcaggcaccatctcatatgtatggcaatagatcaaattcatcaatggcagctcttatagctcagtctgaaaacaatcaaacaggtaagttttcaagaattactaactctaaaaccctactctcacctactttaatttttttccccttttggttcattttatttgaaaacatgcagggatgtggttagtagaggatttgtactttaaaaaaatattcacagttggaaaatgttaaatatttcaggtgctggttatgttaactagcttgattttattattccacattacattcatatatcataacatcaatttgtactccaaatttatataattacaaactgtcaatttacaataaaaaagaatcacagttggaagtaaatagtatgctgtgctgcaaaatagcaatgtcctttttttttttttttttttttttttattgtctgaaatggaaatgtttcaacagagccatcagcaag

SEQ ID NO: 60141 - DNA, 1232 bp, Homo sapiens
tgtatgttttaggaaaaatcagggcaagagtttaaaacctcttatctagtgagagtcactttatcagctctgaaatatttacactacagatcaagatcttggagacaatagccgcaacctagttggcagaggaagctcaccccgaggaagtctctcgccacggtaagcgctatttacactgcaaagtataggcaaaggaaacgtttgagatttggaaactttcttatctcatatcagtagagtgtacatttgtgaggctataaaagcattctacagataagaagcatgtctagacaagaaaaatgattctaaattaatttaaatattaatttaaacaccattagatttctaagtaaaacaaatccctttcctttggtttccaatcagttcgaactctcttgtatttattacctgtatactgatttgagtaattctttttgatcataaaatagttttaagatctcttaaagttgtagacccaagactttcaagtttgggttccagttttagctctgttctgtgtagcacttaatcccttagtctctagttcctaattcagtaaagtcgtgtggtagatcactaaactcctactagttcttaaattgtttgaatcagttatagcaaatgtattacaagttttttgaaatcattttatgacagtattcaggtaccatttattaaaatctaattaatatatttggggttatcaaactgcatattccttctgttctaaatggggagaatgtggtatgagatactgtgtctgcttgtaggggagaatggaactttggtgatagctatctccttattaattttatttcccttctgtgcgttctctttgttttctccatgttctctaatttaggaaccctccctcaagcatggtgttagactgggtgacaatggagagtaagagaaaagcccattctagggtctttcttccaagaatgggagaaacgtgattaaaaatgaaaactttggtcaggcgtggtggctcatgtctataatcccagcgctttgggaggccaagtttggaggattgcttgaggcctggagttcaagaccagcctgggcaacatgccaagactccatgtctacaattttttttttttttttttccaaaatgaactttttcatgtgatgacagatcatgaataacagtattgctgatatatttggggaatgtctgttaaggaacatcttctttatcctaaagattagttcagtaacca

SEQ ID NO: 60142 - DNA, 1379 bp, Homo sapiens
gaattgttttcaacagatcccctgtaagcagcttacagattcgctatgatcaaccaggcaacagcagtttggaaaatctgcctccagtagcagccagcatagaacagcttttggagaggcagtggagtgaaggacagcaatttttactagaacagggtactcctagtgacagtaagtattcattttcttatatgtgaatcaagacagatgggcagatggacaaacaggcagatggatgcagaagtcacttttcatccagagtagtaatgggattatgatatacattttatataatacagtgagagaaagtataaggtgaagtggtttaatagaagagattctatagtgttactgcttggacttgaatcctgtctttacctgttattaatagtatgatcttgggcatgttttttaaagttctttaatctcctatttttacaattgggagtaataatgcacccatatcagagggttattgtgaggattaaatgacatgaaaaatgtaaggaccactgcctggctcatacatagcattgtctcggtgcttaccatgattatacatattggtactttgtgtctccactgtactttgttcttatcaatcagtttactaaaatacatgagcactgtcttctcttaccccaattgttagaagaaaacttgctcacctctggaaaacttactttaaaaaatacaaatagtcaagtatggccggctagcttcttcattttataatttggaggaagaataataattattgaattaaatctataattagtatatattatgcttatcatctattggattatagagcatgtactatatatctgtgtttcagtatcttcaccatttcaagtattagggccgtgggtgtaaaatgcagagttaaaataggtggtggttagctggagatgtggccttgtcttaattttagggaaaaataggtggttttcatcattttcgagtataaacttttgctgcctcattttattgaaacattttgcttattgttggctagctaagtgccataaattggtattttatgaatggtaccctgacaaaaaatgctaattaattgtgaggaaattcatgccaggctaatcctttaaacacgatagctggaggataggtttagctgagtcttattgcatctcatttgggcccactaaggtttctttgtgggatcttggaggggagggataaaagttaaatccatgggaaacggccagatgtgtctgtaccagaggagttgtatcttctaaaggccctgaggtcatgttaaacaaatacaactttttagtatgtgacggacacttcaaaaatcttaacggcaacactctgtgttgttagctgggaggtccaagttgtggaaggaattg

SEQ ID NO: 60143 - DNA, 1639 bp, Homo sapiens
gatggcagcacttcgtttaaaccggacaacaaacaaaaacatgtgctcattattttggtagagggtattggtgcgatccttaaccattctgtatatgacttcaatgcaaaatagtgacaggcacttgaatttttaataggcttttattttgatgaaaataaaatgtcattacttttcattgagaatggaaaattacctgaagctggtgtgtgttttttggtatgtggcaacaaagtttccagaaggtacatccaggaacactttgcctttgtgcttataaaaatacaaacatagataggcaatttatatccataaacaaatttaggaacaaaactttatcatttagaaacactttacagaatttctactgttctattttaacttatttctaaggttaccggcactgcgtaaaatacttagtcttatgtgtgtacttgtcattattaaaaactatccaaatgtgtggtagttttaggaatgctgaagtcattacaccaacttcaagttgaaaaccgaagattagaggaacaaattaaaaacttgactgccaaaaaggaacggcttcagttattgaatgcacagctttcagtgccttttccaacaataacagcaaatcctagtccgtctcatcaaatacacacattttcagcacagactggtaagtgtgaaaatatttattttgtatctaaggaaaataggctttcagttttatttgtattataagtgagtaataattggtcaccagttatatgaagatgtagaaaaggaactataggttgtttttgaagggcataaagaatcctgttaagtgatcaacttgaatttaactttcttagtccataatataatggtaaaatttacttaaatgtctaatgatctcgttattgatttaaagcgatggtattcaatatagatttttttttcttatttaaatcagtcttaggaatagcaagactagatatttaagtggttttgatacgggcttcagcataagctttttaataagcctttaatcttacacataatgtaatttaatagggtaaataggtttctttttgtcttttattattctagctcctactactgattccttgaacagcagtaagagccctcatataggaaacagctttttacctgataattctcttcctgtattaaatcaggtaatttttgtatggttattttcatctatgttgatttacttgtgaataatagtatattaaatggtttaaaattattttaaacagttttgcagtgttctttaaacttagtttctcttctttcttacgctgggacttaatgtccagtggacttagtttctcttctttcttacgctaggacttaacctccagtggacaaagtaccagcagctcatcagctctttctaccccacctcctgctgggcagagtccggctcaacaaggctcaggagtgagtggagttcagcaggtcaatggcgtgacagtgggggcactagctagtggaatgcagcctgtaacttccaccattcctgccgtgtctgcagtgggtggaataattggagctttgccaggtaaccaactggcaattaatggcattgtaggagctttaaatggggttatgcagactcctgtcacaatgtcccagaaccctacccctc

SEQ ID NO: 60144 - DNA, 1965 bp, Homo sapiens
ccctgctatgtgccaggtgtccttgcaagatacagtgacatttgtgatttcagtctttaataataggctgtaactccattttttttatagattagtaaaaggaaacgcaaagaaagcccaaggacaaatagcaaatgtggaatcacagccgatgactttcttagcccataaaaatttcattctctacagtaccatgttacttctgtggaaaagttgattttggaagatgaattctgcattcattctttacaagttctgtccctcagatgggcccacctctttggtctttttatactgttgaatttaatgtttttaaagtatttactagtaaattcatgtctatatattacgttgcaagtagccttgccaacttgcaagaaaaaagggagtaactttctataccacattttatctcagtcacagtttcaaattcggagaatattatcaaaagttgatttagctaacgcatctgctcttttgtttacctgcagagacttagtgataaaactgggcctgtagctcaagagaaaagttgacacctgagaaacatctagaaattgcctatcctgctgttctagcacttcatctggctgcctttgcagtccttttactacagctatgaagaaacgcaacaagaaactcaatgcacaacaaaggattaattgctgcaaggacattcttgtaaggctttgattagttttcttgttgctttgttgcactgaaatggaattcccatgcccctaccccttaccccagttttttgaacatggaaagaaaatttaataactttttaaagtgacataatttacatgcaatatgtttatcaactcaagaatttaatatagttggtacacaactagttttgtttataaattggagatgcaaatagcaaaactaaatacttgctccatttacaaactacttgattttattgtacaagttgaaatatgctcttttgtttgggttacagtatgcttgctctaagtcaaattccaaggaactaatttcttctcctggagttgcattgattcagtattacaaatatatagcacatcacctgggacttggcaatctttgttaaaaaaaaatttcctttctaatgggatttggccaattttggtaatgaagttaggatggtaatgtctgcatctgctaaaggtaattttcttttgagaattgctttctttagtgttaagacctactcatattttgaagaaatcttgagttaagtgagttctgaggctgctgggggaaccagatcaattcaaagctaaatacttctttcagaaaggggccactgtggaaagtgctggtggggtttgcccttgatcaagtgcctccattgtgctgcaagggctgtagacagcagggtgggacagtcagtcctccgagcagcaggaatcatcccgtcacctgcagccttcccatgcttccgcctttattcagaactttctgtgccactgtagatagctcaggcaaaactattacctgggtatttatccactaatgagtcacaagaaaaggagtggatttggtaagaatagagatttgttttatttaaaccacttcccattactgaccattaaaagctcaccactagagttcctgaaacaggtgaaacctgtatgacagcccttccactttggggagccacgcttttgatgtgacagtaccgcagagtgattcccccactgaggatgtcatcatcaaactcttctttggtgtgtgaattattagtggaaaagacccagctgtaattagacctccactgtgtacttagctggaagaacatgttaattctgcaatatgtttcttggttaaacattgcacagttcttacctcatttctgtaaataaagttttgtgaatctgttttgtattgtgacaaattcataagataacattgatattttgatttgtaatatttctaattggtagatttaattgaaaagtaaaattaatttat

SEQ ID NO: 60145 - DNA, 1013 bp, Homo sapiens
cttaggaatatgacattatgtaaaacagatacttaaattaattagattttatttttgtagaggtaaggaaattatagaaaagacaagttatagtgtattaaatgctttccaaaagtaaaagtttgataatatttaaaatacaactatacctatggagaaacagttttttttttttttttttttaaagatccacatttgtatctgatagtccttttataatgtaaggttttttcaccatattgtatagtataggatttagtttttgtattttatgttgttttccctgcatccagccttattaatataaataactaccttttaggaagaattgagatataattcttatattataattacctggtgacttatatttctcttctcttctactataaacaacctgatggttgagttcatggcctttttatctttgtatccactgtagtgtctatagggtaaatgtaattaaattgagttggtgaattagactgatgccactaatttgtttcacttaatcactcaatgtctattacatgttcttatcctttatgtgttgatctttcaaaggacaatcttatttccgtcattttaaacttctgggagtatcttcccatattcacaactaggaataacaggggtggcagagctaacttgataagttttgacactggattagattcaaatggatgaaccagaaaagcagtttccccagtgatagtctttttttttttttttttttttttttttttgagatggagtctcattctgtcgcccaggctggagtgtgcaatctcggcttactgcaaccactgcctcctgggttcaagcaattctcctgcctcagcctcctgatgagctaggattacaggtgtgcaccaccacgcccagctaatttttatatttttaggagagacagggtttcaccatgttggccaggctgtcagtgacagtttttaagtagagatattctggtacaacaatatggttagtattgaggaaataactttttttaccga

SEQ ID NO: 60146 - DNA, 1033 bp, Homo sapiens
catgctgatttccttcttctctctctccctttttttcttcctatcttcctacaaaggaacactttttttctaatgacattttacatagaaccccagtatattaaagaatgatacaaaaaatttctctggttaatgccaaaatgagggaggctaaagtcttgtcatctcagcttcttcctcactccatgaggtgtagaaccttggaaaagccctaaaattccaagaaacatgtcttccctgcttagtttcacatttatctatatacacaaaaatttagtggttttggaagagttttctgttcctgtttaaaagggttagcactaagagtatggtcctgaaaagtattcaacaaggacttttaatggttcttactctactcttatgccaaaccctcttcatttccaagtaaaatggcccccaaaccaaaattaagccatcaaagtcatagcagtcagttaaagataaatggcatatccttctttattaataaggatagttgttaattgtattatggagtattccagaattgatccactttataatctagtaccatttaagataatatttttcggctggacatggtggcatgtgcctgtaatcctagcactttgggaggccaaggtgggtggatcacctgagatcaggagttcgagaccagcctgatctgcatggtgaaaccccatctctactaaaaatacaaaaattagccaggtgtggtggtgcgcacctgtggtcccagctactcggaggctgaggcaggagaatcgcttgaactccggaggcagaggtggcagtgagccgagatagcgccattgcactccagcctgggtgagaagagtgagactctgtctcaaaaaaaaaaaatttttttttctatgtgtcattagtgatttttttaaagggtagttttccaactatcttgcagtgtaaccaattttaaaccagccctctttatcaaaattctagaatataccatgagtgtgttggtaaattttttttaattggttcttaggaggaaaaaaagccttgattt

SEQ ID NO: 60147 - DNA, 1035 bp, Homo sapiens
tgccaacagtacatctgaattagattttaaatttgtacccatatgattggtataaaattatatcttggtattacttaatttgtatttctttaacctttagagtgtatgagcctcttttcttatttgttagccacgtgggcactcaattgtggattgcccatttatgaccttttgcctatatttttctattgggtggttgtccatttataaaatctgtttatagcaatcttctgtttatactctgaattggatacatcctttccaaatctattatttgtctcttgatttgtttactcttttatcttttttgtaacagcatctgggttttcattcttatttagatgtccccttcctttaaatagtacaagtagattttaagatttctttttgcaaaatttttattgttttggcttttaaagtcaactctcttctctatctggaatttatttgtgtatacagtgtaagagttttcttttaaatggatactcagttgtgtaagcattacttaataaattgttttcccactaaattgaaatatagacaatcctagacttataatgatttgacttacaattttttgactttatgatagtgcaaaaacaatactgtactttgaatttggaatcttttcctggactagcaatatgcggtaggatactccctcataatgctgggtaacagcagcaaactgcagcttccacttagccatatgatcatgaggattaaaactgatcctctacagtgtactgtgtcactatgttattttgcccaactataagctaatgtaaatgttctgagtacacttaaggtagactaggctaagccatgaagttagttttattaaatgcattttctaattaaggatgttttcaatatatgataggtttatcaggatgtaatcccataataagtcaacaagcattggtatttacagattctctattctcttctaggaatttgtctattcctatgccagtatatactgattttgttacattggcagtatagtacatgcaaatacacacatacacacgt

SEQ ID NO: 60148 - DNA, 1048 bp, Homo sapiens
aataaacagttttattgagaaatccaacataaacactggttgttaccacatctctttttaatttgggagttttttattttctaaaggaatatagcaatacaaaattaaaagacactcaattttataggcttttacctcattaaaaagctttgataaaatcatgtgtataaatacttcagccttgagccaccgtagtttaggggtagacataaaagcactgactagaaaatttattctgaatttgattcaattaatatgtaattcacggtaacaaacagctcttatcttgatctttctcctattgagatcctcctttttgttgctgacttcaatggtagagtctttactatagactagtagacaggtagactacacgtagctcctttagtttagatgtcactccaggagtcacatctttgggtgctgtaaaaacatgagatctggtatccacagtatattactggacacttttttgaagggtgtcagtgactagagctatctacagtgctttgaatttactcgatattataatgctgggaacgtacataaacattatctattttggataatttgttttctttttcctttttgtaatataggcacaaatagttttttttgtttttattttaaactccccgtgaaaaactgttatatttgtactgtaggtatgatgatattctgatcaatggacttccagattggcgacagcctgtattctactacaggcgggtgagaaaaatgagcaatgctgagctggcattactcttgttcattattctcacagtgggtcattatgctgtggtttggtcaatctacctggaaaaacaactggtaagtgttagtaataaatcaaatgaactagcctccttaattttatatggaattttggacatttatttttcaactgatgaaaatttctgtttctctctgtatacttctcattctaatagttttatactcaatgtttgacatatttctaagtcaagaagaacccatgaaataagaaaatattcttcttttaaaaaatgtggcacttaagtttgttata

SEQ ID NO: 60149 - DNA, 1018 bp, Homo sapiens
cctttcagaagactggcaatatatttatgtagtagtttataatgccagtgacttaagaggagattacacagaggcccctttcctctactcctacagaatgtatggaatgtagacatcatttcagcagccttctaagttttttaagtcagaccacaacacatacgcacacacacacacataactaaaacaatagtttcacaagatatttcttattgcatgttaaacacattattttctattctaggctagactagtcttttggtgttttttatttatttattttttaaaaatgttggttgtggttcactaaattcatttcatgagacactagtggaccacaatccaaaatttgaaaatgttctacgatacaagagtacctgtaaaaaacaaaacaaaacaacacctggctatttgacatttaggcaaaagccagcctaaatatctgtgtccttcactaggggggtaatacatctccagacaaccctataaattgtgctatgttacattctgaatctttcctcaaatgtattatctggaattagtctgtatcctaaaatgttagctaccattcttgattctcatcttaaccgtttaatttgaatacctctgcttgtcagattgcaaagcacagggattcaagatcttctcttaaagtgttcttcactttataacaagggctggcattggtccagataccatagcagacattcctctggtttgagataatccatagtgttgaaagagtccaagaagcgtgttgaaagaagttttggtcattctgtgcatattttctagttggtttctctgtgagccctagttttgtttcacacatcaagaatgtgcctgtaaaggtagctttatttagttttctaatatttttggcttgaggtttttttctttttgtttgttatcttaaaagtcaataaactttgtaatttctttcagttaccaaaattatttctatcttttcaaaacaaatcacttctcatatataaattgtttcttcattaacatggaa

SEQ ID NO: 60150 - DNA, 1043 bp, Homo sapiens
ataatcaattaaccttagcttactatataacatttctacttgatgaactttttaattttttatctttttgactcttttgtaataacacttagcttaaaacagctttataaaaatatttttgtgtcctttcaagcttttttctatacttatagaaacaatttattatattcattgtttgcctcaattgctaccccttaccccattcagcactggctaatacatttgcctgtaggccaggcatggtggctcatgcctgtaatcccagcactttgggaggccaaggagtttgagaccagcctgggcaacatggcaaaaccctgtttctacaaaaaataaaaatcaaataaatacatttgcctttaaatgtttacgacaaatggcctatctgctctggcagagttctgagtgtggcaaaataaaagcaagccctttacacagtttaagccaacagagaggtcaaaacaaaataaccacagctctttgagaacaaggtcaactctgatctctctggcaccaggaacctaaccaaggccttaggttggcatctttaagacacttagtgagaatcatctttctcttaagtgcttgcctaattgctgtaaattttgacaggtttttagagatcagataaagttgattctgacatttttttgtcaggttattttcactgtttctctggagggacgaacttggagttccctaacatgctgttttttgctgacatgccattgcattgtttccattttgataagcttacattattttcagggtttgttgttggtgttgttttggagacagggtttcactgtgtcacccgggctggagtgtagtggtgcaatcgtggctcactgcagcctcaacctcctgggctcaagtaacacccccacctcagcctcccaagtagctgggattacaggcacatgccaccacacccagctaattaaacaatttttttttgcacagatggggtttttccatgttgctcaggctggtctcaaactcttgggctcaagtgatctgcctgcctcagccttccaaagtgc

SEQ ID NO: 60151 - DNA, 1184 bp, Homo sapiens
gctgcttattatttcctgatcattatccctcaggaagtgtttcatagttcttatctctgaaaataactgaaatattttatttcagtatatttgttacatttgacttttgaccaaaattgtagtcaaattatttctaataatttatcattcaacctttgcagaaatgacaaagaagcaaggcaaatacatagtttgatttctcagatacctctctaatgtcatgattcaaaaatatgggatataataaaagtattaatactaatcagtccttatttccttccttgcagtctttttttttttttttttgagatggagtttcactctgtcacccaggctggagtacagtggcacaatcttggctcactgcaatatctgcctcccgggttcaagtgattctcctgcctcagcctcccaagtagctgggattacaggcatgagccaccacgcctggcccaacttgcagtcttgaatgttaaagtacctatcaaatatgaatatttgaatttctgtatatttactactttgcaagaatgccagaaatcattgcacaaaataattttaggagcaaagtaaataaaatgttgaatctaagaagtacttagatataatatcacaaaaatcttcaagtcagtattattgaaattaatgtggaaatttctaattccaggcagagtgtgtttggtaacctgtagtatatagcacaggctcccttggccaagctttaactttctgaggtttcagttacccatggtcaactgcagtctgaaaatattaagacattttgagacaaaagagagatcatattcacgtaacttttattatagtatattgttgtaattgttctattattattcctgttaatcttattgtgcctaatttataaattgaactttatcataagatatgaatatataggaaaaaacatagtttcagccatccattgggattttagaacgtatcccctacagataacgggagactactggacattaggaacccagttaaggttcaaaaaaagcttgggacaagttaaaagtacctctttttaaaaatgcttgccacttatctcagcttcatgcttcactccctcccaattggagaatttctaggatagagatgccagtaaaactcatttaattaattcagaagagtagccaaacaaattgtatctgtcccagcaggaa

SEQ ID NO: 60152 - DNA, 1975 bp, Homo sapiens
agacatttttggttattagaactggggggctgggagtgggtaatgctactggcatctggtggggtgctgccaaacatcctataatgcacagaacagcctcctacagcaaggaattacctggttcagaaatgtcaatagtgccaaggttgagaaaacctgacttaaaggaaaatggttaagagtgaggactaccctggcacactgctcgggttttgtatcatagccacactactaactgtgtgactgtgggtggttatttaacctctttgtgcccagtttcctcattatattataataatagtagtacctatcttacagggttgttgagaggctgtttaatacatttattatgtgataagcttagatttgtacctggtacatagtaggaatgttggctgctattgttttattgtttctcagtaaaaactaaaatctaaccaattatataacatcaaaaggatggccaattaataaagatatcttagtaatttgggggagtttctaaacatggttgttgagagttactaagttaactctatatttcagcctactatttcctatacaaactgtttttttaatatttgaaaaattacgtttggggcgatgctgcctctttgtagagcagtagcccttcgactgagatattatttcattggccttttctcctagattctgtagttgtagtttttgcctctttgaaagtttcagctcctgcaacatagtgttagatgcttattctgatctttcttcacttctaggctagtgaagacatttttgggaagtatcattatgactacatcctgagagtacaatgagagtgtctgatttatgaaatctaggttatttttagaggcaagagaaaatacttaatttagtcacatcataattttatttcctctttttataaagtattatagtgtactgtaaaattcattaatcccgagtaagtatttgtgtttctcatcgctattcctctcagtggagtaattcatgaactgtacttacattaaaacacataatttaactaaaggtttaattcaaaatatttttatatgccttgcaaatataaaaatgcccagaaaaaattttagattgagagacagtgtacagtgctattttctagaaacatatggcaacttttttatataatttgatttaaacaataaatagcaaaggttaaacagacaaacccatttattaaactaacaaaggaaagtgtgtaagtggtgaagaatacatagttggttttttttttcctcttcttttttttttttttttttttttttaaagttcagttttagttttttaccacttgatggcagtgatggagctagagctctaccctgagaaggttagggcaagaactcattatgaataacaaaagcgtaggtacaaaggaaatccctgacattttaatattattcacatttctaggtgatattacttatattgcaagtgacagtaatagggggaaaagcctctagatggagcttcagtactttctaagggaaaacatttcctgtatctttccaaatgcatattttatattattttacataatatattaaatccagaatggatttttacaaaataatatttaagggtgaatttatttcagatgtaattatggaaattaattcaccaaattacctaataatttgaaaaaatggctatttaagtatcttacatttttaaatcattattaatatttgttgaaaagtatgttaaactttgagtcaaacatttctatctagtataaatgatttgcatatctaacaagttagtaaaagatatttaataagaagtcaggtgcttaaaatcaatattgcactataattaaatctgaccatctatattattatgcctagtatcattcaacatttgagttcccaagagaacataactattactccaactcaattgcccaactaaaaaaattaaaaactaggaattttaatgtaaaataattttttaa

SEQ ID NO: 60153 - DNA, 1044 bp, Homo sapiens
aaagtcaggccaggcatggtggagttcaagacccgcctgggcaacacggcaataacctgtctctacaaaaaaaaaaaaaaagaaaaagaaaaaaaattagctgagcgtggtggcatgcacctgtggtcccggctactcaggaggctgaggtggaaggatcatttgagcccaggaggtcagggctgcagtgaaccatgtgttggtgccactgcactccagcctgggtgacagagtgagataactgtctcaaaaaaaaaaaaaaaaaaaaaaagcaataaaatagcaagttttaattgcatcctagatggatagaatagaatttagagtttagagtaaaaatagagccatctccaattttgaagaagctttaagaagtggcaagtcttaataattggtcaaaagtcttatgttggaattttgaataaattactatacattaattcacaattatttattggttgcttactatgtgcctggcactgttttaggggcacagcattaaacaaaacagacaaaatgtctgcccttattgtgtttacattctagtggaagagaataagtgtaaataaaaaatatgtattatgtactagttacaattctatggagaaaaatacagcagagaagagggataggaagtgtggtgcaagagactgcagttttagataagggtagacaaaggactcctcactgagagggcaatatttgagcaaagacctgaaggagggaggatgtgagtaatgaagataagggggaggaccatttcaggcagaaggatcagcaaatgcagaggccatgatgatatgcccaaagtgttcagggaacatgagggaggcctgagtgtggagaaagttagaggaaaagtgatgggatatgagttcagagagataatgaggcgtcaggtcccagtgacttcagatgccatttaaaagactttggaggatgtgatgtgattgtaagaactttggctttaaaaaacaaaagtaaaatgtgtataacaaaaatttaccattttacccattttaagtatacaattcagtgctatta

SEQ ID NO: 60154 - DNA, 1011 bp, Homo sapiens
acatgctcactgtcttctggagtacccctgaacatatacttcttctaaataatttttctttgtgccttaaaataaaatgcacaagggaaataattatttgttgattttctccacacagtaaggcctttttttaaaaaaaatacatccaaactgagggggctacttgttttcattgtctttagatatgtaccaaggccaccctaaagaagatgcaagccaccatagttacagttgtcttggcactgtattaggcatgatttgtggttactatatacaattcccagggtttatcaaagtcagcaataggaaatttatggaagattgaaaaataagatgatttcttgtatgccatctttgataatagaggccacagaataaacttaattaaaaatgtagccagaaattgctatagactcttgaagcagcaccccgtgtatagttgtgcagtttgtgtatctgcttcaaacctgtcattgtgttataaaaatgttttagactttggcattgttaagaattgcacataggtggttaaactgtgaagtaaataatttctctttgataattgaaatattatgtttctgcgagtggaattttaattttcaggcccatcttgagtgtgagtttctctctcctctctcttcacctctccctagtggctttatagatgtttttactcttttctctgagacacctaggcaagaactaggtcttatataggtggcttagggctccctcctgaggttacattggggccattgcagatccagataccaagcctgcaggtcccttggcctggtctggactgtggggctaaaaccattgcctcttaacatctcagatacataatgttttgtaagttgtagcctcaggcagtgtccttctcactttcgcatttttttttccccacaggcggtggattgccactgcatcccctgatttcaagcagcaagcctggctgtgatcccaggccttggtagagtactttcagtcctcatcactctatgggagtca

SEQ ID NO: 60155 - DNA, 1431 bp, Homo sapiens
atagtctgtgaggcattagttacttagagggataattgtggtatagattggacctgggtggtagcagtggaggtggtgcaaaatggtcagattctggattgaatttcaacatggagcaaacagaattttactgatggcttgaatgtggtatgcgagagaaaaagagaaactgaagataattctaaagatttttggcttcagtaactggaaggatgcaattgccatttgttgagatggagaaacctggactaggagcctggtttggagaacatcaggaatttggtttacggacatgctaaatttggggtgtctgttaaacgttgaagttgagctggtatgtaggcaattggttattcaggtgtagagttacaagaagaaagtttagggctgtagataggaatttgggagtccgaggcacttagagagtaacttgaagccacaaaactggatgagttcaccaagggagtgaacgtaaaagagaagagaagagatctgggagctaataagccttggggattccagactttaagagtcaaggagccgggtgtggtggctcacgcctgtaatcccagcactttgggaggctgaggcgggtggatcacgaggtcaggagttcaagaccagcctggccaacatggtaaaaccccgtttctactaaaaagataaaaattagccaggcgtggtggcaggcgcctggaatcccagctactcgggaggctgaggtagagaactgcttgaacccgggaggcggaggttgcagtgagccaagattgtgccactgcactccagcctgggcgacagagcgagactccgtctcaaaaaaaaaaaaaaaaaaaaaagagtcaagaagatggaggggaatcaacaaagaagatagagcaggaacgaccagtaaggtaggaggcaaaccaatacaaggttctcttcagtcaagtgaaaaaagtgtttcaaagacaaagggatcagctgggttaaatgatgatgatgattcaaataagatgagctttgagacttcaccgttggaattaaccgtatggcggtcacaggctacctcagtaagaactgttttggtgaagtggtgagttcagtagtctgggtagattgggttcaggagagaatgaaagggaagaattggagacaattaatatagaacattcttttgagatatccatatcctaaactagaaggcagagatggtagtgactgtctgtggcatcttctttatccccttatccaccaggtataagataactcagttactctctaagctctataatctgaataacagatgacttagaacttggaccagaccaccttatgaccttggacaagttagttgcctcatttttaggacagatggtagctttttattttcttcatagtaaggcacatagtaaacacctaaatatttattgaatcaaacattataaa

SEQ ID NO: 60156 - DNA, 1050 bp, Homo sapiens
atctcagctcacgcaaccttcatctcttgggttcaagcaattctcatgcctcagcctctcaagtagctgggattacaggtgtatgcaaccacacccagctaatttttgtattttcagtagagacaggattttgccatgttgaccaggctggtctcaaactcctgacctcaagtaatctgcacaccttggcctagaaaaccataattttgttaaactttgcaaataagaaactctgtagtcaaaatcttggcaagaaaatactatttaatttctaaagtgaaatttgggagctgtcatcagtgttgtcatgccatgattttgttagctacttgagtgagtataagataatggcaaaattaaaggagcagacctaagaatgaaattataactttaaatatcaaatctttgtatctaaccagtccacagttttaaaaggatttcgtggatattagaaaagtcatgtctactctttaggacttcagcgtagcatgttgaaacgtattttaggaagtttgatcccttatttttaagcaaagcagttaatgtcacatggggaatatctgagttgtaaagaccaaaattgtgaagtcttcatctaagaagaaatgagaaatcgatttgtaaaaaagaaatgaaaataaacaaatgtaatttggcaaaagatgaaggcaaattttaagttaaaggaaggaagttaggaagaaatgaaagaaagcagtcatactccatgtaacatttaatgagaaaagaacaggttgcattatgtgtcttagaatttctctgcacagacaaataaaaaataattttcctttaaattccgtaagtgatttaaatgattcacttatcttttgtatggattataaaaagcaagttcaattcttaaatcacataatttctatcttcaccagttaatttatatgaaaattaggaactggccaatcacctaataaattccatcaaatagaccatttagataataagcacagttacctcctcaacagcaggttgatttttttttctgtactaaaattataaacgtcaccacttcag

SEQ ID NO: 60157 - DNA, 1072 bp, Homo sapiens
ttgcttttgtgcaaataacgctgaaggaagatattcctttagattgaagagctcatggaactccatggggagaaaaaataataagtttaagtgccatcgagacaaagactagttttaactggcttatatatttattatatattctagtggggatctgttttatccctgcctgctcatatgctacagagaagaaagtttagaacactttagaaactacctctaaataagaaaccattctctctgtgttccctaacaccgatgctttgatggttactttaaactctgagatatttgttaatgaaaatagtctttactgttttaaagctattttaaccacaaatggacagttggaaggagtatttaactgagttatatatgacacttgagagtataagtcaaaaactgtttcagtgaagtttataaaacctgtctatattcttttattaaataacttggcaaggcatagtttgtgacttggaatttgaatggtcaagtttttgcacattcatgatcacagagttcagtggtctcaaattgcatcttatatcacactgtgagacaccaaactgagtattcagaggggacagtaaagcttttattttcaatttaaacatgtaatccaatccctaattatttctaaacagtcattgctgcaataattgatatggacaaatataaccttttctcacattgtatagtttaatttgcatatgtggatttaaaaatgtgtgagggaaatgaaatacaaattacattaaataaactgtaaccacagggtttaaaattaatgatacagtgttctctaaaacagataacttacgcttatgatttggcacaagtgttttgtatttttcccctaaaacttttttgaataaatttatattaaatggtaaatagtacaatttctatttaatattgtcatcatttagtaccattttatgttatttatttatttatctatttattttagtagagatgggggtttttccatgttggccaggctgctcccgaactcctgacctcagatgatccgcccaccttggcctcccaaagtgctgggattacaggcgtg

SEQ ID NO: 60158 - DNA, 1257 bp, Homo sapiens
tctttgggggctataatattttttaatagtaaaaatattaaggcaaaataagttaattgaagctagtaatagtagagttcttgttgtgttctttttattgtttttcacttgatcttgttgctcatctcatttacttataattgactgtccttatagttgatgtttttaatcttgttaaagggtttttaaacccaaattaaaatatcctttttggaacatgactgtaaagaatttattatcataggcatcactggaagttaatttattttagatcatccagacttgaaacatatcgacccagtggttttaaaacattgtcatgcagcagctgcaacttacatactagaggcaggaaagcaccgagctgacaagtcaactctaaggtacaggatttatttaaatatccatttattttcaaatactaccttaatgatttcaatttcagttttaaaaatggagacagaactttggctttttttttctttcttctagcacttatctagaagactgtaaatttgacagagagcgaatagaactgttttgcacggaatatcaggttacttactttaaaatttttaattaacagtactatttttcttttactttgtttgtaaagatgtttttttttctttctttcttgctttcttttttctctccagaataataagaattccctagaaatcctactgggaaggtaggtactgtataaggtgtcaagctgaggcacttttcacttgcaggtatgaatggagagtgttggtgtgaaacaagatcttcgggatcttgacccaaagaaaaggagccaaagggcatgtcaagcaattgaagttaagctcatgtttttaaagatcgtttattgagatgattttgaaatgctcctttaccattcataatttaaaaataaagtttaacaatggtttaaattcagaatggattaaaatggagttgggggtggaaagtagagccattcttagtaaatataaataactgaaaagttcttctgaggagactatgtacgaagttatcattgcatctttcagtataggcagatctctccctcatataacggatgtttcttggcgcttggaatatcagataaaggtaaagtttaagaaacttctctagcgggggatttagggaacttcttaaaacctagagttaaaagctgttgcgtgtttgttgtgttattttagaccaatcaacttcataggatgtacagacctgcatatttggtgaccttaagtgtacaggtattta

SEQ ID NO: 60159 - DNA, 1013 bp, Homo sapiens
cgccggccccgcccccgcggcgcgccgcccctcccccgcccgcccgcccgcccgccgccccgcacgcccgccgaggctcggggctcgggccgggctccgcgcggagttgcagcggtggccggatgccaagtgtaagtgtaagttgctatggaaaccccgaccgaggcgagttccgaatccggagcgagacggagccccgggcgccgccggatccgcccctcgcatcccggcccccgggcgtccgccgcgctcaggccccggcccaggccgactggaggtgctcctcctgcggccccagcacccggctccggaaatgccagggatgcagggagggcagaattgttttccctgcgcgtcgcgtaaaaacgtgccaggttctgcttgctggaaccgtctaaaacaaccggaaccccggattttcacttgcagattcttgaggaagttttataataaattcggagacctggaacaagccctagtggttggtaaatatccgcggggattgtgtggcgtctgcagcagccttggggctgctgggctggaggacaaatggaagaaagagaccctaatacgctcagctcccagcccccaccccagactttcttctacctacaggaatgatctgagagaccagaagtaatgttagttggatccttttgcatcagtttggtagaactgattccgatctgatgagtaaattccttctgtagaaacgttaggacagcccagctgtacagtgttaaatgagttttataaattcagtgtttcagggtttgtgattactagatgatctccattcttgttctgtgaattatggccattatttctgtgtcttgcaggattttttatcaagcagaaatgcatcgaacaacgagaatcaagatcactgagctaaatccccacctgatgtgtgtgctttgtggagggtacttcattgatgccacaaccataatagaatgtctacattcctgtaagtaccgagctttagctctcttttgtatcatgcgtatttc

SEQ ID NO: 60160 - DNA, 1264 bp, Homo sapiens
ttatatttaaatgacaaaaaatgtacatttacctttgttcttttattacttaataaaaatatttttcactagattgatgtcatgtatgaggaggaacctttaaaggattattatacactaatggatattgcctacatttatacctggagaagggtaagtagcatatctgttgttagattatgatggtaaactatatttaaagaattaagagtaatttttttccttttaactttgtagaatggtccacttccattgaaatacagagttcgacctacttgtaaaagaatgaagatcagtcaccagagagatggactgacaaatgctggagaactggaaagtgactctgggagtgacaaggccaacagcccagcaggaggtattccctccacctcttcttgtttgcctagccccagtactccagtgcagtctcctcatccacagtttcctcacatttccagtactatgaatggaaccagcaacagccccagcggtaaccaccaatcttcttttgccaatagacctcgaaaatcatcagtaaatgggtcatcagcaacttcttctggttgatacctgagactgttaaggaaaaaaattttaaacccctgatttatatagatatcttcatgccattacagctttctagatgctaatacatgtgactatcgtccaatttgctttcttttgtagtgacattaaatttggctataaaagatggactacatgtgatactcctatggacgttaattgaaaagaaagattgttgttataaagaattggtttcttggaaagcaggcaagactttttctctgtgttaggaaagatgggaaatggtttctgtaaccattgtttggatttggaagtactctgcagtggacataagcattgggccatagtttgttaatctcaactaacgcctacattacattctccttgatcgttcttgttattacgctgttttgtgaacctgtagaaaacaagtgctttttatcttgaaattcaaccaacggaaagaatatgcatagaataatgcattctatgtagccatgtcactgtgaataacgatttcttgcatatttagccattttgattcctgtttgatttatacttctctgttgctacgcaaaaccgatcaaagaaaagtgaacttcagttttacaatctgtatgcctaaaagcgggtactaccgtttattttactgacttgtttaaatgattcgcttttgtaagaatcagatggcattatgcttgttgtacaatgccatatt

SEQ ID NO: 60161 - DNA, 1035 bp, Homo sapiens
ctacatgggaggattgcttgaactcaggatgtcgatgctgcagtgagccgtgatcacaccactgcattccagcctcagtgacagaacaagaccctgtctcagaaaaaaaaaaaaaaaaaaaaaaaaaactgcgtagagaatctctggtgacatagtttaattagtaatctcaattcttattcttcccaggttttctttcatatgagtcattataacttctagttttccatacttttaacttgttgatgacaagtttgaaactgtcatttcaaatatttagcgttataggtgcagacaagtcccatttcttagattgtagcttgacatgtaattagtgtgatttgcattagcataatcatgaagatggaactgaaggaaataagttatattctaacaatggaatcactttcatggcaacaagtctcagaacatgcatgtacagatgtcttgaggttttttttaagagcagaacagtgctttaaaaaaaaataaccattgtcaaattctgacagctgctatgacttgttttattctttaattctttcctttttaatggaagggcatctcccattcatggctccagcagtttcgcctcctctaaatgagacagagaaatgtgaacctccctggtggtcgatcttttcacagctgcgctgcaattccagtgtgacatcaaattagtaattatagctgagcgggctgctttttacaaatgacagtcttagcatgctgcctgctagcgagcgactcagcaggggacctggggaagtaaaagaaaacataactggactcacttgatttctgggggatttgacctgactctttaaaaagcccatgttcttgagagagagagtcctggggatttacacaaatatgcattttgttcatcatcctgcacagttcttctcaaaactcatgtctgattttattaggtaaagtaaagtatgtgtaatggagccatagggtcacaataagaagatcccttttaacatacagccttcttcctgaaacccatttgaaagaaaacagctgccc

SEQ ID NO: 60162 - DNA, 1072 bp, Homo sapiens
gagcatttggggcacatatcaggtgctcctggaagtctccctccctcacgccttcctgcctttgccctctccacccctcacctcggggccttggctgcatcttggccctgcttgagtcatgagcaggtcttgtttcccttatctccacattcatcagaatgggttgtctttttttttcttttttcttttttcttttttttcttctcagacgaagtctcgttctatcacctaggctggagtgcagtggcacactctcggctcactgcagcctctacctcctgggttcaggcgattctcctgcctcagcctcccgagtagctgggactacaggcacctgccaccatgcccgtctgatttttatatgtttagtagaggcggggtttcactatgttggccaggccggtctcaatctcctcctgacttcaagtaatccaccctcccctgcctcccaaagtgctgggattacatgcgtgagccaccatgcccggccagaatggagcatcttaaaggcagcaagttcctctgtggttggtatgggagcatcatgtctaagcagtgttatgcccaaagatcccctcccctccaagggtgaggatagggaggagctggaggggaaggaggcagacgtcctctaattgttgtgcacgtgactctgtggagaacaccatttatcagctttatcagtgcatacaaactttgggaagttgagagaattttaagtgtgaattctgtataaatcatcggatgtgattctttactcttattcagtgacagattgatatcactagggttacgattctgctccacccctttcctcaaagttctgtttctcccgtgatgctggagaatgaggatacattgcgtggtacagtttacacgtgcggtaatagtcccagaacagataaactgtgaccatttccgaattctcccccaagttaaccatgtgactgccttgttttttttttaagattaacatccttaaaccgttattttgtggtaccctcttttcctcctttcatgcccgacatatgccttttttcctacttattgtgtaaagttcttcatttgtcgt

SEQ ID NO: 60163 - DNA, 1909 bp, Homo sapiens
gtgtagagaatataatgggaaaggcatgagtgccggtaagtctgtaattataatgtacttaatacgctagactttacgtgctgcatgccagtaaaacacagggtaaacaccattctgtagaccttggttctcatgtgtggtctgcagacccactccagcagcagcatctacttctgaaaatgccccacccctgacctgctggatcagaatctgcattttcacatgatccctgggtgattcagttgcttgttaagtttgagatgcactgactatgcagcttttgattcaccctattggcccatgagaggacgttatactgtcctatctaatgtgcataagaaaacgatctatgaaactgaggctgctggaattctatcctgtgctgaatacagttctcctttactattccccatcccccaaaagttgttttacacgtattgtcagtttgacagagtttaaggtctgttccacttggtctgctccacctggctttcataaacttgattgttcccactttgattttatgcccaaagataatctgcaatcttacagttcctagagttcttgttttatttgaaagaaatacccttttgcaaattagtgattgcaagaaaaaagtaagaccactaacaaagagcaataattgctttttgggggctagcatttaaaaccccacaaggggaaattcactttgattttcttcctttttgttctaagtgggaagtagtataaaggagatcttgttcatgttttaggaaagaaaaatgtaattaagaattaaactcttgttaatgtaggcattttcatcctgaaagtcatttttatcattctcagtctatctaataaattttagttgtcttaagaataactgaacactgccaagtcttgctatttaaagtcattggggattatgtagatttttttttttccttctctcaagttttctaataagctaaggaaagcaaattcagttacttggtggcctggactctgcatctggcaggtgcgcctgcttgccttcagatcaaggtgtgctattgcagaacgtgtgatccaccacagggggtgccagggtggtgaggtgagaatcctggaagatgaagatttgctcatgggccacttttctcttcaggcataggtagggcctgcgtaaacccctgcactgctgcaatggattctacctcaggtggttcagtcctgttgatttcatctagaaaggaaggaaaggataaagagactggaatatactagacagaaaggcactctttcttttgcaaattcatgggcagagctatctatcacctgcccctctgaaggtatctgtgttcccttaacttgacagcatttggccactgaggcctttgaatgcccacttcagagagcaagttaaagagagaaagcatgtttgcctttgaatcccacacaggccatcccgcagggccaggcaaggagtgaaagtcactgctcaggagcagtcggcaaggatggagacgagactttctgggggccaggggtttgctagaccccatggctggacggccattgtcaagaggttggggcaaggaggaggcttcttggaggatgtaagaaagaggagatctgaacggaagagtcacatgggaggagaagggtagacctacctagccagtgtcactagcatgaaccagatcttggagtgaatgatgtcagcagagcccctactcagagcccgtccttgtccaccctccaggagatcagtagttctcaaaaatggtggtagggagtggaggatggaccaaattcaaatcgcctaaggaggagctgttttagaagacactctcccaggctcctgcctcctcctcctggggcacacaggtagcatagtctgcaagttaagtactttactagttgagtagtttactagttgaga

SEQ ID NO: 60164 - DNA, 1061 bp, Homo sapiens
gtttcagaccacaagagccagggaatttttttaatgtctgattgtggttaatcagttttctgttcttcctggagataaactgcataagaaaaggtcacatgtttcagggctcctcctgcaaaatcagagatagtatgaaatgacaggaagagtgttttccagtctgaggaaaatacttggaaaaggcaaaatattcattatctgtaacaagtggttaaagattttcaaagacattcataaaaattgaagaataataatgaagttgtcccatggaagaaatattcttcagattacttttcctcttctttgatactgtaataaccagagggccatttaatgtcagctaataaaggagtcacagagtaactactaagcagacttaaggaattaactctccccacaccgtccttaattgagttttttggttgtctgaatattttctgtacatattctcactcattatttggtactttttttttctttttacttagcatattttaagatacaacctttgcaggaaagaagagagaaaactgtatatttaaacagagtgaattttgtgttaactctgaaaggacagagactggaaggaagataagtcagggcttgaatattccaggaaggctttgaggaggaaggaaataaagtctgaacagccttgaagaatgggtagacgtaggaaaggattcaggaaggtctttagataacaaaagtagagatccagtggctgagatgttgtcgatgttttatttttatcttctaaatgcttttcttggaagatcttatttcttttcacacattgtttttcttttgtttttcccagctctctgcttccagggctaatggtgagttttctgccgtgtaaaatcccaaagggtcgcttgcatgtacttgttgccagtagcctgttttcattgggtcatttactgtggtttaatatgccacttccccagtggacctgatgtgaagaaagtccccacaatcctgtcttctgtgacctttctgaggccttttccttgttacttggaacaaagatgtgatagctgattgggaggagagtg

SEQ ID NO: 60165 - DNA, 1344 bp, Homo sapiens
gtccctgtggctaaatgtttggttgttagtctgcatgaaatagatatgacaccaaattagaaataggagaaagcagcagaagaaaagcaaaggttctgtgtataaccaagacaatggggttaaaaaaacacacacacattgctgaagaaagtaagttaagtaagttgagctttcatttgcaaaatgactttttatttggctgtaatattcctctgggatggctctgtgaattcagtaaaacaaagctaaagaaaaacctattctgtttgagggaccgtataattaaccatagaaatgagtgccatccagtgtattactgaagaaaaaggattaaatagtggtatgaataaaaatagtatccctttttattctctctaggctaaaattataaggactgtcagtcattttgttaagggtctagtttattattggctgtgttgggaatagtgctttctatcttcctattatgtaatagtccacaattacatgaatagtgggatttttattttttttattttttattttttttcctcagaagagcctggtgttgaggggctgcaggagcagaacaggaagttatggttgttttggaattgtgtgtggtgtatgtttaaattgtattagaataatttttattctttttaaactgtctttctggttgtctcatgctactttgagtttaatataccctgggcttgatgcaagaccccgggccagggccagagcacctggttctagttctaggtctacctttgactgttgtggtcattttaattaattcatgcatacatatttattgcattttcctgcactgagtcctgcgcatacaaaaatgaataaaacccagttccttcctgtaaggaatcagtttagttggaggatcacagagataagcataattataagacagcttagagatgtatatggagtattttgtgatgtaagggaaggaacccaaaccatccttggcaggaagtaatgggaaagacttcctggaggaggtgatgcctgaattaggtagaagtcataaccatggggatcaggggctttgtagggcattctggctagaggttatcaaatagcaaggcagatagaccccaagtgtgttcagagcactcacctgtccaggaagtggccctggacagggagacaggaaatgaggctgcaggaatgagagagatcactggatctccgtttccttacctagaagtgaagctctgttaatactagaaggcttctcaggaactcactcattttctggaaagctttcatattgctgcttgttggagaatgacatgttaacctgctgctcacctttttaggacgttgagggctgggtattaa

SEQ ID NO: 60166 - DNA, 1111 bp, Homo sapiens
taggcctcatgttaatacatgaggtctacattagacctctaaacttgttcatcctctgtatctgctattttgtatcttttgacctccatctcttcatttgggcctccctccacctcggctctgataaccattgtttgattaaatgcatacctgacctttttaaaaagagtccacatataaaatcatgcaacatttttctctctgtgcctggcgtatttcacttaacataatgtcctccaggtcacttcgtgttgtggcaaatggcagggtctcaggaagggtttctctttcatctgaggtcgacatttccttcatcctttttttttttttttaatctgacttattcttgcctacttgaattgcagattagtatagtgtcacatagcatgccgcatcatgagcatatcagaatatcacatttaatgtataagaacttaatccagtaaaacaaataaggtctcatttgctatttacgagtgagcatgtatgtgctaagtaactgtggagcaggagacagaatgtgcgcgttcttcagctgcggaatacctctcataacagacggccctaaatgcgcttctggcgtctccagacatgaaaaattcaaatggtctaatttagctgcgtcagcgtgagaaatttaaaatgttgaaatgttacctactttgtaccatactctactttattcctagattaaagaaaaaaatagaggctgggcacggtggctcacacctataatcccattcctttgggagacaaaggtgggaggattgctagaagtcaggagtttgagaccagcctgggcaacaaagcaagacctcgtttctactaaaaaaaaatttttttaactaattagttggtgtatgcctgtggtctcagtactcaggaggctgaggtggaacttaagcccaggagttcaaggctgcattgagctttgattgcaacactgcactccagcttgggcaacagagtaaaaccccatctcttaattaaaaaataaaaatccaataagaagaaaatagagcttgctttcttcaattattgagtgacttctcaacctagtataactaacaggaagaaaagtctttttgatgcctactgatgtcagttttca

SEQ ID NO: 60167 - DNA, 1018 bp, Homo sapiens
tccaccggaggagcagggacactggggacacttggctttgagggaaggacagaggaagaagaaacaggaggagaaaacagaggtcggcacaattagatgttcccaagtgcttgaaagtcatggctgtgcttgtggttgattgcgggtggctgtgaaagcttaaagacttaaggagtgaatgagtggaagtagaggcaattcctcttttttggaaggtaagtagaaggaaggtgaaagatgccattttgttaggaatccctggggagtttccttgaatccgtctcttcgtttccattctcacttctgtcactcctaaccagatttgtttccctctttcctagactgatattaaacccccctagcttatttccctgtgtctgcctttatcctcatttcttttcttttttgtactaggaactcctatggcagtccagtgaaggccatagactcctcagaatgaggcttttaaaggaataaatgaaaatacagaggatatgtcctagcaagttcaaggatccttttaattctatccatggaccacttgggagttcatggaaccccatcaagaacccttgcaagaataagatggggatagtgtggggtgagaaagtggggagagcacgcagcagccaggaagaattcttgggggggaacacgcataggctgaattgattacccgcctgggtcacagtgcctagtacttgggattcacaacggtaccgttaaccactgagctgtgctgcctgggccaagctcaggaatcattcatttctttgagttcttttattttcttagtcttaagagctgttcttcttggatggacagagtattagctgttaacatgggagaaaactacttgaaaaccagtttttcccttcatagaaagaaaatcattgttaatgttcagagcatgtagggagagaaccagtacataatttatttaagaaaaatgttgtagggagttttaaaacagtaacttacctaaagctaagcctcacaattctaaatctttatagtt

SEQ ID NO: 60168 - DNA, 1050 bp, Homo sapiens
tttcagtctactaggtgcacagtgttatactaggatttgtagaatactatataaaagttgtcttactattataaccttccaaatgcagcaacattcagggaattttcaagaccttgactacaggggaaggaaatctatggtgattttaagagactgtgaactaagggtttgttatattgaatgtagctgaactgcattgcagtctattaagccaaagtcgatttgattgaaacataacaacttgcaattaaggtgaaaatgttcaagtccattgaggtggtaatgaaaatcttgatttgggcaatggtcatagtcgggagtaagcctgccattgtgtggttaatttgatatgttactgctttgtaacttaaaatacccatcagtgaatggatcagtgccaatttttaagtattttaagcagagaatataactgaatacataaaggaaaagacttaaggcagttttgtcttgttacatttagaattaaactaaaaatgatcaaacagtaagcgtcttaagatgatattttaatagtgtggggaggatgttgaatgatatgagccaagacttgttttaaatagatactctaaaagatttttatccacagtgaaatgtgagccttttagaaattagtattttaaaacctatttaaatatccaaaggaaaacattatctgtatagaaaaatcttaaagcacataaaacttgtttaaaacatgtagcatttagaagtagctaagtattgatgttagaggcttttggtttaaagctgtagaagttgaaatgagctttggcaaaaatgtcaggtattgaggggtttggggggcctatcacagtagaaggaaaggctggtaatggaaccatgtgaagagctgggtgcttgagtgtgtgggtgtgtgagtgcgtgggacttttctgtaccctttggctcagttctccttcatagctggctggttcctccacagagcagggaatgaacggttcctgtatttcacattttgtcatttctgctcccccaaaagggtttcctgtctctaattcagttataaaa

SEQ ID NO: 60169 - DNA, 1030 bp, Homo sapiens
cccggtccgtggggcgaagagcacttggcggagaggggccccaggggctgggagaggggcggcgatcgctgcgacgcgcccggtggggacgcggcgcggaggcccgacccagaggccgaggcaccccccgccgggagcatcgaggccgccccgagtagtgcggcggagccggtgatcgtctccaggtcggatcccagagacgagaagctggccctatacctggccgaggtggagaagcaggacaagtatctgcggcagaggaataagtaccgattccacatcattccagacggcaactgcctctaccgagctgtcagcaagacggtgtatggggaccagagcctgcaccgggagttgagggagcagacggtgcactacatcgccgaccatctcgaccacttcagccccctgattgagggcgacgtgggggagtttatcatcgctgctgcccaagacggggcatgggccgggtacccggagttgctggccatggggcagatgctgaatgtgaatatccatttaactactggagggaggctggagagtcccacggtgtctaccatgattcattatttgggcccagaggattccctgaggcctagtatttggctcagttggctcagtaacggacactatgatgctgtatttgatcactcctatcctaacccagagtacgacaactggtgcaaacaaactcaagtgcaaaggaaacgcgacgaagaacttgccaaatctatggccatatccttgtctaaaatgtatattgaacaaaatgcatgctcttgaaatgtctcaaaaccttacaccctgggaataattgcatatataacttgtgtttggagaatcacatgaactttaatcagggtaatagcactttcaaacttgctagtagattttactgtaggtgtaatgccttaatcatctttttgaatgttttctcagagctggaggttgctgggcacctaaatgatgtttcatgatagctttgggtgattttactgctatttataatttgctgtataaagtgagc

SEQ ID NO: 60170 - DNA, 1598 bp, Homo sapiens
attttattttaaatgttgttgtaaatggaattgtttgcttaatttgatttttgaattgttcattgctagtatatgaaaacacaattgcttttttttatattggtcttgtgctctgcaaccttgctaaacaaatttatttgttttaatagctttttggtagatttttaaaggattttctctatgcatgatcatgtcatctgtgaatagacagttttatttatttctttctaatctagatgtgtttttctacctccctcccttttttacttccttgcctaattgtcctcgctaggtcctgtaatacaatgttaaacagaagtagcacaggtggacatccttgtcttgttctggatcttagaagtaaaagcacccagtctttcaccattaagtataatgctagctgtaggttttccacaaatacactttatcaggttgaggaagttctctttctcttcctactttgttgagtgtttctatcatgaaatggtattggattttttgaaatgctttttctgtatccattaagatgattatttgatttttattctttattatattaatattacatattaactaatttttgatactaaaccaaccttgcattcttgggataaattctacttgattatgttgtacaatccttttcatatgttgctggacttagtttgttgagaatttttgtctatattcataagagatattggtctgtaattttcttgtgatatttttgtctggtttgagtgtcaggataaaagtgactttctccttctatttttcattcttaacactgctgttcaggcacttttgggacatgtaagatgaagggaagagaaggaagtctagggctgatagtgagttccagtcagcagtatggaagaggggaggaaaaccctaaatagattctatagtgggccaaagattcttggctgccacatggacaccaggcggggacctgttattgggtatatcctatgtaaagaatgtgtcctgttctgttctttttatacacatattcattcagaatatttattgatcaccagctgctatctaataagaagtaaacttattaccaaaaagtttaaatagacctgactcctgtcctatgagaacatataggttaaaggggtaggaagacacaatagaataattacaaactaaatgtaaaattacagctatgatttgtatgatgaagggaagattcctggtgctgtgagagcatataatataggggtttggtctggtgttctggcggtgggaataacataccccaaggccctgctttaggaagaagtgaaggaaggccagtgctgggggaacacagagagcaggaggaagggaaataatgggaaggagaaagtaaaaagaaccaggctacctgcggcctggaagtctggtgataggcccatgtcattatcctcagagcagtgtgttttcacttttaaaatgtctgtttctgaagaactgggggccattgcctaaatgaaataacccagaaacagaaagtcaaatactacacttataagtgggagcgaaacaatggccacatacagggtggaatagtagacactggaggctccaaaaggtgagaaaatgggagg

SEQ ID NO: 60171 - DNA, 1050 bp, Homo sapiens
agtggcaggtgtgggacggggccttctgttaccttatgcagactgcactttttctaggccgaggagtccctgagctgcattacaattcaggccagtgtaatttctggctttaccatcacatagtttaaaattttccattaatcctttggtgtgttctaatcaaataatgctgttctcagttaaacagttgaagaagctcccattctggcaggtattatactctttaacacagttgctctgttgtcaccaaggacacttctgcatctgatattgatttaaatcttcagttatgaaggtcttgaagatgactttgtagataatgaagattgtattggctcaagaaactgtaacaatggaaagaatatagtgcatacttgttcatccaatctgagaaacagagtagccttattgataagcaatttacaaagcattttgttctatgctgatacaaagttgaaacatagtgggtgttctatttggtgtcaagtgttgaaagtatttttggaaaattcattatattttggagacagttcaagttgtgttgaacttttactcaaataaagatttatatagctgtgccttgattttgaaaaatttgttttatcaaaatctgaattgcagaatagatacatcagaaacaaatgccattacaaaataatctccaggtagctcatcaaatacctatggaatgggtacaatgagtatagggaaccgggtcaccatctatccttcttattctctagggtctgatcaataaagcaaaccaatgaagcaagattgctagccagatagaaaatgaaaagagtgattttgctttgtagagtcctctgtgcacatccttgtaaaatctatattaaaatatttgctttaggcttcatcaaaagtgagactattgactcttactctttatctagatgtgagcaccacaagctcagatgtgcatacagaaggagtgaggcaccagatcttctgggccatccccaataccgtgtgcttgaatatggatgaggctggcaggttggttccagaaagaagacattataggtggaa

SEQ ID NO: 60172 - DNA, 1649 bp, Homo sapiens
aaatttgggaggttcaacaggttgctgttttttaatatgtggatcacccgatttgggaggctcactctgcctctgagattaaagagatgagggcactggctcccagcgaaggctctcggccttaatcatgtgtgaaatgttttccttcctcggctgcagagcctcggtggtttgcagcagtggaaccaggcaggcccagttgtgggtaggagaggccgtcacctgttgaggcctcccccccacacccccgcatcgccctgccctggcagagcccagcccccagtccccggagagcgcgcctgaggacggacggacggacggacggacagacctagggacggagggccaggggcaggggagatccaagaggccccgcgctggaatgcagttttctcgggcgagggagactttgcaccggagtggaaaatagtttggggtggggtttcgcaccgtcccctcctccccagccccgggccccctcccaggcgctttctgggagcttttagaactgcgctctgaagtttccagagagcgaggagcttttgcggcaggcagagacaatggaagaaaatgaaagccagaaatgtgagccgtgccttccttactcagcagacagaagacagatgcagggtaagtaacagacccattcaaagatggagttacagggacgcgtgccccttgccgcttgctgctttttataaactgcagctctgggacccggcaaaggaaaaaaaaaaaaaaggcaatttcttgggatggtacattttccaaactgagtagagcatagagaactgtgatttcttaggcttgactttatctctggcacgattttcttaagcagcaaaagaggtggtggggtgatgtcacatttgtagtgcagtgagccatcagcatgagctgtatctctaagcaatgacaaataaatcactaagcagcttttaatcatttccccccggggctccagccacgggagaaaggagctgtttttgtgaaactgtctctaggaccgcagcttccattcattggttgggggattccatgtggcagatgcatgctggctgcaaagtttgtgcagaattttagagttaaatcacagaaaccaggcatgttttattttacagatccgagcagcaggggagggcttgagcatctgggtgatagatagaactctggatcttcttttatgttttaattcaaaacttgggagttgttggacaattttggtaaattttctccaggcagtttccctttaattgtgtttataatagacttgtcttttccgtagggaatttccagaagcttatgttgttccaaagaaatttcgcaccgggttgggtggccagaggaggtccctgctctctggcatctgatgcctgtgatgccaagagctgattctgtgggatcctataggcagcatgttcataaaccacacagccctggaccacccgccccaccctccctcaggttcatgcaggggccagtacacaacaaaaagacgtgcgggagtgcagtgctgtgcgtgggagtagggattatgcacaggggaaaaggtgtgtgttttatgaaaatgtgaaagggaagtaacacatgactcatccacgctgaaaatgcaaagctaagccagtcaggagaacttacaatgacaagag

SEQ ID NO: 60173 - DNA, 1116 bp, Homo sapiens
tgccctgggctctgcagaggctgggaggggcaggaaagggaaacaggactgcctttcagcaagcccaagccttgccttcatgctacagcttcattattttgtttgacaaggattcccagaatagcgaacagctagacacacccatatttaaatgttaacaccaaagcgcattccaaacaagaaatcgaattgtatttctgttttgatgacttggataatccacacttgagcttttctctattcatgtggataatgaggagttggccaggctcagatctctgacaacatggctgtggaattgtgactaaatgtcctctgcctgatccctctctagtttgtaatcattcttagtttttctccactgaaaagaccacattctccttaaatggctggaatggcagagttgttgcttctcccccaggtgtggggcttgacgcttccaagagctgagccttgtcgaggaaaaggctcaagtgacagatgtgctgaagtgcctttgtgtggaaagtggcgttaggtggctctgagtgctggtgacaggagagcaggtgcctcgaggtaggaggggaggcagacaggatgatagagcattgggcattgggtggaaggcacaaggcaggaaattgagacaaaaggaaggagtgagctccaaaggcaatccgatgtttgccaagtggctgcattgagccttctagccttgctagtggttgatgctttttgtacctttcctctaaatcgcatcaatccttgttaagcaactggagatattttggaaaaatccacaagaaagagaaaaaacagaaaagcaacatgaggtgaaaagtgctaggaaaaaaacaggggtctgatgagtctagtccagtaagtcagggctgctcaaagattaatgtggactgaagattggctctgacccccaaaactctccccttccatctcccttcccaactcatttcaaagaagaaagagggtttattgtcccggctgtcttgaactctcttgatgctctttggatgaaacagaatagatcatatgagcctgtgcagcatagtaaggcaggatgcgactttctgccgttattgccgttggacatgcatggatgtttatctgtatggctgt

SEQ ID NO: 60174 - DNA, 3009 bp, Homo sapiens
gtcttcccgcaatatcccaaggagacacaccctaggggggccccgaagttccaaggaaatactgggaatgcaaacatctgagatggatcggaagagagaagcgttcctagaacatctgaagcagaagtacccccaccacgcctctgcaatcatgggtcaccaagagaggctgagagaccaggtacgaatatgctctcatttctccttgtgtagctcgctctctaatgaacatcgaggaaagcaaacttactttctttgtaaaaggtaaaggatagcttagtggactgtgcatactatttagttgttctggatttctttggggccttgggaggaggaagccgggtgtagaaaacttctgcctgcaagctcagtcttctttgccaatacagcaagagaacaggaggccaggccagagaggaagggcctagagagtatgcagttccccaaaagagtgttcccatgttcaaccacaaacacatctaaacacatctaaagtgcagggaatgaaggggtattatctactgaggaaagcatggcaccaactaccgtgtaccctgaaagcacggagtgcttagcactgtgaatgaatgaagtaatgaatgaatgaatacacaaatacataaatgtattttcagggtaaaatagatcttacagatacagacttgtggtaactccttttccttaaaaagctgacattagggttttgtttctgctcttcttttttttttttttttttttttttttgagatggagtcttgctctgtcgcccaggctagagtgcagtggtgcgatcttggttcactgcaagctctgcctcccgggttcacaccattctcctgcctcagcctcctgagtagctgggactacaggcactggccaccatgcccggctaattttttgtatttttagtagagacggtgtttcatcgtgttacccaggatggtctcgatctcctgatctcgtgatccgcccacctcagcctcccaaagtgctgggattacaggcgtaagccactgcaccccggcctttttttttttttttttttttttggagatgggttattgctgtattacccaggctggagtgcagtagtgccatcatagctcactgcagcctagaaatcctgcactcaagatcctctcatctcagcctcctgactagctaggactacagacatgcagcaccatgcctggctcattttttatttttggtagtagagacggggtctttctctattgaccaggttggtcttgaactcctggcctcaagtgatcctcctgcttctgtctcccaaagtactagaattacaggcatgaaccactgtgcctggcatttttttcttttgaatcacagatgtgctccttctgcatgcgttgctttgtgctagctttctgtcttcacctacctgtttcctctggttattttgacagtcatatagacattacccaactgtggctagggatgtttttgtttcttggctgtgtgcaattacttttagcagatagagcaagtttggggtcacaggagatttgaggcctcctctaccgacctcactggcgagttaccagattgacctttgtgtatggagaatgtagggaaggaagcagaaagcacttaaccatatatgtgacgggtgggggtgggaaggagggcaggatgatattgatttccacacaagggaggaaagctcagtgttttaagtctgctgtcttcccagttaggtgcaaaaattatgtctaactcactcagcctttgattatccatggaaatggagattggcatcagcccgaataattgaaatctatactttattctcaatctcatattcttccttaaattcaatcttctcttctagagaatcattatctgagtggctaaaaatgtgaaacgtgctttatggacttcatgtttgctttttgttcacacttccaacagtcagtaaacccagaagaggagaaaagaaaaagaatcctggttgctataaggatgggctaatgattaattctttgataattttaaaaagactctgggcacagtggttcatgcctgtaatcccaacactttgggaagccaaggctagaggatcagttgaggccaggagcttgagaccagctgggtaacatagcgagaccccatctcaacaaaaaaatttaaaaaaattaactgggtgtggtggcacacacctgtagtcccagcttctcaggagactgaggtgggaagatcactgaagccccaaaatgagaccccgtctctaaaacaaaagtatcaattttgctgagaaatatagaaattggcctgtcaaaaatggtatatttttccatgtcaaaaataatgattattgttactcttcttatttgtagtgttataattattgttattgctgtaataatggtggctttggttaaaacaattacaagggaagcctaattataattaaggttgaaaggagtaatgaatatattttggtgttctcaagctctgatctgctgttacatacattgctagttctgccatggctggccagctgtcccttctctgataatgagggatgaacaagtcacattctatctttctgcctcttttgtactcgaagctgaccatccaaaaggagagagtttttaatgcatgaatctatgtatacatttttattctcttattaacaggaaaggggtcctgatccagaccccaagagagggttcttgggtctcgcacaagaaagaattcagggtgagttcataaagtgaaagcaagaattttgtttgtttgtttttgtttttgttttttgagatggagtctcgctctgttgcccaggctggagtacagtggcgcaatcttggctcactgcaacctccactcacttcaacctccacctctcaggttcaagtaattctcttgcctcagccccccagtagctgagattacaagtatgcaccaccacacccagctaatttttgtagttttagtagagacggtgttttaccatgttggccaggctggtctcgaactcct

SEQ ID NO: 60175 - DNA, 1049 bp, Homo sapiens
attagcaaagtaaagaaataaaagaatggctactccatagagcagccctgagggctgctggttgcccatttttatggttatttcttgatgatatgctaaacaaggggtggattattcatgcctcccctttttagaccatataggataatttcctgacgttgccatggcatttgtaaactgtcatggcagtggtgggagtgtagcagtgaggaccaccagaggtcactcttgtggccatgttggtttggtaggttttggctggtgtctttactgtgacctgttttatcagtagggtctttatgatctgtatcttgtgatgacctcctatctcaccctgtgacttagaatgtcttaaccgtctgggaatgcagcccagtaggtctcagcctcattttacctagctcctatttaagatggagttgctctggttcaaacgcccctaacactgtcattgcccttctgcaagcaaaccccaaccagcattgtaaacaccagagatcggtgtagacatggcctatgaaattgctgcagacatcatctcatcttctgtcttttccactctttttctcctaccacccatttcctctttcctgtcttcctctctgcaatgccatttgttcctcctggaccttctcagtatggactatcccaggcttcctttgcaggaagattacacagccagctgtgagaaggaagtcagataacacacatctgatgctctcctccagatactgaggctcttaataccagatgctcttctggcagctgtttttctggcttcctctcagagaagtatccttgataagaagagagccaatcagcaagatagagaataagatgttgaaagtgatgtatctgccgtctaacatgaaatctcttaaaatctaggttcttttttttttttttttttggaagacagggtcttgctctgttgcccaggctagagtgcagtggcatgatcatggctcactgcagcctcaacctccgcggctcaagcaatcctcccaccccagcacccaccacccaccccgcccacccccagataactg

SEQ ID NO: 60176 - DNA, 1825 bp, Homo sapiens
gggggatgaaacagaaagatgttctgaaatgctaaggaaaagaaagactggactggggaccagtctgcctcgtgtcagtaagtgtgaatgagatttaacgctcatcctgcaatggatgaagtgccagcgtcctggttggatttgcctttaataatttgaagaagaaaaggagtttggcactgaagaagcagtagtgtgcctgcctgtagtcccagctacttgggaggctgagctggggggatcatccatgcccagaggtcaaggctgctgtgagctgagcagtgatcgtaccactgcactccagcctgggtaacggagtgcgactctgtctcaaaaataaataagtaaataataaagaagcagttgcatacatagtggtgagtacgcagaaagtgaaaactgagaaaaaaccattttcagagcaagcactgcacgtgaaaggagtatggtgtcataacagaatcacaagtcatagctggagaatttacaatattgtatgtgcgagtgtatatttaatggaatactggaggcccgtgagcaaagaatatgataggatcgaatcagtagaaaaacatctcttgtcctcagagaaattccagataatgttagatatgtctaaggaaaatcaggatgtggtcaatgatcaggaacaatagtcatttacatttggatatgatgaaaaacaaaagtaaaaaagaaaaaaaatgaacagaaagaagagcctaagatctaagagagatgatgttcctcaagggatgagatgaaggagctagcttggatgtgatacctggaggactgatttatttttcactcttgggtttttttttttttttgagatggagtccggctctctcacccaggctggagtgcagtggcatgatctcggctcactgcaacctccacctccggggttcagccttctgcctcagcctcccatatagctgggactacaggcatgtgccaccacgcctgagtaatctttgtattcttagtagagatggggtttcaccacgttggccagggtggtctcaaactcctgacctcaagcaaattcacctgccctggattcccaaagtgttgggattacaggcgtgagccactgcacgtggccgaggactgacactttgagttgtgactcaaaggtcgttgaagtacatctcagaagatttggaccattacatagtaggacatcttgcggcagagactgaacaattgaaaagactaaattcaggggttgtagttttacttgcaaaattgacgtacagttgacgttaatcacccagaatgcagaaaaacagcaaaggaatcctaaatggggatcattcataacacatcgcttttgatccatgtttaattgggtgccaccaacctcagcattagctttcattttaattagtgacatggaagagcaagagaacatatcttgagaacagtgctatattaaggaaagctctgcaagaaatcaaaataagattctactagaaaacctgctaaggagtgcccgggggtaggtggggaagtatggaaaggcaagaaccgaagtctagctaggcagtgtcaggagacacctggaaagtggtagtcagctagaggaaattgccacaaaattagatggaaattttcagtgttgagggatctaaaaaagaccaatgtgattcagtccagtgcatagatgcagaactcatactgcaaatgtccaaattgtccttcctgtcttttcttgtcaaacttgagcctttgccatttattcattcttcctgcagttatgttcttggattaattcattcaaatgcttatttatttattagggatctacatttcgagg

SEQ ID NO: 60177 - DNA, 1692 bp, Homo sapiens
tagctatgtactgcaaatattctaaaatccaaaaaaaaaaaaaaatctgaaacctgaaacacctctggtcccaagcattttggataacagttactcaacctgtaatgagcgtgtttattagaaactacatacatatatatcggccgggtgcggtggctcatgcctgtaatcccaacactttgggaggctaaggcaggcggatcacctgaggtcaggagttcgagaccagcctggccaatatggtgaaaccctgtctctactaaaaatgcaaaagttagctgggtgtggtgacgcatgcatatagtcccagctactcagagctgaggcagaattgcttgaacccaggaggcagaggttgcagtgagccgagatcatgccgctgcactccagcctgggtgacagagcaaaactgtctcaaaaaaaaaaaaaaaaaaaaaaagaaactacatacaaaaaacttggctttgctttttcagcctaattcgttaagtctgtttttaatgggaaattccgtccactagcatttagtgtaacaactgatggacttaattatattcctccatcttaatttgacagcaagtactgtatgtctattcttcttctctcttaaatgtggctcatgctatttaaatgcgaaacaatggcttgagtttaggtcttgacaagctgtatctgaaatgacagtggttgctccaagtgaaaatgactgttagacaattggagataaaataggactggaccctatgccaggaaacaagactagacagatacatgttggagggatcagctctattagtcacagttcttcagaatatcagagccaatagcagaattcctttttctttgggggacctcagtctttgcttctaaggtcttcaactgattaaatgaggtctactcacattatggtgggccatctgccttactccaagtctactgatttaaatgctaatcacacctaaaaaatacctttacagcaacatctacactggtgtttgaccgaacaactgggcaccataacctggccaagttgaaacatgaaattaaccatccccctctgcaccaacagttgacagaatgtgaatggataatttctaaaaacaagtaacaactacaatcaaacacagagccaaagatcaagggtttagcattagagaattaccacagttggggtccatgtttcattaaagaatccaagcattcttatcttttggtgatacttgtagtgtggtcttgacttacgaaatgtatatgtgttgttttctacctttttcatgtttgacagtttttctttagaccagaacttcggattgcagctatttcttaagagttgctatttcattagccttatcaacatcctagagatctgtttgccctggggttttgagggctaagccctgagttgtaatgcattaactctgttctgtgcagtccttctaggactaaatacagcctgcagctaaatacatactgcttctccaaggctgctgctgtgctgatgtttctgtctgaactaccccagactccagtaccgtctgttaactccgtatctcggaggatctgcagaaggtccgcgttgaccctttgcaatccagtatgcactttcaggctcatctactaaataaatcctttcagcatggcttcgtttagttaggctcttagtatcccaattatgagcaattttattaaact

SEQ ID NO: 60178 - DNA, 1840 bp, Homo sapiens
tttattgagctctgatttgattagtatgatgctaaggttgccatcaggcaaatcacaatgtcattaaggcttagtgagatgtttttctcattcagggatggtaggaaaaatcgtcactggactggccacctctaatcaactcttggcatttctgcccagccttcgtgtgttgtccttattgctgggatccttgttgccaaacactttcccagctctaagttgttcaagatctctctgtcttgatcataataatgtcaatgctggttacaaatttttctcttgggtttacctctgcctgtccactgaggaaacggttaatggagttgctttcccatctgaattctttctggactctctccatttgcctttacattctgactcttctcgctctcttttccaagcctgaattcaataagcaaaagctgagatactgtaatttcctaaataacccaaagggaagatctggcataatttataaccactctgactgctgaatcaacttgcacttgctcttctctctaatggaactttgaagaataactgtaattgaatagtgcctccaccccatcttcagatttgactgaatcaagcctagatctggttatatctggtttttgtttgtttcatgttgtgtttgtgccccactgagtataaagcccaagtgtgggcttcatctggatgtattttcatctcacagagacattaattgaatctctgacaatagtcttgcctccgaggagtgctccaactctggctgcggtattaaaccaaggtagttcttggttgccttcaaaggtaacctcccatctgttgacagtgaactacggcaatgcaacgcttacagaatcattggaggagaggatccaaagcgtttacaattccctgctatgcaaagagtcattctgagtttttttaacctatgattgctctctgtaaatacctgggtgcacccagcaaggtgtagaggttaatgtttgctctctgacctttgaagacagatgcactgaatatgttgcagtttgcaatgggatccgtggcaagttaacagcagactgctccttcagctactgctgtttccaaaactctgcagtgtcacatcttgctcgcggctgcctcctcagaagtgcttctcagcttccattcagctccctgctgagttcctctgaagaactttgtactgtggcatatgacagcgacctgataacattatgataaactcctatgggtttgaactcagtcctattcaaattttctggtgcctagtggtcagcagtcttagacctggggagtaagaggtgtgtctgcagtgaatttagaggtgagaagaaagagggctggactcagatattgagtatcttagagcctacggaccatttcccaaagcctagaatagatttcagcgtaattctggtaatttacataaactaggatagacatgcaaaatatctggatatgttaggaaggagttaaaaagttctccacaccttttcctaccacctctgcagccatagaagccgaggggaaatgcacacacacacacacatacacactctggcagggaacctgttttgcaagttttgctggtaaaaagttctaggaagggggctggtggagaacagagtggaaaagaagtatcaattgaaggtttttcaagacctgagttttcaaggtaactttatcctgcagagagagacacgcatggccgctgtaggtttttcttccaccaattaagtgcattgttagacagggaggggcagattaacgaacgcctataattttgatcattgttttttgcaaaacagctcaggctttgaaaatgaagccatcgttcccggctaag

SEQ ID NO: 60179 - DNA, 1801 bp, Homo sapiens
tacaagtaggttttatgcaaatgacgagagtttcactgggaaaaactgcaaaagaaaacagcccagacatggaggggggttttacctgacagctccgaaggaagaccctggagtccgttccagacaaaaacttccagaagaattagattttctgctttaactgccgcctcacctgtggagctctgggtacaggtaaatatgcggggtttttttcttccaagtttttgccaaaaattatttggaaacatttcgctctgtttctcggcattgttctcttggcaggaagaagtgaatcaataagcccagctttcccatagcaatgttcgtgctaaagggctgtttttaagggcttttttttttttttttattgaatgaactgagatttttgaatagagctgaaaacaagcgatgcattgtgcgttctgctgattgtgcccggtgaatactgctataaaagtgccacagataagggttagatggacaatctgaaaattgagatgctccatgtatttcttatttattcccagatgtgtgtgtgtgtgtgtgtgtgtttgtgtgtgtgtgtgtgtgtgttcttttactcttacgacaaacctgaaattgagactatgggtagttttgtattttcacattgtaaaaatgccaaaaataaaatccatggaatgttgcagaaataatctttgaatcaggtttatgaacattgcacttttttaaaagtatgtatctgatgcttttctcaccgaggcatttttcccagactagaaaaaaacagtcctgatagagacatccagtttttgagcttttagggaagcaggatttctaaattccaagaagatagataaagacttcttggaggaaggtggggtgtgggtgataaaggtagtttttaaagcatggtttaaaagaaaatactggtcacttgggagtatgagggttttttttgtttgcttcggctgccagtgaggataagtaaacagtcttgccagccatttggatgtgatagcaatcactggatgcggctgtggatctgtgagttagctgaaaggggttagttcagaggcatcagttgccctgtgagtagttagttccaccaagcttaaaaagaacacaaagaaagcctattgtttcttccacacagtgcatggcagcgtgtgaggttaaagcggagttcagaatcatcgaaagatacctgtgaaatgggaatttggacttttgaaactaaaactacttaggaataagtggataggctttcaaaatgttttaagaactgcctcatgtgtgagaatgagacctcctgaaattttgcagttagataatgtggattaatgccagaactcacattcatattaaattgttaccacagttattgcaaaacagtgagtgacaaagaactgtgcctccaacatcggaagttctgggcgttgagttctggcttcaccacttagtggctgtataactagaggaaagtaaattcatgtccttaggcctcagtcatcatgtccataaaatgggatgccagtagctagctgtgttgtgaggattaaataacaaaacagacgtagcacagttctaagcattcatgttccaaatgttaatgattgtttttattgactgctgaaatggcattggatatttagaaagtgtttttatattctttacttcctcttatcattacaagtaatgactagcagtcaagtaaggctagtagtctttttttttttaaaaaaaaaagacagggtctcactctgccacctaggctgaagtgcagtggcgcgatcttggctcactgcaacctctgcct

SEQ ID NO: 60180 - DNA, 1158 bp, Homo sapiens
ctcccagcagcagcaatgattctgtaaagtaattaaaatacaaaatgttaagtatgccaaaggagccagggtatttatatttttatattaattatgcttttgccacttttttctagacaggctacagaagtgatattaatttactttttactggtacctactgataggagctccagtactgcacagacttaaaattttaaattctacctgcctgaaatttttcttggccatacaagtagagtcggattttaatgttacaggtattttcggagtgagaacccaagtcaccaaggggctgtggttgctacagggtgcagaaggagcctaggagtcgaatatactgtcctttattccttctgtattctagacgttggcacttcctcccttgcctctatcccagacagaaacacagcccataattatatcctacatccattgtatgtaagagacaaatatgtttttcattgtgctatttttagccacagtgtttctagctggggaaaacactctcttcattccagggttttcttaacaatttttccagtttttccatgtcagactattcagaattattcaggttccacactcctgggagaaggctcttaatgaagtattgagtaggctcatcgagggggattctagagggattttggcatctgagctgctgagcctgaactcattctatgacagatgatgtctgtggtcccatgaattaggctgcattgaggactctcattcccagcactgtttgggggcactgggaaaaggttgagttaccttatcccaagggtagatctataaggagaaaagcaaatatttatttatttgttttaaatttctgcttttatttttagatataggaggtacatgtataggattgttgcatgggtatactggatccagataatgagcatagtacccaataggtagttttttaacccacatcccacctccatccccactctagtagtccccagtgtattttgttcccatgtttacatccatgtgtgctccatgtttagcccccacttgtaagtgagaacatgtggtattgggttttctatttctgcattaatttgctaggaaaatggtattcagctccatccatgttgctgccaaagaaatgatttcattcttttttatggctttatagaattc

SEQ ID NO: 60181 - DNA, 1080 bp, Homo sapiens
tgaacatcataacccataggtaatttttcaaccctcacccccttcccaccctccctccttttgcagtccccagggtccattatttccatctttatgttcatatataccaattgtttaactcccgcttaataagtgagaatatgcagtatttgttttttttgtttctgagctagttcacttaggataatggcctccagctccaaccatgttactacaaaagacgtgtttcattcttttttatggctgtgtagaatattcacatatatacaggaatatatatatatatatacacatctatgaatgtgtagaatattcatatgtatgaatacatacgaatgaatatatatgtgtgtttgtgtgtatatataggactatatatacacatctatgaatgtatacaatattcatatatatgaatatataagaatgaatatatatgagtttgtgtatgtatatatacatatagatcctgttttagaagcccagtgaagctttttattacacttaattgtcgtagcgttcagagattatctttgatcaataagtagcgatcgcattgagcagagcactttacacctagtgggttttagcaaaggcttgtaaatcagatgggctgcgtgcagtgactgaagaagtctcctgcctggattcggatcctgccttcattacttgctcgtagcacaggctttccactgaagagcatatgaagttttgttcatattccaaataaaatagagcatctgaatttccaatgcctcttgataaaggaattagtggtctttaagtattacattattctctttgaatgtcatttttggaattttcacagaaatgatttcttcagaaagaaaggcactgaaaatttaactggaagttcctctcggctggctaccggggaggtagagagcagagagttctcctgggtgggagggatttctagaagctctttacagctgaggcccttttcatcgctatttattaatttgacttgatcagaagcaatccagttttgaaggtgtagtttctaaaatctctttatttcaaagaaagtcatcctgaagaatggtgtcatcccagatg

SEQ ID NO: 60182 - DNA, 1952 bp, Homo sapiens
gtccgcttattgcaacctccgcctcccggattcaagtgattctcctgcctcagcctcccgagtagctgagattataggcatgtgctaccatgccctgctaatttttctaattttagtagagacagggttttgccgtgttacccaggctgatctcgaactcccggcctcaagtgatccgcctgcctcatcctctcaaagtgctgggatgacagacatgagccagtgcttccggccagcttatcctaacggcaggaagctttgatacttttacttcctgaccacagacttagtaggcagcaggaacagtcttcaacttcctggttgtataattacaagagccaatgtgaaatattatgcatttggagaagcccttctctagagctcttatagaaaaggaatgtacagccaagtttatgggaagcatgaggatggtgagtccaaagtcaaggtaggtgatagcattggtggccccttgcagcaccgggagtctatatggcggtctaacttcgcaccccctatttgtcacttcatagcactcttcactttcactccgtttcacttgctcatgattaagcaacaaacgtggtaatggtgtttcctactctgagtttcactagatttagtaaacgcacatgatcatgctggtcccgtcgaagtgacgataggagtcctcggagctgtggtctccgccctggctggttgcacctgctctgtgctctgctcagatcatacaagatggagagagcagagaccccatcagagagaggcttctgttggctgcagtgtgacactgtagacttgccagaaagggctctctttggacctactacttgccactcagaagcaaatgggctgcagcctcatacgtttttggagtgaataagagaactaagattctgatggacccttggtgattttctctcttcaatattatgaatgttcatgaatgcccctcagaaggtcacagggatgtcagatctcattttctccccttccccttccccttccttttcctttccgagacaaggtctctctttatcactcaggctggagtgtagtggtacaatcatgtctcactgcagcctcaacctcccgggctcaagcaatcctcctgcctctgtctcccaagtagctgggactgcaggcatgtaccatcacaccaactaattttttttttttttcttttaggtagagccagggtctcactttgttacttaggctggtctcagactcctgggctcaaacaatcctcccactttagtctccccaaaagtttagatcaaaggtgtcaaccactgcacctggccaggtctcattttcatagcagtcactggtagtaaggtaaatgtgctgcagataatcgtttggcctgtgttttggagggacctttttgttttttaattgtctctttgaattttgcacaaagaagggttgcacgggctccgttcatctttaacttattatttgcatccttttttatgataagttttaagactactgaagaaagcagctccggtaaagagcctcacaaaggccaattttcaatttctcccttgtgggctgtgtgtgtgtttatgacggtcagaagaagacagactctcatttaaaactattctctcttcaaagcaattataaagtggccccatcatagataaacttgaccccttttaattgctggttagattgcttcttttttctctccctgttgtgaacaggactgcagtgaccatccttgtatctgtgcatgtgggaacgaatctgaaggacaaatttctagaatgtcaagttggattgctagttttggaaggtattgcccaaactttttctcaaaaacactcagtttattctgtcgatatgaatgttgcaggggatattatggtacgttcagagaatacagttcactacagtgatgccaatgtgtgaaatacacttgacatgtgggtaggaacaca

SEQ ID NO: 60183 - DNA, 1666 bp, Homo sapiens
ctttagacataatttcaaacactagctcctgtttaattcagatgcacagaatgcattaaaaccacgagtgtagtggacgtgatttatacattctcttagcacaaatcagtacctatcttcactgtaattagacttttcttcctttctccttctcaaaagctacttttgaaaccttatgttttccctggacatattttctgtacttcataaaatagctcagttctgcaactaactgcaaatatttgcaaaagggaacaaatgtaaaataaacgtcccctaatgcagtgtttggtgaagaaacatatgtctgacattagttggttaacctgaaaaatagtaagaaacaactctacttaggggaaagggggtagaattgagcccgtactgtgcaaatcaagagaaagctataatttacgcaatttttattaaagagaatacaagtgctgtaggcttggggtggtgctaggtcatatttaagcctaattgagctttttctatatcattagaaaaatgggccaagtttcctatattatagggtaaatacaacattttcttcctgcaaatattaaataccactggctttttaagacgtaaacatccaaatctcaaatgtctttattcatgccaatgcaatacaataaaaatattccccatatacacttaaatcactgcaagtaagccttagaatccccacaagtattattacttactatatctcagaaactttcacacacattatttcaaatatagttctcccaaaaaaaccctgcggagagatacctgtaaaccaaggctgagactagcctagacagttcgttctttagacaacaggagtggagatttgaacccagctattgtgactcaagcaagcctagggcatgtttctgagatctctaaggtgtgcgctgtgaaaccggtggctcattttatgggttggatttccaaacacgactatcacaatcatgccaggaatcaatgactgacttcttgcctccgtggcctgaagttctcctctgcacctcctacctttttgccatttcagtgatgcaccaaagggtggagttgaagaacatcagttttgctgctgcttgttggcaatactctcaaaaaggcgtggggagggagaggtgtaactcacccctgaagtcaagcctggagattacttgtcaggaatgtcaaaagcatttgttaagcaaccttcttcctggcattttaagaagaaagccgcatacatagatcaaatcccttccttcagaaacctgtactctctgaacagagccttggaattcagcctagagaaagaatacttggtggttcatagaacttggttcacaaaagagtgcttgctgcccacgcattttgcacaatgactcccaaacacacagaatgcacattggcaacaattttacgcgtgtttccaaaagtgctgactggaattgaagggacacatttggcactttttttttttgaaatggggtctctctctgtcacccaggctggagtgcagtggcgcaatctcggctcactgcaacctccacctcccaggttcaagcgattctcctgcttcagcctctggagtaactgggactacatgtgcctgccaccacgccttgctaattttttttttttttgtattgttaatagagacggagtttcgccatgatgg

SEQ ID NO: 60184 - DNA, 1383 bp, Homo sapiens
cttgattgtttgtttaccagttctcaacatcttcagtgtccacttggttactaaaatgtttactccttagcccagtgtgtaggcatgtgcctgtaatcccagctactcaggaggctgaggcagaagaatctcttgaacctgggaggtagagattgaagtgagccaagattgtgccactgcaatccagcctgggcaacacagcgggactctgtctccaaagaaaaaaaaaaaagaaaaggaaagaaaaaattatccaggcatagtggtactcacctgtagtcccagctgctcgggaggttgaagcgggaggatcacctgagcccaggaggttgaggctgcagtgagccatgatcaggccactgcactccagcctgggtgacagagtgagactctgtctcaaaaagaatataaaaataataaaaataaaataaaatgtttcctcttgatcacaaaaaaaaggatatagttctatgcaatcatgtctgaaacaggatacgtgtgtcatgcatccctgagttcgggttacctcaatgacatgaccatttacctaatctttgctttttcatctgctctcaattgaaaagaaagaaaccattaattatattgaaagatgctgacttgtaagcttctcccctctcctggctcaggtcagttgctcagaatgcacccagcaaagattggctgaacaaagacagggagatgttgtgagtcccactgatgcccttaacaccgggcattgttcaacttggggtcatttgtgaaaatgatgggaatgcaacttcctcactttacagatgagaaaacagcctcagagaaatgctgggatatgggatatgagttggtctcatagcctgtgagtgccagagccagctcgaatccaagtttctgactcacagtgactcttatccagcaggacgtattcttcagaggccatgtgttgaaaacagttaggtgggttgggggctgcaggccataccattaggaaatggggggcatgtcctctgggtggttcctaagcatttggatgttacagccctgcctttctttattctgttgttctagaagctccaacctggtatgcttttaaggcagatatggccacaaatgaagcacattcacatgactgcactgcctttctggatgaaacaatttgaccaaacactggtgttgagacagttggtgatttgggctttgccacgtggtgggaatgacacaataaatatattttgatatgaattaggtaaagatctgtctctaaccttgggctatatgtgaacattaactgcccattggatactggggaactataaatgtctccgtccaactctgttcaactctaatttttttttttttttgagacggagtcttactctgtcacccagg

SEQ ID NO: 60185 - DNA, 1871 bp, Homo sapiens
gccaaaagagggccgggggccaatctggtttctttcaagtgaaattatgcttctcaagcagagaatgattgcccacagcagttaaaccttgtttaatggtaattaaattgcttttcttcactttgaaaaatctcttaattttctgtacaaaggcaggaagcatttttctttgattctacaggatgtttctaagtatggtgtaatcagttcatcttaccttgccgggctctgaaagaatgagtgtgtgggatcagatttagaaatgcctcaaaggttagaaagccgagtgctgccgattaactcaagctcagatgaccaaaaaaaaaaaaaaaaaaaaaaagctgcttttcccctcacttctccctctggttctgcctcagtactttgcttaggagtttctaaaagcaggcacagttgcctgcggggctggtgtgtgtcaccttcgcaaagtgcagatgaggtctggcatgtcccatcttgttcctgcctgactacaactctgcacacagacagtgttgatctggcttggagcccatagtggcaatccttggagtggaggcagcagagatctcagttcttcctagtgcttgagaagttaactaactgtctttcccatgaggaaaatgttttgagactgtagaagcagagaagagacttcgccaaagcccatagaaaataaaaagcaaaccctcaagcatgaaaatccctggccctggagtaagtgcaggtgataaggcttgctatctgatgcctcattccatgtctctggcttcccattgcctaaattaagatgtcctgaaagaaaccttgggaaaaaaaaagcacagtccccacatttgaagtagaaatagaattaaggagaaattgtgattttcctgaaggaacagaaccaacactggttttcaaaagccttagttttacattttagtagaaactgttagcagtaggaggatttgctttgtgtgtgtgtgtgtctgtctgctttgccttattttggttctgaccataccactgctatctcagtcttagaggctgattttgtggcccagagtgtttcgttcagatatctttgtgttgaggtgatattgagccagcagccaaagaaatgcatggccaagatatggaatatctggtcaacagagaataacaacaaagtgggacgcatcataaggtcataggtcagtgaaaacagctgctagccatttatatgcaggagagaaagaaggcccagggagttggaaagactgaaggtattttggactgagcagagcaaagggatttggggacatataaatgtatgaaacaagatggtcaggaaaacaatttttttcaaaggtagcatgaatagagtgaggtaaggaaacccatggccatggtactggtggcctaatgggaaaaggcagtgtaatgacttctacatggagacttcagttctgcccctcgtactgttgaagaatattctgtccagagaggctcttcagtttctacctggttttctaatggctttaaaaaactttggtgtattgggggaatggaaacaaagatatttactagagaagtgtttggcaaaaagtgccaagcttattcctgagaaaggatggaacggcgtggggggtggagggagggttggaaccatactccaaattcccctgaggcccacacgtgttcaccagacatctgtggggagcccggatgagatgtggggcccttcccctttctcattttcttttttacttttagatcctggatcaaaatgagtccttgattccctcatcccatcccaggacccttttttagttgcattaccacctagtgaagtctaccaagtcttgatttgagaatcaaaacaaactcagatcaaagtcaacctc

SEQ ID NO: 60186 - DNA, 1761 bp, Homo sapiens
tgtgtgttcctaaaaaagcctctggaaaagtggtttaggaagcttctgggctaggagagacaccatgaaaaacaaaacacaaagtatgtgagtcagttatgatcaattgtgccataatcgacatttcagttgtatagtagttacactatgaaaagcacagacatatttaaaaagacaattttgaggccaggcatggtggctcatgcctgtaatcctagcactttgggaggctgagtcagaaggatcaattgagtccagaagctcgagacgatcctgggcaactttgtgagacctcatctctacaaaaaaaaaaaaaaaaaaaaagccaagtatgctggcacatcccagctccttgggaagctgaggcgggaggatcacttgagcccaggagttcgaggctgcagtgagctatgattgagccactgccctccagcctgggcaacagaatgagatcatctcttaaaaaaaaaaggagaaagataattttgagattcaacatagcccactaacagcttcatttagacatcataccttttgtctagacttgacagaatttgttaaatactggaaagttgtattttttatcttgtttcccctgttctgtctgtgaatagagacgtttgttctttacctagtttataggactgtcatgaggaaaggtgacataataatgggttcacagtattggaagggggaggacaaaatgcctgtttacaagagacccagttacagagctatgtgaagtaaatactgaatgtcaattctaggtaacgatcctcaatgtcacaggtacttcacgtattaatacctctttgccattatacatatgtccttctccaaatgatggctctttgctgtaaaagtttgtcttctaagctggttgtgtggaatttggcccctaccttccacattgtcttataggagtgcatttaggccaggtgtggtggctcatgactctaattacagcactctgggaggctgaggcaggtggattacttgaggtcaggcgtttgagaccagcctggccaacatggtgaaaccccttttctacaaaaatacaaaaattagctggacctagtggtgggcgtctgtaatctcagctacttgggaggctgaggcaggagaatccttgaacctgggaggcagaggctacagtgagccgagattgcaccactgcactccagactgggtggtagagcaagactctgtctcagacaaaaaaaaaaaaaaagcatttaatctggtgctgagctgacctcttgtactctgattttttcattgtttagattggaaataggtcctgagttctaattctgtatttgggacttggtgactgcttctatcccagtctttgatggtttagacagtggaaccctccatgggggcatgtgggtgatcctcttgtcggggaaaaaagagggtgagtgactagggggtgggctaccgtaaccaggactctgaggataggtgcagggtcactgatgactgggaagagttgtaggtcctgccaccatctattttgcatgggaaggacatttgcctgagctaagccatgggaaaaatctaaatttagatacctgagctctccacagcaactaagccaagacacagtagacagaatgttttggcctttcagaatcagtattttacatacaaggactcgatttcacagaaaacccttctcaatgcttatgtgtatatgaaaagaaagtttgacctgcaggaatcattgtaatgtatcagatccatatcacagctcaa

SEQ ID NO: 60187 - DNA, 1443 bp, Homo sapiens
cacatgtccacagagaaccgcacaaggacttcaaggtgaaatagtggctgatcaagtcctaggagtctgagcaatcaaacattggcatgtgttaccaattaagtagagaggtggctgctgttttagaggcttgatgattgtctgtctttaagagtcaatattggccgggcgtggtggctcacacctgtaatcccagcactttgggaggccgaggtgggtggatcacaaggtcaggagatagagaccatcctggctaatacggtgaaactccgtgtctactaaaaatacaaaaaattagccgggcgaggtggcgggcaactgtaatcccagcttttcgggaggctgaagcaggagaatggcgtgaacccaggaggcggagcttgcagtgagcccagatcacacaactgcactccagcctgggtgacagcgagactccgtctcaaagaaaaaaaaaaaaaaaaagagtcaatatttgtgggagtctcaatttaaggtgctaggtaaattgggagttccatctgaggtttctttcaagataaaatgccttataaaagtactgtaagtccacctggccaacatggcgaaacctcatctctgctaaatatacaaaaaaattagctgggcacaatggtggctcatacctgtaatgccagctacttgggaggctgaggtgggaggattctgtgaatctgggaggtggaggctgcagtgagccagtatcgcaccactgcactccagtctgggtaacagcaagaccctgtctcaaaaaaaaaaaaaaaagagaaaagtattgtaagtcacttcagtattagggatgggggccaaagtccactcacgtataaaaatatccctcagaggaagacttctatgtgtgtctcatgcaaccactttatgctgtctctgaggttgttcattccagttttcctgcttttctgttccagacttgggctgataccagagagtgtggattgcctgcagggcttcatgcgcatttctctgtgtatttaaatactcacggaagattagcaactatgcataaactttccagttgtacttccttaataatgattactgctactctttgttggtagctaagggaagcgtctgcatggaggtggcttagaattgacaatgtgcaaaattctgggtcgtttcatgggggctgggggaaggcttggaaataaaggcttgggtcattcccttgtgtttagctcttgcaggaaactcttgcaacaccatgctgttgtgttatcatctgcctgggtttcgtccccaggacagaacggcatgaatgatgtctttagtgtctcacagaaggaacactgggttcttgagtgcctgccatctctgtctcatcttgactccaaggacattttaacctctcaatgccttgttttgcagccaaaggtatattatctgtctcccatatgcgttctgggagat

SEQ ID NO: 60188 - DNA, 1055 bp, Homo sapiens
ctctctctctctctctctctctctctctctcattctctctttctctctctctctccctttctccctttctctctttctctgtctctctttctctctttctttcttgtctcattctgttgccctggctagagtacaatggcacaatcctagctcactgcagcctcaacttctgggctcaggtgatcctcccacctcaacctcctgagtagctgggactacaagtgtgtgccactacccaccacaccctgctaaatttttgttgttgttgttttgaggagaccaggttttaccatgttacccaggctggtctcgaactcctgggctcaagcaatccgcccaccttggccacccaaagtgatgagtgctaagattacaggcatgagcctctgtgcccagcttggatatttcaaagacattagccatggccttcatgtttatctggacttgagggcttcatatctttgaccatagatgatgcttaagttggtctttcacgtggtttcagatccacagacattttgattaggtcaaataacaatcgtcttcataatgccaccatgtatgtatgtagtcctttggagactattttgacatcatttataactgacaacactgtgactttcatcctcctcttagctcacatgccttaatcccacatgtactgccctgtagagaaatattcctccttcctcttggcttgctttcttagctttgtctctatcccaggacaataactgaacaaaggctcttcattcttggtgcaactcagagttggaagagtcaagggtgaaggggcattgggcagccggccatagctgtcttcttcctctcttaatgtctttgtctctcccatcttcatgtggacattttctctctccttcttctctttttcctcccctcgctgaaaaaaataggattactgttttgaaccgggcattatgctagatgatagatgtacaggggtcagcaagatgggcaaggtttccatcttcatgtatattaaagtttggagggaataaaacattaaaataaatagttacaagggtggtgagtag

SEQ ID NO: 60189 - DNA, 2087 bp, Homo sapiens
gcgctctgtaaaatgcactaatcagcactctgtaaaacgcaccaatcagcaggagtctaaaagtagccagttgtggaggattaaaaaaagggcattctgataggacagaaatcgaatttgggaggggacaaataagggaataaatgctggccaccccagccagtagtggcaacccgctcggtccccttccacgatgtggaagctttgtcctttgcttttcgcaataaatccttgctactgctcacgctttgggtcggtgccatctttaaaagctgtaacactcaggactgcgaaggtccgcagcttcattcttgaagtcagcgagaccacgaacccaccagaaggaaccagacacagtgccacctacccacatcttcccctatggctagatggcaggaatccacaaacacctgccaagatagtattgtgatcatgttaccagctataattggaggtgaggagtttggagtagaaatttgtctgtttttataataacgaggttgaattatttatagctttgtgtctttcctcttctccataagtataattaattttattaggcatctattcctaagagccaggaattcacatagctgctgggaagatgaagacttataaagaccacttgtggtctctcaaggagtctgttggcagagactggcatacataaaacaaatggaataaatattctatcaggaatatgggtaaggtcttacagaaacccagaagaggaaagagttctcccaaggtaagggaacctagaaaaagttacaaaacggaaagagctatccatctatctgtatctgtatctataactatatatctacatctatacctatatctgtagagatgggatcttgccatgttgcccacgctagtcttgaactcctggcctcaaatgatcttcctttctcagcctcccaaagagctgggattacaggcatgagccaccatgcctggccccaagaagggatatttgagttgatcctaagagaatgatagactgctgataaagctaaatagacttttttagagtgttccattatttttgtattttgtagttaatgcttaatatgagtaatcatgctttagaaagagaaagcaccaatcaaaacaagcctattttcttttcacctaggcatagtacttggtatgagttggcctagaaacaactgcatattctactcacactgctgcatggtttgcctaagagtactccatagatggactattgaaatttgggtgtgggttaaattttcataaatcaaatttcatttcccattatcttacacctaattaaagagataatgtgccttctgatgaccctgtaattggcagttgtaactggccctttaactttgtttccctgcgctgcagctcctgtctccagcagttagttcatcatctgtacactaacagtaagctacgcgggcaggcactattttaaaaaacacacacaaagctgtctgtgaatggcaaaggaatcagagcaagtcattactctctagttcatttggctagaaaggtcaggtcgcctatattgacttttcatgaaaactaggcgaactagtagttttcatgcacaatatgtcaacaacctgttatatttgaaattctttttaaattaggtgggtgaatggtgtaaaacttcactatattttctccctgcctgttaattgacttgctaatctcctgccaatatatgtccattttaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccactatgaggtatcatctcacaccagttagaatggcaatcattaaaaagtcaggaaacaacaggtgctggagaggatgtggagaaataggaacacttttacactgttggtgggactgtaaactagttcaaccattgtggaagtcagcgtggagattcctcagggatctagaactagaaataccatttgacccagccatcccattactgggtatatacccaaaggactataaatcatgc

SEQ ID NO: 60190 - DNA, 1092 bp, Homo sapiens
catctaacaggtttggttaactcaagaagttctaggaaatgttcaaacactgcagatatttatcaaggggcatttttaggagtagcagagtgtcaagaactcaaattgacatctagtggcaacacttctaaagattggggccccgtactatatacaatgctaaatttccaatgctgtgattggaaaagactatgagaaggcctctagtctcttcccactaccatcatctgcagcaggcccacaccacccaaatcaacacaggtatggaagaatcgccccctgccacaggagtgggcagtaagcgttagaacacagattgccgagttctggttctcagtccacccaagtctggtctgtttccctaactgtagaaggaaggtgttagaaatggaaaatccttaatatattctttgattttttcaaaacagaataattgatttttatcatctttcttagtatacctttcacgttctgcacaattattctagattcaaactgaagattgtggttcatgtcaagagtcagtttggtcactgaacactgtctcatccagctgtgggacactcatatgagcttggtcataggtggctcatcttcccccacttactgggtttccataatgccattctcttgggctgttagataaaatatttacaacccatccctccatcatcatcaaagcaatttatttgcacaaactccactgtcactaaatcacatgaatgcatccatctttcttattttcatctttttgaaaattagccagcatgaaaaataacagcaatcgattaagctattgcattgtgaagagtagcttagatttctttctttctttttttcaccctgttgcccaggctggagtgcagtggtgcgatttcagctcactgcaacctctgcctcccaggttcaagagattctcctgcctcagccgcctaagtaactgagattacgggcgcctgcctccacacccagctaatttttgttttattttttttagtagttatggggtttcaccatgttacccaggctggtctcgaactcctgacctcaagtaatccacctgccttggcctcccaaggtgatgggatcata

SEQ ID NO: 60191 - DNA, 1423 bp, Homo sapiens
aacattgaacttagtaatcacctccctaggagtgaaatttcatggtcatatatattgaaaaaacctcacaatataaccaacatgctatctgaatcttgattgagattccacatcataagtgctaatttcagttctgactataaccaatttgttagtttatacttactctttactaaaggaaagaagagtaggaataggatggtgcggtggctcacacctgtaattctagcactttgggaggccgaggtgggtagatcacatgaacccaggagttcaagaccagcgtgggcaacgtggcaaaaccccatctctgcaaaaaattataataattagccaggcgtggtggcatgtacttgtagtcccaggtactggagaggctgaggtggaaggatcacctgagcctggggaggttgaggctgcagtgtgtcgagattgtgccactgcacttcagcctgggtgacagagtgagaccctgtcttaaaaaaaaaaaagagtgagaataatgaaactgtgcacacgcaggccttttaataaactttccccctgtacgcagcccattctagctatatatatttcttggtcccagcctcttcaaataaaaattgttttattcaaaagtatgacctagccttatacaagataagatagcccacttaaaagtggcataaaaggccacttttatgcatctccattttaggttggttacaagaggcacagagagaccaaagcccatgggatgctcgtgagagtaggaaattgggtgggaagggtggactcgggagacaacctgacatctctctacttgaagcctagcaataaggttcaaaggttcctcatgccttgttttcccttctctctacatgattaagatcccattcctgtaacagatagcaatgtgtttatgcagtaaaattagataagggagattactagggaagtcactactcagttagggatgtcagtggtgctcactgcaggtccaggttagtaataagaactctggactagtagctaggagtgcttgaatctagattagttctactttctaactcgatgtgtgacattttttccacttaatttttttggccttggttatcttattggaaaaaatattcaagttgcacaaataactaaatgatgcctgagttttcattcagttctaaaacttctcaactgagcaatctgttgttgaaaggagagtacgagttctaaaagctactctagggagctctgcattcaccaagccgctccatcattgttgggaagaaaatactaaggttgactcattgtcaaagccacattctactcaaactcaatgtacataactcgaattctagccacattccagccaaattgagatagctgttcaaatagtcatggatttatttaataactgacttcgaaattctttacttctttcaag

SEQ ID NO: 60192 - DNA, 6949 bp, Homo sapiens
atagcatccaccccagttctttctctggtccttgcactctgagaatgaagtcttagacagcagaatgtcaggggactctcattgcgtaaaagtctgtgcccttctgcgccttggacagttatggacagaagcctttaagaagaagaaaattaaaactagttaattttttagttaattttagcaacactacatatatgagagagagaaaagatggcattttctgaatgaatgagatgcctctgcattttgcccaactcattggagactcaggatagagaaaagggagaaattatgtttagaggctgataaatttccctatggttactatcaagagatcagactcttattaacatttgcaaagtgtgagcagagaagagcatttgaacaataagcatagattaagtactcctctttccttcattcccttttctctagtcatattctcagacagtccaggctaagtattaatgatcttctttgaagttaaacatacccttgctactttcattacattattatttttatgttcttccttttggagtactcaaggtaaatgacatggcagaatctgtcccagtccagtgagggtgtcacataagaggcccttggcttacctctatgcataactggcccacgtcacatctttaattagaagtccaagttattggctggacgccatggctcatgcctgtaatccaagcactttgggaggccaaggtgggtggatcacctgaggtcaggagttcgagaccagcctggccaacatagtgaaaccctgtctctactaaaaatgcaaatatcagccgggtgtggtggcacatgcctgtaatcacagctactcgggaggcttgaggctggagaatcgcctgagcacacgagatggaggttgcagtgagccgagatcgtgccactgtgttctagcctgggcgacagaacaagactctgtctcaaaaaaaaaaaaaaagtccaagttactgttgcagggattgggacatcttgcctttctcaagttgagcaatattcccaaatataaaaatgtaggatcttagtccaatcagagcagatatttggtgtagggcattttctaatgtagtaccaataaattagacgcatacctcaaccaaaaaacagcccatatccagtaagtaataaggcaatgatttacatttcacatattaccagagtaatgactaatagcatacatgtataaactgaaaagtgactgatgcttattttcagatgggtccaaatttattggataattatggagaataatgtatgttttctgagagttggtagtaagaaaatattgccattgctggccaggcacaatggctcacacctataatcccagcattttgggagacttgaggtcaggagttcatgaccagccacctcagcctcccaagtaactagaactactggtgcatgccaccaagtccagctaatttttttttttttttgagacggaatattgctctgtcacccagattggctgtgttctccattctaagtccagtggttagaaattgtcaagttctcacatctgcaaaaaaagtaaaaaagatgaacctgctacatctaaatatactttgttgtcttcctacaagtcctattttacatacttatggcatttttactgcagtttgaaaatacagtcaattcttgttattcacagtattgatgttctataaacttgccctaaatactgcattagtgagtcctgaatttattagttaatactgaatttcctaggggaaatacagggttaggttcctgtgagtctttggttacctttttatcaaccaatcaacaaaaatccttattttacctgtgtttttgtttgaagacaccttttaaaatatatattattgattcattagcattgaactaagcttatctaatgcacttattttttgtgtaaggtgtatcacagccttcttgagcctaggaatgccaaatagtacttccacaccatacttaagggccatttcattttatttcttatttttaaaatttattctcttttcttatttaaagaaaaaatttgtagatgccgggtctcgccctcttgaccaggctggagtgcagtgacacaatcacaactcactggagcctcaaactcctgggctcaagtgatcttcccacctcagcctcccaaatatctgggactacaggcacacgccaccatgcccagctaattttttaattttatttttttgtagaggcagggtctggctatgtttttgaggtcttaattccccaatgaacatgactagtatattccaggctggtcttgaactcctgtcacaaagcaattctcttgccttagcctcccaaagtgctgggatttcaggcatgagccactgcacctggcttggaccattttaaatagtgaagtcactcacacacacatacacgcatgcaggtgcacacacagacacaaaaagacacaaaaatgcgaaacttgtggcactaaaaagactgtggaaagggtgcttccttacagtatgaaaactgaaacaaaaaagcagagtgttgtttagttagacgccacctgggaacgtgcttgttgggaaactccagttgtccactgtcctgccatgtctatgatgactgcaaacatttgggagtattaatttgagggtcacaaacagattttaggtgatgggcatatttacaaatacagaatctgctagtaatgaggactgactgtataatgctttagtagtctcaagtatgttttttttctcattaagcctttgcttaagatgcaggcaagattgatgctgttggtttggtgcaaaagtaattgcagtgcttcccatttaaaagtaatggcacacactgcaattacttttgctccaacttaatacttggctttattgacttttagcatcagtgcagtttggttaatgataaaattttccaaagcagtgtctcatctgcaggagcaaactatagcaagggccctggccatcagttctcccttctggtcctgatattcctttttaaactgtctttccatacccctccctccagtgggcttggcgatgttgcattaaatagcaaagagaaggaaactcctccccagtcctcactgaccatttctttttccactcagtcctgctcagaatgtagaagagaagttgaatttaattcataaattcagcagcttgaggactgtcagttttgtcgttatttagtgaaatagtaattgaattgggctacaaggtcattggaatctgctgtttcatttcatatcattttacgtgttattattctaataagaatacaaatggagtttgatgccatttgctgatcatccatcttattgatgccattgaacagaacgcagaaacacaaagggatttataaggcatttcagttttgatgtcctttgaaaaatgaaagtcttttcagaaatgcaaaagacaaaatgacttagaattccatctcgttctgcccggtttgagggcatcccttcctattccttagatagctgttaataagagtcctgaggaaaactgggtttgaatttaaaaacaaaaaatttttaagagacagggtctcgctttgtcacccaggctggagtgcagtggcacaatcatagcccctgtaaccttgaagtcctggactcaagtgatgctcccacctcagcctccctagtagctggaactactggcacatgccatcaagtccagctttttttttttttttttctgagatggaatctcactttgtcaccgaggccgtagtgcagtggcgcgatctcggctcacagcaacctctgtctctcaagttcaagtgattgtcctgcctcagcctcctgagtagctgggactacaagcatgtgctactacgcccagctaatttttgtatttttagtagagacagggtttcaccatattggccaggctggtctggaactcctgaccttgtgatccgtccgcctcagcctctcaaagtgctgggattacaggcatgagccaccacacccagccaagtccagctaattaaaaaaaaaataaaaatcgtagagatggggtctccccgtgttgcccaagctggtgtcaaattcctgacctcaagcaatcctcccacctcggcctcccaaagctctatgattatagatgtgagctgccatgcctggccttaaatttttcaaaagcttttaaaccaatcttaaaatgttttatcctcttagaatcatgtccctagttttatagcttggaaattcttgctcttttcaaattgctctttaactctggcctgattggaaggtggcagcttttcaaatacaggtcatggcagcgctcaacctggattcctcagttgcagaagactgcttttgctagactgctgaatttacttccaacttttcagatgtttctgaggttgaccctggtgtggttcccactcaaagtggagcaagcaggtgggtggcaggtctcttcttagcggcttcctagagggaagcctcgtgagtgggatgggggacaggttgccctgggggagcccaggaatggggagacaaggccacctgctatgcagatgatatagtttggctgtgtacccacccacttctcatcttgaattgtagttcccataatccccacatgttgtgggaggaacctggtgggaggtaattgaatcatgggggcggttttccccatgctattttcataatagtgagtgagttctcatgaaagctgatggttttataaggggctttccctttcactgggcactcattcttctccttgctgctgccatgtgaagaaggacgtgtttgcttccccttcaaccatgattgtaagtttcctgaggcctccccagccctgcagaactgtgagtcaattaaacctctttcctttataaattacccaatctcaggtttgtcctaatcgcagcatgagaatggcctaatacagtaggttttcctgagtcctctctctgactcaccctctgacgggcaaaagacagtggcagcactgccagcaatcagctgggaacttctcccctgtgatagaaagcagtgcttgctggcttccctttgtgatgcttttggacagcagctctatggacctatgccttttgtcctttgaggacggacgcacagtctgtgcagctcgaggacgccgtcatgggtgagatgctgtggagtgtgatgacgccacctcttaggctgtgtgtgaaagtagcgaggagaggcagggtctgcatgagccactttggagcaggccaaaacactgtggagaagcacattacagccacagtggcggtgtaaagggtcagactgaccactggcttctggaaagtcttcatttctgaaagactgtcaggtagaagatggatgagagttactctgtgaggccggaaacctagaactcagaccattgtgtgcagaccagggagaggcagtgtttggagtgagataagcaggaattttgaaattacacagacccggttttgaatttactcatgagctgtgtggcttagagaaagctgtttaatcccactgaccttcatctgtgaagtgtccaaaaataatacagagcttgcagagttgtgtggataagggataatctatcgaaagcatgtggcaagtggcagacacaatgtgggcactaggcaagtggcaagtcccttgtattgagtcttatttgtctattcagtgaatatttggataccaactctgctgttctgggcatgatgttagccactggggagacagaaggaatgaaagagatgagtaacctaatgtgtgctgtctagtggggactgcaaataaagtgggtgttaccactagcgtgctctacagtgttatgctagagagaaatttacttcctttggccactcacttccttgtttttaaataagaactgagttaaagttgctaactgtgaagactgagtaatttgaatctgctgttggtgtactcagattacttttttttttttttttcttggagacagagtctcactctgttgctcaggctggagtgcagcggcccaatctcagctcactgcaacctctgcctcccaggctcaagcgattctcatgcctcagcctcctgagtagctgggattacagtcacgggccaccactaatttttgtatttatagtagagacagggtttgccaggctggtcttgaactcccaacctcaggtgatccgcacatcttggcctcccaaagtactgggattgcaggcataagccaccacacccagctcagattactgtttactcaaattaatggggatgattgaggatgaaacagtgcagggattccccattgttttgttttcttctttgcatttctagtgtctgtttttttttttgttggtggtggtggtgtttttgtttgtttgtttttttttttaaaaaaagatctgcagaggctattgtgtcctttgcataacccaagtccagtagcatccttgacttcaaagtctgttggcattgatggcatctgactcagtcataactatctttaatacatcattataaaatctacaatattgctcaagtgaagatattatcatgtaactgggagatattactaattaatgagtatgtggaaaattttccctagaaaatgaagtgtttgtgaaagggactgaaggatttttgcagaagagtctatgagaaagttattataaaccaaagggttatgaattctgcatatgaaacataaatagctattaaatattttatttcaatcaaaaagtgtaatgaaattagagcttctcattatgaatctgggatttatatggaaacttataaaactaaaaggtaatacattcaaaatagaagcacagatttaccaattaactggagttaaaactttttacttctctttacagtgacaggagaaaaatacatcctaaatatgttattatggtaaaaaaataatattgctagtggacagaaaaaatagtcgtt

SEQ ID NO: 60193 - DNA, 1002 bp, Homo sapiens
attgtactagttgagaactgatgaaataaaaccataactcgattcatcaaactgtttagaattcaaatgttgagacatatctcacttaataacatgagggtattttgtttttctttttaaattgttcactctggcctttagtagccaccagggagacatgtgagtttggaagggcatctcaggtcaatcctaaaagcctgcagaagaactgagctggcagaatataatcctgcaggttgaaacttagccagcctttgaaattattttcatcgggaaagtactacaggattttttaaaatgacatagtagacaccctactcagaagcctactccctaatttttttttctagttactcatttgccaagatgacttgtttatttgaaagttgttgtgatggaagttggattatgtatattatgattgcttttcttcctgtgtattattttcatttgaaaatgtcaaagtatctcaccattttcctattttatagactagtaaactgagttatatgattttggtgaatttaagcttccagggctagatctccatttagctttctcttctactatttagcgcagtccatacaaagctagctgcaccagagagcattttatctgaatcctattcttgttcaccatgccttcagcaagcacattttacagagcgtccacacgccggccaatagaactgcaggtgtgagcagttccattaacctgtcctcaagccttagtgggagagatggcacagaattgctatataggatgtgaatgctcactcaagggacagagcatacaaggagaccagagaaacagaccatgggaacactagagggaacaaaaggataagaggcagtttgggtcagggaaggctgaggcttgaagagtgagttggagtttgccagacacagaagagacccttggaagcaaagagatcatggtatgtcctgtgcagagtttaatgagcacagcgtgtgtaggggacatgcttggacatgagacagc

SEQ ID NO: 60194 - DNA, 1033 bp, Homo sapiens
attggaggatttttgtttagtggattaaaaattcaataatacttgaaaactttgtccagctcttcaacagagatatttggatgagttttctggcttttctaatcaggaaaggcttgttggagaattaaaggagatatgattgaggaaataaaacacaatacaagatttttctggatttattatgaataaaaagggaccccagaggattaagtggatgtagtttgcagttgaggttaagtggtcatggcagtttaccgtggacattgtttaactgatggaaaactccaaaagactgaccaaggaattgaagtagaccaatttggaccaataacttggagctcagaattaaccactgtatttctctattccaaatacccattcctcttccctggaacctcaggctggccacacaaactttcttgaaaattcttggggttctgcctttacaggaaggccatttgcctcactcatcagaagtattagaggtttattctgcacaaccatgaagaggttaaagagaagggtagggaggccatgagggttcttacattccatcttgagtcaaccatctcctgttaccctctgaaaagtggcagaatttgtcccagacttttttttgttgcacttcatatctactatggaattacatttatagctaatgcattaactctaaaaatggagaaacccattgctctgctgttttcatggtaaggaaaaactgctgagtcatgattgacatgggctgtttcaagagtttccacggaatgaaggtaaacgcttaggatatcgcagcctgagtgagaggcactgcaaagtgtggccgctacttgaagttcttcatggtgagtggagagggaatcctgagcgcatcctggattagaaaaaaaaaagaagaaaggtggcctgaaatatgatctgagtatatctggaaatacgcagacatctagtacttcacttgcagcactctgtgaaccagaaggccaatttctacatgctacaagctgcacttcaagatgcacccaaaatgcatgct

SEQ ID NO: 60195 - DNA, 1015 bp, Homo sapiens
cccggccaggatccacattttaacaaggggtctccaggtgattccaatgcagctgagttgggagttctggctttgtacattgcacagaaccttgtataaagcagagactccctggatagctattgaacaactaatgaataaatcacattaaaagctgagtttcttctcattgacttagagggaggttacctcataattactcaaacatagaaaacgtaacccaacatgtaccattttcctatgaccattttgagtcttaaaaacgtggaaacccttttcttcttttaaaatcttggatttgttatttcagatcacctttgatagtttttctttctttcattttttgtgtaccctcactgggtagtgtttggccttcgcgaagaaggatagagagaaagcttgctaattggggctaaatacagattatgtgcaaaaaaagaaattgctagcatctaaaaataagcactctacacgtgtatagttttataatcttatcagctgtgatcttcaggaccaagtacgtggcaactacaggaggatggtctctgtcgctgtcaaaagctgagtattccaactctcacttacttgataccaaccacagaaggacatgagactgtaatacactgggattttcaaaatgcaaaagaatttgatattaaaggcttgttagctgtctaggaataaaacaagaatggggagaaacatataaagtaaggaagattatctctctacagctaaaaccaggcaaaaggaccacccactatggcatattgtgaaaattttgggggctacttttgtttgtcacaataattggagcagttggttgaagggtacaatgcagcagggccatgttctgttaaggaaacagatccactgactacatttgtgtttaataattgcatgcttagtggtctgtttctcctcagtgtgacgtaagtaactaccatgagtttgcctaatggaagtagcatccacacacatccagcacatgccccttgatggacagacagggaag

SEQ ID NO: 60196 - DNA, 1246 bp, Homo sapiens
atataaaaagaggccttgggtctgatgggtttgagaattactggcatggacagcctcattagttcctgtcttaagacagaggataataaaagttaaaggctcagacttaatcaaagggttagaaataggagtagcgagccgggcgcagtggctcacgtctatcattccagcactttgggaggccgaagtgggcggatcacctgaggtcaggagtttgagaccagcctggtcaacatggcaaaacctcttctctactaaatatacaaaaattagccgggcatggtagtacctgcttatagtctcagctactcaggaggctgaggcaggagaatcacttgaacttggaaggcggaggccatggtgagccaagatcgcaccactgcactccagcctgggcgacagaggaagactccatctcaaaaagaaaaaataaataaataaaataaaataaatagtaagagcatatcccacaggaaaagaagctgagagacaatcttggagggaattcatgtatggggcaacttgtcagaatgaacagagcttgggctcaggaattaatgcactgagtttggtgctcttctcttcaactttcagaattcaactatcctgaattctggcttctgggggtcccggcagggtcagaatgaatattagagataatgaccttaaaacacctagcacagagttgcaaaaaatgttacaaattgtaaatactgtatataataacgctaatgtcatctggctcttcaaaatggaaaatgatgaagctatcttactggcttttagagaagttgaccgagttttctacaattgctcatggctagattttggggccaggctctaaaatccaggttctttagattattttgagcctaacaaccaacttaggtttgacctgacttgaatcactctcttcctctaaaattccctgtactcttggctttgtccatacagaacctgtacatcaaattacaccaaatatcacaatcctgtagctttctcatggcaacgtaagtgcctttgatatgtgagttttttcctttttttctggaaacagggtcttgctctgttgcccaggctctgatcgtagctcactgcagccttgacctccctggctcaaacagtcctcccacctcagcctcccaagtagctgagaccataggtgtgcaccaccacgcctggctaattttttaatttttttgtagagacagaatctccctatgttgctcaggctggtttgaaactc

SEQ ID NO: 60197 - DNA, 2959 bp, Homo sapiens
gtgttggccgtctttgtattaggacatctaactcttgtgtttgacttaatgggattcaaatttgcacgtgtgtggttttctgaatgtggcctacagtttcacttggatcttcatattctttttcatcataatctgtaaaagcagaaaaaaagaccattggaaagaaatgctgtatgaaactttctgaaaatggatagaaccagaaatgatgctgacaggagttttagaaatgaaaaatagagagtattcagaccaaatataagtaaattagcataaatcagcattctctgatttccacgcctacttacccaagttggttgactcaacagctgctaagactacagctgtgtgaatcctccacatttttttttttttttgcatggaaaagtgtttcagtttgtcattgcttcatcatttcgaattccatattaggttacctttttttttttttttttgcctgaccatagtacttaagaaaaatcttgcaactgtccttcattctgttgaaccaactatatcttatgttttcacttgacattttgttttagatctacttggggctttatttaaatttttttaacatttaaaaaaatttttttacttaaataatgaggcagtgtctcattattatccaggctggactgcatggggcattcatagttcctgggctcaagcaatcttcctgtctcagcctccaaagtaactaggactaacagcatgtaccaccacatccaactagtttttttcatttttttatagggacggggtctcgttatgttgcccaggctggtcttgaactcctggcctcaagtgctcctcctacctttaagtgctgagattacaggcatgagccaccagacctgaccttggggttttattatttgccttcgagccccttcagacagttcttcttggaggtttggggaaggcttctgtaaagaaaacttccttacacctgtttgatgatggtaaaaggtccaggtggagaaagacttcctaggcagaaggaaaaggaagtgcaaagctatgtagcctctacaagagcacatgtgtagtttagggtggctgcataggacctgggaagagagctgggtgatgcagggcagatgactggcaggtaatgaaggtacttatgggctatgctaaggagtatggaaaatggggagtattcaaaatttagagcccagggtacagtgatgggattgcattttttgacaaagctactttgactgccatgtaaagaacaaatgggaggtgagggagcctgattagaaggtccttgatgatgcaggcaaaagatgatgaaggtctcaaagttctttgagccttgactggaacacatttagtgtgacgtgtgtttataacataaaattaaatacgaaagcagaaacattggtgatggagaggagagcacaaaattggggagatattgtagccaggttgaaagcttgtactgctcactgcacaacagccagtaagtcaagagacaaggagttagagtaaggaagatgactttatttggagagccagcaaaccaagaagatggtggactggtgtcctaaagaaccatcttaaaagacatgaatctcaagcttctttttatatttgggaaaggggaacaaggagagggttgaggtgacaggtgaccacagacatctgagcattagcaggcgtccgagggtgttacattgaatattgcattgttacttgtgtctatgccctttttatttcctcagtggttagttttgggaagggactattatcatccttgctttaaactgtaaactaaatcccccccatggttatcttggcttatgtgtgggaatgagcaaagatagtcagcttgagcggttagaagcaagatggagttagttagctacgttatgtttctgtaactgttacgtcttacttgtaggattacaacatctacttggatgaatggtgatgtcattctagcatgaggagcaggtgggattaggttgaggttgaatgggaccatagttctgtcaggacgtgtcatctttgtggagcccaggggtcatccattaagcagctgggaatacagttctggggctcagcagagacctcagcctggaagaacatgtttagaagtcatcaacatctcattaggaaagagaaagagatcgcccaggagaggaaatagagcaaggagagaaaatggtcaacaagggaaaccatgctgggattgagtctctgtggtaccaatggtcttactattgacgtcagagttaaaaaagaagagagttatattcaaattctggttgagttagtctcttattaacatttcctgactcaccaactggtaaatgtccaagaaaaatatatctttttgttttatcagaaaatatacatgctatttgatcactcttcaggcattaacaaatggtgtctatgagaacattttaacaaaatgtcctttctactgttaatacccacagcaaccaacttggaaatcagtcatcatagaagatgactgcaggttctggctttcccaaatcaccaataattcacacctttgtacatggttctgtgcatgatctgttcctaatattatgcaacacttgtgaaatctttaggactttaagtaattcatcgttttgccccaaacctagacactactataagaaacccaacaggctactcttaccagcaataggggttcctgaacaatatcacggaacaatgagaaatcctgcactcatgaattctctttacaaccccaggtgctcaagcatggtttttaagggtgactccctggccacctggtaagtctgagtgacttgcgggcagctgtctttctggagcgggagttattctctgaagccatagaaagtgtcagggaaggctggatacacatcacgtatgtgcatgagaagtaatactttcaacagcagcagcatcttccaagtgataaaaataactcagctttagtcagtag

SEQ ID NO: 60198 - DNA, 2563 bp, Homo sapiens
tgggtgttattaatcattgaaagatgtggctgtgactgctattatttcctgtgttaagcttcccaccagcaaacctggccaagtgctttggcgctgtggaaacagccttcgtgtacacacttcttgacccttcactcccttcatgcccttcttcccatcaagacttaatgattggctgggcatggtagctcatgcttataatcccagcgctttgggaggtcaaagtggaaggatcacttgaatccaggagtttgagaccagcctggaccacataatgagaccccatctctccaaaaaaaaaaaaaaaaatattagccaggcatagtggcaacatgcctgtagtcccagctacatgagaggctgaggctggaggattgcttgagcgtaagaggtcggggctacattgagccgtgattgtgctactgcacttagccttggtgacagagtgagaccttgtctcaaaaaaaagaaaagaactggaaaagaaaaaagaatggtgttcatctccacccagcatgctagagcaggcatgccattcattgtggaggcaaaactcccgcatagctgccaaaataactgctgagtgctttgcgatggagagaaacaaaggaatgttgggtcactgcccgagtcatggggtctctgcctgagccatagaaagcttttgatttctggagccacattgaatgaactgattatgtttaaaattataaaagaaaaatatagcctaagataattgagtgcaataaaccaatttaacttatttgttcttacgtgtaacaattgttgagtaggtaccatggtacccactctattgctaagctgtggaaggagccttgctttggaattctctcagctcctctttcccatcatttccttagctgtgtcccttttcagcctcctgtgctaactgatagcacatgtgtttcagaatggaacctggaaaaggaatgtgtgcagccctcgtaaggatataccgttccacattccatatgctgttagataatatgctggctagaccgtcaacagttaccccaggaagggggaatttggattggaaagaaatcaaaggaattggaggtaacataatggactgcagttaaacagtaatagggtggtctggacaactggacgaaggccagtttctaaattgcaggcaatcccctctgcccttttagaacaaggcaaggtccactgaatggagaagaaggcaggccatcagccttcttagggtttaattcagacacgggctctgagctttgtcttttgttctctttaaaggaacaaagccattgaatccagccagaaaaacctgtgcgtatccatcataaacatccacaaactcttctttaatctcccttgttattctccctaagaagtaaggctccaacataagttcttggttgcatctgacaagtgtcagctgatgtccatgaccccttcgtttcctgtgtcccttctacttgatgcaatgactggcataacgtatttgttggaatgaatgaatgaatggcattggtggctgggcacagtggctcatgcctctaatcccagcactttgggagtccgaggtggctagatcagttgaggtgaggagtttgagaccagcctggccaacatggtgaaatgctgtctctactaaaatttcaaaaattagctaggcatggtggctaatgcctgtaatcccagctacttgggaggctgaggtcggaggatcacttgaacccaggaggcggaggttgcagtgagctgagatcacaccactgcactgcagcctgggtgacagagcaagactctgtcaaaaaaaaaaaaaaaaaaaggaaggaaggaagggagggagggagggagggaaggagggagagagagaggaagggtgagtgagtggaagaaaacaatgaaatccagttctgagggtaaggagcatgccatcaatatgatgggggatgtgatatggtatgaggatggggtctttcaaactgtattgtgtagaccagtagaccatgacaaataggcgcgcgcacgcgcgcgcgcacacacacacacacacacacacacacacgggcttccatgttcttacaaatgttgcacactatatctgactgtgggatcacagtgtacgtttgtataccaaagtctctgtaaagacctgcaatgaagtgaacccctttaacctttcttttactcagtgttcccctattgtatttgactgtggaaccctctgcgtcatacccttttacatcccagaacccaccgaacacagtttcttcaacattggcagaaatttacaaaatcatcgtagtcttgagtccagctgacctgagtgtgaatcaaggtttaccacatagtgtgtgatcctgagccaaattaagtaacctctggttccctccttcctcatctatatgatgaggataatgtgcatctcctaaaaggagagaatgaaggcagttaatgcaggtaatccatcttgcgtgcacccagcacagggtggctcttccctggttaatttccaccctgatgtgtagaatttccctgcaacactctgctaccacaaagaggggcttct

SEQ ID NO: 60199 - DNA, 1734 bp, Homo sapiens
aacaaaacaaagcaaaaaaatgaagattgccaaatatttaaatgtcagttactattaatttaaatgtccatcagggttctccttgaagtcaaaactgctgttttccccaatgccagaactcctaacagtggaccccaggccgtaggaggtgatctagaattgcccctgaattaaaggctttgtgttctgcacacgtgatgcaacctcaggatcggacatgtgttagttcccagcctgtgtcctgtgacaccttggagaacaatcgagactggttgatatttggagggttaagcaaaggacctttcttttgccagctactctgccgtggttgaagtgtcttgagggtggtgaacgggtcctcgctgggcttgtctctgagctgcacacattgacttgacacaggagtcaagtagtaagtattggttgaaggaatcagcgatgtttggctacccattgtgtgctctctaatatttgctagggatatggtgataagggaggaaaaagacccaaggagtaatgaccgagcagctatgtaagtgaatcaatgatgtgaccacattgctttttcttagccgatagttacagctctatgcaactttttctacttattgctggaggtaatcacattccaaccctgaggactgctcccatgctgggcggtactgcagtgacctctgcatttgagctggggtttcttgtatctcacgagggtcaggggcctgtgggaactttttgtcatctggggggacaaaggctttcttgggaaaaaaaagtctcctttttatcctctgcgggtgaaaaagaagtgccgttagaataggaaggggcttcttgtaggcttgaaaagagaaggacttggcaggtggcacctgggctttgttcagcagaactgagagggcaagagtatagctggcttttttgtaagactcatgaactctgtggcccattgatgagatgctctctgctctacaaagtggactttcctcgaggtggaattttattttcctccctgtgctggtgttagattctctggatacataaggtgacccgaggagaagcaggcaatgtcatcacagtttatttgtaggatctgggcttcctccttcagaggaggtgccactcacacccgagatgcctgctctctccctgagcctttcagcacaagggcaggacggagaggagcccagctaacgaggggccagctcaaagtcattcaggaaaaacagatatacacagacatggccggaagcctcaatgtgtttttctactgcaggaaggttaaagtggaacttcatgtcatagatttaaaaaaaaaaaaaaaaaaggctggggccaggcacagtggctcacgcctataatcccagcactttgggaggccaaggcggccgaatcacctgaggtcaggagttcgagatcagcctgggcaagatggtaaaacctcgtctctacgaaaagaaatacaaaaattagctgggcgtggtggcgcatgcctgtaatcccagctgctcgggaggctgaggcaggagaattccttgaacctgggaagcggaggttgcagtgagccaggattgtgccactgcactccagcctggtgacagaatgagactccatttcaaaaccaaacaaaaaaaaggtgggcatggcggctcatgtctgtaatcccaacattttgggaggatgagagggaggattgcttgagtccaggagttcgagaccagcctgggcaatatagtg

SEQ ID NO: 60200 - DNA, 1100 bp, Homo sapiens
tctctcctcaccgcgatctcttccagttaactgctgaatgcaaatcaacagtagagcgggacgtattttgcagttcagttattgatttttagggagcctgggtgggtacccttatctgtgtctctttgaggacaatgacaggagccctcattgccaacagagataacagtgagattgtatttttatttgttccacaaacactgacgtgacaaagtgctcttactggtaggcttgaggagagtagcctggcgattaaatgttcttatttcgagtgagcagccgggctgtgttcagaagagcccattagcagagcacgggacccatcaacagtccaattaagagcaaagggatgtgactgcggaaatattaatgggctgtgttggtaaagctgcccggggttagcgccagatggagtttttctgtatacagtttgtaggaaactcttgtgtattttcacgcgggatgtccttctgcagagggggatggttttagataatgactgttgtgctttttggggataccacctgcagagatgtgtttattttgagtgtttatagattgcagaaagctggtgaaaccaccttgagagaggtgatcctttgattgaatgtttttttcatccaacaccaaaaaattacaggccatgattggattttggagctgattcttgctttgtaagactgcatggttttggtgaacatccatctggttgttttttttttttttttttttgagtctcactctgtcacccaggctggagtgcagtggtgcaatctcggctcactgcaacttccacctcccgggctcaagtgattctcctgcctcagcctcccgagtagctgggattaccagtgcccaccaccgcgcccagctaatttttgtatttttagtagagatggggtttctctatgttggtcaggttggtcttgaactcctgactgaacatccttcttgaatgatgaagtcaaccttatttacccttgaaagatgacttaatccttaccaagagagcttcaaaaatacctgttattctgtaccttcgtttaaaaaataagtcctattgccttaactcctgtccaatgcctactgtagctctgttt

SEQ ID NO: 60201 - DNA, 1717 bp, Homo sapiens
ttgggaggccgaggcaggaggatcatgattgtcaggagattgagaccatcctggctaacacagtgaaaccccatctctactaaaaatacaaaaaaaatcagccgggcgtggtggcaggcccctgtagtcccagctactcaggaggctgaggcaggagaatggcgtgaacccaggaggcagagcttgcagtgaactgagatagcgccgctgcactccagcctgggcgacagagcgagactgtctcgaaaaaaaaataataataataaaataataaaataaacccattgttcatctaagaacctacccatgtctttcgggaggctttccatcttatcttgtcttggttcagacagtcttccatgggacccactgataccctggagcatctctggaaggttgaagcggaggacagaggaggcatggaaaaggtgtgcagtaatacataggaagcttccaaagagaagtgggtgcaagacagcacagaaacatgttcagttgcctcagctgctgatgttcaaaatacctgcagaaaatcaacgctgctacacccaaaagaaaaggaagatggaactgggggcctagagtgaattttttcaaaggtaaaaaggagcccaaatttcacagaatgatctcccgcttcagaaagggaaaccctctaagtacactatacacttccctgcctgttttctggagagtgataccgagtgttggcactgtctgcaaggaaggaagtaggactttgactaattgcacaaacagcaattttgtgtttttgaagtgcgaggactcagtcctgtgtccacgaagcctccttcaggaggttacttcttgacatagcccatcaaccggacctcccgttgctaggttctgagccttagggtgctttcaaatgcaatatctaggccaggagtggtggcccacacctgtaatcccagcactttgggaggctgaggcaagaggatggcttgaggcaggaggatcgaagtcaaggctgccgcgagctgtgatcgtgccactgcatgctagcctaggcaacagagcaagaccttgtttcaaaacaaaacaagaaaaaaaaaatatgtgcagaatccactaatggaagtcatcataaatttgttgccagaatgggaatgtatcagtttatacttcctacattttgttttttgtgatgactttaactttggatcattttatcagtgactggatgaaagtttatctttattttatctaatggggggggggaatccaaggagctttttaaagacagccagtataattgattataaagggtagttccctgctaagctgaaaatgctgtcttcgaacactttaggcatctgtttctacctaagagatgcattgtggagcccagtctatagcacctgccactggtcttcaatgtgttcagtatgtatcctgataatatatgaaacatcagggtccgctcacctgcttcaggtgctgtgtgtactccaacaggtattctacaatccgagctgttcatcagttgttaaattactgtgatttgagtcccttcaaagtgagatccattggcagcaggaactgttatatagtattatgtgtgtgtttaagggcagagggatggtgttatctaactgtcctgtcccagtttgcaggcatggaaggagttcctaggatgtgtgactttcaattttaaaactgagaaaggcctggacaaaccaggatgagttgtcaa

SEQ ID NO: 60202 - DNA, 1096 bp, Homo sapiens
tggtgagattgtgtagtctagaaaaggctagaattataaattattataaacgttggccatgtggggaaattcttataccaaaaatactgcaatgtatgtcagcctatagattttcatgtagtttcttgtccaaaactgtatatgagagcagaaatgattgattatgttatgttcaatgtatacctaatatctagtgctgatacataaataaacccatcatttgtgacaagggtcttttgtccgcatttaattttattttgttactttttatttatttatttatttttcagccagggtcctgctatgtcgcccaggctggtctcaaatttccggactcaagcgattcccccacctcagcctcctgagtagctgggactggaggtgtgcaccaccacacccagcttaattttatttttatggccaaatatgacacaggtgaaagccattacccagaccttcaaaggagtgtcacgatggggttggcaatgaggacaaggggtgatgaggaaaatacattgctggaaatcaagttgataataggtttggtggaagatctaagaaatgtagtgtggaacctctgaggtagggaaactgggaattcttttctttagaatatacatgtatattggcatgtatgtagaatatgcatgtctggaactccagaatacaatctgggctgcagccatcagtgtacaggttaaaggttcttaggctttctctgttcacggcattcctgtagactaaaagaaacagctaacagctccgtttattaagtagtaaagcccaaacaacttagtaattatttatgacctaacaatttagtggccaattgaaaatacaatcacatcaattcaaaagaaaagatgtattttttcatttttaggtgatggctggttttatgcatcaacgtgcgtagggcatggggcctagatatttggtcaaacccctgactgggtattgctgtgaaggtttgttttttagatgagattaacatttaaataggtaagttttctgggtgcagtggctcatgcctgcaatcccagcactttgggaagcggaggcaggaagatcacttgaggctaggagtttgagacca

SEQ ID NO: 60203 - DNA, 1064 bp, Homo sapiens
aggtaaaagtggatggaatcagtggaattatatgtatgatatgaaatgctctttggcatctattaaatttttattttgaagaaaaaataaaggacaaggaaagcatcctattccaagactccaaggagattatatttttaattccacaccacagaaaatgcaaacaaatttctaattacacttcatgcatggagatctgtagaggaaaaataaattggtacccatccacccaaaagccacaaatcagacatagaatggctaatcacaaatataacttgtgtgcctgatgctgattactttctccgcagtctgttgtgaacaattaagaatttagatcttgggctgggagtgctgtttttaaagtgtgactcaaaagcataaagttcatttaaatttctcctaatcctggtttgcaatttctattcctttttggttagagtattatttatcttcaggaggcccctattatactataaatattgccttggggcagtgttcatagcaccacagcacctatctatccatttatcagaataatcagcacttcctgttggctgagaaaacactgtcatttttactgtttaaaaacagaacagctttcagtagcaattgccattaattgatttcatggcaggaagacggaaaattctccattttttcattctcataagtcacctaagaacatcttaaaagctacagagaggccgggctcagtggctcatacttgtaatcccagcactttgggaggctgaggcgggcggatcacgaggtcgggagatcgagaccatcctggctaacacagtgaaaccctgtctctactaaaaatacaaaaccaaaattagccgggtgtggtggcaggtgcctgtagtcccagctacttgggaagctgaggcaggagaatggcgtgaacccaggaggtggagcttgcagtgagctgagatcacaccactgcactccagcctgggcaacagagcgagactccatctcaaaaaaaaaacaaaaaaaatgctacagagaaaggggacagctgccatggaaaacagtggggcggttcctcagaaaaa

SEQ ID NO: 60204 - DNA, 1028 bp, Homo sapiens
caacataccaaaaccccatctctactaaaaatacaaaacttaactgggcgtagtggtgcatgcctgtaatcccagctactcaggaggcgggagaattgcttgaacccaggaggcagaggttgcagtgagccaagatcgcgccactgcactccagcctgggtaacagagagcaaggcttcatctcaaaggaaaaaaaaggagccaaaggatggacacaacccaggaagaatggataaaatgtgaaggaaattctgacacatgctacaaaatggatgaaccttgaggacattatgctcagtgaactaagccagtcaccaaaaagacaaatagtataggattccacttgtatgaagtacttagggtagtcgaattcagagacagaaagtagaatggtgattgccaggggctgggagaggggagatggggatttactgttcaatgggtgtgcagtttcagttttgcaaggtgaaaagtgttctggagatgggtggtggtgatgatcacataacaacatgaaaatacttagtgccactgaaccggacgctcaaaaatggctaggttggtacattttgtggtgtattttactgacattttattttattttattttattttttgagacagggtctcgctctgtcacccaggctggagtgcggtggcccgatctcggctcactgcaatctccacctcccaggttcacgcgattctcccacctcagcctcctgagtagctgggatcacaggtgcatgctatcacacctgactaattattattattatcatttggcagagatggtgttttaccatgttggccaggctggtcttgaattcctgacctctagtgatccacccgcctcagcctcccaaagtgctgggattacaggtgtgagccaccatgtctggcctgaaatttatttttaaaaaagcaaatctacagaggagtgggctccaccatagaaattcagttccagttagtcagcagtagcggcctgggcagcagcaattctggtctaaggtgcggggtaatctc

SEQ ID NO: 60205 - DNA, 2059 bp, Homo sapiens
accatatcacatttgtagtatattgcatagtataaacatatgctgtttatatacatagtatataagtagcacatagcatatactatatacatagtatataaatagtataaatatatagtatataaatagtataaatatatactatgtaattagtatataattatactggagtgtatatatatactataaatatatacatagtttatatttatacatagtacataaatggtgtatatacatagtatataaatagtgtacctagtatataaatagtataaatatatgctatttatatacatagtatataaatagtacaaatataaataagtttataaatatattttttaaacagaagtataaatatgtatactatattatacatagtgtaaatatatacaatatacttgctgctcagtggaaaataagaattatttgcttatacttaattaatacaaaatcttttctagagtaaaatcattataaattcccctttcttcagagccaaaggagaaaaataaattgtcttcaaatataagtgcatcactcattgcatgatccaccctttacagacctaaaggggcaatgtacgctctcctggagtatgtcaatgggaagttgagcatgaatagccctgcatttagtaaatcagaagttatttaactactcggaacctagatgttcctatgtgttagataggaatgaaaatacccatctttccaggtttactcacatttaaatatgatcgtgtaatgtacttagtacagtgcctggctgccttctagtgtcggcactcaataaggagtagttatcattggttcttcgtagactgccattgggaacttgagcaggtttggagaagtggccattagcaaagaaatcataatggaaagaggctaggaatatacacaaagccagcactgtcttatggggttgcctaaaatataggaaattatggaaaatggaggcaagaaaatctctattcttgacttagaacttgcttaacttgtctaatgcataatttacctaaggattcaaaagtgtgggttgcttaagaataagcagaaacggctgggcgtggtggctcacacctgtaatcccagcactttgggaggccgaggcaggttgatcacctgaggtcaggagttggagaccagcctggccaacatggtgaaatcctgtttctactaaaaatacaaaaattagccaggcgtggtggcgtgcacctgtaatcccagctactcagaaggctgaggcaggagaatcacttgaacccaggaggcagaggttgcagtaagccaagcccacaccactgcactccagcctaggtaactagagtgaaactccatctcaaaaaaaaaaaaaaaaagaataggtagaaacttgaaaagcaaggctatgttaccctttggacattttttgtttgtttgtttgccatttaagaggacgtaaaaggagatcattagacagaaagtttgtaagttttggaagtaaaattttagagcaaaaggaacctttgcaagcacttttgatatagatctgtcattccagagaatccatacataggcttccagaacatctaactaagccatagaccttggaggtatcaggggtcttgctgccctcttctgccttatagaatcaaataaattcatagagaaacagtaggggcattttttatttttgagacagggtctagctctgtcacccaggctacagcacagtggtgtgatcatggctcactgtaacctcctcctaccaagctcaagcaatcctcccacctcagcccccaagtagctgggactacaggtgcatgccaccacaccaggctaattttttaattttttgtagagatgggtttttccatgttgctcaggctgttcttgaactcttgggctcaagcaatctgcccaccttggcctcctaaagtactgggattatatgtgtgagccactgtgcccagccaggacattttatttttatcttatatatatttttttatttttattttttgagacagggtctcactgtgttgcccaggctggagtgcattggcatgatc

SEQ ID NO: 60206 - DNA, 1249 bp, Homo sapiens
ggagtgacatttattcctcaaagcgtatctttttcataatttcaatttttatttgggattcagggggtatgtgtgcaggtttgttgcctgggcatatttcatgatgccaagatttgggtatgagatcccatcactcaggtagtgagctaaaagcagtataaaatgggtttctttcttagccctgtaagttggttctttcttgaccaactaccctctaaggagagttaagagaagatcttgtaggtataaagctaaaaatcaataggctggcctacaaggtcaagtaacaaagcacgttgttttaagctcagggtcttaggcttagtggagcagggatctggtctgatccctacaagtaaaagaatgattagagacattgaaaaagccataaagatggttaaaaggttggggaaaataaggcttccaggccaaacaaaacttgaattcagtgtggaaaaatgttgagagataagttattaatgttaagtatgcaaagaactcctaaaagcacatggatgtcagctgttctatatttcttttgctgaccaactaagagggcaaattcttaactgaatgaagcatttgccctacatcaacttggaatagatttaaaagaagagagtatgactattactaaacatggagataagttagtgggggagggtatgtgtctccttctaagagatctttaaaattatgagcaattgtggctggaggatacatacatgttatacatttataaaatatttgagtttggactcaaagtagaaaatgaagatgagcccttttgtctctttcaactatgcatcaagattagtattagttttggatgacttagtctattgcaagaaagttttcactaggggttgggcatggcggagcatgcctatagttccagctacttgggaggccaaggcaggaggattgcttaagcccaggatttcagatctaacctgggcaatatagtgagaccctgtgtcttagaaaagaaaaaaagatgaaggaaggaaggaaagatggaggggtggaggagggagggaaggatggaaggaaggaaggaaggaaggaaggaaggaaggaaggaaggaaggaacttacttgaattggcattttccttttcctatcacaactatgccttcagctttcttctaattaccatctaagtccttataataaggacttataaatccttacatctaagtgccttacagtagtgtatataaattcttactgtatttgctcacctaac

SEQ ID NO: 60207 - DNA, 1191 bp, Homo sapiens
tctgtctttctctaactgcaactcctgcatttccatctttatccaatttcttacgaaggcaaagctgcactggatggtctgttcatatatctgggtatttttttccacaggataactttctaaaggtagaattgattgttcaaaatgtttacaaatcttaccagaaatgttagacctatttggatatatataatattctgcaacatataagaatgctagttgatagttgctatcctgtatattaactttttaaaagttttgctaacccaatgagtaaaaaaagctcattgttttgatttacatttttataatcattgacgttagagtatattttcctatattagttagtcaattttgtgtttgtgcgaagctccagtttgtgtttttacccatttttaattggatgatgaggtttttggggggtatttttagaccacttcataaattaaggaattaactttcacactttatgcaaatatttctccagttgttaaagtttgcatgtatttttcccatagaaatttaaaattttcatgcaatcaacctcagaaatctttcctctcatatttctgcctctggaattgtatttttagaaagaacttccctgtcctaatattacatattaagcattgtttgtgttctatactagtgctcttagagtttagcttccttacgttgtaatatttgatccttctacagtttattttgaggcaaggagtttgatagagatctagctttctttcttttgccaagtggctagtcaacagtaccactaccacgaactgaataattaatcttttcccttgttgatttgaaatgccactttgtgagatccaaatttctgcctgtgtttgggtctgtttctgaactctatgtttcattccattgagctgtttttccgtctccaattctacgatgtttgagtgactatatttttagttatgggccatgcagggggaagatttgcaaaattggttgctcagttcactgttttgaaactgcttaatgaagaggcctctttgtttccattttctctattaacaccagaattagtgttcacgatgacattgtatcatccaaaaagaattaattttgcccttataataagcttaacaagattgaatataaacaaaattttaaataaataagataatgttaaaaatagcatctagaaggatatttttaaatgtc

SEQ ID NO: 60208 - DNA, 2392 bp, Homo sapiens
tacattttgtttattcattcatctgtcaaaggacatttggtattttgggttttgttggcccttttttttttttttttttttggaggcagagtcttgctctgtcaccaggctgaagtgcagtggtgtgatctcagctcactgcaacctccgcctcctgcattcaagcgattcttgtgcctcagcctcccaagtagctgggaccaccaggtgtgcaccaccacacccggctaatttttgtattttagtggagttggggttttgccatgttggccaggctggtctcgaactcctgacctcaagtgatcctcccaccttggcctcccaaagtgctgggacaacaggcatgagccactgcaaccagccaggttttgttggcttttaatcaagataatatgcaaacactacttttgtccatctgatgatgtctcaacaaagccattttagaatctgaagatacttcctcattaaattgttactattgttaataaccgagtgttggcttagtgagtgttaaggtatataagagtagtccaaataaatggcatagaaataaatgacagtgattaatcactcactagtctgatacctcatagcttccttacttcaagtttaggcaggtgcaggagtcatgaaaaaaagccaaaagataaaggtcgcaaccacttggtgaggaatgtttgctttcttgaaatgatagccctctacccagcaccatgaaaagtgtgtttttcgtggtcattttcaggcctctaagcttgaggtgtgggtttatattctgaaggatgcagtgcgtgatctttctcaccaaactctctcaaatactgcactggataaacactcagaggactggaaagtgggactggaaggagccattgagattttttttacatcctcttgtcctggagtactttccttcctctacactttccttacatttctcagagaaaaaaagaaaaactttgtcatttttgtattacaaacgtgccagctttgactacccttgacactaggtaagtgggagattaattgttgggattatacccatggaaaaagccataaggcttacatcacaagttttattttttttaatattttgttttcatagctggggattactctattggcattcagggagagagaatgaaaaaatatactaggataaaaaagggagtactaattaaaactacaaaagcaatgcaaacatacattaaaagatacaacaaattccatgccagtttcgtgaagaaatgctttgaggtttttttccccccagctttattgagtataattgacaaataaaaaatgcatatatttaaggtgtatgacctgacaatttcatatacaaatacattgtgaaatggttaccacaatcaaattcatgaatatatccatcaccacacatggttaccatcctttgagttttaaggtgaattaatggaatgcgtgtcattcatatgcatattcatatgcatgtcatttgcataccattccttgactcaagaaagttgctatatgagtgaaagataattattgatcatatgaacttaagatacaattattctcatctggccaggtgcagtggctcacgcctgtaatcccagcactttgggaggcagaggcaggtagatcacttgaggtcagaagtttgagaccagcctggccaacttggtgaaaccccattactgaaaatacaaaattagctgggcatggtggcacatgcttacttgggaggctgaggcagaatcgcttgaacctgggaggcagaagttgcagtgagccaagatcacaccactgcactctagcctgggtgacagagtgagaccctgtcacaaaaataaaataaaatgaaataattatcctacaagaattaccagtaagtatacttctaaaatagatcttactctagttcattccaatactcacataatacaactatatattaaatggtgaaaatatcattgcagataaattctaaatgaaaataaatcctaatatgtaatccattaggaaataaaattctaaatttaattctacaaattactttgtgattttgataaaatttacctaaagatacagggaagattttaaatttgtttaaaaatgggaagttagtaaaatcttgaggataaagaagaaatgtatacatatcaggcaagcccaccactgcatgttccatagaatcttacagataatggatctcaagaataagcaggctaaattttcacacccatcccccaagtagctgaatcattggggattttcttttggagaaatttagggccctagcaaagagtagatagcgttctgagcaagttactactcccaagggttggcccaagcattcaaaaacagctgggggctgggcacagtggctcctgactataatcccaga

SEQ ID NO: 60209 - DNA, 1172 bp, Homo sapiens
tatggtggccaaagcaccacccttctattaaaaagtataatctttttttttgttgttgttaaccaatcaaatgttccatctgtttagactccgctgtctgctctggattttagaacaatgcagtcaaggttattcttgctcagtaatcttgccttgaaaaagtgagttactgttcccagaggcaaaggcactgcttcttgatgacaggcaagtgggatttattagctttgtgaaggaggtgggagggcatcgtgatacttggtaaattatgagaggggctggggagaccatgtcaaaaagaaagggattccttgccagatgttcctaagagttgaattaccatggagaaaataatctgaaaatatgagtgacctcgactttgtcctaaacccccatggcttaaagtgcaagcgaaaggagggaatgtggctttataggggcttgcaggtagatggagggtgggtgggggtggtgtcaggtcagttccttatgggcttccctaagtcagtgctggagagcaaaaagagtgttgaggcctcccgagaacgctagaatgaccccacatccctctacatcagctttagacccacagcagcctcctaggtcttctaggtggaggctgagatagagatgttctatcctgaatatgttcagacaagccaggggcactcatataggtggtgcggtttcctgttttgcaaaggacaggagatagagccacccaagcagatgtcccagatgaaaatggctgtgaaacgacagtgtcaccttaatatccatttggacctcatttatgggaaaagccacctttcccacaccactatattttgtttgttacaatctctgtttgtccttctctttcaaacatatttctcattagatttattccatcgcatattttcagcttgtttctgtgaagttccgacaggaggggtgttccaggaagctccgcggtaccttttattttattttactttatttttgcccttctcctggaagagcacttggtaatcttcttaaatgctttttgaaagccttttaatgacatcactcagtgccccgctgatcactcatgaactgcagttgtacaccagctccaaaagttccatatttatgatgataaacaagagctgtaagatttctaattttgctgaggggctattttccctctc

SEQ ID NO: 60210 - DNA, 1204 bp, Homo sapiens
agggaggcatggcagaccaaaaggcaacatttgggcacaaaaacaggaatgcccgttcccatttagggccatgggtttccagacttgagggtggggcttttgccaaggaaccaccctcttctacccagtatttccctgcctcctgtccatgtcatttgtacaagaaaacatttttctcccagtaaagcttatcagttttcacagaataattgtcagcccctaaagtatttttggctgtctccagaggttagtaggtaagaagcttgaagatgaggccagagttcagcattgagctgtcccaggtgacacagactggtgagggcaggcaggttggctgaactcagtccctggagcttggggccagaggaggttgcagctgtgtaagcaggtgggcttcagcccctcaggatagcaagtctcacagccagggatgcagatgctaacatctgtcacattgtcttcagtggtttattatcttagtttcagctgctgcaaccaataccatcgacttgggggcttaaatgacagggatttatttctcatagttctggaggctagaagtccaagagcagggtgccagcatggtcaggttctggtgacaaccctctttctagttggtagacctctgtcttcttgctgtgtcctcatatggcagaaagaaagcatctgtctcatgtctctttttagaaggacactaatcccatcacaagggctctactcttgtgaccaaatcacaccccaaaggcctcacttccaaatactatcacattggagattagggcttcaacatgtaaatttggggttggggggcactcacattcagttcatggcacttgtgaactgaagccaagtgttgtaggtcttctgtcgccacagctgagcaggctgagatgagcatagcaagtcctcactcttttttttttttttttttttttttttttttttttttttgagacagagtctcactctgtctcccaggctggagtacagtggcccgatctcggctcactgcaacctccacctcccgggttcaagccattctcctgcttcagcctccccactagctgggactacaggtgtctgccaccacgcccggctaatttttgtatttttagtagagacgggatttcactatattggtcaggctggtctcaaactcctgactttgtgatccacccgcctcggcctcccaaagtgctgggat

SEQ ID NO: 60211 - DNA, 1012 bp, Homo sapiens
tgtttcctatggaagaaaagggagaatcagaagtgcattctggactagcttcaataaatcatcttatgtcttatcccacctcttttccctattaaaattcttacctttggccgggcccaagcttgagaaggccactcctaaagcaaggcccctttggactagggcctgggcaagagttaactggcacctgctatgccagcacaaagcttaattcccctgcagcagcacacccgcaggcagctattgaagcaaggatggaatgtcttacaatacaaagcctttgtaataatgagagggaaatagaaaccagaggtttgcaagctctttttttcttggggggttctgagtatttttgtttaacttaagtttcgtgttccaaggaaggggcgttttagtgaaaattgtgaagggaaaccctgccaaacagaaattccttataggatgagtattttcctcctttcaaggtgtgagagcgaccaagaagcaataacgcataggggagtcggggtgatagattggaatgctcttggctggagtgtgattggtgtctggaagtgagtcccagcaggttggctggtgaggccatgtgagcattgggcctgttccagggctgtgaagtgtgcaggcttgcttgaggctgtaggcaccactgcctgagccatgcacgtaaactccccagaccctaagagtagtttactgtcagggggtaagcccccaaatcaagcaagctgcacagagccaagactcccaagaaccaatgccttcttccagcctttcattcattcattctgtaagtgaaaactcagcgtggatgtggatgaagatattcatgcctttgtgatcattacatttcagtgtgtgggtgcaaggggaaggagacagataagaagtgagcaaataagtaaagtatctagtgtgtctaggggttttaaatgttatggaggcaaaaataagcagagttctcaaggaactggtcatcccgatgtccatgggctgcacttggttggggcag

SEQ ID NO: 60212 - DNA, 1135 bp, Homo sapiens
gttagccaatgtgtttgttcattctaatactttctttctttcttttttcttttcttttctttctttctttctttttttttttttttttgtttttttgagatagagtctcactctgtcacccaggctggagtgcagtggtgctatcttggctcactgcaacctccacctcctaagctcaagtgattctcgtgcctcagcctcccaagtagctgggactacaggcgtgtgccacaaaacccaattaattttttgtgtgttttttgtaaatacggagtctcagcatgttggccaggctggtctccaactcctggcctcaagtgatctgcccgcctcggcctcccaaagtgtcgggattacaggcatgagccaccatgcctgacttagctttcatttgatgagaatattaattatttcaaattgctcataaatctgcattactgtatgtcagatattggctttagcatttttctcaagttatttcatacaacaaagtataatataaacatcattattactatgtcatgaatgaagaaagtgtacatgaaacatgcctaaggtaatatgcccaaagtctcacagatagtaagtgttgaaaatgaagcttacgcccagttctttctctttccagaaattatactttcaaccactatcctatattcactataggattactttagattctaagattccttaggaaattagaaattcttagaattagaagctgttgggatatcaccctgaactcttttttgttaaatgttgctgctttttagtttatttacccttgaaggtctttgaggctttatattttattattgttatatcaactataattcttagtgtgacttataaagtctcacaaggctacgtaattttattccatctttaagtattttaaacagttagaaaaggaattatattacaattagatttctcaatttagtagctctttttttttaacccaaataatcagaaattactttgctcccccagttactgacagactgtgtatctttaggatataattacttttttttttttttttttttttttgagacagactcttactctgtcgcccaggccggagtacagtggcacaatctgggatcactgcaacctctacctcccgggttca

SEQ ID NO: 60213 - DNA, 1126 bp, Homo sapiens
catcagaaagtctctaatttctgggccgggcgcggtggctcacgcctataatcccagcactttgagaggccagggtaggcagatcacttgaggcccggagttcgataccagcctggccagcatggcaaaaccctatctctactaaaaatacaaaaattagccaggcagaggttacagtgagctgagatcatgccactgcactccagcctgggtgacagagtgaaactgtctcaaatttaattaaaaaaaaagaagaagaagaaaagaaaatctttaatttgtgaacaaaagtggaactttgggtgagtgcttaaattttagcagcctccagagtttcctgatgttactccctagagatcaacaattcactttttccctcctttactgatacttttctttgtgccttgttatagaattatatttattatagaaaaccctgaaatagacatagcaaaagaaataaaataaatatcgcttgtcattcagaccgtttgaagtactgtacgtgtgtcattcatttctggttctctccactacatttgctcattgtgtggttacccaatatttattattcttgagcaattcttctcagactcatcagcattaggaaagaaactctgaacccctttcccttcctgccacatttagcctttcaaagagatctcaagtgccatttagtacaacaacaatgtctgaagtttctttttgccattttcttatgatagctgatgaatttattaggagtctctgaaataataaatgctcttctgtttaatttttacagtattattatttttgccattccttgaggtagttgagtcttcctgttttctcagtaacattcctttagttttttgtgggttttgtttttgtttttttttttttttgaaacagggtcttactctgttgaccgagctggagtgcagcgtgcagtggcacaatctcagttcactgcaccctccacctcctgggctcaagcagtcctcccaccttagcctcccaagtagctgagacttcaggcgtgtgccactatgcccagctaatttttgtattttttgtagagatggagtctcattgtgttgcccaagctggttttgcacacctgacctcaagcactcagcccacc

SEQ ID NO: 60214 - DNA, 1040 bp, Homo sapiens
ggttgaggtctctttgtccctcctggcagactcactgggactccggtctcttccattaccactttccattcctggtcctctctgaagggctgtggttgtcctggttctcctcccgcagccggtgttacttatcatcgctctgtgattttctgtgctttttttttgtcccccttttccctgtccatagcagctcttcaaatctatcatcctgtttttatcttacacttttatttaccatgcatctgcagggctttattatttgtggtctacttcagggtatttctttcacagttgatgaagcctgtaaacttcagagcagagaatcagagggccctaagcaaccctcacctttctggtgagaatatattcacctagaaaagggcttttatgaggtcactttagctaattgtttttctaatagtgtcactccctttttctcttcaaggtctcttcaagttcttttatttatttatttatttttttaacccctatgtgcatcttgggtagaatattttagtacagtttttgtctggagacctgttgtttggctttttggctttcgagtgtagccatctgtgttcaagtgttctttttcttctagtggaaatttgtgtctgatgtgtgggactaagttctaagtaatatacacacatatatataatctatacacaatggtgatatggatcatggatattgtataattcaatcatgacggtacttagaggctcctatatgttactagtccttatggatatgtgtatatgcgtgtgcagtaagatatgcagctatggcaccccactggcagatattgggcacaagaggaagtcactcttcttgcatgaggattatagaaattttcattttttaagtcacaaaaaaatatttcactgccatgtttttttaaaaagttaagttgctcaaaaatgagtcggatgcagtggctcacaaatgtaattccagcactttgggaggccgaagcaggcagatcacttgaggttaggagtttgagaccagcctggccaacatggttaaaccccatc

SEQ ID NO: 60215 - DNA, 1068 bp, Homo sapiens
tagccagctttggtggtgggcgcctgtaatcccagctactccggaggctgaggcaggagaatcgctttaactcgggaagcagagggtgcggtgagctgagatcacgccactgcactccagcctgggcgacaaagtgagattctgtgtcaaaaactaaaaataaaaataaaaataaagtcagtggcatcaatgagaattaaaatatttaaatgcttgcacagtaagcattgtaaaccaaaggcacactccagggtccaccaggttcaaatattagaatttgtgccctgaattacagtgtggatcttctgttcctgcatgtattcaccttgggtgtgccctcctgcatggcaaagcatgggcagagagcactgcactcacaggcctgctttcgtggagcaatctagtggccagtgagcccggggccagtgacaatcaagatggcagcctcagactgcattctggctaagaaagctatttcatttgggttgggcaggctctagtaagttccctgcagctctgggacaacctcagggatggtggattaatatgacacattctccaatgatacaaggtgaattcagaagcgcctatggcagggtattttggggcaaacccattgctagttaaggcttcaacatgtctttctaaaatataaggatggaactgtcatcatttttctttcttttcggggaagaggagttaaccgtgctacattttcatcatgaataaataggtggtccatttggtcaacctattctttttctcttcatgttttcaccccttttctttcctatttttttcttgttttctcctggtccacaggctttgaagggcatgctgatctctcttcaggcagaacttgacattcaaaggtacttgatgaaaattgaatcgtctcagcgagttagtactctacctgttctttttctgcatcgagttgcaccctcatcctgcacctttccctcacctgcaagtgccattctaatcagtgtcagccactaacgcctgcacttttcgctgtttaccccaatccctgattcaaaactatcagagccaagtgcttgtagc

SEQ ID NO: 60216 - DNA, 1051 bp, Homo sapiens
gaacactaattgcatgcttgcttcgaaatatttaatttgctttccacagattggattgtggaatcagcagtaatgcaaccacaagctggagatctttgaataattgtttgaaaagtgggcatctctaagcagagatcctatccttgccagcttgctccagcagaatactcatggcagtaaaacagaagcctgaatcattctgacaatcccaaagctatgtcattctgctttgctcagttccaatgtgtccaatgttgggtccagatcattttacttatatacattttaataatgatcataatggaaataaacacatttctttagaacttatatacaccaggcactgttctaagtgccttacaagtattaacttctcacagcaaccctgtgggggaggtatactatgatccccattttacaaatgaggtgattgaggcacagagaagttaagtaacttgcccaaggtcacacagctaggtaatggttgtgcttaggaaatgttcggccatctggctttgtacaaaagtgacctccttcccattggtcagtcttcagtgaccatgcttatctctttaccttccccttcttaataatcagtctcattgatctctttttagggtaacaagctcaatttagaaagttcctgcccagacaaataaacattaaagttcaagtttagacactaaagagaattttcatgtcacacatcatcccaattctgatgagtgtttatccttaattttattcttaatcattttcacattcctaaaattcatgcaaaatagaggcatctttattatttccgtgcgcatgtattgtgcactaagttaaaatgcagaaagggaaaagaagggcatagtgagctcttccctacaacttcacaccctgccattaacctttattcctactttcagaatagagatttgacattgcccagtgggattttcccatcataagtagtactgagtttgggattccctcccgctattctttttttcttctgcttgaaacaaataaatcttcagtactgactttccttttctttcttttt

SEQ ID NO: 60217 - DNA, 1010 bp, Homo sapiens
tatttgttaatttaatattttgttcctggaatttttaataaaagtacctagcaactagaatgttctcttcaactgaaatcagaattttgactgggtttgagttgaaagtttcacaagtgaaagaaatggggctaaagtgtctgaatgtcatgattaaattaaccatgtcctttaatgagtgctaggaatgagtcattccaaatacatttgcatgtggaaaacttcattgtattttcaaatgccctgtggcaaattgggcattaattaggatgaagtaaaacttcatcacggcaatgttgatttttcttttcacaatagaacgtaatctgaagcaaagtgaataccttggctagccagacaccccactgttcctggcaattaacatattacgtaaagctacatttgcaggttcattttctggacctcggcatttcaatttagggtttaagggtctgaaaacgggaatgaaaaatacatcatcaatacctctagctctaactttcttttatctttgttgttatctccaaatccaatagcattgcaaagaatatgaataaatctgatctccctcgcagaacagtgcacttggtgaacatttcagcaaatatttgttcatgatgttaaaatgaaatcatgaccgtcttttaaaaattaatgctgttcaactatgttgcatacacttgaggacataaatgcggaaagccagatcttagcactacctagctacatatatctatggagcaggtgctataggataaataattcgaaggaaatctcagtaaactgtttttctggatgacatgatcttttcttcttatatgatgtgtacttagagttagaaagttttggtcctgcaagggatctgagacaccaactagctcaacctctggccttacagatgagatacctgtgactcaacgaggttatatgtggaccagtttttggcagaagctgaactagaactagcattcccagactcctggttaaataaaaattttaggcagggtgca

SEQ ID NO: 60218 - DNA, 1026 bp, Homo sapiens
atcaggcacaccttgggcatccctgaaacaaatctgtagcccaaaactcaaggcaggactggctaaagaattgtcagggtaccttgttcaaaaatcattaataaggccgggcatggtagctcgcaccttggaatcccagcactttgggaggctgaggcaggtgcatcacctgaagtcaggagtttgagaccaccctagccaacgtggcaaaaccccatctctactaaaaatacaaaaattagctgggcatgatggtacatgcctgtaatcccagctacttgggaggttgaggcaggagaattgcttgaacccaggaggcagaggttgaagtgagccaagatggcaccactgcactccagtctgagcaacaagaatgaaacgccatctcagaaaaaataaaataaaataaaaatctcccttgcaatgtgagtttactgattgtggaaacagtcttggtatgagactctgaaggaccagttgtgttcaatttactctggtattagtagctcatccatctagggtgcgtagaagagtatacagtcccatctgttgtgaaagcactgttagaatttgtcgggcaaaaggaattgttttgctgtcactttcttataatgtggcttgtcctcaactccctgttcaaaatgcaccacataagtcaaacaataaaaatcttaatggagaccaggtgcagcgggtcacgcctataatcctagcactttgggaggccgaggcaggcggatcacctgaggtcaggagttcaagagtactcaaagtactcaaagcctggccatcatggtgaaaccccatctctgctaaaaaacacaaaaactagccaggcatgttggggcacacctgtagtcccagttattcaggaggctgaggcacaagaattgcttgaaaaccggaggtggaggttgtagtgagccgatctcacaccactgcactctggcaataaataaataaataaataaataaataaataaataaatacaatggaacacttaagggcaatgttattttccggta

SEQ ID NO: 60219 - DNA, 1026 bp, Homo sapiens
catattatttttccagattaatagaaatggcattggacatattttccacacgattaataatagtctattttcccactttctttaaaatgccttttgcagacaaggagccccaaactgtctcacagtcctcaaccacccagtctgggtgacccggtcgagcatttatcagagacgtccgctgattctttggaagccatgtctgagggggatgctccaacccctttttccagaggcagccggactcgtgcgagccttcctgtggtgaggtcaaccaaccagacgaaagaaagatctctgggtaagctttagaaggcagtttctgatgcccctttcttactgaatgcgtttgttgttatactactgaacctatactctttcattcaacattaatttgatcttgatttgcaaatactctagtactgggaaacttcattggtttaatatcaagcattgaggatttgcctgctgggtaatcaggtcaagtgcaagctgattttgaggctgggcactttcagaagtggttgggattagcaattcaagccaagaggctagtagtattttacctatgttcctgctactatacagcaggagtccccagtccccaggccatggaccagtaccagtctgtggcctgttaggaaacagaccacacagcaagaggtgagcagaggatgagcaagcattaccgcctgagctccgcctcctgtcagatcagctgtggcatccgcttctcataggagctgaaccctattatgaactgcatgagtgagggatctaggttgcatgctccttatgagaatctaactaatgcctgatgatccgagatggagcagtttcattccgaaaccatctgccatccatggaaaaactgtctttcatgaaaccagtccctggtgccaaaaaaaattagggaccagtgctctataggaaattgtgaggaactgaccgtagaatgatcctcttctcaccttgcaaccctcctctccagtcccagaggccaggacagttggcatttgtacccagtgg

SEQ ID NO: 60220 - DNA, 1026 bp, Homo sapiens
attgccatgttaaggttctgatttgggtacttgtgtttgcaaacagatgggcttggggataagaggggacaggaaaagagtcaacatgcaaaagccttcagagtctagcacgtgcaaaagacagctgaactctgccatgtaaaactgagcaaatgccttgctgggagaagaaagaaaaagattgatgtgagagaaggtaccctgattttagttcctttgctgcagataatgacccaagcagactgaattcagacattgtcctagctgtcctaaaaaaaaaccctacaactttgttattatttgtattatcaatattaatatttaacattaaattttgtgtcaaattaaattttgatcaaattaagatcaaattaaaatttgatcttaggttagtaatctaggatcctcattgtataaatgagagaagaccacagaaaatgtgctttttgtttatgtgtgtgtttgcttgtttgagctcacacacttaattaagtggcagcagtgggaagtccagggctccagttcccattaacatgatcttacaaatgaagggacaaggacacacaggggagggacacacccaaggagcatcatgggccaagacagtgtcaagatgacacaggcttccacaccgtcaccaggctggggctttctgtgtggattcaagaaatttgtggtttttcttttcttttttttttttttttttcttgagacagagttttgctctgtcacccaggctggagtgcaatggcatgatcatgattcactacagcctcgacttcccacgttcaagggatcctcccatctcagccttcagagtagatgggactacaggcacgcacccaggcgcctggctaattttttattttttgtagagatggggtctcactatgttgcccaggctggtctggaattcctggactcaagtaatcctcccaccttaacctcacaaaatgctgggattataggcatgagccagcatgtctggcctgaaacttgtgctttcttaactccactcacacttag

SEQ ID NO: 60221 - DNA, 2313 bp, Homo sapiens
atttcctctgcagccaagaacggttggcagtgcaggttgagacttgctgggttcaggaaccaagccttggggcagagaggctgcaggagctggggccggcttgcccaaggaatggctgagggtggcgggtgttttcgcacggggtggccacgcttctgcaaattgctccattttactcagcatcctttgctgtagagtgccggtgtgctgtcacagcaggctgaaaaatgcatctgacctgtttattctgccctccctgtgaggggctttttggcctgccatttttcactactcctggatagaaacaaaggaacacagtaagaggagaggagagaaatgagaagtttcttgccaaagccaagggaagctctggttccagaaaatgaggctggcactgggccagctgggttgatgttgcccttgaccgcctctttgtggccgattggggaatgtccccccagccgcacctggcccttatggcgtaatccagttgagcctggacgggaaataaaaaggaaaatgtgactcacagcaagtgcaaatgcagtctccctcccaggggccttgctcagcttagtctttgggaaactccccgcctgcctggccttatttaacacacagacgcacgggttcctgggataaacagtgctccccagagagccccggccatgagcagggtgtctaccagcacctgggtggcccagaagcacagctgcaactccatggggcctcagatatgccgactggatactttgagctgtaacccccctggaaacccgctgttgatgccatctggaagccctgggtgtcttttggcatctgtatgttgtcactttatctcaatccatagagttttaagttctctcatgaagccctgttgatcttgcctttatttaaaattttgatggtttatcatgaattttttttatcattttattttttaggagcaattttttaggtttgtaacaagatcgagcagaaagtacagacagttcccatacacccttggcctccacgcatgaacagcctcccccatgatcagcataccctactagagtggtacgtttgttacgatcaatgaaatgagaccgacacattgatatcacccagagtccatagtttacactggggttcactcttgctgttgtacattccatggatttggacaaagaggctgtcaagggcaacatcaacccagctggctcagtgtcgcccaggctggagtgcagtggaacgatctcggctcaccgcaatctctgtctcccgggttcacgccattctcctgcctcagcctcctgagtagctgggacgcaggtgcctgccaccatgcctggctaattttttagtatttttagtagagaccaggtttcaccatgttagccaggatggtctcgatctcctgacctcgtgatccgcctgccttggcctcctaaagtgctgggattactggcgtgagccaccacacccacctgctttttaaaagtattgcacaaagacattatttatcatgatcactgagcttttgggagacccttaaattttgcactggaggtatgcgtcttgttgacctcaccccagtgctggcccctcatgtaaccccaggagcatcagacactgttactgccagcccccagccacggggcctggagtaaggagagtgaggaaagcccagttcccggcctgtacactggcacgtggtgccacagtttgtcactggagtccttccccagctcaggcagcacagaaaggggagggctaggcaacttgagggtggagccaggacaagatggaatcctcacaccactccggctcctgagaggagaggaagccttccctcacttcagtctgcctgtgcctggagataaacctgcctgcctcttagtttctccacttgaataagtcctcatttctattgcttcagtgtatttgggggctgggagaaatgcaggaaggctgagcatggtgcatttcgcaaatggtgttaaaagacatgcaagagaaagtgtggggaacagtagctgtgttttggacccgtcttagacatcactggtgtctgtgtaatggtctccctcgggtgctgtcctgggatgcaaggtgtctacttctcatttgggagaagcattttgacattcagacagagccaagtgacagcaacacacaagtcctttctgaggcttagagcctagaaatttacaaagaagaaaggtaaagaaagaaattgatgggttcagcagcactgacttatcccaacgccaggttccaacaacctatcgtgtctaaatctgtacttccacagagtgatgggttccctgc

SEQ ID NO: 60222 - DNA, 1062 bp, Homo sapiens
ctctcttcagtgaaaatagagaagaccaggagaaaggaagactaaaaagtaaagtgaaaaccgccttccaatagaatttggttgcagaaataatttccatgaaaaatggtcgggctgatattaggtctggagtcttaatgatggagtagtttccttttaatcatggtgctgtcttagaaatgcctgtctggaatgtgaccatgggcgggggttggtgtctggccactgcgtagtcggccttcggggaaagggtagccacaagatgttcccactcttctgtgagccctcaggaatttgaaaataagactcatgtgaaaacaggaacaacagcagcaacttcttgatgcagacagattcctttgttgaccatattctgaatgcatagctttagaaaagagacctcactgaccagcccggcagccagaggagttcccatttctgcaacaaactgcctctgaaacactcagactgaaaaagcaaaaatgatcttaagtggcataggaggattttagactggttagagggagaagttcctcagggggacgaattattgaatatctgtgtggctgttcttttattccaacatgattaactttgatgcttatcattccctatgggaatttaaggaaaagaaggctcataattgccagaatcttccatcctgtgtacatgcaaggctgagtaggaaatcagggcaaaggaattgatgaattgtctgtctctaaagatgaaaacaaagagggggcaacaactgtaagactaatgtgagactgtctgaatgtgaacagttatttcttgaatattcaaaaataaatctattttatttatttatttatttatttatttagagacagggtctttctctgttgcccaggctggagtacagtggcacaaacatagctcactgcagccttgaagtccctgactcaagcaatcctcccacctcatcctcctgagtagctgggactacaagtgcacaccaccatgcccagctaatttttctgtttttatttttttttagaaatggggtcttgctgtgttttctgctggtctcaaacacct

SEQ ID NO: 60223 - DNA, 1899 bp, Homo sapiens
ccctggcctaagtagctgggagtgggtggttagggtgtctggctggaatcacccataccagtctcttcctagtgcacctgctgctaccactgaggctggaaagcagattctttctggaatatccaatgtgctgggttctggaaggtgagaagcaaggcagttgtggagacttgggttttttgttttgttttgttttgttttttttcagcattatttgccaagctcccagggcacggccaccagcttgatcgggttgagactgctggggcaggcatccatctctagtactgaagtgaaggtgaggcccaactctgcatctgtgctggcagcttccaatcaaggcagcatggctttggaatcacacctgaccagagtttaaggaagcttcctctttaccaaaccaggtctatagtcacccagttttactgtgaagattcagcccagtgattctgcaagccatttaataaatccattttttttaactggctgaaccagttcagttctctacaactgatctctgactgcacaggggcctaacttattatatttgtagatattgtagtgctgcctgttctgtgtgtttcaggaaataggacaagtgctggagggtataggttgatgacttctggaggcttggcagggagctgtaagtgtggttttcaaactatgttctagagaacatggaagttctatattataaatactgcaatttcatgtaagatctcatttgaaaaatgagctgatgctaaactggtaaaaaatacaataaaataaaaccgatacacacaataaaaattaaataggccagtagtatgggggaaaaaaggagggagggagggagggaaggaaggaaggaaggaaggaaggaaggaaggaaggaaggaaggaaggaaggaaaattatgaggaaatttcaaaagaaagggagaaagagagagggagggagggaaggaaggaaatgaataaatgtcctttatactcagcaggagtctttaaatactttaatttgccaaaacattctcttagttttctcgcacttgatgtaatgaatgtcctgagaggtagttttttaaaaaccgagtcaatctttaagtaaaacatttcaggctaagaattaaccattgtaaggaatatgtcaaaaatttcttcagtatagtgaagcatgttttgtgatacaagcatccccccagtttgtcctttatcaactaggattttcatatatgaggcttgctgaaaaaaggcagcgttgtccaggtttcctcacttggctcccaattcacccataagaaagaatgttcttgtaaaagatcatgtggattcatgatgcatttgtgcttactttaaaaaacaaagttggtcagatatccttaggaatctcttgtgattaaaattcctgggttgaaactctagaagagatttctcaaactttgaagcaattgtttagttaatatggacctgagagattctatgccttttaccaaaaaaaatatatcttctaggattactttgcagatgggacataggtaaaaaagcatggcctgaagtgaggagaagatgtgatgaatgacaaaggtgtcaaccctcaggcaccattattttagagggactttcagtgatcagggactatgaggaggaaacagtcttagcagtgagagaggtcttagagaagatttaggttctcctgtttctttctttctttctttttttttttttttttttttttttttgtgagacggagttttgctcttgtcacccaggctggagtgcagtggtgtgatctcaactcactgcaacctccacctctggggttcagcaattcttgtgcttcagcctcctaagtagctgggattacaggcaacggccaacacacctggttaatttttgtatttttaataaagac

SEQ ID NO: 60224 - DNA, 1033 bp, Homo sapiens
ttcaaaaatgaaccctccatcaagtttcaaagacaacacagaagaaagtaggcaagttttatctatgatttatacctttctaaatccaaattagatttgatctggcttcatcaaaaccaataaaaatatcaaagaaccattaaaataagaattaatacaagtagctgttgggtaaaatatgtgttccagaaaaattaagataaagatgatggctgtaattgcagttaatattagaatataagacaaaagaagaaatgtaaggcattattacatggattgcattgtttaagatgaggtttataccagctcattagaaaaaaaaaaagttttaaggcattatcttccaacaactcttatatcttaatgtttttgacatctgattatctactaagcagttatatatcacagttgttttatgaaatgttttccatgtggctatatctttaccataaaacttcaaaatccaacaacacagtattaagtcatgcagtgagaaggccataacttagaatctatagatttccagggatctaatttaatacatggaaaaagttgatgtagtcttgataattgctttagccctcagatggttggtccttggctattagttgtcttagcaggttgggtaacttcagctgaagaggaatatttgagaggcagatcattgttgaagacttgaatggcaaaagagagttagaaaagtcatttctcccacagtgacaaaattccaaaatttttaatatgttccaataataccagctactactctacactttccccgggaatgacattggaaatttatggattcagatgctgtacttttagatgttctgcaatggtttggttggaacaagagatgagacattaggaaatgttacctgaactgtgtatgaggaaaaagattttgtttatcagcctcttttgtttccctttgccatgaaaactctatctaaaatctgttcaccatgccttactgttttcataaatgcaaaatatattacacacattatttttttttaattaaaagtttctg

SEQ ID NO: 60225 - DNA, 1027 bp, Homo sapiens
gcctgactttcctggtagggttggagggagccctctcctgccccgctcatgcctgactagctgcctaccataataatagaagtggacccacacagctcaaactgtattgttcacaggtcaactgtagttgtacatagccagtgagatcatataggtcatgttcttaatacactgcctgatatatagtaagtactctgtaaattagctgatggtcatagcgatgaactgaggtttttttcttaatgtctattgcattctaaggtaggacattacaaatttcatttagaaatatttacatcataatggttaaaattaagacatttctcatttgtgacgtactcacttttaacttattctttttaccgatgatgttaactcaaacctcatctctttcccaattcaaaaaaatgctctatcattgtcctttcacatcgtgtttcatttgctaagttcatgagttattttataataattaacattttagattggtcagctgaattctgatagtctttattctcattggtaacatgtcactgagttatattttaggttatcttagatcccatctctaaattctaatggccactctgtgttgcactgttcttttcaattctgtctttcagttcctgggtccatcagatctaagaatgtgactgaggtattccagcatggagagagttaatgtgaggttgaatgtggataatgcttcagaaagagtccaaaaaatacagaaattatgctaataggaaagaatgagtatcagaagatttctagcaatatagcagcatgagggatcttagatgctaactgtaccccttgtcaccacaaacacgtagcgacccaggatgaaatataataataacaaaaaaataataataatacatggcaagtttgaaagcgatgaaaggaaatctccagattccaaaagtgaagaagaatatcaaagtggaaatcaccatggacatggatatttcagagatgggtaccatgtctttgaactaggactttgctacttaacatagcaaca

SEQ ID NO: 60226 - DNA, 1014 bp, Homo sapiens
acttaagattgaaaaataacacaaaattccaagcaagaaacatacacacacacacacacacacacacacacacacacacaggcccactttggagaaactgcaaaacatcaaagatcaaaagaaaattttaaaagcagctggagagaaatgacaggttacttacaaagaaaagaaaacttaataccagcatgcttttataagccaagaagtcagaaagcaagagtaatagcttcaaaatccaagggaaagaagttaccatcaaccaatatatatatatatatatatttttatccagcaaaattctttatttgagagtgagggcaaaaagagcctactttaagataaacaagattaggagtatttaccattcacagactcactgaaagtactattaccatatgtatttcacacaaaaatccttaatacattataagcaaatcagattcatcaaggtgtaaaagcaataatacatcacaaccaagcgaggtttattccaggtatgcacggctggttcaatatttgaaaatttataaagtaatccaccatatgaacaggctgaagaaggagaatcatatgatcatgttaattgacagttaaaaatatttgataaaatctaacaacaattcatgattaaaaaaacacaaaactcccagcaaactaggaatagaggtgaactttctcacttcataaagagcatctaccagaaacctacagccaacatcatactttccctctaagatagggaacagccaggagtgtctgatcttaccactcttaacataattctggacatggtagccactgcaataggcaggaaaaagaaataaaaggcatgtagtttgggaagtaagaaataaaactgtctctgtttgcagatgacattatctacataggaaatccaatgaatgcaccaaaacaactctcctagaagtaatgagtgagttcaagatcaacatacaaaatctattgcatttctatatactaagaatgagcaaatggaagccaaaataaaaa

SEQ ID NO: 60227 - DNA, 1050 bp, Homo sapiens
tgcagtatagtgcctgaaccataacaaacacttcataagttgggggtatttttgtttttaagcatttcataaaaccaatgtgggaaaataaatcatgagctatcaacccaccctccgaatgtatatagatcctgaccacttcttacatcccctactcctaatccaccaccacctcttgctgggacttgtgcagtagccacctaactggttcccctcttatcacgagcagtctccacagggcaacccaagtagttgttccaactcctgagtcacatcacacctttcctctattcaatatactgcgtggcccatcatttcattcagaataaaagagtacaagccttggctcatcccctgccaccctcctctcacctctctgctccaattcctggcatcttggcagcttctttaataacctagtttattggcaacaacctcaaggcctttgtactttctgttcttttttgcctgatatgttcttctcctagatgtctgtgggagagtggcttctccctcatcaatctttattcaaacaccatcttatctgaagaagggctctctggccacaatctctgaaatatcctttccttccctgttaaatttatctctaacctgccttatttccctatagaggactaatagccacctgatatagtatacgctcattcttaaactgacatatgacctgtctcttgctaaccagcatcggtggtccatgacagcaactatcttgttttgttcactgctgttttacaagctcctagtatggtgcctgcacatagtagatgctcaataaatatgtgttgcattagttaatgaactggcgtggatgatacagtagtttatattggactttcgaagcacttttacatacacagtcttatttgatccttggaaataagaatcacagggggacagattttttttcttgcccctacacctacaaagattggctcagatcccaaaggggcttccattttttccaaaaccaagtaccctgacaccactttacttttgtacttatgtcaaatattactattttatttgact

SEQ ID NO: 60228 - DNA, 1122 bp, Homo sapiens
cagccctagccattgacctcatcttgtcacacctctgctcataatcctctgttgccttgcagctcaatcaagagcacaagggcctccaccatgtgatcacctaccacctttctaacctcttctcattccatttctcatctcactcatttccctccaaacacagtagctctctgctgtttctggagcacatccagcatacttttgtctcaagaaaacttgcttttccctttgcctccttcccccagatatctacaagtctcgcttccacacttcttccaaatatcttcacatcagcaggatgtgcaactactatgaataaaatagcaatccgcccacttccaccccactgctctctagtccccacaccctgttttgtctttttccctgtgtcttggcacactctacacttacttgtttatgagtttagtgtctatctacatcaatagaagctatgatctctgagcttaccatcgtatcccctccttttagaagactgaggtacatggtggtattcaaaaaatatttctagagtaaatgaaatccatcttttaccatacccattttgtttaagtgtgaagtttaatgcaatactgtttctctgtaaatctaaaacagtcctaagtttcatcaacagttctctattcctaaagaatttatttaaggatcaagataatagtccagtctgctttgctttagttgttcctccttgcataagtatgccacataggttgaattatcttgtcctgtggaaaggggacacagactattatcctcccttttgttatgcttgttatataagcataatgtttacatatgagctgaattgctactatagaaggtaaagctgacagaatgcacagatgctggtaagggaagcagattccttccacctggggtaggtgctcaacttgtttaatgcatgttatgattggggtagctcagtatgatgactttgcttgataagttcctcaggtaacaaagcagatgggagggggtacttatagggttgattgcttttttcccagtgccttgagttggaaagccaacaattgtcgttttgatcatgaggcatttagggggacttctacctctgtatgtaatggggagagaaaggtgatttat

SEQ ID NO: 60229 - DNA, 1951 bp, Homo sapiens
gaaaactttagagcgtaaatggtaacaaaagttgttccccaatatataaactttggataccctaaaagcagctcagcgtgactcagtttttgctactagcataaaaccaaaaataatcagatccctgcagaagtagagggtactcaggtatccacctccatagcactacttaagaaataaaaataaaataacctgttcatagagtggacagcacaacttgaatgccaaaaggcagagaaggttctgttcctggctttgatgctgacgcttgggaaacaccccttgtctttctgcatcacacacaagcctgcctggggcaagaatccagaggcttgtatatgcccatgtctaaatatttttaaaggtataaatcaagctaacaaactattagataaaatgtgttctatcctcatactttgacaaatttaccttcacgatgaccgaggatgccagatttgattttagacttctctgagccctcacagttgtgggctggatcatgtgatcaggaagggtcccccccacatcccagcctgcagcaagccatcttccctcctcttcatcctccctccagctcccttccgctttgcaaggaggctcaggcacacgtgagtgattttcctcaactacacgggcaggttccctccatgtgccctgcaaacagcattctttggtcacccctcagtgtgaggggtgcatacaccaatgtcaggcaaggattacgggacaaggactcccttcccagactcctcctccattccacagtttgacccttattccttcaggacttatacccctaatccctgtacttccatcaagtcagtcacaaggatttagggaagctgatcatttctatgagagctggcaatggatggattaggttcctttatgttttcaggtcacgtaagagatacagcgagtcttttgttttttttaagagctccaagatgaaggccagcgtgatatgaatttcctcaaactgcccacacagtctttctccccaccctctggggaaaaaaatctgagcctccccctcagatacctaagaagaagctgagaaaaatctgcccagaagaggaacagctgctgagagcctgcctcaccctccctggctggccgtatttccaactttgttgccttcttcagtagatctggggaacaaaaaagcaaggcgtgaaatttgagtgttcccaagtctctctccatagctgcccgtgagcagtgttaccttttgattgaggcactcacgcttgagggccacatgaataaatgcacgcctaagtgtgagggtggcaaagaccaatcattcacagactgatgggaattgtttccctaaaatattcccctgagctgctagaaagggggtgatttccacgagagcatagactgatgcggactagaattgctaggacagggaacccccgtggacggctggccattgagacacagtggagaggaaggagaccatggtgtgaagtctacgaatgagagtgaggaaaaggaagaggtgggaagaagtggtacccaaggataaggctttatggaatctaagcatcccacatttactgtttttaaaaatgagcttgaaaaattagggtgtccgtcctgtgaaatggaatcccacagccacagatctgctaacatttgtttatatttgttgtcaaagaatagcttgatttttttttttttggttattaacataacttaagtggaataaaagtataaaggagcaagcaccatggttttctgtcatctcctctcctcttttcttttttcttttctgagacagagtgttgctctgtcacccaggctggagtgcagtggtacaatcatagctcactgcagccttgatctcctgggctcccgggtcctcctgcctcagcctccgtagtagctgggactacaggcatctgccaccaccaataaaaaaaaaatgctgctttttttttat

SEQ ID NO: 60230 - DNA, 1037 bp, Homo sapiens
aagattgttcagaggacttgatgtatatgtgaagcaaagaggtggtgagaagtgcgtggcgcagcgtgtgggatgaatgtgcaccgtaagaggtccagtcccactgcggtgccctagcaaagtgggacgcttcgggaaaataaggcaggaagaggagttgaggtcacatggtgaatatccttggataccatgttgagataaagatattttagaagatgtcccacattctggaactgattctgagacgcaaaagataatgaagatgtgtgggcacaagtgtgacctgccaactgcaccctgctttttgtaaaatgtgagtaagagatcttggttaaaatccacattcctttgcaaagccatggaggtgaaagaacccttcagtgttcaggcttctcagggggacactgagcattgcaaggttcatatcgacactcactctggcacaggtttcagagctcggcacctccccctcccaccccacacccccatccagcatgtggatccattctaaccctgtgatggcattcccttcggttgaggtaaagacgggaatcttttttctgagctgcacccagcacgcttcaacatcttcaagcagatggtcagcctaaaagtgtgaggatagctcaggttgccctgagaggatgcttgcaggagatggacagagctaaatgcaggatttcaggagaagtatgcttcaagaaagagagcatggcatctatgaatttggcagaagtggacatatagcttctgccaaatgatgagttgtaacttttaggcaaattgcttggactttctgagcttttatttccttatctgtgaaatggggtcatagtatccatctgacaagagatactgtgctgatgagatgaaatacatacacatggtttctgacatatggcaggcatcctataaatgcatttctctcatcctcatcccttcttcataaaaagggagtttgggaggcagagtcccctggacaacctctgggaatctggagcagccagcactaacttggagcgaggaagcctgtgcca

SEQ ID NO: 60231 - DNA, 1089 bp, Homo sapiens
gctgagcgagggaatcttcatctgtatttacagctgctccccattgctcgaatcactgtctgagctccacctcctgtcagatcagcagcagcataagattctcataggagcgtgaaccctactgtgaactgcgcatggtgagggatctaggttgcatgcgccttaagagaatcccatgcctgatgatctgtcactgtcactcatcacctccagatgggactgactagttacaggaaaacaagctcagggcttccactgattctacattatggtgcgttgtataattatttcattatatattgcaatgcaataataatagaaataaagtgcatgctaaatgtaatgcgtttgaatcatcccaaaaccatctccccctaaccctgtccatggaaaaattgtcttccacaaaaccggtccttggtgccaaaaaggctagggaccactgatgtagcaaatgtccatctctcttcccaccccacccagccaggtagccacccatcacatccacagaagatggaagagtccacatcaaacacactggattctggctgaccaagcataggggaaggggctgatatgccctcgaccgaatgctggcaaaggggccagctccttagtcaggacactggagggtcctctctaggaatgctgaatgacccatgagaagagacaaacttttgtgtgtatgtgagagactgagtcttgccttgctctgttgcctaggctggagtgcagtgacatgatcagggctcactgcagccccaacctcatgaattcaagctatcctcccacctcagccccctgagtacctgggaccataggagagaaccactacacccagctaattttttgtatattttttttagtgatggggttttgccatgttgcctaggctggttttaaactcctgagctcaagtgatctgaccacctcggactcccaaagttctgggatgacagccatgagctaccatgtctggcctgacaaacagatttttgagggtcatattcagattctgtctggtcaccccatagcgaagcagccagacccacatataaaacttcccaaaattacaaccgtgcctccctc

SEQ ID NO: 60232 - DNA, 1114 bp, Homo sapiens
tctttaacacctgcttggacttcaaagaacgaaggtgagtacttacacaataaccaaacagtgcattccttggaaattccaaacctagatctcttgttacatgcttgccaagcttgtcctgaacgttcctaagtgcagcaggaaagaagtggctcagcttgtgctgtgtgtcccctgagtcttgacctgtgactaataactgtttcctttgtgtgcaggggttctctatctccagtatggagatgaaaccaagcagctcaggatgccgaatgaaatcacaagtgcagacacaatccgtgctctcttcgtaagtgcctttccacagcagctcaccatgaaaatgctggaatcgcccagtgtcgccatttacatcaaagatgaaagcagaaatgtctattatgaattaaatgatgtaaggtaagttgtgacatcattttttgcctgccattttgccttagagttttttttgttttttgtttttttgtttttgaggggtttttttttacccactatattgcatttagagtgtttttttgttttttgttttttgttttttgttttttgtttggtccatcatatccctttcatagagtttataccaaattctaatttctttatatcctagtgaagaaagcagattcattatcctgattggttgggcttatttcacccagtcagatgatttcactatctggttttctacaattcatttacagggtatagcttataaaaacgaggacaaatttctccgccacagatttttgaatgctacatctgaaaagaacattagaaatgattcagtccaccattttatctaagggttagggaaactaaggcccaaaaaggtagcggagagacctgatcgaggtcttaagagttgtaggcagtacttcattcatattggaactttcccaattccccctcaagtgttctttcctccatagaaagaccctgtggacattttaggtaatgatcccactgggtcgttatttacacataacaagttagaataaaagcagtgggctctgtattattttccataagaaaagagactgagaagcatcttcactttccattcatttcttaaagagttgtcctttacccaaagatctta

SEQ ID NO: 60233 - DNA, 1010 bp, Homo sapiens
catgcctggcctcatctctctttttttgaagacagggtcttgctctgtcacccaggctggacctcagtggcatgatcatgtctcagtgcagcctcgaccttctgggctcaaatgatcctcccacctctgccttccgagtagctggcactaccggcacatgccaccatatctggctaatttttaatcttttgtagagacagaatctccctatgttacccaggctggtctgaaactcctgaggcaagcaatcctctagtctcggactcccaaatggttgggattataggcgtgggccaccacacctggctcaaaagcatctttattgtcattttggtgtcatgtatacagtagaaagaactcatttgatctgttccaaccaaacaacctggaaaacaggacttagatcaacacaagcaatcagttgctagtatggtctctaaacattttagaactccacagattatttagtgactaatccagccatttcattttatggaaccagaaactcagacgcataaaatttgagggacttattcaaaagcacacagccagctaagtaccaagctctgccccaaatatggctgttcacacttcttggtcaagaactttttgatttcttcgaatgttccctcaccaaatcactggaggcagaacttggggtttctgagtccacaccctggggggaatagcaagttgccctgtttcttcatcatggaattaatgggtaccacttttaaaaaatatgcctctagtgcataataaatgtaaactgatctgtatctaccaatgatcacaaatgacatatttaggcatgtgcccaggtgtatgagtaatttagaactttcaaagtttgacacatgcctcaaggtatagatactacatctgtttcacaaccttacagctttttaaaaatgtgtttaaatattcatgggtacccaaaaattcatgtttgtttttaaactaaattattaatcaagctgtcaccaaaagaaattttttgcattcacaaa

SEQ ID NO: 60234 - DNA, 1061 bp, Homo sapiens
tggggagctcctttagtgaaaccccacatccttacctctgtgagtctccccttcatattcacccagccccctttaataacagggctgctggttccccctcaagccgacttctaacaagctactggagcaaccgtgcaagcttgggctagtcattgcttcaaagcaattactggcggatatttaaaggagaaagagaagactagtccaagaatcctccacttcagttaaaacagaaacacaagccagtaatcccagtgattgggtcagcccactaaatgaggctgcacctggaagagaggaattcttcctcctgcccacatttctctgagctagcccagccggcattggaagggatcacagtgtagacagagccaaaagggccttgggtggcccttctgctgatgaaagctgaacatggagggagagagacttcatagatattcatgtgctcttcgataattttaaggtaggctctgatcctgtcttttgctacgttatgacaccttggctctaagagccgggttcagagaaaaaagaagaatttatctgctgctatttcttcacatccagcaattcgatttgtatatagaaaaactaattttctaacccactatggaaggaaaaaaggcatggtaaagatattagatctttttggtactgtttttttttttttttctggactccagataccttttctttcagttgccgaaagtgtttgaaggcaaaaaaaaaaaaaaaaaaagaaaaagaaaaaaatcttctttcatgtacattcattagataagcagcaaaccaggtgtttgggaaaagtaaacaattaaatatttaaatatcaaccaaatctctttgaatgtattgtaaatattggaactttatttttttttttaaagccttagtttccatactcggaatcttgaaagaaagttcgtgccacccaacatttatgggtggggaactatactggaggaataatactttcttggggaacaagaaaaggagagaaaagctgaagtcatttttcttcttcttttccgtatttataattgcctattttatggtca

SEQ ID NO: 60235 - DNA, 2893 bp, Homo sapiens
agggattaaaataaggctggacacatcctaatttatctttaagcaaggagttatgtccttactttaaatgaattctgaaaatcttcctataaaagggtccctggtccacagtatattaactgactcagaagatctcttgcatttctttctccaattaaagcaaacctaacatacaaaaaggcaaacagcaaggtgcacaattgcatggaaaatctattcatactcttacattagctcttccaagttctaacattctaattcaatttctcaccttctaattcaggagctaccctggaagaattttgttgttgtactgtcttaaatattaccatatcctctctgagccatgctgaggtcataatacaaaaatccgcatgatttgggaactaaaattctctagctttagattgtctcaggagattatccaaacattcaaagcacacagggatgttttgaagaaaaaagaaggagaaactgaaaaagcagattttaagatcatattaatgcaggtccactagaaagggattgagtttctaaaaataaggctacattcctctgtagcaaaactgggaggtaaaaagaagattagcttctcagctgtacaccccctacacacacacacacacatttggaagacactgtgccattttttctcatcttttctacagattagcacttggctggatgctcaagtttagctagaaaaataaataaataaatgattaccttttattgccaaagaaacccaggcactgttctgtcttggagctgcagttttgttcctgagcgaggctgtctctgcttcctgatagtacatattagtttcctgttgctgctgtaataaattaggacaaattcagtgacttaaaacaacacagatttactctcttaaattttagagtctgtagactgaaagtctctggtctgacataaggggtcaccagcaggtatgcattcttttctggaggccctagggagaatcttttcttttttttttttttcccccaacttctagaggtcatcaacatttcttggtttgctgtcctcttcctccatcttcaaacccagcaagatagcttccctttgaccctgcttccatgctcacatccctaaccctcccatgtccacttttaaggacactttaaggacattgagcctccctgatcctccagaaaaatctccctatttcaaggtcagctgactggcaatcttgactcccccttttccatgtaacctgatgtagtcacaggttgaggggactaggatgcagacatctttcagggaccagcattctgctttccatattgggtaagtttagaaccataaaagaagccagcagatctagctgaaagtgctgggagaaggtctgtccttctggactggaatatgaatgacgacattgtgggatcagagcctacacttctggagggaaaggcctctcacgtactcaactgctgttatttttgtgtcagaaatgatgtgtgacttgaattgaaagctgtgtcgctacttcagaaattctaggattttcagccttattttgccagttatactttatgtgtaaaccagagccacatggagacagattgagtcatgccaatcgtgaagcatggactaaatattacagcaccatttgccttttattactctgttattctctttcttggagacattcatcaatgtcttcgctccttgaatatctttattttttgctatgtctagccttcaccctggagttccatggtgctgagagttctgttcctatcacatagagccatttccacaccggtgccccagaatcgcctctgagaatcttgtttgtggctggaaagacacctgttttaaccctccagcagctctggtacctacgtaaggaccagcagtgaggactgagagtatcgaatattgaccgtatgaacaaagctgatcaggatatgcagaacatgtgctgtgggtttctgcagagtggttctgttcttacttcaagatgaaaccctgctgatcactttttctgggttacccagagcctactttaagccctcattttgtgtgtgtgagaaactcaatcattgtccccaaatgaagggacagtaaatgttcaccatctaaccagcagaaaagcttttgtgtttcaatgcagattacttagaaatgagaaatagaaagcggtttcaaagccagctaggtgtgatcatgcctgcagtttgcaacttggttcctgttcacagattgcagacgctaaaaggcatggaattcagctgccctcaccttttggctctgcaggttggaattctttttcctttcttgatgaatgtggctgcattgccattaaagggcaggaagctttgttgagccctgcctctggagcccagctgcacaacccactgcccatggtggagaacagaaacagagaacagagcaagcatcaattgttgtagactaaaccacgctgcagcgtggggttagggaactccgtcctcccttatgtttgcaatgtgagcgtggccatgaaggaattcgatgctaactactcacatgagtcagtcactgcagtcctgcccctgatgtcattagacctcactccccagcctccagagacagcctggcacagacctcccagctgcctgcttatgaccaataaacatgcatgtcatgaaaaacatcagttggaataagcagaggggcaacaaaagtcacaccagaactcctcaggggctcctgagactttccttaaccaatgaatgtaatatcttgcctttgaaagaaaagaaaatgtaaaactctccatctaaaacagtcttcccagagcggttttatgattggaaatgtgttactcaggaagcgtgctagactaggcctcagagtgtgcgtggaatgcatgcttggtggggaa

SEQ ID NO: 60236 - DNA, 1004 bp, Homo sapiens
gactttttaatgatcgccattctaactggcgtgagatggtatctgattgtggttttgatttgcatttctctgatggccagtgatgatgagcattttttcatgtgttttttggctgcataaatgtcttcttttgagaagtgtctgttcatatccttcacccacttgttgatggggttgtttgtttttttcttgtaaatttgtttgagttcattgtagattctggatattagcactttgtcagatgagtaggttgcttaatttcattatacatctctttcatggtatctttttatatttaattttgcttcattctcttcttttctgagcacactaaaaatatatccattaaaaaaagaaaagaaaagaaaagaaaaagagtgagttgcccatttagtatgtgtgtctgcagtggccactgaactcagagcactttttctcacagggcagtgttcttgttgagaagaggggtttgggattcagggagtatcaagtcatcccgtagtaacaaaagaatcccacagaaatggaagtttcagaaaacactcctagctgataatctatttagagatcgtttttgacccacctgtaatatccccttcactcatgcaatgacaacggtatcaataactaacattcctgacgtgcttactctgtgccagtcaccatactgagcaatttgcttgtatttactgccatttgattttcacacctatacaatgtgagagaagttcttattattctcctgtttcagaagtggaagctgaggcttaagagaggtcagtgtgcttgctcaaagctacccagctaaagagaagtggagctgaatttagagccaggcaggccaactctagaactggcctttgtaatcatgcctgtggtcactaccgtccgtcctttcccaccactgtcttcatcagtgtgtcgatgagtcatcgccacatgtccatgggcctctcatttctgaagacctaacccagaagccactctcttcatcaagcctctct

SEQ ID NO: 60237 - DNA, 1929 bp, Homo sapiens
ctccctggctcaagtgatcctctgccccagcctcctgattagctggaactactggcacacaccacaatacttggctaattttctgaattctttgtagagacacagtctccctatgttgcccaggctggctttgaactcctaggctccagggatcctccctccatgccttccaaagtgctgggattacaggcatgagccactgtgcctggccccttgcttttagattgagtcgatagtcagtatttcaaatatctctaaacttacaccgtaagggtgatgatttttgaacagttaacctaacttcattactgtaagcgtttactgattcactcaatcagccatagtgagtcagatccttcctctggtctcagctctcatgcaagatcctgaagatatattggcaaaaagcaataatgatacagacaataatcaattaactcaataatcaataatgatacagacatctataatttttcacataagttcaggctcatgaaatccttgcctgtgttctataatttgctggagttaacactatggaactcatttatgagtgatatacataatgatatcttttttatattgtgcttttctgggaggcaaaaagatgtttctgttatgattgataaggaaggactcttacagaaatgattagctaggcaaacacatttgaatacagtggctgtccagaacatgggagatattttcttgttccttctctgcttccagttataaagtcttattttttagaagcaagaaaaggtaatatatgcacatctgatatgcaacttccaagtgatacaaatctcatctttcctgctgcgtggctgcttgcttttccttgtactatttttttttttattttttgtcattgagaggttatgacaacatgagccatattgtatttataaacatcacgtgtttccttgatatggcttgcagtttctgccagacagaacacatggaagaaacatttctcgttagttcagcattggttttagttatgctgatttccgggacaggaaaaatgccttcctactcagaattaactttcatagagtagaaacaaaacctctgaatgtccgtgaaatagttttaacaagagtggatactgctcctttaaaccacatattttgactaaaagcttccttctgtaaaaaacccaaggcttgcatttagtcaccatgaagacaggcaaagctgaaagcattggagagaggggtggtttcgaggtctctgcaagtctagaaagtttcttctagaaaagaaaggctcacggaaaatgtaaggtaagaactgtgcctttatgataggatattatctttagaatcttttttcatgctctggcacgtttatctttcattaacttgtcttctgtattcaagttcaatgcaataggcgattgcaattttaggttttattttaacttcttgcacactgcctagaagaaaacctctctttgttattgacattattctgtttttttgaaatccacttaaattaaactgggctggtcttcaatctataaatcttgtggtctagtttctggctaaccttataatttggaatgggatttaaagtgccaacacagtttgcttttacaggtcttgttgatttatgtgctctgtgacaattttcagtgttttcatgaagttgttgacatacattcagtgtctgaggcaaagtcgataatttgaaggcatggtacaagcaaggagggaaattcatatgtgtcctttaacattccagggaaaaattatttggtgttttgttcttgtgaaaatcactttaaatttaaaaataaaaataacctttatcctggtcttgaaaaaattttaaagaaatagcagtttaatctgtatgaaatcacattaaaaacttctacagttttaaatgacaagcttgatataacaaatctcttatagcagg

SEQ ID NO: 60238 - DNA, 1065 bp, Homo sapiens
gctctcttctttgcttcatgtgccgtgttgctcataaaaaaatgtttccataggacagagcaggaagcttgtttgtgagcttgatttgggagcaagaaagtatctttgaatggagactggctaactgtgcctgcccactgcccttcaggctgctggcagagctctcaggagggggacaggaagaatgttaaggctgaaggtggagggttctgaagttagggcagctggctcagctgcctgagagcccgaacttcaccttcaacagtgctcttcccacctcctcctgaagattgagacatcaacacagcagcaaaaatatcctggtgatttgtaatgcaaagtaattactgctaacagcatcaacaggggatgcagctgctcacaacacaggcttcaggatcaaggcttccagccccagttcagcataaaatccaggattggctacacaaccaacacaactcaaagttgattggagcagaaccttccttctccccaacaggtcctagggttagctcccgaagagttctgagccgtggctggctggagtgcacatgagaggtttttgccacatccctctgccctttgatatccaaaccacatcccttttctttgctcttataagtataggtgttggcggagattgcttttgactggggacatatgtcctttcattttcaagttgcatcccttgtacctgcatgttgttcacttgctgaggtcttgcttttctgtgttctttgtgggtgcccagcaaggcatcccagaccatactaggctgttgtctaccacatcagcctaggcgccccgagtcccagaccctactctatagagggcttccaggggaccatttttctcttgatgctgtttctaacatttctcaaatgagcatgtgttacttttatataaatttgggggtagggagagaacacgttaatcttttaaaaagaaaaaagtgtttttaagatacattttgcctactggtaacacattttcttctgtcctagtttttcttgtggagcaggtgatctctgcttgcatgtggtttgcagaagtcatagatactct

SEQ ID NO: 60239 - DNA, 1078 bp, Homo sapiens
ataaagaagtgacaaaaatagggctggatctcaagtcaccgttcccaagaccagacccttgtctctatgcagtgccatttcagcctgttctctgcttttgttctcacccctctggatcttatgaggtttgtcttcttgattgatttagaaaaacactatctatttgactatctatttgacttctcttagccatcttttgtggtacctgagtccagccagctttcgctaatcctctagaaagcaggacaactctcttttctggattatcttactaaaagagaaccagaaatcctgtagttaggccagagctgattaattggaaatgcatgagcctggactaaaaataaatggattttaaactaaccagatttagattatccagtattttttatggaaggagaataggccatcatgtcaactgaaaaatagcagctgtttcaaattatgagatactttgaatagagcaatattggctcagcaagattgtacagtgttatggcattattttaaaaaacagcctctttgctgtggcaaatagctcctgcagttatgctgtttgaaatgttaatgtatgactcctcacattactttcagagttgttcattgcttggaaccagtgattttaggtggcaactagaaaagcagtttgtaaatggtaataattatatgatgttgttttgaatgaatgttggaaagactggtagcacaaagaacttgagagttacttttcattaactccttaagtcacaactataattcttagtcacgactaaggagagaaaaagtcaatttaaaactgacttaaagaaaattattaaatgagtactaggacagctgatacaaagatatagccaaagtggtgatagtatcttgttaatgtatgaagtataaaaaccaaggctttaagatgaagcccaaattgagggttcaaggaaggaacagggtaaaacttgatttaaaagcatacaattggcaaaaaaaaagaaaaacgaaaaaaaaccattttgatgtccaaatgaattctaattcctctctaagagttctcaagacgatcagcatcgtactatttggcagaaaa

SEQ ID NO: 60240 - DNA, 1049 bp, Homo sapiens
aacacaaacaacaataaggaatcataccaatgccaatgatggggcaattcagaaatagcaggggcctgatctgtagggtgcttaaacttccatgcatgattttcatgaaatgcagcacctctaaagcataggactggtggtcagggtctgatagcttcgtctagaatgagcatctagtgccagtccttgcagtcacttacaaggaaggagggcacggaatagaacatgttgtagatggttgaccccttgcagtagggactgagggatcatgacggatacatcatggatggaaatccacaaagtggaaaccgtttttgcttgcctttaaaagcaaatctaaaaatatgttttctagcagctgtgtaactgcaaggaaaaaaaaaaaaatctgctccactgcaacacaactcgctcaccagatatctgcagggttcagatcttaatgcttcagaaatttgttgcagattttactgtatatatttagaccaaggagcctattagcttgcaatctgagagaacctctgcattttcatgaaaatgagaaatgtggcactgttggcaacctcgggctataattatgttaatctgaccattttaagactgaaatatgttgttttaaaatgtttctgtatttttattattcgtaacaatgatctgaagaaatttactgaaatgctaataagtttctattcagtatcactttgagactagagcacaaaaaatgagtcagatgtggaattttgatatttttaattttggcacagaatttttatcgacagatatgtactcatatacatagagtatcttaatataaaaactacccaaatataattttatattttaaatatagatacagtgagtatatgtgcaaagctgtcttggcagatatgtgcaataacaaaacatctctacatttgcattaaattcccaatctttgctctgccaaaaattaattttgcgcattattacaagataaatgtttttctatcaagaaccatgctaaagcacccagttccctgtttttgatataaatgtaggacaggactaga

SEQ ID NO: 60241 - DNA, 4186 bp, Homo sapiens
ggagtgcagtggtataatcatagctcactgcagccttgaactcctgggctcaagccatccttcacctcggccttcaagtagccagggtacaggcatgcaccaccatgcctggctaattttttaaattttaattttgcagagacagggccttgctatgttgcccaggctggtctcaaactcctggcttctagccatcctcccgccttggcctcccaaagtgctaggtttataggtgtgagagccactgtgctcagccctaatcatgaactttgaaaagtgctccatagattacaaagcattttcttcacttgccttacatcctgtgtgggaaggaagtctttccttcctggaggcaacgggtaagaagagcaactagacagtgtgtagctccttactctcggtaggcatttcgtcatatggagcatgacttattgacttgcttctgttctttctcatgagctactcagtgtcaggagtacagggcttgacttaaacatagggatactcaaaggcccacctggcagtttgttgttgggacacagggaagcagattgtgtctctgaagaggaggcttctgtcggtgtcagagcctggtggggaagaagggattggtcaatatttggctaaactccttcagctgttggtgcagcaaaaggcatggcagggcgtgggcagagatgcctgccaagcccggcctcagggcatgtacagctcccaaactggttgtctttgaggctgttatttatccaaataaggagaagcagtagttttgctgaccatctcagatttccaagccatgctccctggctggctgactgacttgctatttgaactgaaaacacgaaggtattcctttgaaatggagcagtcttgtggggctcgtgagtaccctagagtcattacttggaagaagattttttttgctccccacatttgtagataacatgaacatggcttggtctatttgacccttctcttgtgactctggcaacactcaatacagatggacctgatctgggacagaaatagtactcattttcagaggttcttgaaccactgccctcctttgaagaggattcaaaggtcagacctccacactgatttcttaacactagaatgcaagattattctagcacttcatagatcctggccctgttatctgacttcaggtaagatatttgaagtctctgagccccagtttgttcatctgtgaaatgggaattataatgtatctaatgggaatgagatgagaattaaatgaggtaattttggaaagcattggtaaataggaagtcacccaaaatattcattttcttccctatttccatcttctcttggcagatttaattgacaatatttataatagagaaattctagataattatgattgctgtccaaaggatttaaccaagctcacagtagaatggagattgtgatgtgaacgttcagtgaccctgcattactatgtccctctactcactaaagcagtggttctcaaagagtattccctgaaccagcaggtcagtatcacctggggacttgttagaaatacagattcctcggcaccacccgagacctactgaatcagacacagtggatgttagacccagtaatctgatttactaaactctccaggtgattctgaagcccaccatctgagagttggagaaccactgtccgagagtaactcactggttgggtcggtagtctagccattcccccagggcacctggactttcctatcccttgtccttgaccatgccttagttcctgcctggaatacctaagaaagggacctctttcttacctgctgaaattctattcatcattcatgaacccactctcacctcttcagaaaagtgttcctcagtcatccccaccataagaacctcattattctatgaactaccagagtatttgtctgttgcactcatttgacacttagcaaagttattcttgctttctcatattttaatgttcacgtacatgccttatttttcctactagaatgtaagttcttcagaggtagaaatcatgtcttacagatcccttttccctcatcagccttaaccctgggctttgtatataggtagctactctgtaaatatatggacccacagaatctcatcattggaatgggccttagagaaagtctacatgagatttcttatttacagataaagaaagggatgttgaccaggcgtgatggttgacgcttgtaatcctagcactctgggaggcctaggcaggaagatttcttgaggcaaggagtttgaggccagcctgggcaatgtagtgagctcttagctctacaaaaaaaaaaaatgttttttaattagctggggatggtagtgtgcacctataatcctacctattcaggaggctgaggtgggaggatcacttgaaccaaggaattcaaggcttcagtgagctatgatcacaccactgcactacaacctgagcaacagaatgagaccctgtctctttaaaactaaaaaaagtgaaaagaaagaaaacaatgttaacacctggaccaaaatgctagttccgggactccccatttggtgttcttcccccatcaccctgctgtgccgactgcggagaaacatacctgggggctttcagagccactggcctggccccaaaactagcaggtgttctcatgttctctgccacagacttcaactaaacccaaggaaagcagatgggttttcaaagctatactcatttaatttataaacctggaacctcttacattttttcataactaatgaaaactgggaaagtacaaaattttcattcataagcctataaaattgtataacaaatggcatcaattcctagccttacacgtgagaatttccccagctcacacactccgtatacttaggatacccatggaacttcttttatttttgaataaaagttcacagtgaagatcattcacagtggagcaggcggctcttctgaacccaggaagaatgggcatgagggcttttttaatctaggtccccatcattgtttttttcatgtttattttgaggaaaaattgaacctggcagatctgtgaattactgtctttcggtgttaccctctgggactattccctcagacaatcctttcttctcttgacacatgggctgatgttgtttggctgaggatcaaaataatggcacaactaaaacacctttcatcagaagtcatccataacataccctttaaaatttgctccacagacacagctcactttatgctgtatgttttttcttttgcttggtaatagaacctacacatatcctactgagatcaatatgaacacagcagaatgcaggcaatggaatgtgtttcctgtagacgggctaagacggtaacccaggtccacagagttggtttcagaaaagctataatcaaagaaggaggaacagtgaaggtagacatgagacaggcctgaaggggttaaacctactagggagcaattggtagtaagaagctgagaccacatgaggctgtgagaaaggagttattacagaaacagacatcctgggatttgagtagctccattgtgagaagacattgacagaccacgaataaatggccatatggtttccaagttgacatctgccattccccaatgtgtttaccaccattttctctcacgggctctgaaaaccatctatcctttacactgcaattgtatagtgtgaaattctacatagatcaacatcaattcattgtttcagtttaggtatatcatatcatcaaactaaaatatatatacattttaattttcatgctgtaatcatcctaaagttatataacactccatctagctgttttcatatctgtcctttaaactgcaattgtagagcataacattctttttttgtttttgtttttgttttgttttgttttgttttggtggtggggagacagagtcttgctctgttgcccaggctggagtacagctgcataatcttggctcactgcagcctccatctcccaggttccagcaattctcctgcctcagcctcccaagtagctgggattacaggtgtgtgctaccatgactggctagttttttgtacttttagtagagatggggtttcaccatgttgtccaggctggtctcaaactcctggcctcaggtgatccgcccaccttggcctcccacagtgctgggattaca

SEQ ID NO: 60242 - DNA, 1092 bp, Homo sapiens
atggagtgaggtacttctcaacagacttgttcatgtttcacaccatggccagaaatcgaataaggaatccatcagtgatcacgcgtgggcaggcatgaggaacatcgttctttgcagaatagcttgcagtgtcctgaagtgcacagcaggtcacacgcaaacaaccgaggaagctggggttcttgctgcctcactgcttagcagctatgggaagctgggtgaggttcttaactccctgcacttctgtttcccaactattcaaaaagacataagacacctgttctatgtctttcactgagttctggagcccatgaaatgtcacaattgagagccctttgtaaactgcaaactgctatgtgattattggagtgtttgtgggtggggtatggtgagcacggggatttaaaatctcttgttagaatatgaagtgtcacaagcaaataaagcagtatatcctatatggcaacatgtggttgacaagttacatagtagtttcaagaactgtcataaagagaaaaataaagtctaaggcgctaaaaagttgtagttgggtgccgcagataacttactagcatccaatctagaaaacattaaaagggagctgtgcataaaagaacaaggttcgtccaggaaatgggtggatgtgcagagatggagataagagaaggaattatttgtaccatctgttgcaagtggcataaaaaagatatcattttacaaactgtaactatttttggtacaaaaggaggttgtccttggcctggggaacatgggagtagcccagcagaagattgagtgtcagtgagaaggacatttttcttttatccatcctacagcactgcacaattattgattgtggcttggaagcgaaatgatttatttaacattacttctctattctgctccagattgagatctttaatcactgttggacccaggactggtcagccaggtctggccactggagggctcagtagagttcctctgtcaaaagatttatagaaataacgctcatcttaaatatagccataagctaaccgctgactggaccatctctttcctgggaattaaataattttggcagcagtctgt

SEQ ID NO: 60243 - DNA, 1016 bp, Homo sapiens
tactattggccttgccagagcataaaaattacttcctgttgaggtaatcctgaatatttcctagcacgtccattcttaacactgactcagaaagaatacattgcttccactttgcttttaggcctagtcaatgaaaggaagagggaaaatgaagagtgggacactttatacactgctgggaagaggaacgtagtaatggctgtaatgtcccaaggtagagaaggcagagaaggatctggtgatgtaatcaaaccaaagcgtgggggtgttagtggttgcacacactcatactgaaccaaactttatggtgagttagcctgaaagagcccttctctggagaatgtgccttccactgagataaagccactgggtcctagatggcaccaggatattgtttaggaaattggcttgtctggttcattagcaggtactctggggcctttggagattgaactccacctctcttgggtgagcttggcgcttgctaaagagcatttaactcatcctgattcaccgcaggattgggctggctttcaaactcctgacagtgaattactgctcttgtaatgacgaatccatgcatgcatgctacagacagtgccctggagcattttgaaagtgaaaggaaattgctgtgaacctggcaggaaggaagagaagggagaggtaaactagacttcttctcgcattgaaccgaccgactctcattgtaacagggtcaacagaagccacctctctctagcgtaatggacatggtttcttgtggttttaccctttgttgcttttttttggagccagggtctcactctgtcacccaggctggagcgcaatggtgtgatcttggctcactgtagcctctcaacctctcaggctcaagtgatcctcccacctcagcctcccaagtagctgggaacacaggcatgcaccagcatgcccagctaagtttttactttttgtataggctgggcctccctatgttgcccaagctggtctcaaactcctgggctcaggggatc

SEQ ID NO: 60244 - DNA, 1025 bp, Homo sapiens
gaagaattataagagccatgtctgttagcacacctcacgccataagacagggtctttggaggatgtgataggggcggcatcgtggcctaatcagacaagggggaccactcctccatcccccttcctggaaagtacgtgcttgactgaagacacaaaacaaaacctgcctaatgtataccagattcatcagaagctgatagtgtgtgcctcccatactctggtgagaaataacaaacccttgctgattagattaaaagtcaagagcttccacattccttctactgttttccgacctcttaggtggcatctgttacaaccacttcatccaaatatttttcctagtgagacatcttaggagggtggcaatgtcacgtgctccatttgcccccttctttaataaccacaaagtgatttgatggcagtaaacagtttttttagaaagcctgcaaaggactggatttgaacttgaaagacgtcatggaattcttttggtcagcaagaacaacctctaaaagccttaaaatgttttaaaaatgcacaggctgcccagagcgtggtagttgggtgtggcgtgaagccagtggggcttccagcccagtgagtggagttccttgtcaccgtattcccacttggatagctttcggttccacccagtccccaagggctcagaaaacatgatggtaatcagagcctgcctgggagcgcaggagatgcttcctttctcccccaccttttgctagcaatgcattaatgccagtcctccgctgagagctgcacaagtcacttcgtgttgtggacacgcaccttcttgtacctgttcccctggaagataccagctgtgctgacagcggttgtagccagaggtctctggggatcgcctaccttctcgtccttcatcttgtttagggtggggcagaagggctctggtttcctttccagaatcccctctgcacagccctggtttgccctctctatctttccttctcgtttcagatgtattttccagggtgattgcagttccttgc

SEQ ID NO: 60245 - DNA, 1034 bp, Homo sapiens
ggatctttgtgtcttttgtgatgattttgtttctgaagaggaagctgtctaaaatattcaagtgtgcaaccaaggatttagatgaagccagcaaacaaaggaatcatgtaatcaggacctgagcgaatgtgcttactcacggcgttagttacacaggtgatttccttaagaaaaagtaagtggctttaattctttgagggtgaaagagtgtcttaagattccatttcagttttctctgcttacttcattgtgtggtctgattgagtggtatgtttacaaattctagacttggaagggtggggtttgaaatacaacaaactgtacataatattccttttccacaagcaatatatatatatataaatgctccacagacatgattacatgaggcagtttcccaagatgattttaaacaaatattttttatactaggttttttttttctggaaacaattttaatatgttgtttcttatcttacgttcaagaaacttctgaatgagtgatattcgatttgacttatggttcttttgggaaataatatatagctacatgtaagaatttctaactcagacttcagatcttaatttgaaatggccccagatattttctggtgtttcagaagtatggtgtaaacagcattttgatccgtgtgcagtctgtgggcagggacacctgcctgtcagcctgctattatgatgaggctcttgaagaaactaccctctttctaagaactggaagaactcaaataatgaagagacaatagaggtttgggcagtaatggaaagaagaaaagacagtgcctagccaagcagatgaatgaggtagaacagtcttgttcatacattgccattatatctagtgcagttgaatgaacattttctgtgtctgggcttaggtgcaggcaaatagttatctgtgttgtattcagataaggggttagaagaatctttatttttctgtgtcggtcatctctttcttgctgtaaaatgaaattgtttaaagcttacattatgacattagtgttgaaattctg

SEQ ID NO: 60246 - DNA, 2266 bp, Homo sapiens
agatgataagattagtagcatcagagagatcagtggcagaataagggactgggatatattaatgtgaatggcaactcgtatgtgtgtatgtgtatgtgtgtgtgtatgtgtgtgtgtgtgtgtgtgtgtgttgcttatttattttctttgtaagtttagtataattttctcccacaaggtctgactttgagtaccagcgcaggaaaaacccagtatgtatttaatgccatgtctttactcattagccaaataacagttaaaaaccaaaacaaaataaatctgtgttggtgacagattctaggaagatctctccttagtaagaatacccgcagcaaaggctgggtttgttttaaactgtgaattatacaatcttaaccatcatgctgcttccatctatcagattctggagtctctaaattctactttttattgcaagtgtgaccttggaaatcacattgaagacttgaaaacatccctccagtgatgtccccttaccttcccccacatcctaagagcgagttgccttaggttggtccctgtcttttatggtaggattcccaagttgtctgatcgtaagggttcattctagttgtggttttaaaacaaatgtttcccactctatattgggatcattgtgtcatttttcttcttgggctctgtttagagccaaggatgaaatacatgatcctggttctttttaaaactccgtcttagaaagtcagtcacagcttggcaaaccaacataagaattctgccaagacttccaacatctaagtcacctgtgttgatagagacattcaacctcagattaccaattctgtcacaaccgaatgtttgtattcagcgccactgtggataactcagattgatggtgactctttcggtgacccttttggatgatggcaagattattttgaagtggacagggcagggaagacacacaggattagctccagatccgggctgctgactgttcatggcaagcagccgtcctcattggctgaggtcccattctggttggttggtgtccatgccatactggatattagctgtaaaatatttcgactatcactggtgtttcccacatgaatgcccaatacaatgtatcagaattacttttagttaattgttatatttctttctaatctcatctatacataccactagtaaatctattgagatattctagttagatctttaaatgtttcattttaaaggttatttatatatctcctaaccattttttgcatgtcaccaagcatgtttttaaaatacctatgtaaatacctttgctgttttcaaagaaatgtactcaactttttatgaatttaaataaattttacattttctttttactaatattatttatccttctggacagttctatactctctagaatattttattttattttattttactttattttattggagacagagagtcttgctgtgtcgcccaggttggagtactgtggtgtattcttggctcactgcaacctccgcctcccaggctcaagcaattcgtgtgcctcagcctcctgagtagctggattacaggcgcatgcactgcgcctggctaatttttgtatttttttatagagacagggttttgccatgttgcccaagctggtctcaaactcctggcctcaagtgatccgcccacctcagcctcccaaaatgttgggattataggcgtgaaccactgcaccgagaccctagaatcttaatgtccctttttacactcctgccaaaaagaggaaagcttctgctggttaattgggatcgtagtcccccagataaagatgtactctgaaggtggctaaggaaggaaaagagaacagggaatagtgactgacctagttaggactgttgttcataccaagagggttctagatattatattgattgattgattgattgagacagagtctcactttgtcacccaggctggagtgcagtggtattatctcggctcactgcaacctccacctcccgggttcaagcaattctcctgcctcagcctcccgagtagctaggactacaggtgcatgccaccatgcccagctaatttttgtattattagtagagagggggttttgccacgttggccaggctggtctcgaactcctgacctcaagtgatccgcctgcctcggcctcccaaagtgctgggattacaggcctgagccactgtgcccaggcagttctacatattttaaatatttttctggaattaataacaataatgacaacagtacctaccat

SEQ ID NO: 60247 - DNA, 1271 bp, Homo sapiens
tctggtctaaagcactgagcacctgagtcatgagggtgtccaatgagcagggaggtcctcatgggctggagcatcagggcaggggccatgcagagcagacgcacctggagcctgacctcgaaccttcatatggatccccaagaactagcacatggggagagagaccctggagtgaggacagcatcaggatatcacaagttaggtttagagaagggagaacagattagcctatcataatgggagctctgtgtgtgttttgggaggggagtagagaggaagtggagataaaattgtaattgtgagggaggagcctgcatactccagggggcccagaaatagcccctataggagccaagaggccaattccgtggtgcccaggtcatgtattcaaaaagggctcccttttgttgctacatattagcaccttatttgcacttctcattggtcactttcattatgaaatccacttgtctatgtaaaacttgcagggcagggattctacaccgctggatccttccaggagcaagataaggaagccatgggagtcccactggttgttcctgcattcttatctacgaagtttaagaaagaaggtgccctctccatggcgcttgggagtttccatggaacttgggggcttctttagaactgtatcctagaataaccccaggcacttaccaagtgcttggtaaatactctttactacatgcagtgaatttttgtgataaagaagcagttagtttgtatcctgtgcattaggctctgtttcattttcaaccttctcctggtgcctctactatccctactgtcttccacatcatccacatcatggggtctcttggctgctcatcttggttcttgccattcaagcccccacctctttcctcgggtccctccctcatccaccctccaaccatttatacccttcttctctgtcacatctcctggaagtcaggatagggactgtgggctcctgtgacctcaccaatagaacttgaagaatggatggagcctgtctctccttccctcagttatttggagaatctcagtggtcatttccccactgcaccttgaccaaagcaaaaatatatgaaatcatcatatcctgagttatttttttttttattctactcccttgctaaacacagtaacatagttgcaaattacagttgaccattgaacaaggtgggagttagggatgctaagtcccccacacacagtaaaaaaaaaaatcagtgtagaggccaggtgcagtggctcatgcctataat

SEQ ID NO: 60248 - DNA, 3011 bp, Homo sapiens
cttcatgttgaataggtgagaaggaggaagagaagggcttggccttgctctctcaggagtggcaggggagggaggatatctgtgtatcagtcaacctgcacagttcaaagctgtgttcttcaagggtccactgccattgtactcttattgcttaattatttccttccagcctctccatgctgatttctcataggctcaaatgaagagttggtgaatgaatgaaacttcccttccaggttttcccccatgcatctcctttccccctgctcatctccctagattgtatccactttgaaagatgggaaacatggttactatttcccagggctaacagtagaaaaacgtgctcaggacaagttttagaagactcagcgtgagcactattgatacactagacctgcatttattaagcagcatctctaagaagctgtgacattaaaatttaagccaccacactattttttcctgaaatcccacaaaattgcactctccatcaggtgtattcatttcttgtggttgctgtaacaaattaccataaatttagtggcttaaaacgtcatgatttttttaaacaccataggtgtatcattttacttttatggagatcagaagtccttaatggattttgcacatcaatatcaatgtgtcggcagggtcatcctccctctggaggctccagagtgggatccatttcctcaccttttccagcttctagcagctgcccacattccttggctcatggccccttctcatagcaccttccaaactcttctaaccctacttccatcagcatagatctcccctggagctgatttccctgcctccttcctccgcatataaagacccttgtgattgccttgagttcaccaggataaagatctcccatctcaccatcctcaacttcaccccatctgcaaagtctcttttgccatgtaaggaaacatattcacagattccaggatgagggtgtatacatcttgcaggggaagtcacacggttacacactgagacttctcttgaaacacgaatatcaaagtcaactttctgatcccttgttttcttttcagatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccaggtaaggtgcagtgagggtgaccgagggtggtacctgggcccatgtgtcactgtgggcagctctacaggggtcaaaccgacagaataaatgtctgagcacccatctctgcagcatgtcctgtggatgctgcaggagtcacagagtggtgtcaaagccaccattgtctgcaaatagtttctaaattggcaggggttacagtcattaagccatgttcaagaagacaggtgcagcaacaatagtaatcagtcccttgtgcctctggagcatggatctaagagcattatcatttgtataaatctgaataatttggaagaaaattgtcattagcagaagacagatgaaaagatcaaaaggtcataataattgatctgctactgctgaaaataaggagtgagtgttttcagttttaactgttggaaatggcagtttgtgtttttccttgtggaatacaattttgttttctcatctggttgtgggaagtggaaataatgtgtctgttttctaggaggataaacatctgaatttgcatgaaaatagaatggcttagatttaatatttatctaggagtggtgctgaaatcagcaaaatttttccagggaaagactctctggggacttgaatttctttttaaatagacatattttataatttaccaattcagaagcttcctactctatcttgaaaaccttccaaagttcatatagtaatagaaaagctaattttgataaagggaatttctctagcctgaattggttgaaacaagtcaacataataatcataaaaatctagccaaagaaattgagtccaaagaaggtttaagcatgctgctacctattgttatatatgaatcaaggggtatgaaaaataagatgtccaggccaagtgcagtggcttacgcctgtaatcccagcactttgggaggctgaggcaggtggatcacctgagctcaggagttctagacaagcctggccaacatggtgaaaatccatctctattaaaaatacaaaaattagtcgggtgtggtggcaggtgcctgtaatctcagctactcgggaggctgaggcaggagaatcacttgaacctgggaggtggaggttgcagtgagccaaga

SEQ ID NO: 60249 - DNA, 2747 bp, Homo sapiens
tgcatataatgttgagagccagaatcctacctcccacactgacctatcctagataaaagagcatcaggagcttgattttgccatgaccatattgaactgtttccaccccggttcttggatgataaaaacctgaatttgcatgaaaacagattagtttagatgtaatattcttttgggaatagtgctgaaattatcaaaatttttggccaaccaaagatggtgtctgccttctttccagaacctagctcagtgtcatctgtgtgattaccacgcacacacaacttaatgtacatccttgagcctcacttttcaagacgtttagttatggagagaataaaacaaaccctctgctgacctgtggagtcatctctgtatgggatcaaaatcttgaaagattttagcttttggtactatgggtattctttgagagcctccactcccttttttaaaaaagatctgccaaccctagagacttccattttgtaaaatttcagaaaattctatggacttcagttttacatgttagaaaacctttttagaaaatccaaattattctatttccagattaacaatataagaaaaactgacaaaacagatgaatattcacctaaaatacagtcattatcaccagtgtattctgacatatgattgtaattatgaatgtaattttacatgttcacatttttcattccccataatgtaaaatagcacaggaaaaattttatctcatacatcttgccaaggtgactccccacctgtaatcagcttatctccagagggtggaattggaatgcttgggtatatgtgggccggttagattctcttttcctagagacctgcacatagacacacagacacacagagacacacacataccacatggacacacaaagacacagacacacacagacacacgacacacacacaagacagacacacctacacattctctctacatttagactcactattgctgaaagacctaaacactccccgctaactcccctcagtcacatgtcaaaggtgaagaataattctctggtcaaaagaacttgagtctggaacttttgccctcagcactcctacatgcttcccccattgtttcttacatgggacaaagtgacaagggtgaagctcatgccatacttcctcctccaaggacagctcagaatctggccctgaactcttttagatatcttggtaactaggctgacatgtagcattcctggggaatgtataggaaggaggtgaatggcacctatcatttattgagagccttttatgagccaagcactatgtgaagtggtttctatacattatatgatgtaatcatcatgacaacccagtgagatatgtactatcatcatctcctttttacagatggagaaactgaggctcagagaggttaagtaacttgcccgaggccacaaagccagtaggtggcataaaatgtccaggactattaaagaattctacatattccatgctgtttaccactgtgcagtattctgccttgcaaatgagaactataagccccacctccacacaacagagaagttaattcaggagtgaattctaaacatttcaaccagaattcttcaaaaattgtttcaggactagatgctaagtaactgctcctaaaggatatttacaatcataaacacagtagaatttgcataattatgctgctaaatatacacatgccattttaaatataactgccctagctagtatattagcacaattatgcagaaataggggaagaaagaggacagcattcttggtagacttcatttttttaaatgcatctgagtactatgtcaaagaaaaatgttaaaaacaggaacatcagaaacaattaccgaagcacaaaattataatccattgtctcatctataccatgatgttatttagaaatgcttaatctgtgtaagtattgttaaagaattttcaaccccttaaagcttaacttcatgagcacagggtcgtataaagaaccaatccaatttctgttgcaatttcataatattaaaaagcaaataaatatgagagtgtttttcatatgagagtctcaagtgacattttacatcgaagatgtgaagctgcaaaaacaccagtgggaggctgagaaatcggtggctgtgctttctgttggcactgctgggttcttatgctgttctgaagagcacttcaatatagtagcccaaataactgtgggatgttagaaatcagagggaaaaattcttccttccacatgcatactttgaagacatccagtggtagcttttttgaaggaacatgatttggtaacagctctgttgacttgaaaatagctcactcaagactaagtaattgagtcttcagtcttatatttagtcacataccttgtgctaatgaatttggcatttctttctttctaaagatgcttcaatgagcatctagtaataataaattgcatctagaatatctgaagaacacagtgtctatggtataacattcttgtgatggtaggggtctcctaccagggactttggggtacagtgacagatcatagctgctttgactttcagaacagccattctagtgtctgagcttctagaaaagaaagcaatcttgagtgatgaagtggttttatccaagtgacttccattcagctaggactccaagtagagaatagtcctagtgaccaggagagactgcccaaggagaccatgtgtgacaaatggcttagtgcctgaggctctgtc

SEQ ID NO: 60250 - DNA, 1051 bp, Homo sapiens
agtaacaccattctgagttagaactcaaggtcagaggatggctgtaaagattttgaggctgtatagtgccaaatttctgtaggggttgtaagtatggatgttgaagctacaaaggatggcagctggggtatggtggatgggagcaccagggatgggaggggatttcctgggtagtggtagggaacttagggatgagatagtcaagaattccaaagcaggggagatactgagacattagacgaaacaaaatattgaagtgctttttaggggagacagaacgtagccagtcttcttgctcatgccataagcacagggcccggggagaagaaatggcagccctgactgcccactacaccagtgtctcccaaatagatctaaatgtgtcaatgagaagttaaatgtattgggagtttggggaacaatgtctttagttacacagcttttccaccaataggttaacttctggcagaaatagaaaggtcattgcttagagtcacatttgaagctttaccacaaattcagacaatttaaattcctttgttttgttgaactcgtctgaaaacagtctttaattactttgggtttttttttcctcataccagagtcagggcatgaacaaacaagggcatagcctcgctttaaacctgttcactattgcatcctggaaaaatgccttcggcactgccaagatcaaagagttttagttcaggtagattgctcctagaaaaaaggaaattgacattgtcaaagaaaggcatgcctgggaaaggggatgcagtgcctctgctgtgtccacggcagctagcatgttacctagcacgtattaagggctcaaaaatatttgttgattgactctttggccatgtaacactttctggggtggggagagagatgacagggaatgagcaggaatacaaagaaaaaaattgcaaaatttagaactagaagcaaatggcggaaccacctagtagggactctcagaaggccagaatactgcagttgttactgactacagtgggttgaggctgcagtgagctatgatcattcgtgc

SEQ ID NO: 60251 - DNA, 2320 bp, Homo sapiens
aaaacctccaggctaaagttcctatgacattagatctaacatcatctaccttcaaataaatgggttgttttgttttgttttgagacagagtctcactcttttgcccagtctgtagttcactggtgcaatcttggtagcagagacagggtttcaccatgttggccaagctggtctcaaactcctgacctcaggtgatctgcccacctcggcttcccaaagtgctgggattacaggtgtgagccaccgcgcccggccgggtttcagtcatatttctccatggtctaaagaagagacatgtttgtgttgcccctaagctgtgacacaagtgttactacccacacagcaaacagctccatcatttacaccaaaaccactccgcagcctcccagctgaggtgtacggcatagaaatgtgtgcagctaggtgagatctggcctgggacactgcgaatgctagggaacagcccttttgtgcaaggtgaaagaaagaaagcagggcagaaagactcaaaaacataggatgtgcaaacaggagtgtttccgagggagatgtctttgagttggtccgtgctgtgtctttttttagccagtcaggtcactggcttgatactgaacactgatcacgaatcttgacctgagctaaggatgtgcggctcttcatgttcctgagccaggttgggtgaacttccacggccttctaggtggtaccttttataaccctcaggtggtgcattcacccggacaaactggtttgaaagtccataaagctttaacaaacaattctcttgttttacagagagaggatgcaagccatggagaaacagattgccagtttaactggccttgttcagtctgcgctttttaaagggcccattacaagttatagcaaagatgcgtctaggtaaaaaagaagaaagccaatgaaaaaaataattcaatctgtttctcttttaatcattaagataattcattcattcaaatctgttttcttgtaatcatttcaaggctgaaaatattcacatctctatggatcatgggcgttatttttttgttttggggggtttggttgctttttttctttcctccttctggtaattcttggtcgaaagtaacactttggcccaagaaggtaaatgggcttcccagtgcatgtggcttcatggaccactcaccgtgcagtgcctgcaaccaccacccttgcgtgtccacgtcgccatcatctgaaagtcacaagtgagcctggctgcattccacccccagtgtcaggtgcacacctgggaagccttttccatcctggccaattgtgatgctgatgctaaaataccttcattgcttaatcccatcactgccaattgcttcaaatagtggatggaatgggctttaaaaaaaaaaaaaaaggcattttggaaactgcatagctgactctctttttcttttattcagcgagaaaatgatgaaaaccacagccaacaggaaccacacagatagtgcaggtaagtaagtgtttttggagctgtaggaggcctgtgggctgcctgggatgagccctggctggtctcagaaatgtttaacatttccctaagtcacgtatttggtatgatgtcaggggattcctagatattcctgccaatactgaaattccagatttattcattaattcgggggcaaagcactgtattctcccttcggttttcattcattcgctcattcatttgttcattgatatggccacacggtggtcatcttgcagacacggggctgcctgcctagaacttagaattcagtggggaagatggaaatgggacaagtaattttatgtgtgtcaagtgtttaaaagtgcaggataaatgtttcaccaataggactagcctataccaagggcagtccccagacaaagtgacataaactaagcccagaaagatgaagaggacttagggggaagaagggttgtccagtcaagggaatttaaaattgttctaagtgcaaagtgaagccatcggaaggttgtacactggggaaggacatcagcccagctgcaatatggggatggatgagaagggacagtagccaataaggaatgaccagtgtccagatgggagaaaaaggagtacttggactagggcctactttttattttatctttttaatctcatgacagatgacaaggcctgctttttaaatgccagcattccccagaaagacagcccagttctgttagtagtggcgttcactagtatccaggtctttgcaatgaatgtctcatccagcagtctcaagccaggcctctgcaagaagatgaggtcttccctctcatcgggtta

SEQ ID NO: 60252 - DNA, 1047 bp, Homo sapiens
tgagtagatagtggtgccactggctacaattaggcccgtattataatggacattggagactcagaagtgggcagggtgggaggggatgagggataaaaaaaactacgaattgggtacaaagtacactactcaggtgatgggtgtactaaaatctccgacttctccactatacaattcatccatgtatccaaaaactacttgttcctcaaaagttattgaaattatatatataatacaattaggcccacagagacagaaagagctttgtggaagacgagtggaaataatgaatttgacttgtttatggaaaagttcagtagtggcgtgaaggcgttagtatgtggatctgaagatgattgtgtgctgctgacgagggtgcgggagaccttggtgggtggtggtagcagaagtggcctccctagaaagtatgtccagcaagaagagaagtggacccagggacacaacatatcaggatttaaaaggttggcagaggaaggagttagaaaagagattgaccaagacggagcagcagaaagggaagaagatcatggaaagtttcaaagtgactaaaaggaaaagaagtggctgacaaagcttagtgtcacattgaagcaaaggagagagtccacaggggtgacaactagaagatcgctgaaatgaacataaagagccatttcagagaatgaaggagctatgacatgtaccaaatataggagattaagaggttatagatgaagatttttttaagtgagtatagattccattaagaaatttggttgtggcttggcatggtgacccacgcctataatcccagcactttggccgaggcaggaggatcgcttgaggccaggagttcaagaccaccctgggcaacatggcaaaaccccgtctctacaaaaaatacaaaaatattagccagatgtggtggcacatacccatagtcccagctttggaaggctgatgtgggaggatcacctgagaccaggaaggttgaggctcggggaattgcaccgctgcactcaagcctgagtgacagagcgaaaccat

SEQ ID NO: 60253 - DNA, 1050 bp, Homo sapiens
gttcgagacctgcctgggcaatacggtgagaccctgttctcaaaaataaaaaatagtaaacaaacaaacaaaaaaccttatattggaaaagcacagctggagataccgttaacactttgttttatacacttctaagcttttctctatgcaaacctgtgtgtttaaaaaagctctacttccaggggttaagaaaagaaaaaaaaattaaaataaaaaaaaaataaacaaaattgatcaattgatagaacaatcagtggatagatagataggagcataggcagctctgtggcctgtcttcctatggcactttcttactaaacttctagaatgtgatcattgcacactgcataccataacactgtgtgattcatatatatgcatattttttgtaatgagagaattaggcctttttagaattaccagtcatctgcattgggatgggatgcatagcttagactttcctttgtggccttctgagttctctgatgcacttttctcataggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccaggtattcctcatgcacggcggcctctgtctcggttgccctgagctcttcctaccttccttttcctaggggctccgtgaagacctagagaatgtagaaccatagaaacagcatggcttcctctctcacacacacaatccaagtctagagccttccactgcaactatagtcaatctataaccacttctttttttttttttttttttttttttttttttttttttgagacgtagtctcgctttgtcccccaggctggagtgcagtggcgcgatctcggctcactgcaagctccgtctcccgggttcacgccattctcctgcctcagcctcccgagtagctggaactacaggcgcccgccaccacgcccggctaattttttctatg

SEQ ID NO: 60254 - DNA, 1049 bp, Homo sapiens
tcagagggggcctatcggctcccaagttcgttcttacctggggctcctggaggtcaagcccttcccttcactgctcctgccttttggcaccatctgctggccatttcgaaattgttacctcctcattgcgccctttaagaaaaacatacatatcatttgtatggaagtacctaactgctctcaaaagtgagcatttgttggtttggggacagggatggaattgctttagcataaatgccgcacttcccctgggaatttcacaggcgttagaggtgaatttgataccaaggctctcttgatgtctgtagctacagcgtcaccccatcagtggctggcgtagtttggtcctctggccggctgggagggatctctcacacttgtctcgccttgcaacccttgaactgtgcagctttgtgaaaaagagcagttttcttaaacaaagaaggtctttggtcaaggtctaggaatgctgtgttaaccacacaagtttctttattgctccagaactactcaacttttctggctttctgggaataaagaacagtgagcaaatgtgcttttgagcctgggaagttgggcagttctaaagcgcagactcgcagggaaaaataagcatggtgtttcctaacctggctgttactgtttctacctctgcatttgtattccctgggtcccattcagctttcctccccatcaaacttctgtcttttcaatcgagggagtctacttaagacaaaaacagcttagaataattaagctatctcggcaccaattctccttcaacatgtgcggtattatataccaaaaatgaactgcagccgcacagtggctctaagtccaataatggagctatcattagagatatacgaaacactagactagtctcaaaagaacaaaaattgaattagaaattcaaatattctttgaactgtgttataaaatagtgaaactgaataaaaccatttgtgcttggcagccagctccagtaattagataattaaatcattggaaaatcctagactgtagagcatatcctatttgagcatttc

SEQ ID NO: 60255 - DNA, 3534 bp, Homo sapiens
agtttcccatgtgcaacagacccgtgtcccctgccaagcagaaataataaacggaactagtacagggcttgacgattaggctgcttacaatgtgccaaggtctagtcagatcttcagacaacaagaagctttctaagatggggagacagcaccccaataacatgggttatatagctgtgaccaggcatcccttgtcttgttccctgaagcctgcaggaacagatccaggtgggatcaggagtcgttctgaggtctggctttcctcctgaatctttctgatttgtggtataaccactgttccatgtcactgctagacagcaaaatcagtccaattacattatccattgttggcaagactgatagtcttagattttacctaagaaatcaaaattgagtatgtgagatataggtccattttcaggttgggggaattaggtttaggcatttgctagtttctccatgaagtgatttggataacttatttggtccaattaaaattttaatggacaagagcattatttctgtctcttattttacaagagtgcttataaaaatggcaaagcattttcaataaattatctttctagctatgaggaataactgcaactctacttgccctcccactgtgggcaactagaaaactgaaaaataagcaaatgtatgaaacaaatgttttcagaaattaaacaacacaggaccgtaatccttaggagaatggggggaaaaaacctacagttgacccagctttctgtctggaggcacttttcagatcttggtgcaggaaggaaaaacccaagcatggcactgacagtgagttgaggagataagaccaaagtttagagagagctgaaacagctagaactggtggactggagaaccaaacacaagaaagctctgcagagaaagaagtacatcaataaatgggtctgttattaaatattaagccaagcatgtacagtgtgaaagcaaccgctaagccaggcagaaactaagtcgggggctgtaagccaaaaagttcccgaagttcacacaggcctgggagatgttcacgttttgaaaagcaaaaagcgaagaggccttgttgagcacctgggcattttgtagagatcggagaaggactgtgcctcagtcttaggactaaactagccccagaggaaagactacccttgatttaacctaactgcttaaaaataagcctttaaaggacaaagctgatccacaagtaactggactgtctgccagagaaagtccaaaatctgtaaaggaaaacaacaaaattcagagctccatgcccaatatccactcaaaaattactagacatgtgatgatgctgacaaatgtgacctataacattaagaaaaatttgtcaagagaaaccaaccagacatggcagggataatgaaatcagcagcaaggacttcaaaacagctattataattattctcaaggatttaaaggaagacatgaacataatgaggaaagaaatggaagatataaaaaatatccaagtggagctttcaagagctgaaaaacaatatccaaatgtgcttaacagaagattaatcactgcccaaaatgtcagtcaccctaaaaacagcaatggaaactgttcaaactgaagtatagagagacaagagactaaagaaaatgaattaaaatgtagtgaccagtgagacaatattaataaaagatgaagtggaaagagaaaaatattcaaaaaggtaatgactgaattttttccaaatttgatgaaagctgtaaatccacagaccaaaaaagctcagtgaacccctagaatggtaagcacaatggaaattgcaccaaagcacatggtagtcaaattgctaaaaaccagagataaatggaaaaatcttcaaagcagctgggggtggagagaaaacccattacatacaggaatcacaattaagaattaatgccaacttctcatcagaaacaaaaggcaagtcaggacacagtggaatgacgtctttaaagtattgaaaggaagaaaagtctttcagaaaacagagaatacttcctaactcattttatgaagcctgcattaccctaagagcaaaaccagacaaaaatattataagggaagaaaaccacaaaccaatatccctcacgaaaatatatgtaacaaatccttaacaaaacgttagtaactgaatccagcaatatataaaaagaataatacattatcctggggttttattccaggaatgcaagattgttttaatacgaaaaaaatcaacgtatttgaccttattaacagaaaaatcgtatttcaataaatgcagaaaaagcatgtaacaaaatttagcatcaatgataaaaacagcgctctagaagtagaaggaagcttccttaccttgataaacaatgtttgtgaatgacctacagaaaacatagttaatggtgaaacactaaacacattccccataaaatcaggagcaaggccaagaaacctactctgacatctgtttaacactgtactgaagattgtagcaagttcagtatggctagagaaagaaatagagtcacacaaatcgaaatgtaaaatgtctaattggctttactcacaaatgacatgattatatatgtgtaacattaaatggaatctacaaaacatgctactagaaataagtgacttgagcaagatcacaagaatcaagtcaatgtacacaaatattaaaattttgttatatccatttgtacaatgaaatgccacttagcaataaaagaatgaatcactgaaaaactcagcaacagggctggatctcagaaaaacatattctgaacaaaataagctggacacaaaggagcacatgttatataattccatttttataacgttctagaacacaaagaactcatctataatgacagaaagcagagtggtggtttctttgggctggggcttggggattgattgtaaaaggtctcaaaggaattttttaggatgataaaatatatagctgtctttcagcagtggttacatcagtgtatacatttgtcaaaattcatcgaacggtgcacttaagatggatatgttttattgtctgtaaactttgtgcctcaagacagttgattttaactattgaaatgtaggtatcacctcttaagcaaaaaccaacttaacaatttgagcttccaaaaagtaatttacttgaagcatttagagaaagatggtgatccacatcatatctttagcacttttttacactgtgctcagataagcaggaactgtcctgcagcctggagacagtggcaagaacaccagacagggagggcagggggactgggaaagcagacagagaacctatgtagaccttgttcattcatgattcactcctcattgcccacgtgccagccggtgagctatgacagcttccctctttagtaccctcagcaggatcctgtaaggccccgctttctagacaggaggataataaagcctaggattgaaacagagcctctccctctcctcctcttctagtggagtaagtctagttgtgtttaaacattatg

SEQ ID NO: 60256 - DNA, 1043 bp, Homo sapiens
actaagtggtaaaactggaaatcgaacccaggcagtctttccccagaggccagttcatcaccatgcagtgctgatgttgggacctaatggtggttctgcttgtggcctgtgttgaaatgttttatctttattcagagaaaacagaaggcatgatgtggctttaagcaggtggtgacatggtcagattgcatttcccctcaatttacatggataatggacagttgacaaagacatcatcacccccatgagatgataaaccagtccatgaaaccggaaaacaggaaaccattgaaatttgttaaatgatatttcagtggaactttggggataatatactaggcataatatcattattgtgatggaggctgattgagtgaattcactcgatggagctgctgttagaaaattgtcctgctccagggactcaagtgctcaaccagactcctgcgaagcctgaataaagctcccacctcctatattctctgggatgagaaacaagaatgttctcggaactgtttggaaattgtgagttctgtatacaggtagcctacctccaatctagagaaattcataaattgccaaaagccctggactcatccagaatcattatcattgccaacattaaagtcctatgttttaagcatctgtgatttcatggtacttggtacatggaaccatgtgaacgaaaaggacacagatcctctttgaactgatactgacgtatttcatagccaaatcaccacgtgttgagttcccattctacaccatgcggtatttcatgtaaccctcaagaatggccaaggaaagtggattccccatcattagaggtaaggaaatgaagaccaagggagtctaaataatgggcccaaagtctcacagtgggctagagagagagtatgggattagacccaaagtcttcttggctccaaagcaggtgccctgtgctgctccctctaaagatacatcagtgagagtttacgcctgttgtccatgatgcattgaccagagtagaaaaaggatcctttgtcttgcaggcagtctgg

SEQ ID NO: 60257 - DNA, 1037 bp, Homo sapiens
ggcaatatagcaggaccctgtctctactaaaaataaaaaattagccagctgtggtggcatgcctctgtagtctcagctactcaggaggctgaagcaggaggatcgtttgagcccaggagttcaaagctgcagtgagctatgactgcacctctgcattccagcatggatatcagagcaagactcaatctctaaaacaagaaagaagaaagaaagaaatggtttgttaaactcaactgaggtggccttgaagatggggagattgcatcagcagaggctagagatggaaggacttccaggcagtagaaccctgcaaaccaacaagtttctggcctggaaaatgcaagatgtctttagagaactggggagcagtccagttaggcagcagagttgggtgcaagatactaataacatcccatatttggggagtgtcattcccatttgcacactgacttcctgtatcttagaccatactcaggcctcacatacctgcttgatgcctgtctgggctgtgcctacagagattggaagattctgtaagagaaacctggatttctggcttttcttgaaagttccggggttcaaccccagattcacaatttctgtggatggggcttaggaatctgcagtttacaaacaaagccggtgattctgaagcactttcacatttgagagttactgcctagaatgatgaggaagacactgagtgtttgggtttgtttggtttttgtttttgatcaaggaagtagcaaagctagagctgtattggagagaggtccctctggtgatcatgtgccggactgattaagaggaaaatagatcagtgactaggagaccatatgggaagctactgtatccgtcaggcaaaaggcagtgaggcctgaaccacatagtagaagtaagaaagaagtcaaatgcaaaacgtcctatggtattcaccgtctaagactagctctcaaaattcttctttaaaacaccttttgaaatatatatccttttggctgggtgcagtggctcatgcctgtaaccccagcactttg

SEQ ID NO: 60258 - DNA, 1023 bp, Homo sapiens
atgctgaagttgaaaagcctgatattaaccactgtgggcttcttgttttactgcaccgcaggtcggtctccctctctctctctttctctctttctccctctctctcctaccccaccctcccacctatccctccttctgtccctctgttggcatcagcaccactgaataaaaagactcggtcctctgttagccaggcacaatcgtccctttggccaatgtagaacattccctggaaaaccctccttgtacctgcctcacaccactgcaaaatgttcccagccactgttaaaagatgagcgacccccctccaccaccaccacacgaaaggcaggggggaggagctggggctctacacaaaatcagaggctgagacgggcactcggcccctcctcttcctctgtgaggcctcgtgttcagctctatgtgctggtgtccttgctcccgcagcgagttggaagactttgttgaagacttgaagaaggactccacggcagccagccgattggttactctgaaagacgtggaagacggggctttcctcctgcgtcaagtgggagaggctgtagctaccctgaaaggtaaactttctgctgggtcgggggaggagtctgagctgtctttcctgcggtgtttaaaaatctgccacatagaggattcattcatgtatgcaagtatttattaaacgtctacatgtgccaggcattgttctggacacttgggataccccacagcacaaagtaggtgcacatccccctcttcttggagctggtattagagtgggtgctgtaagatttcacactaaatgattccagtaacactttctatttgctaggctcttacagtgcaccgggatgcatgtgccaaacccgttaaaaacacaaggtgggaggatcacttgatcccaggagttcaagaccagcctgggcaatatagagagactcacatctctaccaaaaaaaaaaaaaaaaaaaaaaaaatatatatatatatatatatatatacacacacacacaaaaaaaaatt

SEQ ID NO: 60259 - DNA, 1346 bp, Homo sapiens
aggaattagaatgtgggcggcccacccaagatgcttggcagtgaaaggaggagggaataagcaaacttttggcttagaactaagcatatttgagggctgcataggccagaatcaggcggaggagttagagaggctgctgttagactcatgattcattttcttctacccaccccccaaacaatgatggagttgcaagggtctgagcacaactgcaccagcagaaagggatatgtctatacatgtccctaagcggctactctgagctttgggatgtgtgactctcacctggctttgggatgacatagcctgcaagtataccaccatgagaaagtgacatgagggttaatgccgctgtgcatggtttctcctagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgaggtagagtcctatttctgtttctcataaccccataaaggagtctgatacatggacctttcccttaaagcatttataggtcagatgatgacatgattgtgtatggatcagagacagggttttggaagtggaagtgggattcagtggccaggttaagagataggtcatgtggtttcagagaagggtgagacacctggcctgtaggaaggtgagacacctggcctgtaggaaggtgagacacctggcctgtaggaaggtgagacagcagtgtgctggtaaatgtttaacaaccagctctctggtagcggttgtggcggcggggtgggggggcagagtgggtgcgtgcagatctgtgtgtggcatttgccaatttccatggtgtaaatatcgcaaccatggctgatttcaagttatgacatgacaccactactgctgaagttgggagaaatgtaacaatcagctctcctgggccaggacaagccggcttcaagcactccactgaggtgaaggcagcctggggagggtctgccacacat

SEQ ID NO: 60260 - DNA, 2679 bp, Homo sapiens
tggtggcgcgtgcctgtagccccagctactcagggggttgaggtgggtggatcacccaggcccagggaggtcaaggcttcagtgagccaagatcacgccactgcactctagcctgggcgacagagtgagaccctgtcttaaaaatcataagatcaaatgacatattatgtttttaaatattctttttatcaagggctggtaccagtgctccgataacacatttgtcttttctacttcttttttcttcttgcctcgtaacttttcctccactcatttgctttatcacccaacaaccttgtcgtaaccctcctgcctctactgaaagtcaccagtggagaggtcaggttgggtatatcgagacgacctggcaaaactgccacagccacggtcgcagcctcggggcctctgaacactaggtggtttctctgtgtcgcaagggccctggcttgcctctaatcagagccagctattttaaaaacgcatatcacaagggtacagaaatgtgattgacagagtgtgattctattcccagtacctagtagggcaggggagggaaagacatttcctcctaagaattggcagatccgtcacttaagacgtcttgccactttaaacatctcaacatttaaaggatgtcagtatgatggcactcttatttaacaaatctctgttgagaacctagtgggcatagttatcattgtgatgtgtgtattttacgctttgagaggagacacgagtcatctctgaaaatgccctgatccacaggtatggaggcctgggtttttctgccagctctgccactgacaaatggggtgagctttattcattcaacagagattactgagcctgttatgtaccaggccctcgtaggctcgggggaaagccagtgaacagaagagacaaagtctctgccctcaagacacttacctacttgtaggaagagacagaaaaaaagtatatgccaggtggtaataaatgctaggaagaaaaaataaaggagggttagaatggtgaaggtggtggctattatttatatgtaatgaaacttgggcaaattctccatctcgctggacctcaaagttcccatatgttgattcaatgatctttgccaattcttaggttataaggttccactaatcttggtgtgaatttccactctgcccccttagaattattaatgtgctggttcaaaagtcacagaaaacattcttttaaaaagtatgcagatgttttaaaatgcattttatgtataactctctgttgtggaacttaaaggagtttacaggtcatctaaataatacctcctccctcattttataagtaggacaatgtgacccagagggcatatagcaattctttgatagaagtggtactaagacacaggatttttgttcttagtgttgtgggttttgtttgtttgcttggacatctcttctacaatgaaaactcaatttaaaaaaattttaggctgggcatggtggctcatgcctgtaatcccagcactttggattataggcatgagccaccatgcccagcctaattttttttttaattgagtgagactcatgtctcactcagggcagaaggattccttgaggcaggttgtttaagaccagcctgggcaacgtaacagaacccattgctacttaaaaaaaaaaaaaattagccatgtgtggtggctgaacatgtgtaatcctagttactcaggaggctgaggcaggaggattgcttaagcccagatgttggaggctgcagtgagctataatgacaccactgcactgcagcttggatgacagattgagaccctgcctctaaaaaaatacatcttggtagtagaaaaaatacttttaaaagcatcttttttaaagttcaggggtacaattgcaggtttgttgcataagtaaacatgtcatatgggtttgttgtgcagattatttcatcacccaggtcttaagcccagtacccattagttatttttcctgatcctctccttcctcccaccctccaccctctgagaggtcccagtgtccgttgttctcctctatgtgtccacgtaacttcctttacgtgctatattcctccagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcaggtaagttccggtcccacagcaggaatatatggaggtacatggctttgggcaaatacagtgccatccacgacagcacatactcatcaacagaaccaatgtctcagttcttacaaatcttacaaaatgtaaaacctggaagagcaaatcctctggtgttccttagatctttactactatctctctctttttgttttttttttttgtttttttttttgtttttgaaatggggtcttgctctgccacccaggctggagtgtagtggtatgatcttagctcactataacttccaactactgggctcaagcaatcctcccacctcagcctcccaagaagtagctagggctgtagatgtgtacaccactgcacatgtctaatttttttttatttttttagagacaggtttcttcctct

SEQ ID NO: 60261 - DNA, 1656 bp, Homo sapiens
ctgcacttcagcctgagtgaaagagcaataccctgtctcaaaaataaaacaaaaaaggcctggtgcagtggctcacacctgtaatcccagcactttgggaggctgaggcagacagattgcttgatcccaggagttcaagaccagcctgtgcaacatggcagaaaccccgcctgtaaaaaaaaaaagaaaagaaaagaaattagccaggtgttgtgacacacacctgtaatgccagctactagggaggctaaggtgggaggatcacctgagccccggaggctgaggcctcagtgagccttgatcacaccactgcattccagagtgagtgacagtgagaccctatctacaaaataaaaaaaattaaaaaatttgtttaattaaaaaaatcaaatccacttcctctccaactttgttctttgttctcatttgcatcccattttttctctggccctccctaagccagattctactctgacattgaccttcagcagaaacccctcttgctgatactgttttttcagactgagggatgaagtatttggaggccaagccaggggctatggatttgcctttgggcttcaattttttttttttatctatccaagtaatactcagctttttccataacaagaatgttatttaataatagtaggtaatactttacatagcatttacactatgccaagctcagcgtataagtcattcaatccttatgacaccccagaggaaagtatattatactacccatttaacagatgagaaaactgagaccgagagaggtttagtaacttgtgcagggtctttttgggatttaaatccagtcactctttagggtctatacacttaatccttgctctatggagagaacagaaaatttttaaatcagattgcattgggtttgtagcaatataccagactttctggatgttttcttgaaaaaagattattcttgtaatggtgcactgttttccagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggtctgataggctaagccctggtaaactggcctctgggttcagatgatacccttagacaaggttctctctgttggaacataaaaagtagtgaggcagagaagtagtaactcgaccacacaagatccccaggaagcaccacagatggaacaatggcagccagtatgattggactagacccagaccatgagttttatccttattttacttttagctgcaacaatatgaaatgcaaatcacaagctatttcccatgtgggcatcataagattgaaaatgagggtaggagggggaaacgcaagaaagattatcttccaaaggtaactgaggtgagctgacaccgttgtgggagtctatacagaaagatgttcaatgagctttaaattccacttaactaaccaagtgttagctttcatgttaaatgtaaaacacaatttccaaagagatgcagtatgggagggcctttcatgaggactgtattagtctgttctcagggtgctgatagagacatgcctgagactgg

SEQ ID NO: 60262 - DNA, 5840 bp, Homo sapiens
acggtccgatctcgtgagacttattcaccacctcgagaacagcacgggaaagacctgcccccatgagtcaattacctcccacctgatccctccaatgacacgtgggaattacgggagctacagttcaagatgagatttgggtggggtcacagccaaaccatatcaaagacactgaatgttgaggagttccaattatattataattatttaatccattcaccaaaatgacaacttatgcaaacacaaatacaaactaaatgcaaaggaataaaatagcctttcagctattttctcagctaagatctaggaagcaagtgttctagacagtgagggaccatacgatctgtcccttttttgctagcacctaggagatgttaaaccactatctgttgtttcaatctcccacaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccaggtatgtggatgaggtgactgacattggctccttgcctcccgcctgggtctctccagccatggcactcacagatttgttagcgagaaggccagggaagcgcatggaccgggaccatagaagctgtgtcttctggccttagcctttgctttcccaagatggcgctgaacaaggctctcaggatgcctataagatgtgcaaggaatgaccatttcacaaaacaactcacgctttcctacctctggctgtaaaattgactttcctttctttccatcttaagagattctgcttcatttcaaaagcaagtaagataaggattagaaataccagccattgtcctgtcttgataaggacagactgaaggacacgttacgtgggttcccgttccttggctttaccacttagagccactgaccttggatcatggactcaaggccaatgactggcctcctgtggtccataaccaggtccctgttcaatatcaatgtcatcttttcagatattctgaaaagctgaattattttgttttccattttccttggtctatttgagaaatgatactgtatcagttttagatatttattttttaactatgacacagtccactcataggatgaaggatggcgtgccaaggctgtgcccaaaactgatcccacattcccatcacggatgtgattctaccccaggtctatgtcctgagaacttgtctcatcagagacatataaacaattcctagaacaaactttgtgtagagtatttcatttgcctcatgcttcttataggatttttctgtcaatcagatagttggaacaccagcaccttggggctcaaaaacatgttagctttttaccgacgtaccaatggctttgtgccaacccataaattttcctcttttctttggagtagggagaattttcaatctacattgtttttactgcacttgttctactctggtttccatggtaataactgccaaaattgagctgcctggattttgcagggaaaacagaactgctggttgatttgtcacatacgtgagccctttcacacttcactaaaactcacagactagcctgggacatccccgcaaccaatcaggctatttgcaggtttttagaaggcttggataattgttttcataggaactacagatttataaagctggtatctttcaggcttgtggataattttttacacctctctaagagaaatactaaatttgttgcagccacttacagcccaccactgagggacactcttctccattgaagtctaaatatttgatgccctctttgaccactgtacagacattggcatatctggcttcatgtcatattcttggtggttacataataaaagtggtggccaggcatggtggctcatgtctgtaatcccagcactttgggaggctgaggcgggcagatcacctgaggtcaggagttcgagaccaacctggccaacataacgaaaccccatctctactaaaaactacaaaaattagctgggcatggtggtgggtgcctgtaatcccagctactcgggaggctgagacaggaaaatcacttggacccgggaggtggaagttgcagtgagccaggatcacaccactgcacttcagcctgggtgacaagagtgaaactctgtctcaaaaaaaaaaaaaaaaaaaaaagcgtggtgaatgaagtgctctaaccttaacttaaccaaaccctgttagccctctggctgggatagaaacccagcctgctaaatccgcaactcgatcaatggccagtggccataatgattctcttgtttctgcaccttctcaaggcaggacaaggagcagctgtggccccttctaaggacagttgtggaaccactttctgtgctccacatctccaggcatcagaagaaaacacaggctctgaaatcgagggtctaatagctcaaaggagatggcaattggcatttgtaagcagctttctaagtaagcggataaaccaaacacatccggggcaagctaggactggtatgactaaggaacagcaaggagaccaggtacagcagagacaggggagcaaacagtcatggaagaaaaggccagagaaagtccctcatcagccaccttcagattttaggaccagtgttggaatgtttactgagggaggacatacattattctttctgctggcagagatatctccaaatgacaacatttgacataaagaaaacactaggcaattatttaggctgattcatttaaataagtggtctttcaccaggcacagtggcttatacctgcaatcccagcactttgggaggctgaggtgggcagattgcttgaggtcagcagtttgagaccagcctggccaacatggtgaaaccccatctctactaaaactacaaaaaaatcagccaggcgtggtggcgggtgcctgtcatcccagctacctgggaggctgaggcaggagaattgcttgaacccgggaagcagaggttgcagtgagctgagatctcaccactgcactccagcgtgggcgacagggagagactctgcctcaaataaataaacaaacaaacaaacaaataaaaatagtttttaatcctagctgcacattagaattactttgggagttaaaaaaaaatcctacagctcagagattctgatttgtgtattctctgagtggggtctcaagagtatttgagaacaacagtattttttttttaacctgggtggtatatagcctggttgagaaccactgttgtccataaacttgggtccctgagttaccagtctctccttctctcatgatcatattatctgggcattgcccacatgcccgcttcctttttagccctgtagacacagtctatgtctatactttctccctttgtctgagaactgaccttcctgactgaagttcacaagagccaacagttggctcttatagttttcagagacaaatctccagggttcaggcagctcctaggccactcggaatgacatcgttgcttaaaagcatcactttactctaaatgagcctcagaacacctcggagcgcggtagtacctgttactatttcagagaaggattgctaagagtacttttattgtaagacttaaaggtttaaaacgtcttgtgagcttttgctgtataatttcaataaaactcataaaaaaagaggaataaaaaagaaagatagttttttgttttaatttatttacatattgagcattttttaaatgtcaaagcaagaagccctcctaagtaccaatttatgttcaccccagacaggcagaaaaggtagtaatgtctattttatcttggcattccccaagaaaggaaggcagcctttgcctcggactctgcctccaagccagctttgtcaacatgagagcacgtgaggagcaggatttcagggtgctgcctccctggcctaaacctgcgtgcaggacccgggttggggtccacaagcgtctggttgttcctgcctgtttccctccattctcctcagtacccttggatccctgttaacctcagtattttaattccttaggcattccagaagtgttcctttatggatgtaaattcaaacagtcatgctgagccatcccgggctgacagtcacgttaaagacactaggtcgggcgccacagtgccacccaaggagaagaaggtaacgtggcaactgcacatttgccacacggttgggagtccttccttccttgctctgacactaacacggctcttatactcgacctttgtcccctctgtcttttttctctctcttttttttaactaatggagacacaggcataggttaaaatcagagatatcttgctcaggttttcagagcaaacactgtgttccagcccacagcatacaatagtatatgcagaatttagacactatcttcccaaactaaagagtgaacacctttcagtactttctagaacaactctagaaagaaatatatagaaacagcaaccaagtatttagcagtttttctaatttgtaagaccctttgggaaaaaaagaaaaacaactatatatgttaagaaaaataggtaaaaatcggctgggtgcagtggctcacgcttgtaatcccaccactttgggaggccgaggcaggtggatcacctgaggtcaggagttcgagaccagcctggccaacatggtgaaaccccatctctacttaaaatacaaaaaattagctgggtgtggaggtggacacctctattctcagctactcgggaggctgaggcaggaggatcgcttgaacccaggaggtggaggttgcagtgagccgagattgcgccactgcactccagcctgggcaacaagagcaaaactctgtctcaaaaaaaaaaaaaaagtaaaaacctttgatttgggaaagaaaatgcatggtagaaagtatctaccaccacacactggtgtaacctcatggaaacatacaaatgtgtatttgcacaaacgtccaaggatgccaaacagaatttttgctaagtattatccatttataaagtgtaccttccaagatagtaagttcagtatagttttagtgttaacatacatgtgtgatgtcaaaaaaagaatccaggctctgaaacaaagtctgctgtcattgtataagtaagcactctagggaaacgaccatagcctgaatgtttgaaatgcaactttaagttgcacctagagcatctctgattttcagatataaagacatcttacttgaattaagcttccatctaaacttcaggataaaaagcttgcaaggcctaacatttttctccagggacttatctttcagaattcaaagattctagctttccttaaacaaaatcaaactaatcagatgcaagagagcccaatagctactacagatgggtacctcagtccatgtacgacagctcaaggaggtagatgtagtatcacaaaactgaaaggctattctaacacaaccattcaagagacacagttttgggctcccagctcccagccaagaggccttgccaaggaggccagcttgcttccccctggctcataaccaccacggcacccttgtgtaaactctctgccacataaattgacatgtgacactgttaatgggggaagggaatctcgctatatccaaggggggttattgttgataaatgtttctcatgaagaaaacctggcctggcatggtggctcacacctgtaatcccagcattttaggaggccaagacggaagaatcacttgaggccaggagttcaagaccagcctgggcaacatagtgag

SEQ ID NO: 60263 - DNA, 2009 bp, Homo sapiens
catgaaaccatgttggaaatatattgatttttattgtttttggttttttttttttttttttgtgagaccgagtctcactctgtcacccaggctggattgctgtgacgtggtctcggctcactgcaacctccgcctcccgggttcaagcagttctctgtttcagcctctctagtagctgggattacaggcgcctgccaccatgcctagctaatttttgtatttttagtagagatggggtttcaccatcttggccaggttggtcttgaactcctgacctcgtgatccacccgcctcagcctctcaaaatgctgggattacaggcgtgagccaccgcacccagccggaaatatattggtcttttcagtatgtggaatttccttatgagggcttattaaaactaactcatggaaggcctggtatagcatgttatacttaggctaatgtgaccatttctgtctagaacactgactgggaatttggactttctcaaagatccctctggagaccattattgtctcattgtagaatttttcttttcttttcttttctttttaattgaaatggagtctcgctctatcacccaagctggagtgcaatggcgccatctcagctcactgcaacctccccctccccggttcaagtgattctcgtgcctcagcctcccgagtagctgggactacaggcgtgcaccaccacacccggctaatttttttgtatttttattagagatagggtttcaccttgttggccaggctggtcttcaactactgacctcaggtgatccacccgcctcagactcccaaagtgctgggattacaagcgtgagccaccgtgcatttctaattggctagaaagtggcatgagatttcttgccccataattagaaatccatatcccattggtctcatttatctcagttgaggatccactggctaataagcaggtctttattgagtgcccaacactgagtttagtcacaggtgcttattctggataattaatctcagtagattaaccttcttcagaatgaccatgtatatcagacttctcttatccccaattctgggtccttattaacctcttccagggctaagtatttacccttccataaatcggatgttttcttaagcattttttctcctgtcatcactgaaactccagcctagttcttcacttgtatgcaattttcttgtaaccctgtctctcgttttggtttattgtccatatgcctattgagtgcttttccagttgtcttcataatccaaatcccagggcctataaatacatattaaagaggcataattacctttcacccagagtcttgaccatctaagactaagaaatcactgtgagtttgcatgacaattatgaccaagctcctgcacttgctttgatacattcattcatttttttctagcccagtgataaaaagtataggtcgtgtgaaaaccaaacttcacatttttatcctagtgactttccattagagcatttatgctactactcagttttaaaatacatatattacaggggggatttttgaaatttatttatttatttttgagaccgagtctcgctctctcgcccaggctggagtgcagtggtgcaatctcaactcactgcaacctccgcctcctgagttcaagcaattctcctacctcggcctcctgagtagctgggattataggtgtgtgccaccacgcctggctaatttttgtatttttagtagagacagggtttcaccatgttggtcaggctggtctcgaactcctgacctcatgatccacccacctccacctcccaaagtgctgggattacaggtgtgagccaccatgcctggcctgaaacgtttaatgatgggaatggcacaggccatgaccaaccaacagacaccagccctaacctccagtaaatagacccccagaacatctgccacgtgtgtgtctttagatcacatgccaaatccatccacgattcagggggcaaattctcatttgggtcctagcatg

SEQ ID NO: 60264 - DNA, 3132 bp, Homo sapiens
aaattcccctgggctggttcctaagtttataggcaagaaaactgaggccaaagaagtaaagtgacttatctaaagtaacacagtttagtggcagatcttgattaggatcaaaactttctgtcagcccatacattgtgcttttcacaattcttcaggttttaaattctgctaagctcacaatctgatgttgaaaagaggacatgttagtaatgactctgtccctttattttcttcaccactcccctacaaaattttaaattcttgaaatcttttgctaattgagattttcatcttgtgcaaacacagggcatttttggcagttggagaacaaagcaatccaaggtaaacagctgtaggctttggattggtgtgtaagaaatatgcgtggcccgcatgtcttagaaatgtaattaaaggaacgatttagttatagtccacttttttggggggatgtggttttgtggagtaacatgtcctacactattctaccagaatttggaatttttccatgaagatgtacggaaatctgatgttgaatatgaaaatggcccccaaatggaattccaaaaggtgagttcaccagatctgggttccgaccaataccatgcacattaagtacctgcctctgcagatccattgctgattaacgtgtgtggtttccctcctccgttctccctctcaggttaccacaggggctgtaagacctagtgaccctcctaagtgggaaagaggaatggagaatagtatttctgatgcatcaagaacatcagaatataaaactgagatcataatgaaggaaaattccatatccaatatgagtttactcagagacagtagaaactattcccaggaaactgtgcctaaggccagtttcggtttctctggcattagtccattagaagatgaaataaacaaagggtctaaaatctcaggcctgcaatactctatacctgacaccgagaaccagacgctgaattacggaaagacaaaggagatggaaaagcaaaatacggataagtgtcacgtttcctctcacactagactaacagaatcaagcgtgcatgattttaaaacagaagatcaagaggttatcacgacagattttggccaagttgttctaagacccaaggaggcaaggcatgctaacgtgaaccctaatgaggatggagaatcaagttcaagttctcccactgaagaaaatgcagccactgacaatattgccttcatgattaccgaaaccactgtccaggttctttccagtggggaggtgcatgatattgttagccaaaagggagaagacatacagacggttaatatcgatgccagaaaagagatgaccccccgacaagaagggactgacaatgaggatccagtcgtgtgcctggacaagaaaccagtgatcatcattttcgatgagcccatggacatccggtctgcctataagagactttcaactatctttgaggaatgtgatgaggaattagagagaatgatgatggaggaaaagatagaggaggaggaagaggaggaaaatggggattctgtagtccagaataataacacttcccagatgtctcataagaaggtggccccaggcaatcttagaaccggacaacaggtggaaacaaagtcacagccacactccctggccacagagaccagaaacccaggaggacaggaaatgaacagaacggagctgaacaagttcagccacgtggattctccaaattcggaatgcaagggtgaggacgcgaccgatgaccagtttgaaagccccaagaaaaagtttaaattcaaattccctaagaagcaactcgccgctctcactcaagccattcgcaccggaactaaaacagggaagaagactttgcaagtggtagtctatgaagaagaggaagaggatggcaccctgaaacagcacaaagaagccaagcgcttcgaaatcgctaggtctcaacctgaagacacccctgaaaacacagtgaggaggcaagagcagcccagcatcgagagtacatctccgatttcaagaactgatgaaattagaaaaaacacctacagaacattggatagcctggagcagaccattaaacagctcgaaaatacaatcagtgaaatgagtcccaaagccctagttgatacctcatgttcttccaacagagattctgttgcaagttcatcccacatagcccaagaggcctctccccgacccttgctagttccggatgaaggtcccactgccctagagccccctacgtcgataccttcagcttcacgtaaggtatcttggtctgctggaaaatgaaaagacccagctgctttcctaaatctgccataatcaccattagtgaaaggtgtcttgtaacttaattgctttctttcaggtggcttttttttttttgtctgttcgccatgaaacccttctttcatactttctccctcaccttccaaacaacaacaactaggtatctaacagctaatcagttctgtttttgcctctgttgctgactggtgttgggtaaacacgaggctgctgggtcagccatgtgctgttgaaatggttgctctgatactcacattaaaatccgtttgatcagtagtgagcagttgattctgtttgattcttctgattaaccccagttggtgtctcctagatctgtcctgcatgtagggctgtggcttctcaccttgagcttctctgcacatcgtggggcagcctcacagatgacctactcatgcgcttctccttctcttccccctctcactggtccttcccacagggctccagcggggccccacagacgagcaggatgcctgtccccatgagtgccaagaacagacccggaaccctggacaaacccggcaagcagtccaaactgcaggatccccgccaatatcgtcaggtagttttaccttaaacccacttttggatggacgctatttcagttaagcaagtcactgacttagtttataccaaatattgtgctttctttgtaagataacggtttacatagacatcctggatctgggggcatgaagaaagtctaaataaacctttgttacacttttttaccacgcttttgcatgcttgcaataaaacatcttttactttgtgactccaaactccaaatt

SEQ ID NO: 60265 - DNA, 1770 bp, Homo sapiens
ctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatg

SEQ ID NO: 60266 - DNA, 1055 bp, Homo sapiens
ggggagagagaatctgaactttcagctgtaaaccggttaaaaccaaaatgctcagcccaggacctttccatctcagactggctggccagggaacgcctacgcaccagtacctctgaccttagcagaggagaaatcggagatccccagacagagaacccaagcacacgagaaatagccacgaccgacacacctttgtctcttcattgcaacacaggcagttcttccagcaccttggcttcaacaaacaggccccttctttccataccaccacagtcacctgaccaaataaacggagaaagcttccagaacgtgagcaaaaatgctagttctgcagcgaatgcccaacctcataaactgtctgaaaccccaggcagtaaagcagagtttcatccctgtctttaaactgggggtatgtccactctagcaagtaaaaaaactactgttacacgttccagtaactctgtcaatattttcttgtatcagaattgttattatgcagccttcatttgggctggtttcatcattttgcactgtgaaatagctttacagtgcattactacagccagaagaacatatatatatatatatatatttaaaaatatatcggatagttgtatacaaatgagcaaggtatttgttgcaacttactacatagcatatacccaaaatcactgaagaaaatcgctggcatcagtgtgcagcaaatttgttcttttggtttcatcactaacaaaagtgcctcatcataaaaatacagttggtttttagggtgccatattgttaaaattagataacttacttacattgaataaacgaatgcgttttattggtaacagatatcattacatttaccagttttaacacaggtggatacagaacttccattctttagtcattccaggtggatctgagttttatattcaaacttttaatacagtttttgagttttgtgtgacttgaatttttaatctttctgtaaaatacgtaacttaaatgaacatattaaatgtgtatcttttcttcagataccagatttgatataatgttgtaacata

SEQ ID NO: 60267 - DNA, 1172 bp, Homo sapiens
gttccctaggctgatctcgaacttctgggctcgagcaatctgcccgcctcagcctcccaaagtgctgggattacaggcatgagccaccacacctggcctgttttttgaatattctaattccattgttaccttgagataaatgaagacattaccaacctgatttacttaaggcagatccttgaagatcctgcctgaatgaactaatggaagaccagagttcccttatctcaatgagcttatctgatacagtatctatatcatgtggtacctgtaattagaaaaatcaaagtcagtcataaacatttaataacctatatcagaatgtgatgtttaataacctatatcagaatatgatgtttgaccgtgtcacaatattgttttacctatcccatgcctctattccaaatgaaggaagtgaagaatgcctgggcactgtggaaggagggaaggtcaggtgtttgggggattttgataggaatcagcactaagcacagactattttcctgaaaggcagatgtgtatgagctgtggcttggcagttaaataccacgaggcaagaaattggactcattaaataaaaatttgactttggttcaaggtaaaaagaggtattaaaaaaaaagctaattgcactgttaatgcttccagagctttagtagatataatttgataagaaatatttgggagacaagcttgtcagaaaatgaactcagctgcattcttatgctcagagtctttcttctctcttgcttcccagggttcttggggatctggaaaggatcagtatagcagggaactgcttgtgtcctccatctttgcagctgctagtcgcaagaggaagaagccgaaagaaaaagcacagcctagcagctcagaagatgaactggacaatgtattttttaagaaagaaaatgtggaacagtgtcacaatgatactaaagaggagtccaaaaaagaaagtgagacactgggcagaaaacagaagatcatcattgccaaagaaaacagcactaggaaagaccccagcacgacaaaagatgaaaagatatcactaggaaaagagagcacgccttctgaagaaccctcaccaccacacaactcaaaacacaacaagtcaccaactctcagctgtcgctttgccatcctgaaagagagccccaggtcacttctgg

SEQ ID NO: 60268 - DNA, 1044 bp, Homo sapiens
agaaacctagcaatagtgtttggtcccacccttgttcgaacatcagaagacaacatgacccacatggtcacccacatgcctgaccagtacaagattgtagaaacgctcatccagcacgtaagttcatgcttcatctctgtaagttcatgcttcatctctgcaagaaaattcattttcacgggcagccgctatttggtcagacagaggttggttgtaatatctttccctaagaaaattaccctttttctatactatcctccaagatctcagtatatttaaaggcttgtttaatttctcttctcaccttttttaaattttagcatgactggtttttcacagaagaaggtgctgaagagcctcttgtaagtattgtctgtcagcatttgtactcagtagtttcatttgggacacaagatcctggcgcgccaacaatgtcaacttcctgctttgctattgtccgctttgcgccccggaagcaggtctctagctcagtttctgatctaatgaatatacaagtacggtgcttattttgcagttaattatgcgtaaacaatgtaaacacattaagcacaggtgctttacttagtaatgtgtcttttactaaatgttgtttaaattttaaagaaagtatctttgaagagatgatgaagagatctttgtttattaaccatagacaacagtgcaggaggaaagcacagtagactcccagccagtgccaaacatagatcatttactcaccaacattggaaggacaggagtctccccaggagatgtatcaggtaactcttgcctgggcagtcttgacctctaggctgaaagctacattcttacaatatgaaagagcaaatcaatcatagtgaattgttacttatgatttttttctttttctcttcctttctactaataaaaaaccttaatcttccttttccaattgatctgaattatcttccagtgactctaatgccattggcagtgcatgcagttgtaatgtttgtcagaatggaactatgagggaaatgagcatgcaaaccactgttttgttct

SEQ ID NO: 60269 - DNA, 1081 bp, Homo sapiens
tagcattttaaaacaaggatgagaacaaggacctgattaagaaagtataatacatgtaaatgtatgtgcatatatttaaaacacccatgctaggattcgtatcatgaattgatattactctctcctcctcttttcttgactctttattcagcggaacggtttccacattctctttacctgttgttacttcctttttagaatgttatctctctgggggtccctctctttctttcagtctctttgttctcttcttactgtctcaaatatctcttgcaggttttatctattcccagatctataatgtctgtattctttatattacataacagcaatttatgtttccttttggatgaaaggggcattttagctgtgatatacaactactaaacatttgtgctgcattaaataaaatgtttatttcttgttttgcagtatattccattaatagttgacatatgttgcaaattagttgaagaaagaggtcttgaatatacaggtatttatagagttcctggaaataatgcagccatctcaagtatgcaagaagaactcaacaagggaatggctgatattgatatacaagatgatgtaagtttgcttatttgaataactgatccttttttttccccctttggtggaactggatatgaaaatactatatttctattttgtacacctagaaatggcgagatttgaatgtgataagcagtttactaaaatccttcttcagaaaactccctgagcctctcttcacaaatggtgagttaactcccgtgaaagataccagatgaaatggttcaagttacaattggaaaaccatagaatattaaattgaacaaggacaaaatgtcttggtcaaaggaagcaggaggctttatttagttctccctcatatattaaaaacataaaagttatttaggttcagtgaaatatgtattatcttgttcatacatgtttgcagccaaattaatattattgtttccagtcaaatggcttctgacatcataaggtacaatgagtagaaaaatgttttttcagtcaagccaagtatttaagtgccatgtaagacactttactagat

SEQ ID NO: 60270 - DNA, 1034 bp, Homo sapiens
atccttggtttcactatccttaaaaattagtcagtcactaacaaattctggcagtctgttttcatcttttatccacctatattatttgtttttctttttgaagaaaaatcacttacacgtatatttcttaaatgctgatcattctttctggtattagagaaaacactggctgcttcctagtcatttattttaaatggacggatcaattcaataagtattgaacacatgttacttgctggtactatcctaggtatcgcatggatacagaaaagaagcaaaaccctttggcaatgttgggaggcacttggaaaatctttcacacagtgatgttgaatagaagctttgaaacagctccactgagaacagatgatagtagtgtttgtgttaaataagcaaagcagtacaatagaaagcctcaaaaaagtaaggatcacttatttatgtttagaattgattttctaattttactttattctgtaggacactggagtcactaacagggatctaattagtcgaagaataaaagaatacaacaatctgatgaggtgagaatcccaccttgcctgcagttaatttggatataaaatcagtacagtcatcccccttatttgcaaggatacattccaagacccccagtggatgcttgaaaccgcagatagtaccaaatcctctctacgctatattttttcccatatagtaatgggcgggtagtgtatacagtgtggctactcgggatgaaaggatgattcttattctgggcaggactacaaaattgaaagcttatgaattgtttattccaagaattttccagttaatattttcagaccatggctcaccacgggtaactgaaaccatagatagagggggattactgtaattgttaacaaatgtcatttccttcaacagcaaagcagaacagttgccaaaaacacctcgccagagtctcagcatcaggcaaactttgcttggtgctaaatcagagccaaagactcaaagcccacactctccgaaggaagagtcggaaaggaaacttc

SEQ ID NO: 60271 - DNA, 1037 bp, Homo sapiens
tcttttctatagatcgcagacagccaaaagtcatcagaagactctgggtccagaaaagattcttcctcagaggtcttcagtgatgctgccaaggaagggtggcttcatttccgaccccttgtcaccgataagggcaaggtagtgtgttttctaagccaccctgagtgtcagaaatgcagaccctgacaaataaaccataaagcctgtatacataaaatggcatgatatccagattaaagagtgaaaaaaaaaaccatttataaatagatttttctacattaaaaaaagtattccttaaaaaaattctaattattgcattaatttggtactttttgtcctgtgtatcagctacatgtagaatatattgtcttacgttttggcaatgtaaaaaggaaatctaagtatttaaaaaggaactctgcttttcttattagtttattagcaatgggttattccgttgtcctttaggaagtggcaaatcagttttaaatttttatgtctcttttcttagtttattttaaattacctttataactttgtttcattttattttaaaaatattaagttaaacaaatataaaaatatcaatatatgcatccagtagatttcaacagaaaaagactttgccataaaaattttctataatatttggacagcttatatataagaacattttaatgctgtcagaagagtttaaaaattttaagaaagctcactttggatgtggatagagttgcttagccatataaagttgatgaactctgttaattagttatgtatacaattgttggagaactcctgcagtatctgtcatttgtgtgctctaagacgtaagtctttcactcaacaggttttttggaccgatttttaaattttctattccgttactgtttttgatatgttttgctacatttattttatttgattagctttgttcatattgccttcccaactaaagttgggatttcacagtccttgactttgatatgaatacactgcctaactcagtttatgctccacaatttttatccttcctc

SEQ ID NO: 60272 - DNA, 1015 bp, Homo sapiens
tgttaattgctgtccataaaaattataccaaaccacattcccaccaacaatatagaaaagcctctgctgttacactctaacacagtgtattgtttgatacatatatttttaattattataatggcatattgcagttttaatttgacacttagcagttgaacaccatttcgtatatttaagatatttatatttttctgtgaactgattttttatattttttgactattttctatggattcttctgacttctgcatcctttttatataaagaaagctaacatttttctgtgatgtgttgcaagtctttcctaattcaatatttttcattttttttaaaccatgcaaaaatatttaaaattttttctgtggctaaatttaggaaatatttgtggactttgaattttgagtcatattgtatcaaaaaattctgtcactactccagaattataacaaaatttatgtttactttttatttttttgtaaactttgactcatctggaattaatttattcaaattagataaagagacaactttacattttctaatatctctattgtcccaaaagtacctgttgaatgtcatccttttcccaccgatgatacatcatctttattatatactaagtcatatgtatttaattttattgtggggctctattctattcagttgatttatctgtgtattaatgtacacgaggttctattaattatggtagttttataatgtctgtcttacctggtaaggctattattttatgttttttcagaattctcctggctatttttattttagtatttgaaccttaaaatcagattttctagttcttgaattcttatgtacattttcattgatacaatgattaatttataaattaacttggggagtactcacatctttatgatactgaaccttatgttaaagaactatttgtcttttttgttatctttgcatacagtcctctgagggttccatttggttattctttatattccaataaaagtagttctttctggag

SEQ ID NO: 60273 - DNA, 1033 bp, Homo sapiens
ggaattaatgctttgaaaactgagcctcagccaatcaccttaatttcctgaagtgataatctgtggtacatttaaaatttgaaaagtaattctttcagggtgttacatgattattgctctggtttgatgggtttaggttcgaggtacctataaactttagtaccttgacaatcagttagtgaaggcattaattggttggtagagcagctcatttaatttcttacaccatattctcagaattatttagaattactagagtaataactgtaaatcaatttttagcagactgaataggtcatttagtgatgtgctttggtggtgaagtgttaaaatccttatctgacccccttaataatgattattgactgagttttattattaataacaattaggtcattgaacattctgattttccttttttcttacagatgaaccaactagccctagcattgatcatgatattgcacatatccctgcctctgctgttatatcagcctctacctctcaggtcccctccatagcaacagttcctccttgcctcacaacttcagctccattaattcgccgtcagctctcacatgaccacggtacgtctaaagggtggttttgtaaaccgtatctcatgctctgttttccacttagaatagtatgataaactgatgtttccaccgttaaaagaatctgggaaccacttgtgaatgtctaaatattggattttaattaattacagaatctgttggccctcctagcctggatgctcagcccaactcaaagacagaaagatcaaaatcatatgatgagggtctggatgattacagagaagatgcaaaattgtaagtctcgggtgtattattttaaatatttgtatgtgggtgggtgttcagcatgaccttgacacataagttcagaatttaatgatgtcttatgttttctaactttgacattagaaatgcaaataaataaagttgttaatggtaacattaaattgaattttaaaaatcagtaacacacaaacatggtagaaaaatatgtt

SEQ ID NO: 60274 - DNA, 2442 bp, Homo sapiens
caagatgcttcaaataaattagacttaatttattatagtagtagtacttaaaatgcatttaagatttttaatattttcaccttttctctggcaaaatacatgaatcttcctttgctgggatttatttggcagccatttaacctgtcaactgctgaaactcagaaggcttgaatggggagaattttagaagtaatgtgggtacatctaattggttgggtagaaatttgatgagtttcacatgttttgagcaaagaggtgattgtaatttgtatgtgttgcagattctacagtttatttgatttctgagagactagctctttctagatttgtagagtacccttatgttgtgtttgcatgcatgctatagtgaatgtcactcaggaacgaggtaggacatagataaaatagtgcactgtaaaaatggaaattattattctttttatgaatttccagtgacaccttcctctcatttctatacaggcatattctcaagatgcctacctgaaaggcaacgaagcttatagcggcaatgcccgcaatatacctgaacctccaccaatctgctatccctggctgccatctgccccatcagccatggcacagccagttgaaatatctcctcctgactcatcattgagcaaacagcaaaccagtacaccagtactgacacaacctggtagggcctatagaatggaaatacaagtgcctccatcaccaacagatgttgcaaaatcaaacacagcagtgtgtgtttgcaatgaaagtgtaaggactgtcattgtgccttctgagaaggttgtagatttgttatccaatagaaacaaccatacaggtccttcacatagaactgaagaagtgaggtatggcgtgagtgagcagacctctttaaaaacagtgtcaagaaccacatcaccaccattatcaattcccaccactcatctaattcatcagcctgcaggctccagatcactggaaccttctggaattttacttaagtctggaaattacagtggacattctgatggaatctcaagcagcagatctcaagctgtggaggctccctctgtatctgttaatcactattcgccaaattcccatcagcacatagactggaaaaactataaaacttacaaagagtatattgataacagacgattgcacataggttgtcggacaatacaagaaagattagatagtttaagagcagcatctcaaagcacgacagattataaccaggtcgtccccaaccgcactactttgcagggacgacgtcgaagcacctctcatgatcgagtgccccagtctgtccagatacggcaacgcagtgtgtcccaagaaagactggaagattctgtgctaatgaagtattgtccaagaagtgcatctcaaggagcactgacgtctccatctgttagttttagtaatcatagaactcgttcatgggattatattgagggacaggatgaaaccttagaaaatgtcaattctggaactccaatacctgattccaatggagagaaaaaacagacttacaagtggagtgggtttactgaacaggatgatagacgaggtatttgtgaaagacctaggcagcaagaaattcataaatcttttcgaggttccaattttactgtggctccaagcgttgttaattctgataacaggcgaatgagtggtagaggagtgggatctgtgtcgcagtttaaaaaaattccaccagatctaaaaacattgcagtcaaacagaaattttcagactacttgtggaatgtcactgcctcggggtatttcacaagacaggtcacctcttgtgaaagtccgaagtaattctctgaaagctccttccacgcatgtcacaaaaccatcatttagccagaaatcatttgtttctatcaaagaccaaagaccagtaaatcacttgcatcagaacagtctgttgaatcagcagacatgggtaaggactgacagtgcccccgatcagcaagtggagactgggaaatccccctctttatctggagcctctgccaagcctgcccctcagtcgagtgaaaacgctggtacttcagatttagaactacctgtcagtcaaaggaatcaagatttaagtttacaagaggctgaaactgagcaatcagatactttagataataaagaagctgtcatcctaagggaaaaacctccatctggacgccagacaccgcagcctttaaggcatcagtcttacatcttggcagtaaatgaccaggagaccgggtcagacactacctgctggctgcccaatgatgcacgtcgagaggtccacataaaaagaatggaggaaagaaaagcctcgagtaccagtccgcctggcgattctttggcttccatcccatttataggtgagctcatttagagtcattggctaatatgccaaatgtataagaaatctttccagaaaagtatt

SEQ ID NO: 60275 - DNA, 1052 bp, Homo sapiens
tttcatgtgttctattatcagtacaatatcctatttaagtagccatttgtcaagtgtacatgtaggtggtccggcctagagtgagggaagcaagagtatgaattctggagggttctttcatattttgcaggttagcagcagtttactttgtaattttttaaaatctatttttaaataattacaagaatagtatgtgctggttgaaaatatttgaaataatgcagaaaggtataataaaaagaaagtccttctccatctacaccatccccttctcccattccctatgctggcatggttggcatctaccaacaaacatgaagttactcttgcttttatcataggtaaaggcattaaattaataacctgttaaaggtgaactgaaaggcaggaattttaatcttaccaccttatttattcttcaggttttttttttttttttttttttttctctgtttcattttgtttaccatttatcataggtatggtcatggtgattttgatgtgactgtataaaaaatgaactagagattattttagggttatttagttactattaggcattgtacatataatcaagatccaggctgttaatattaagttgtatttaacatactgtttggagttctaattacaaagaaagaattctttgggtcatctttcttattttcttcctcctcctcctccccccccccccccactttttagagctttttgtatctaataggcaaaacagggctgttagggaaggcttcagtttttaaaatacaagctgttaaactccaaaaggtgtaatacttaagtacaagggtaaagaaagctcaagaaggaatgtgaagtggtatacaaaaaggctgagtggaaaaaatggctaaaaatgttttgtcatattctgttgaattcacaagagctagtaaattgggaaaaatttaaatgttgtctgattctatcaaaacactttcatatgttgtaaagtatccatttgggcttaaagcctaactaaaattcaaaattgttaatactgaatatgtaattcttatgacattggtttcaaa

SEQ ID NO: 60276 - DNA, 1047 bp, Homo sapiens
gcactccagcctgggtgacagagtgagactccatctcaaaaaaacaaaacaaaacaaaacaaaacaaaaaacaaaagccatggagtgagtaccgcctgtgtaatcatctttggcacttgttagctgtttgaccttggagactttatttaatccctctaagcttcagtttcctcttttatgaatggtagtagtagtacttacttgctgtggaaattagctctgagatacagtatttagtgtggcaactgacatacggaatgtagccagtaaatggaaagcattacagtgttgtggttgtcattatgttatggaagaagcaaaataaatgtttgaattaaatgaaaacccctacattataattttagcatccaaattcaggatatgtatttaatatttcattaaaaagctttgcttaattctctcaaatactattttatatttaggtattttagtaaagtattgtgaagtaaaatcatgctttgggcttctctgtaacaggaaaacaaagaaaccgcttggaaccaatggataccatatttgttaagcaagttaaagaaggaggacctgcttttgaagctggattatgtacaggtgctgatattcttctttaaacaatacgttttaatttctttttcactttatttcttccatatttcatgttcgatattttttccttttgtatctttctgtatgcttcttccttttccttcacatctgttgttactaattttgagaactaattatgtttcttggtgcccatatgaatgggtttgaacagaaataacaatataaattgatacactgtgagcacttttaattaccacacagatgatagactcttagaggctctttaaaggaacaaattttgcatgcattgaattttgacaaaggattacaaagtagcaaaatgatgaaggtatttatttgatataagtgaaataatcttggattttcaagttctggaagtgcctgatctgacagagttgagttaattaatttgcagcacaaagtggcttaagtctccaatgcggaacataagcctggctt

SEQ ID NO: 60277 - DNA, 1103 bp, Homo sapiens
attttttagaatgtccttcattttcagtttatctgatgttttctccctagttcaaggtcatacgtgtttagcaagaataccacatttgcatctattgtaagtgtatagtttggtaagttttgatgactgtataacccgtgaaatcactatcccaattaagatgtgatatcaaaacaacctttccatcactccataaagttcccttgtgctcctttttattctgctgtctttagacaatcactgatctgatttttatcactgtataggttaatttttgcctcttctagattttttttataaatgaaataatacagcatgtactcttttgtcaggcataatatttttgaccttcactgtattatatgtatgggtactgatagtactactgttttttcgtttgtatgaatataccacaaattgtttaaccactcaacctgttgatggagctttgtaataaccatttgaggtcttgaaaaggttatgagttaaaatgagaaggaaatggccttttttttttttgcactatcaaaagtaatctgaaggtgtaaggccaggcaggactcttcatagttgtcactggtacaagatgagccactcctgcattaccatctgtcatgcaccagggttaggatgaattccaaatgctacttggcatgggttagaaataagccttagtggggaaagggaaaactcacgaagctggcatcagcaagagaaaggaggatgtaggtactccatcttcccatcatcctaaaggctgatgtgctgatacctggacaacctactggacacacagcatctagaattcatgcttcttatgggggggaatatatttctaataaatatagaaagacattgttataaaacttcatgcagatcattatgtgtctgacgtagttcgctgaagagaatggatttagttttgtgctttggctagggagaataaacttgaatatttataagggaaaactagaagatctattatagattcagcagaaggagatttgaagaggaataatagagtgagcctaaagggtataatctgctggagaagataacagtttgcctattttaattattaatttatgcttaatttcactcaa

SEQ ID NO: 60278 - DNA, 1019 bp, Homo sapiens
aaaatatatattggaatcttttccattttaattatgaaattttataaattcacttcaaacgaattaaaaattttaatattgtatagcttttagaaaatgtgtaattaatataacagtgtccttattttgtcacttaactggcaacctcagtctcagactagatcttataatcagaagaagaaaaaaaaaaaacattgggcagccaaaataaaggtcaaaaaattatgtaataaattatcagcccttcaccgaacgtctgtttttctttctaaggtacatggtagctccagtatggtagaggctcagcaaatatttgaaaatgtatttttagactagtttttaaaggtttcttttctaattttccagctagaggtagataacatggcagcaagacagcttggtaacaatgaaagagaccaagtagataaacttcaaaattgaatacaagaacttaaatatgtagcaatttgggaccaatccatttatatagacagctctgggtcctgtaatatcccttaaaggcacatttaagtatagtacagtaagtgatgacctgacctttccatctgtccaactgcctacttgacaacttcacttggatatctccattagaaatctcgcactcaaatgccaaaaactgaactcctgatgtcttacccctaaattggcttcacccacagcctgcttatctctatttgtgaaaactctatctttccagtaaaaggtacttcctatactgttattgaagatgggctatacgtttgcttttgagcttgccagtggctatagaagagaatgtgatcattaagaatattgttagtgagattgtaattggcacaatctggggaggtcgatttgaattaaattgagccttgctgtgattaacaagagtttataaatatgtactcatatatgtatatatatattttcatttgtaggatgaagaaaatggaaacagaggaggtatgctataaacattttaatttatctctgaatgtttttctacccatttctttctg

SEQ ID NO: 60279 - DNA, 1035 bp, Homo sapiens
gaccttttctgttattttctaatgtcctttgttgctgttggactatctgataaggtttaggtttatttcttcgtcagagttttatatctgttctttcatgctttctgtttcttaatccatagtgctctttaaaatttctttggtattatctttcattccttctattgcatttctaattttaggaattatatttctattttctgagagttctttcttctgactaattttttatggcattattttctagaaaaaaattctaggttttgataattgcttgctttgttataataatataataaattttagtttttgataattgcatgctttgtgtagtttatgcatcagaaaatagttcatatcggcgctcaggtattaacatttttacatagaatttttttagatgaggaagtatattgtgttatgtagttaacttttaaatatcttttcactttaggtctcaaaaaataaagatggaaaagaacaaagtgaaactgtatcactgtctgaagatgaaacattctcctggccaggtcccaaaacagttacgttgaaaagaacatctcaaggctttggttttacattaagacattttattgtttatcccccagagtctgcaattcaattttcatataaggtaagagaaatagttaccgcaacttgaaaaaaaaaccacaaggccattcctatccccttctagtcttcctcttacccttccctatggccttttttctgtcttaaaagaatcaagcattacatttgaatttttattatattatttttctccttttaggtattttcccaccttcaagaacaaaacagaaactttagtcttctctgaaagatcatagtgattctaaactccaaatctgcattttttaaggacttctaattccagatttctttctactttttctaatatgtaactgtttattatctagaaaggtagtgagttttctgggcagactatgcaaaggaaatggttcactgaaatattctagcagttatagaaaattagtagaattagaacaatactta

SEQ ID NO: 60280 - DNA, 1075 bp, Homo sapiens
gtatttttagtagagatgaggtttcaccatgttggccaggctggtctcgaactcctggcctcaagtgatctgcctgcctcggcctcccaaagtgctgggattacaggcgtgagccaccacggccggcctaggtgtatgatcatttgagttaatttttgtttgtgatacgagttacagatcaaagttcttttcttttcttgcacacagcctccacacagttgttccagggcgatttgtgtttacaagtatttgtattatacttgtacaatattgacatgggttcatgtttcttttggataaatacctaggagtagaatggcagcatcatgtggttgtgggtctagagcaggactccatattctgttctgtgaatctgtgtttcttgatgccaatactgtactgtgttgataactgtagctttgtaagtcttgaagtctgagtgttccaactttgttcttatttgaagttgttttggttattttaggttctttgcattataaagtggattttagaaatatcatagcagcttgcacacaaaaatctgctgagattttgattgggattgcaatggatttatagatcactttggggagagttaacattgtaacagtactgcgtcttctaaatcatgaacatggtatatctctctatttattctttaatatctcttaatgttttggagcttcagtttgtagatcttacaaatcttttgtcagatttatccctaaatatttcatattttaatgtaattataaatggtattttaaaaagttttaaatttccagttgcttattgctagtatatggaaatgctgtttttttttgtttttgtttttgtttttggtatactgtattattactttcattaacattccatttactagaactcaatcatatggccacccctactgcaagtttggctgggcaatgttaccacctagttatcttttcacctttatatgaggcaaattattgtggcagagtgggtagactcactggtggaagataataaaaaatataatagaagcaagactattcaagcatttgcaattcaataaaggtgaccttttcaaaat

SEQ ID NO: 60281 - DNA, 1046 bp, Homo sapiens
ttcaccctctttgagtttgctttgtctagttgttatatctaatttttatggaattagtttttaaatctttattttggtttcttttaaccttgagttattattcaatcaaatgaccttgttatgaagtcttttaagggagtcaaatgacagttcttagtccacaggaatttaactgctattattccagtcacttcttggcttcttgcactctgatacatgaattggcactcacattagggaaataagatgtgtgtagagggatatttcttaggtggagaaacccatgactgctggctccttcactgtgtgtgcctatagcttgcccttgttataagatctaacagatcagcggcaatgtgggtgagtagaaggagtgaagagggcacatatgtatattttttttatcttccgcttctgtgaaggcccatagaaatgtaaccctctaggagactagaggagctacagtgttatgttctgggtgggtggaatgactgagacacctgagctatgtcacattcagaaatcttaattagtttgcagagagcaagaaagaaattgcctactctgcatcccatcttctctgtttgtgtaaagagcccagtaaaacaagacatagcagctcaattcagaaatgtgaagcatgtaaccatgatccaagagttacctatatgattttcaacaaaagaaaacttggatatatttgggagctgtgaggccaagtcataataatacattagaaataaatttaatactgtatagtttttaaagtgttgaaatatgagtcccacaggaaaaggaaaatataaaagataataaattagatcaaaaagctgttacggggaagaatatgtagattatgaaataaaagagatgatgaaaaacaatttaacatagagaaaatattctagcatcgaattcaggagaccattattttaattcttactgtgatgtaaaccagccacaatcttggataaatcacttagcaaatctggacatcatgtgtgaagggttcacttatttagattaaatctttttttttcttttct

SEQ ID NO: 60282 - DNA, 1036 bp, Homo sapiens
gctgtccttttcctctggatggtttcccttggcttaatgagttttgccccatctgggtcatcactttcacctttccctggggtggatgagagccagggaagggccacccctaggaacatgttttgttacccatctctagagattctgggtcgggcctctggatgctatcttgattttgatactcattcctacgtttcattgacttggaatgttaaatgctgctacctggcctctgctgttctgtgatcctaacatcctccctggtccttaagaagcccagacctatagcaatatcttctactgtcagtgctggccagaaggggacagagaactggcactgcctccatcagcacattcagtattgccgtggtacacggagtgtcctgtgggccctcccgagggtcgctgttagctggttggttttctgatgtaacacatagcacatagacgtgtttagcaggcccgattctctgagccttcagatcccttctgtcatggtctgtcatagcagttctggcatctctacttcatttaatgtgggccatcattttttccaaacttcctagagccatcccagtagtatatttgagcctccactgagcccacgcctcagtgttaatcctatgttaggtcatagtgcctcatttcagccttcatccagcgtcacattttactgcctcgagttaacattctcagaaccactctgccccactacagaggcacagtacacttctgagtactttacctactgcccctgaatgctgaggtttttcccactcattggcgaaaacgggctctcttcttcgtcctgtgtgagttttgagggttggtgcctgtaatttcttcaggagattcttttccctcatcattgctcagctgaagactggggtcggggaggaccccctgcagattctcagagctttctgtctctctgggccactttcttctccaggactctgtgctgtgaacttgagccgccctgcctggttcccctgccctgtgccaaagccctgaaactttctgtgtagtaagctag

SEQ ID NO: 60283 - DNA, 1135 bp, Homo sapiens
tttttctttaaatattactttacattgtatcatccttttaaaaattaggacaaatgcaaagtattatggtgttaccacttaccatattatttaaataattatgtagaaaaattctaagtggctaaatggtacttcttttttgcaaccactggataagatcctaaattaatccagaatacctaatcataaagaaaagcctcaatttttcatgttttatatttcattgttaacataaatggaaaaatcgaaaccatctttaattcttattattttaatcagttagggagcctggaaattggactttaggctgagaactccgagggttttgccttgcctaggtgtaatactttaaattggcttttttcctggcttgacctccaggccagcctctctgtagcgttgtgggtgtgctgtgtgagtgctctctctgcacgtgcttgcggcgcacttccacactcatcaccttgtgtataagacatcagctggaaatggcacagggaaaccttgctggtgggcagggtgcatatgggatgagcagagacactaatatgtgcagggacacaacgggcattgccaaaatgcacagatggctggttttccacaggtggatcttgcaggtgagagcaaggggacgggaattaaaggacagaggcctattaaccattgttaggagaaatccagccagaccgcttctgtatttcaccagcagtattggagaaccattgacctaagcttcagaattgcagctatcacagctattggccttcagcaggggaggaaaaaaaacacctctctctgcccctcacagcaagcttctaaaatgatgaaaaatgccgcaggaacgttagttgaatattttgtgagtgatgaagaataggtaatatttagtgagtacttaactatgtgtcagactatttaaccaactctacagagatgctatgaatatcacattcccattttacagacgaagaagctgataaacaagggcttaagtctcttgtcggggccacatagctaagaaggtgcagagcagcacgcaggcccagggagtgagactccaaagtctgggtgcttgatgccttctctttaccgaaggatataatgtagtgttctagtcatcagcttttaaaactag

SEQ ID NO: 60284 - DNA, 1044 bp, Homo sapiens
gtagataatattgtacaaattcagcataatggcttcttttacagaatagaaagcaacgtgaatgatagcttttgttccagttatcagtgaatctttaaaaactatgaattatttacctcgtaggttattcatcactttgtgggtatttgtcttccttactaaaaacaagttatttaatattgtttgaaatttaaaaggaaaacagttgaaaatgtaattgaaagcaatgaatgataaataaagcacactgaccatgcttgccccagccccaaccatttctcagttcttccataactgtgatgtgagcttcttcgtttatgatatggaattagttcccagtggtactttggggtgtccaatacttttctttatgtactgttttctctattctggaatggtgaaaaaatattttcatagtttaggctgggcataatagactaatgtatcagagaaatcagagatggagaaggtcatttagtctctgtttgtttcaccgtaagattgatccctcaatgcactttctagtctgtgcctaatggatttacattaccgtaaaaaatatggattttgaatggctgctaagaggataaaagaagatagatactggaattatcttaacatgtaaaattcataataccaggagcctaacgaagctgaaacttaaaattttttagcgtttagtgactagtttacagcaattactaaactcattagttagtctcatcatcagaaaactttctagtttgaggtctgagacctttttaagacgtcttcattctgggtaatcccaaaggaatttaatttgagttgcaatagaatctaggggtgcattgatccagtaagccagcgatatcaaaagtgcttttttggatgtgccttggcctggggttttttgctaggattgttgttgctaccatccttgtggtttaggtctgataatcagccatttagttgccaatgtctctgagaagaagagtttttaggccaggcataatggctcatgcctgtaataccagcaccttgggaggatcacttgagcccagg

SEQ ID NO: 60285 - DNA, 1049 bp, Homo sapiens
ctgtgtggcgctactgagaggttaagaaaggacggagtaccctttggtacccttgggatcaagtcagtgtgagcgtcattgatgatggcacagccttgtgttggaatttgtttgctgtggaccggagccagcatagttgattgatttatataccacctccccaggttgtgttttcattgaatgactaaagatgcccagaaaagaaggaaaaagcaataaccttttacaaattaaataatgttaaatactcagtaagaattttatgaaaactttccttcatgatctaataatttaaatgtactggtgggaactacatttgggaagatgatgtcgttctgccagttagctattgctgcttagacaggaaagggaggggaagatcttatttgtggaccacatcactgcagagctctcgtaaccccgctgctctgctgacagaagctgagtcagagaagagatgcagactgtgctataggcagtcatggcccagttcaggattttagactgcatgatcaaccacaattggagtttgttgtgcaatctgtattgtgcatggagtggtcaggtttgtttcataagtgtgtatgtatatatttgctttttaattcaaaactgctatgatgtataaagcaaaagtaaatcaggatataaaaacactgtcttcttgtaagagtaggaaagtaatcttttagaattttttttttgtcaaaatacctgtttaatgtgataaatctaatgatctgaattactttaaaagaattaagttaattcttaagtagcacagatgagactatttgcagagctttaagtggtggaggaggggaagttagaatgaattacttaaaagtggccaacaattaaagcaatataattgtaacataaatgttacatatttttgaaggcatctgacattgtatttattagaaagtaggcaagattttggagtgagttgctttttagctagtttttcagttttagtgaaatatggttcttgagttctttcacagtgggattaaatggaagtactttttaaaacttttttgattact

SEQ ID NO: 60286 - DNA, 2794 bp, Homo sapiens
tttacattttctcttttttattaccaaaatgacaataaaagaacactatgtatagactttaaaaataggtaatatgtattcagtcttgtgaaaatttggtttgtggcaaacctacactgcttaaaacaatactaaaaagcatacacactgctcaaagcaacacttaaaaaacaattttttctttttcttttcttttcttttctttttttttttgagatggactctcactctgtcgcccaggctggagtgcagtggcgtgatcttggctcactgaaagctctgcctcgcgggctcatgcctttctcctgcctcagcctcccgagtagctgggactacaggcgcccgccaccatgcctggctaattttttgtatttttagtagagacggggtttcaccgtgttaggatggtctcgatctcctgaccttgtgatctgcctactgtggcctcccaaagtgctaggattacaggcgtgaaccaccgtgcccggccaaaaaacaatttttaaaaagcaagtttcttcattggaggcataggattcattctagactagttacagtatggtataactctattatttaattttaattttgtgtttcttcatacacctgaatttaagtgtcagaatactgttccatgccaaaagttttatgctgcaagttagggttaaagctaaaacctgttagaattgagaatgatggcagtagcagcagcagggatcattaagtggcatttcggcagaagcctggattttaatgtattgagtggggcctatcactagataagagccatcagcaaagtgagtacccagatctaaagaatttctccgtaaattgttagtgttccttcccattcatttcttccaggttaagcgttttatgaagttcattgtgccttgatgttcttcatttctttagttactaccaggtcaagtaatctagcacaaaggtaatattcagtttcttttgttctttgctttgtgaagggtcctgtcttcttattatagttaacaatatgctgatttaagtatgggcaatgctagcgttgataagatgcacagatgctgttattcaatgcagctattttctgttacagaaagaccatatggtaggcacttgtttttctgtctagttgatgtgattagattactaaaacgaaaggttattggacttaaagattgtcctactattttatctaattttaattgactgtaagtaattaaatgtgttaaaatattgtaagccttccatatcttccctggtttgaagtagaaagatatctaaatgcaaaaaactcaattttggattgctttcactaaaatagttttatggtttaagttgccatgttcttataaaattgggtattgtgcaaattatttcacaatctaatctggatgatggcattttgtgcttctcaaataatccaaaagacaaatggatatattgtactataggtttgagaaacttgatgtgggctggacgtggtggctaatgcctgtcatcccagtactttgggaggtagagtcgggaggattgcttgagcccaggagtttgagaccagcctggaccaaatagggagacccccatcacttaaaaaaaaaaaaaaagaaaaaaagaaacttgatgtgatggaaatgttttataagtcctcttctagttatctatttaatgtgcaagaatttccactatgtagatttgtgaataaaagaatagattgagaacccaaatttgatatttctgactattcatctgtttcggggtaagtagacagatcagaagaaactgtttattattgtaaaaaataaaaataaaaaaacagggaagttaaagactttatttacttttccctggtgactagctgctgagttttctatttgatattgggtgtgtttttgattcagaattggttacttactatgttttcccctgttgcttatctctgttctgaagagggctctggcatagtcaggagtagtgctatgtatgcagcactgtttataatcccacaacttctttgcccttcgtacaacctaaggaagacactctcttgagttctatttttttgttcattgcactactcattaatatattgagaagacttatattcttgagtatatgtcctgattttctccttactcacaatgtggagactgtccttgaatatcagtagatacaaagctggatttatgattatatttagacattcttctgaatgtggcatagctagtgtgatcttgggaattcatcagcgccgtttttttttttaaccttgaggtaatacctctgtaatacccagtatttgcctagtaaatacagattgtatatttaaaagaatttgtataaggcagatcagtgagacttactttcttctctgggttctgcatattggcttctggaaacattatgtgctagtagtggatgtgaggggaaggaaaggctctgggcaccccgttcatatcagattgttattctaatccttttaggaaattgtttttgtttactttttttttatttaatcatatagacacccttctttgtccatagattgtataaacagccctctgtatccatggggttgcacattcgtggattcaactaactgtggatcaaaaatattggggaaaaaaattgtgtctgtgctgaacaagtacagagtttttgttcttgtcattattcccaaaaccacagtataacaaccgtttatgtggtattcacattgtattaggtattgtaagtaatttagagatgatttactgcaggaggtgtgttaggttatatgcaaatattgcttcatttt

SEQ ID NO: 60287 - DNA, 1978 bp, Homo sapiens
tgtcgaattagaaagtttatgcagaaaacgttgtgaggtacagtgtgctattactgtacaatttattaggcagaactgtaggtttacatttagaatcagtgttttactttttgacatctgtaaacacctgcttgcaggcaaaagcatgattaagtggaacaccacaatcctctgatcacggtaaaccataataactccttttggaaggcctacctgcaacctggtgattgcttaatgtgtattgcagttacataataatatgtattgtggtcctgaagccttatttgtcattgtcttgtgaatactttaattagcattgtatttgcattctgtttgcaagaactaatgttatttgatttttttttttttttttggtcatttaagagatgtcctgaaaccaagaatttagacacatcttgtccttggctagcaagcagtatttccagtttgttgcacacttggcttttattaacaatgacagttatgtattttttaacggctgtgaaatttgttttcatttggaccttactgctggcagcatggctatcttgtttttaagtttagcaatgaagaaaacacaatatcacctgtgttttgcttatgtgaaatatatatacagtatttaggtttggtattaaactacaatattatttgactttctaaagaataggtattttgcctagattctatgtggaagtggaaataaaggggatatatgttgtcagaaaacattttaaaacctcagggttgggagtgaagagaacttgtgtaattattgcctgtatttagttgtgacgtgttttaatctgtgattgatgcttctgatacacattaaatcttgtgaatattttttagtaatagggagttagttgctaatgaaatactttgggctgatatttaggtttttgaacattgcatttaatttttgtcgtcaattttattagaagcactacattccacagtggtactatcactctttaaaaaattttaaaaatcaataatgtgtttggatactacatttattattgtgtttttaactaacaaagagatgagcatgtgtgtcttaatagtaatgctgttaatcagccaagaaaacctaactttataggacagaagaaatcaatgtaatgaattaacaggagtctctgtttcatgctttatctaattagccaactccaccttctctgaataaggccttgtgctttgttgaaaaacaatcagagatttcttgttcatcttaagcattgcaattttattgtgttgatatatgatatacatttaggcctccccacccccaggatatattggaagcctcaaaacaaataaacagccctcttcaaataagaaattaggacagttcagtagaatatgtcttggcattatacagtaaggatggtccagatggtactcacacgaatttatatacttttatacatctcaaggtgtatttttaaaacttgaaatcactcactctgaacctcttaagtgatttttggggtgtgtgtgtgtgtgtgtgtgtgtgtgtgtgtagtccgtgaagtcttctgacaccaatccttgagtaactttgctcacaaaatcactttatatagattcttctgttgaatcctctatgatattatcaccccttttcatatccatatagcttcatctttcaaggtttaactttttttttaagccaaagaagagaaaactttccctcagctttcttaaccacatgattttttttccatttctaacatttatttcattttttatctgtagtccatactcttgtccagtaatagaatttttgtcactttattattaaactttttactaatgcaaatgaacttatttttgttttgcttcttgacctaggctaagattattctatgactgaaatgtattatggctgatgaaatacacttgttggttgattttgaaatactgtaaacaatacaataagacatttttctgggtacgagtttgtatgaat

SEQ ID NO: 60288 - DNA, 1871 bp, Homo sapiens
cccatttcagcctcgtgggggagaaaacttcaccgaagtgtccctgtctgggtgatgcagaaaacaacatgcacagccctctgctctacccaggaaagacatgaattaaaatgcacttgaatggggaacattttttcttgaaggctgcataacagccaggtgtgtttgacgcaaccgctgggcagtttcgagatttctcttttttaaacaccccctcgaatttataggctttttgtttgtttacgttaaaatttttttttgtttgttttgctcgggaggaaacgcgaacttggtgtggacatgtgggcaagacagtgataggcgcctggagaaagttcatgacctttaacttctcgttttcctaggatctctctaggagctgacactcgaaccttcacgacccattcggatttttccaggactcaggagtggcactgggaagaaggggaccgctttctgcaattggcctcgacactggctgccaagaagacctgtcgcctttgtttttaagtctccagaaatggaagaagaaggcgaagtcagttgaagtcacgagaaatcagcgaggcatttgaaggcgcttcctgaaaacctttattccctggcacgttgtctgtttcaacagccctgcccctcctcggagcctgcttgtggaattcttccccttcgggtgtgtggtggcattccccgccacgtccaatgtggactccaaaggatttgtcccttctttgtcatttgaaatgaaatgatggccacgcgtcggactggtctgtctgagggagatggtgacaagctcaaggcctgcgaggtaagcgcggagccagcgttcctggccggcagggcggtggcctgtgtcttgagcgtcctgcaagttgggggttaccggccacggggcctcactaggggcttcccggggctttgagcctgttggcgggagcgccccagcttaaccagtagcgaggagaagcctggcccacgtctgtttccagggactcccgtgtttcttttgcaagaacatgtcccgcagtttggaatgtcctcatcttggtcaccccttctcagagccaggaattctcccgtctctgtggctgtggatgctacaagcctgagaatgggcacctcagtatccgttttccttcagtccccttccgagatatttggagttgagctggttgggggtggctttcagcatttgtgtctgctccaaggtgcagagagggcagctagtatgcttgttgcacctggaacttagtctttctttggtactgacgaggggagtctggctgctgttgctgcagatctctgctttaggtagaaaaagaagtgtttttccgtgaatagtttaagcacagccttggaaaacgaccttacagagtcgtaattccaactcccggaaaaatctcctgcctttactgttctcttatttataccctccctttcactactctgaagttctgtgagctgctctggggtgtcaggtgggttgcgttgctggttagggtagcatctagcatctaacatcttcccaagggcccagagattttactccagacttcctgaaaatttttgagcaggcaggacagaaatcatagaaaatacattgatttatgacacgcatatactctgttgcctctcaccttttttttttttcctcgtgtttggagattgaagtattcggaatttacttctattatgaatatactatgtttatcattggcggttcctgtaatttgttctttaaatagactgaatattgttatcctttaaattttacttttgagatgcctatgttttcattgaagggttgaggattactttagacaataacatacccaaatgaaccctcattcactgtctcactttcttttgca

SEQ ID NO: 60289 - DNA, 1076 bp, Homo sapiens
tattttattttttgagacaaagtcttgctctgtcgcccaggctggagtgcaatggtgcgatctcagctcactgcaacctctgcctcccgagttcaagtgattctcaagcctcagcctcccaagaagctgggattacaggcacatgccatcacacccggctaatttttgcatttttagtagagatggggtttcaccacggtagtgtctaactcctgtcctcaaacaatccacccgccttggcctcccaaagtgctgggattacaggcatgagccaccgcgcctagtcaaaagcctatatattttagatgttttggttgttatctttattgttttctgccttgtgtgctaatctacatatatcttttttaaaaaaaaaaaactccaaccacatatttcactctgtcactgccagaagcaacagtacagtattatactctccaatttctctaccagattcaagggttatggcctctttggcagggagagagttactgtcaggaaaatcttactgttggatccaggacaaaccattaaacagttgcataagtctttgtcagcttggagttgttgttctgcaggtgttttgctatgttgacacagctcatgtttgccctgttttacttattgctctttcttttggaggaaatcatagagaaaacaggactcaaaccacaaacggaaacagtttatctgtttagctgttgaactccccgggaaagaagaaagaaatcagttaagagatgcatgagtgaatctttttaaaaatccatcttcaaaacacaccagagagagtaatgaaagtgattgattgattagaggcatttgcaccagagagacacaaatgcctctaattgaggcattaaggttaataattgtgaaagtcccgtcatgctgaaggctctgcagaagggacgcaggtaagtaaaacaagcctctgccctcatggagcttcttgctcaacagagaaaaagagcaggcaagtgactctaacatacagcaaaccgtaaaaatgtggccgtcatcctcgtgacaccccccatttcagcagatcttaataattattcataatcaattat

SEQ ID NO: 60290 - DNA, 1050 bp, Homo sapiens
atctcctcaggctcctcccctccctcgtctccctggcggcgctggccttgcgtcctcgtggtctcagccgctcgctccgcccacaccgcgattggggcctgctcacaaaaaccttattgggtgacgcctgcgcaccagctgcgctttgccgtctctactaggatttttcttttttccccagatacacagaaatagaaaagagcacagtttttaaggggacatcattttcaccccgttaactttcaaaggcacgtaaaaacagtggcttccaaatgagcttctctagcagaaggcgctgcagaaagagggaagaggggagacctagtttgcggtgctgcctgccacttcctcgttgcctagtaacggtttccacggcaaccgcacagtcaacgacgcttagcaatccggagagaaatagggtgttttcttcccgagagaggactgctaagagggggttaaagggggacgatgtgaaggagagaacctgtggtccttcagaaggcgaagaagaaagaaaggggaagcagtgaagaaagggacggagatactgggacagggagaaaaaagttgtggagagtagcttttaaggagtcatttggtggccatggatccaacgtgctcttctgagtgcatttataacctcatacccagtgacttgaaggagcctccccagcctcctaggtatgtggataagcaaagactatcacttgaaacaagaatggggaatactcagtattaattaagcatacatatactggaatttttaataataaataaaatgtatttttgcctcgatgaagtagccttggaggataacttgttagagaaaaggtcgaaatatctaggtattcagcatctcacagttttacagagagggcagtctggcgctgtgagatgaccattttattatattacacttaacctcttattaatacggtatgtgattattgtgtaatttaattatatgtgatatacagcatagtatgaagtttcatgttgaaaagaaaaaaatcacaattctattatcttgtttaaggatacttgatgttt

SEQ ID NO: 60291 - DNA, 1035 bp, Homo sapiens
agaggtgagagcacagactttggctgttggcctcagtttcttcctctgcagtttggtgtgaagctcagagatggtgcatggagcccccagagatagtagctggcacctggagacccatgccctgcttgggccacacctctgctggtgcagggaaacctgggcaacccgaggtggacagaccagttctactggaagctggtccccatcacctgtacttttcccacaaaagactcccttccttatccccttcctcactcacccacaaaagaaccctttccttatccatgacctgtactttacccacaagaaacccccttccttacccactcccttccttactcaatctggcagggctcagattgcaataaagaagggtcagtaatccacaaatccaaatattcagtttcctggcagacgtagaatcattcatattcttgaatcaaaaggatctgttcacgattagaaaaaaaaattcatctaactgcgtttttcattaatagaaactgcatatagaaatcctctagaacaacatcatacaccatggagttgacaattcatcatgctctattctaggctcggcttcagcatatttgaaatcagctaggaggcttctgttgatacaaaatacagtatttgtagactgatctagtcctgcagcaggtggtaaagaagtatgaactgaaactgccatatggcggtgtgaaggaaatgtttctctccagagaaatacttgaaagtgtcataaaaacagtaaaaacatttaacagctcaaaaggcttaaattcagtatgtacagaaactgtgtcaactttggagtcaggctgctttcattaaaatctcagcagatagatgataactttcactcgcgtccatgtgaagagaccactaaacaggctttgtgtgagcaataaagcttttaatcacctgggtgtgggtggggtgagtccgaaaagagagtcaacgaagggagataggggtgggtccattttataagatttgggtaggtaaaggaaaattatagtcaaagggggggtt

SEQ ID NO: 60292 - DNA, 2914 bp, Homo sapiens
cagcctgagtgagagagcaagacattttttctgtctttagaaaaaaattggctgggcacggtggatcacacctataatcctagcactttgagaggacaccacttcctgtttcacagacagtaggggctgtggaggaagaactccttcagctcctgctctgtcgcaattggccagcttgcctgcgccttctctggcgattgcctgctctcctcccacccgtggaagtcatgtcccttccctctctaggggcagtcccttagccaacctccctagtttcttaggaactcccccagacatggcctctccctctgtctgcaaactttcattggcatggtcttccatatccattgggtgttcagtttcttcacctgcatttttaaaaggcccatccactgacccagtgcttcactccctcccttccctcacagtatcccctgccctctgccttcctccagtgccttcatgttccctccactattgcactggggccccctttccagcctctcctctgaagctggttttgcttgggtcactgatagcttccctgtgctaaatccaatggatgtgttaccagcagcaaatttgtacaggtctgcagcaacctcaattcttgcctcctcagaagaaagaattcgactgaggggcctaaggcagaaggagagacggaggcaagttttagagcaggagagaaagtttattattaagtgtagagtaggaagggaaggaagtaaagtacacttgtaagagggccaagctggtgacctgagagaaagtgtgtggtttgaccttggaatttgggttttagatgttggcatacttccagggacttgcatcccgtctccccggattcttcccttggggtgggctgcccgcatgcgcagtggcccgccagtgttggggaggggagcatgctcagtgtgtttaccggagttttgcgcatgctcacgtgaggcattcttcccataccagtcccagttttcctagaaggacatacaccaattaagctctgccattttgcctcttagtgtgcatggttgagccgactcacccaactcccgagatcttattgggaagctgatcaccagtttcaggtttttgtatctattgagagactgccgtcccttggcaccagctgtgaccaattagtattttagcgacacagttaacaactgcttgaccatcacgtgatggtcgccttcctgttgtgggtcggggagccctctcctgccctgctcatgcctgactagctatctactgtaacggacacttcctggttttctgaccattgggcactattgactgtaacccctccttgaaacatggttcccttcactctgcactttgttccccctccttatcctgaggcttttcttcggttcatcacctccagctcacttcctttaattttgccattccctggggttccgtgggccccctcctctctctcttccttatatatctgtgtccatacttacgtctctcaaataatatcactactccaggttgaatcacatctcccacacccaggtagctaactactcaccgggaacgccatggggcggccatgacggtctcaggcttaactcagctgagactctacttttcccccacgagttgtttgttctgctgttttcctgttccttgggaacctgggaagaacccaggacttgtccctctccttcccctctatgtccttctagtctgcctcttgtcagtccccactgccccaggccaggcaattccatgcccctggtcctttcattcgtgctcttctcctccctgtctcagcttccgaggtgacagcttacctgggtgacagcaccacacccatcacactgtgttgtgtcaacggcagtgatcgttttacttctccccatctagaccctgagctccttgtaggcaaggcttgtcttactttacctttgtgacctctgtgtctgttacagtgcctggcactaagtcggtaatttactgaatgaacgatgggcccactttgttgtgttcacctgtgccgagctgaggttcattgactcccactgcatccaggggataaactctgacttagtcttggagtggcagatacaagcgacacacacccgtcagccggaaggctcttgtcctctttgtgaatcagaaccctgtttaggcttctaatcccacatcaaagcccatctcctccatgaaatactcagtttttctagcctgcactgatctcttccttccctgaactttcaatgtatttaatgtacagcattgttcacgctaccactgtattcgtcattgattgtttcatatttgcaaaatgtttctctccccagttcagttgtaggctccttgtaatccggcagcccatgccttatatgggctctatgcgcttacgtgggcctctatgaaccctcaaaatgtcttttgccaaataaaggccaagccagatggactgagccctgtttcttctccttggctgtggccttactatcttcctgcccctcgtaaacagctttgcccctgggagtttgaggctgcagtgagttatgatcgtgccactgccctgaggcctgggtgacagagcaagaccttgtctctaaaaaaattaaaataaaaaatttaaaaaaacaactttgccaccctacccatcacaccccacccgcctgacctgcttcacaggctcccgacggccactggcttccaccttccccatctttctcttcccgcctccatctttcaagctgcgaaccagcccctgttcctttcgctgtccggctgtcaatgagcccagagtcccttagccacctagtgctttcttccacctcctgctgtctcttggggtcttctggtgtctgattctgtcagcggggcaggtggcagtacctgttctagcattcaggccacttggggctgatccacgcattgttta

SEQ ID NO: 60293 - DNA, 1527 bp, Homo sapiens
ggagccttgcccacggagtgttgaatttctcaattgaaatgaatacacttaaattaaaccaaagttttgtagaagaaatcctggccaggcacggtggctcacgcctgtaatcccaacactttgggaggccgaggcgggtggatcacctgatgtcaggagtttaagaccagcctggccaacgtggtgaaatcccgtctctactaaaaatacaaaaaattagccaggcattgtggcgggtgcttgtaatcccagctgcttgcggggctgaggcaggagaatcgcatgaacccgggaggcggaggttacaatgagctgagatcgttccattgcactccagtctgggcaacaagagcgaaactccgtctcaaaaaaaaaaagaaatcctgttggctttctgtgcagttttttgatgccattgtgacacagagaaactttatttcaggaactgcttatatcaacatcagaacttaaggaaatgtctgagtactactttgatgggaaagggaaagcctttcgaccaattattgtggcgctaatggcccgagcatgcaatattcatcataacaactcccggtgagctctttttttcattcctttcttgtttttatatttgggaagtctttcttcccggggttacttactgtttcatttcccatttaagaattagcatataccggctgggcatggtggctcatgcctataatcccagcattctgggagcctgaggcgggtggatcgtgagatcaggagtttgagaccagcctggccaacatggtgagaccccgtctctactaaaaatacaaaaaaaattagccgggcgtggtggcaggtgcctgtaatcccagctacttgggaggctgaggcaggagaatcgtttgaatctgggaggcggaggttgcagtgagctgagatcacgccattgcactccagcctgggcgacagagcgagactcttgtcttaaaaaaaaaaaagtagcatgtacctaaaaattcactttgtgatgtttagattctgactttaagtcactaaagtcactcaggaatctagtctggcatcttttttttttttgagacggagtcttgctctgtcgcccaggctggagtgcagtggtgtgatctcggctcactggaagctctgcctcctgggttcacaccattctcctgcctcagcctcccaagtagctgggactacaggcgcctgccactgtgccccgctaattttttgtatttttagtagagacagggtttcaccgtgttagccaggatgtggtctcaaggtatgagccaccatgcccggctaattttttttttttttttgtatttttagtagagatggggtttcaccatgttggccaggctggtctcaaactcctgaactcatgtgatccacccaccttggcctcccaaagtgctgggattacaggcgtgagccactgtgcccagcccataaagctcttttttgatctgggttctttaataaaatgagcttgggttttgctgagctctgttgcaagttaggttctccagg

SEQ ID NO: 60294 - DNA, 1027 bp, Homo sapiens
aatataatatttactcaggaaaagatatctgttagattgtactagcattctatgaacttttttttgtttttttgttttttgtgtttttttgagacagagtcttttgctgtgtggcccaggctacaaagcagtggtgtgatcttggctcactacaacctccacctcccaggttcaggcaattctcctgcctcagcttccctagtagctgggaccacaggtgtgcgccatcacacccagctaatttttgtatttttcatagggatgggggtttgccatgttggccgggctggtctcaaactcctgccctcaagtgatccacccaccttggccctgcaaagtactgggattacaggcatgagccattgcacctggccaatacattgcacctggccaatccttctaatatttttacatgaaatataaacaagtcctatttcttcagagtacaaattgagtataagccataactgtttttccccttgctttctccctccctccgctgtgcatacacatgtatacattttttttttaatgagtaatacctttaatccgtagacaaatgtgtggtattcatcgttagtccaagaatgaaaagcagtctctccatagaattgtttatctgcccatctctaagcctgacagatacacagagacaaaacctggacaaatgacattcccatgtaattacagccacaaaataaggaagacctgtaagggtcgcatgtcaattgctgtcatgatagactcctaacataattaacaggtaaagagagcttttgctcagacctctcagatgaaaaagtctcttgctgttagtgtctctgttttgaaaagtgtcaagaaatgtataattgcaaggcagaaaagaatgaggacaatcttttcttcctaaaaagacctaatagaaactttaaggaatgtgaattatgtagaacatgctagccacagtctcgaccacttttgtctttttattaaaagggctattatgtttttatttccaagaaattatgtgggttttttttttaaa

SEQ ID NO: 60295 - DNA, 1075 bp, Homo sapiens
attgcaaaatgtattgagaattggagggaaacttacaagctgcattctactaaggataccatttcttcatctcccttcctttttttagtgaaaataatattaaaatctaagagagggctgtctagggggattgttttgtgattgactgatattaaaatagaatccattttaggccgggcacggtggctcacacctgtaatcctaacactttaggaggccgaggcgagtggatcactttagtccaggatttcaagaccagcctggccaacatggcaaaaccccgtctgtactaaaaatacaaaaattagccgggcgtggtggtgcacgcctgtaatgccagctacttgggaagctgaggcaggagaaccgcttgaacccgggaggtggaggttgcagtgagccaagatcactccactgcattccagcctgggcaatagagcgagagtctctcaaaaaaaaaacaaacaaaccagaattcatgttattatcaaaagatgacttatttatttacatacttactcacttgcaaaatacattttgtactcatgcaaaatacattttgtagtttactaataaagacagtggcttgtttcccaggaaatctggtggaaatgagacctgagaggtcagagggcctgtccagttgttgttaagccagacagtagctgagttgagacttgaacccagagctgggtatggtaatcctgccttgtttctctctctctctctctctttttttttttttttctgaatttctattttctccagggctgcttgtggcctggaattaatgggctctcttcctattacttgattttcaaagcctcagagtaccactacagaattgcatattgtgggtcacattagcagaacactctttttttttttttttaattcatttttttgagatggagtctcgctctgttgcccaggctggagcgcagtggcatgatctcagctcactgcaacctccacctcccaggttcaagtgattctcccacctcagcctcccgagtagctgggattacaggtgcacaccaccacatgccacacctggcctcttttttttttacaa

SEQ ID NO: 60296 - DNA, 1026 bp, Homo sapiens
agaaggagaattttcttagaatttaacaacacaatctgagactgaaattcttgactggaaatgcggttttgtacatgcttggtgtccctctgatgtcagcatctcctgagtgtgtataatctagccccgctgcctcctattttaaggaattccttcagccaggggtcagctgctttgttgctgcctggaagcagcttatctcagaatgctctttctgtttcaggtctctgttctaggatgtcccgacccagtggtgcatgagatcgcctatcagtacggaaaaaatgtaggaatagcttttcaggttagtatgctttttatttgtaagaatggtggcgtagtgatacagtcagcattctcccctagtgtgtaatcgtcaaaatagtaagaacgatggcagcagtgttggcatggcggtgctccttacatcccatttttccttttgccagctaatagatgatgtattggacttcacctcgtgttctgaccagatgggcaaaccaacatcagctgatctgaagctcgggttagccactggtcctgtcctgtttgcctgtcagcaggtaggttttacaaactccctttgacacatcactgcatagccccacagaactgatgtcccgcggcacagctgatgggaagattgcataaaggaatagatgggaaggcattcagataagagatcacaggtctgcatttgatcctggctgagtgagatgttggggctggtcatttcaccttgctaagactgtttccttatctgtgaaattgagaagatcacctttctcccagggtggttgtgaggattagctaagatcctatttgagatctttgtgtcttgtggtgtgccataggcatttgaggtagcatcgtgattatttccatatattttggccactggcaaagtgaacggtttctaagtcttgattataggactggactttggtggtcctcagagccccttaaaaggcataggaagcatcaagggcctccaagcataagaaattctccggttctagaagttta

SEQ ID NO: 60297 - DNA, 1049 bp, Homo sapiens
cagtagacccacatagttccttctttctccggattgagggactgagtcccccttaatgtgaatgaaaggcttaggaagcttcaaagatgttccctcgactgacaaagcagacattctcacagcctcctccagaccctgccacatggcttgtggctgtactgaatgttacttgaaataagtgagacattagctggtgttggaacatctcgttaatagattttcatcttagtagtatttaatttgttatgttgcaaagcagtaagatgttcatcaccgtgccatgaaattcaacattagctctttggtgtaaaattatagtaacttttggtctttcagagattttgcctctattctgtcttcacgtttacaaaggtcagtcatgtcctccataaaattcagtgattccactgtgatacagaaaccacggcccttgcttttggtgggtttctgattggagagaggaaaggtcatctttcacccactatctagcatagccattggcagcatgattcttcccaggggaggctgacgttctgggtggctggaccaggctactttggcagcttgctaaggctatgaatggagatgttggggtactcggtaggaacacccaccctcattattacaaggcttccatcctctcaaactttggaggctgaggtaagaagtgaaaggtatgctgtaaataggtcctctctcccaatgaggcttacttgccagcccaaaatcaaagagtataatacatgtgcccagttttgacaaaaatttataaaacctccttttgtacattaaggcaagagtgaggaacatttgagccatgtaggtgttatgctggggattagaaaaatgaggcactggctaccagtaacctatataactgcgaacattacttctcagatacttgttagtaaacatgagtgaaggaaagcaagatggactgagtgtgctgaaatccagctagcttggtaaagattcctttacctaggctcagattatcaggataaaaggaaaaagcctttttccctggagaagtctatgagaaagttttg

SEQ ID NO: 60298 - DNA, 1061 bp, Homo sapiens
tagattactgacagatactatgcagaggtccatttcccctttcccccactatatatgaaagcagagatagccattactcctttgtgtgtgtaggggaaagtaagttagtttcttctgaaatatattcagagtgaaacacagtccgaagaggccagcctcctctcacccagtcaccttaaggtttaagtaggactcaaccggtaacttagtatcctggggttcataacaagtacttaacaatttgaagatttttacaaatagagcaaccaaaactttctcatagacttctccagggaaaaaggctttttccttttatcctgataatctgagcctaggtaaaggaatctttaccaagctagctggatttcagcacactcagtccatcttgctttccttcactcatgtttactaacaagtatctgagaagtaatgttcgcagttatataggttactggtagccagtgcctcatttttctaatccccagcataacacctacatggctcaaatgttcctcactcttgccttaatgtacaaaaggaggttttataaatttttgtcaaaactgggcacatgtattatactctttgattttgggctggcaagtaagcctcattgggagagaggacctatttacagcatacctttcacttcttacctcagcctccaaagtttgagaggatggaagccttgtaataatgagggtgggtgttcctaccgagtaccccaacatctccattcatagccttagcaagctgccaaagtagcctggtccagccacccagaacgtcagcctcccctgggaagaatcatgctgccaatggctatgctagatagtgggtgaaagatgacctttcctctctccaatcagaaacccaccaaaagcaagggccgtggtttctgtatcacagtggaatcactgaattttatggaggacatgactgacctttgtaaacgtgaagacagaatagaggcaaaatctctgaaagaccaaaagttactataattttacaccaaagagctaatgttgaatttcatggcacggtgatgaacatcttactgc

SEQ ID NO: 60299 - DNA, 1058 bp, Homo sapiens
tacactgtaaaacaagagattcttagcaagaaatgtgtcaaaagatatatgggactaagattaattcaggtaaaaacaagttccaaaaataacgtaagaatatgcaatatctccacttaatgaaaatgtgtttttagtttacaaaggattctttcatacattatctctaatctcacaactcctctttgtggtagatattatggtgtttattctgcaagtaagaaactgatgcccaaacctcgccaaaattaaacatctggtaaatggcacagcagggaactgaacaagtctaagaccagtattcattttattacatcatacatagtgttattgccactggtaatgctgagaagttagtagctatgataccacacaggccttcccacagagcaggtaactaacccacctgggcactgacgatactcaaagaatcatctctgtgtcatgtctttgctattgtaaacaacatacctacttggtggagtagttctaagacgtctgtaatcctttccctttggtaggtgagttttgtttgctgatgagatggtctttgaacttttccatttgtgaacactggaccaggacaagcattcttgggaaaccaccttttcctttttaatttggtgtggtgggttgtcttggagtttactccagccagcacttgacagaaactccctgtcttttggaattcctttatttttaacatctctcttaaggggtttcctgataacagttggttcagaggatttaaaaagagttttggggatttctggagaagtcccaggggatgacagcgtcctcccatgtacgtatgtgtacatattctctttaagaataaaaacctcatgttaattggattttgaaagcttcagaaacaaaatggaagtgttttactttctctggtgaaacttttttaattttcaaatatcttttttaaaaaaaccaaatctttcctttcttctgcttctcttccttatttgataagtcactagacccaaacgtcagttgtagccacgtttccaaatgccatcaccagcccctgcaccagctgcacaggc

SEQ ID NO: 60300 - DNA, 1120 bp, Homo sapiens
gtggcacgcgcctgtagtcccagctacttgggaggctgaggcaggacaatcgcttgagcccgggaggtgaaggttgcagtgagccaagatcatgtcatgcactctagcttgggtgacagagtgagaccctgtctcaaaaaaaaagaaaaaagaaaaaaaaaactattggataaagtgagtgcctttggaagaaaggaagctgattttcatcataaaccctctgtactttcattttgttatgtctttattctttattttttaagtaagttttacttgtgttttttttacatttaaaaatgttgtataaagatactttgtacatagaacttctgagaaattctaataagtaaaaattaggggaaaacgaatgactatgtaatattgatgagctagttgctttgcatgctaatagaataaaaatttgcttcaatatgagaaaaaggcctaaaggaagttagcactatgagtcgggaaaagaacattagagatgtagtttgactgttaactgtaatcctcagctcatctgatctcaaaactatgtgttcatttattatagcaggaagttaaaacgctgattcagtcagtgacaggcatctgttctgttttgttctgtatcttatagagtgatggtgtgcaacaaacaacctacctcgcccagcagtactgccatgaagcaataagagagatcagtaaacttcgaccatccccagaaagagatgccctcattcagctttcagaaattgtactcacaagagataaatgacaactctttctgttctttctggcagctatcttaccagactgtgcctaaagaattttgtggaatacactttgtttgcttcatgtgcagataaccaaaaatcattttaaaagatatcaaacttattgatgggcaatttatttttttttattgcaaaagttttttcagaaaactttttaaatgtaattaataaaccacctgaatctgtcattctagtcctataaattataatcaaggtatcttgatggttatatgtggtattgtttacactgttaatatccacatgtaaggccattacacaaataaataaccaatgttaaaattcaaatggtttgtcttgatttaccgtaggagtaaagg

SEQ ID NO: 60301 - DNA, 1641 bp, Homo sapiens
tgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaataagtttgatatcttttaaaatgatttttggttatctgcacatgaagcaaacaaagtgtattccacaaaattctttaggcacagtctggtaagatagctgccagaaagaacagaaagagttgtcatttatctcttgtgagtacaatttctgaaagctgaatgagggcatctctttctggggatggtcgaagtttactgatctctcttattgcttcatggcagtactgctgggcgaggtaggttgtttgttgcacaccatcactctataagatacagaacaaaacagaacagatgcctgtcactgactgaatcagcgttttaacttcctgctataataaatgaacacatagttttgagatcagatgagctgaggattacagttaacagtcaaactacatctctaatgttctt

SEQ ID NO: 60302 - DNA, 1221 bp, Homo sapiens
aatctggggacagtcccttaaattagcatgggtccttgaatgagtaggatgtgatttaccttccagtaactgtgttttttcaaattagatagcttggattgttacctggtttactgaatggctatgcagctttctttgcctgataattattttgaaaagccggtgctttgcatatgataggcacttggtatttgaatgaattgaaacatctaataaattctaaaattcagagagctttcttaaagtgattgacagaacctattgatgtattcagtctaatcagattgtcatttggctctaagattaagccaatgatttaagtacatggttggccactgacctacttatattgatagatacaaaaattaagaaatcttcataaaaatagttttgctgtgctatatatttaattgtctttgtcttaaaattcaagtaaattttggatatagtgcactcatgtgatatttcaactgttttttccatagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaatt

SEQ ID NO: 60303 - DNA, 1046 bp, Homo sapiens
tttacctgatattatactagttcattgaacagagctctagcctgacattttcccatttccctgtttacacctttgactgtgtaaagcacacacatatatactgaccacgaccatctagagtttgaggtatgagtcatttttattgttttgtttactgtaagttcctttttgtttgttttttttaattacatcttcaacactttatgtttaaatcttaattgttgatgtattcttagaaaatcgaatctttaggatctaggctttccctcatcccgtgcttatgttttactagcaataatgcaaaattttagcttgctttctacattaaaaaactaattatgaatataaacctttttaaaaatactcaattagattttctactggttggggattctttttccattttttcaacttgtaaaatgtaaataacagagtagaaaatctgcacacagaagcagacctaatactaccaactttacttttctcttcatcaaaacaaacaataatcaacaaagaaacaaaaatctgtccacaggagactgaatttttagggaaccaaagctgtttcaagccaaaatcaggggcatgaatgagcagagtgaagagtgatcaaaccattaacgtaatgttactcatatcattactgcagtccaaatgacaaaagtgacatagatttattttagattgttaacatttgtcccgatctgaaccttggaataaggaaactactcctataatccttataaaaagagacattgtctcctaacaccctgcattcattaatttgtagtacttccagatacccttatttttagctcattttgttatttttaaatgattcttgagtagcataaactttaacacaccaagcttttatttctaatcattgcatgttttattatagtgcatgctgtacttaagttagagctttcttaaattctgttaacttataagtttccatctagacttatttttgattcaaatcaatcatatgaatctttttagttgctgatagtccaactccaccgccaccacctccaccagat

SEQ ID NO: 60304 - DNA, 1053 bp, Homo sapiens
acacaaacattgtcaaagttttccttcaaattaatataatgaaattgctggctatcacttttaaggtcattaacgtgttcagaaatgagttcaaaaccgattaaaactgtttgtgatgcctgcttaattactctgtctttgaataattctaatggtgggaatttcttttgatttctttctgtttacctcaaattgcacatctcaacactaattgcagtcagtgtttaaaagctggtaagaaaagaaaatagttttagcatataatgttaggaagttagaatagtgtagggtagtcattaatatcactttccatattaagatgttcaatgcaaaaaggaaaaaaaacaaaattagaaatgaacctgttgtccactgtttgcttttagcttaaaaagttgtgcccactgggcatagaatgagacaagctttcctacatggcttttgtggctctttctagagccacatgttatttttgtttatataaaaacacttaatactcagtgaattctccatatttacataggaggttgctttaagttctttttatttataatgaatgacctgtatatgtattttaaagcagagctaggggaaagttttttttttttttttttttttttttgagacagagtttcactcttgtcgcccaggctggagtgcagtggcgcgatctcggtccactgcaacctcaccctcccaggatcaagcgattctcctgcctcagccacctgagtagctgggattacaggcgcctgccactacacctagccaatttttgtatttttagaagggacagcatttcaccatgttggccaggctggtctcgaactcctgatctcaggtgatccacccacctcagcctcccaaagtggtgggattacaggcgtgagccactgaaagttctcattagttttttgtttaaattttaaacataaattatgttatagcaaaaattcctaagaattgaaaaccactttatcagaaatatcaaaattcacaaataatcccaaaatttatatagctttttttccagactaaaatattaaagctact

SEQ ID NO: 60305 - DNA, 1018 bp, Homo sapiens
tcaaaatgttgagttttcttttcttgtactctgacctgaattataaactattttattagaaaacatttctgtccctcctccttctggagctccaccagcaccacctctggcaccacttctcccagtgagcactgtgataggtgagattgcatagccattggagccattgaactcactttacataattcataataaactcctctgtgctagtagagtgctggcttttatagttattaggttgcaggtgataatacaaagtttaaagtattaaatctaatatcactaacttctggtgaaaggcttctgcacttatacagtaaacaaatataaaacaactttttctataatatgaaatgcttggtttataaccaacttaatgtgtttttaatttgttgtttgtttagatttttctagtctaatcccccctgccccgcacaagtgaaacttaatttggaactctctggtatatacaacagtcaaaggatcagggtgaaggtggggacaggaggagaaaaattgaaaggcaaacgatatgtgtgggatggggtactctgaggctttcctgtggatcatagtttgaaaaactctgatatggcccagtttttatgacatctcaggatgccatgaaatagttttctcgataaaatgcatttaaattgttcacaagttggggatgactgaactgagcatataaggaattttaaatatattttaaatgtcaatgtaaaaaccattgagtctagaaatacacaatcacagtaatctgggtagaaatggataatgaggtgtttcaaataatgagagctgagtttcaggttaagtgaaataaagctgtctaacaacatcttttccaaacatttgcacataccaaggaaaagggagaaaggaggtagtaaaatgaagaccctaagaatagaaattgttggtagaaaatctgtgagaaaaaaatagcctcaacccaattaataaccagaagaattaaaattaaaaccacagtgagatactattttatatccag

SEQ ID NO: 60306 - DNA, 1102 bp, Homo sapiens
gcttcctatgtaaataaatttagcttcctgtttaaagaacagtggcttatgggtgactgtactgagaaaaatgtacattttaaagtttgctattattgagcatttaaaaaattataaccataatttttagaaataaggttaggactttaaattaccctttcctatgtttttcctaggaaaaggtaacaaattttagttttcatgttaaagtaacaaaattcatatatcccagtgaagaatattttttaaaattacaaactttgtcatatatatttttaaatcctggtatacatggtcacaaagggagactcacatatttttgggaaaaatacaattttatcttttttattcattattcctttctccactatgctcctttagacggaatactccttataaaaccctggaacctgttaaacccccaacagttcctaatgactatatgaccagtcctgctaggcttggaagtcagcatagtccaggcaggacagcatctttaaatcagagaccaaggacacacaggtaagcctttaggttgagtatctcaacatctctaaagtgggtgtaactgactggcgacaaactcctatggaggtgctgagtaaaggtgaggtgccactctaatgctaatataaaatgtaaaagttgggggaataatattatatatgttcctgtaagtttgtgttataacttctgttttgttttgtttttttaactttttaaaacatctatttgtactattaatggattgtttgtatttcctccttttgatagaggtacagactctatcagactctacgggttaagactaaagaatttttttctttttttttttgtgacggagttttgctctcgttgcccaggctggagtgtagtggtgcgatctcggctcactgcaacctctgcctcccaggttcaagcgattttcctgcctcagcctcccaagtagctgggattacaggcctgagccaccacgcctggctaattttgagttgagacggggtttctgcatgttggtcaggctggtttccaactcccaacctcaggtgatcctcctgcctcggcctcccaaagtgctgggattacaggtgtgagccactgt

SEQ ID NO: 60307 - DNA, 1055 bp, Homo sapiens
attcattatccagtaaagtgttaggtctcatgcaccgatatgttaaaatagcttcacatctaatgtgttatggtgtttgtatttaaatgagcgtatttttaaaatcatctgttactcggttggattagttccataggacaaaatactgacttaaaaaatcattgagcctgcatgagattggaataattaagtggtggtttccttatgaatataattcttttgaaaaatacatgaaacacatgagtatttccccagtacgtatggatctctttttctttacaaagtagttgaaacatggctggaaaaaagcttattaacatgaattgagtaactgtaaatgtaaacctgtcctatcggatataacttacctagcattaatgtctactttttccccccctttttttgccaacgtaaagtggctaaaagccaaggtaagagccattacttatcatttgatccacagtatttcctctgtattgatagaggctgcagagccactaaaatttgaaaactcttcttatgtctgtctgcttttccctgtaggatttatgtagattatttaatactcaagttcagttcaaataagcaacatttagcttggctgtgttaatatatcaatgatatattgacatctgtgtttatataggaacattaattttgctaacatttattgctttgctcatttttcgatagttgccttgctttcattgacttacaattaggaggtttcccagacatcatatgtgactttgttactgaattgttaggatgaagatgatttttcagatgcgtatttgagcaaattgacaagtaagatctatagtttgtgttcatgcacacatttcaaaaattttaggaaacccagtgtttgaatgcagataagtttgatctcagtgaacatgtttaacaataaaataagatattaaatccagtcatctcacctgtatttggctacaatgtgatataaatggcataaaataataggaagaccaagtgcaagtggttccttgactttttaaactgtagtaccaaagtctttattcaaactgtctggg

SEQ ID NO: 60308 - DNA, 1027 bp, Homo sapiens
ggtaaatgttaaggaaacaaagtgagatttttttaaaaagagacagggtctcactgaagtgcaatagctcaatcacagctcacaactttctaggctcaagtgatcctccctcctcagccatccaagtagctgggactacaggtgtgcgccactatgcctggctaattttttatttttttttttcaagagaaggggtttcgccttgttgcccaggctggtctcaaactcttgggctcaagcagtccacctgccttggcctcccaaagtgttgggagttacaggtgtgagccaccgtgcctagcctgaaatgagatcttaaggaaataaaaaagtttcattttggatatattttggggatatttaaataaaaaattttatagatttctaacaaaaatattagtattttgaggtgtaagatgtagaggttatttcctactaacacttgccaacattgacacatctgcatgtctaataacacttaatagaggaggccgaacttcataagaggttaaagcttataccattgcatagtagcacagagttcaagtagaattttcattcccaatctaattcttcttttattctttccatttgggaccagcttatacttgaatgctaatttttttgtttcttatccacttgaaatgacaaatgaaggaagatatgtggacatatttagaatattttcttggttattttaggatagtatttagtattatgtatatacattataagatatacattgctatgtaagtatatactatacatgtatagtatatatcataatacagatactgaagtatacattagtgtattttatcttcaaggatcctaataatgttatactcaaaatttattctctagatgtgaaatgtcatggttaggtagggtaccagatgttgtttccagatagaagtaagcagtatcattttaaacaaatattgaagtgtaccaaatttctcgcacagtttctataaatgagaatgtatccaaaagacaccaaatctctcctttggatgatttcctt

SEQ ID NO: 60309 - DNA, 1783 bp, Homo sapiens
cagcctcgacctccccggttgaagcaatcctctcacttcatgtccccagtagctgggaccacaggcacatgccaccatgcctggctgttttgtactttttgtagagacagggttttgccatgttgcccaggctgatcttgaactcctgaactcaagcaatccacctgtcttggcctaaagtgctgatattacaggcatgagccaccatgcccggcccacataccaaattgttaggaaagaaaactgctttccagagaattgttttagaatcaaatccattacattagttggtgctttaaaccaccactaaatattctctgcttttagcctagtataatttaatagtattcactggaaaatagacatatggtgtacagccctgtggtctgtcctaaatatggtccagtgtatatggatagcaaacatattatgtcaaataatattttcttgttttgttcaaattaaaatatagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaaggtaagcattttatattacattaacaagctaatttgcatatccagtaaatattttggataggaaatattgtcataaagatgattttaatagattctctttagcagctggcattataattttcatacaatatttaatatgaattttactaaggttggggtgcaattttatcagttgaataggctgtattaaaaagatattaaaattagaaatggttattaagccataaatcctagacaaatattacccatttgtgttgtgaattctatgtctttctttcactactgaacatttaaaaataaaagtctacatgcttttcaaaattactttagaaaataatttataaatacttttatcgtttcatttctaaatatgtatatatatttgtatacctgtgtgtgtatctataatgccagcaacttattaaaaaatgaaaattgtatgtaattttgtcttaatgccccccaatctcccccacaaaaaaacccccaacagattttcaggagagatatgatgtgttgcctgtgttcatttctaagcatgggaaattagctgatcttgaaggatacctgtagtgtgtcagctttttggtatttatgggtcattttgcaagcatttggaatgaccaaaattctttcgctgtctctgctcaggataaactattcctttgaaatttggtagttcctttccaagaggactatttgatttggattctggtcttcagaatattttataagtttttaaggggtcagctagaatcttgaagcttgtcctagctgattgatctgactggtgctgttgctagatctgttacattctggattttctggggttcctggtcgagagaggagtatagctgacagcattgacctttattctgcccctctctgagactattggaatctcctcttcactttttatgtctggaaattgtatgtaaaattggaacacattgcaaatgcagaggtgactgcttgtttatttcttgtgtttttatccagggatgtggctaggattgtataagagctgaaattcagttttaattcaaggtgctttaaactagactgatctctgggattggagtttcgagaatctggggaaaatgtcttttgtgttactatccaccttgggatttaa

SEQ ID NO: 60310 - DNA, 1069 bp, Homo sapiens
ggtgaaaggggccgagtgatggcatgtggtgatgcctctcctgtaatgcactgcactctgttacaggagagggaccaccagtttagggaacccaaactttgataataggtagtaagccttgtaagcctacctgaacttcaccctggagggagatgacttttttttttttttcccagacagagtctgactctgtcgcccaggctagagtgcagtggcttgatcttggttcactgcaacctccatctcctgggttcaagcgattctcatgcctcagcacccccgcaagtaactgagactacaggcatgtgccaccgtgcccggctaatttttgtatttctagtaaagacggaatttcaccatgttggccaggctggtctctaactcctgacctcaggtgatctgccctactcggcctcccaaagtgctgggattacaggcatgagccaccacacccaactggagatgatatctttattgtactagacagcaaacaaacctgccttttactcctgagggagacactgtttcttgatccctcaagaccattccttatataatacaaacatatgtagcaagttggtatggaacaaaatgagtcagtccctctactcacaacaggtacagaaacatgaaagactcaagtataattgccttccaacagtattcacccttcatttctataccttcttggcttctggtaagatttctttcccatgattatgcaacttcatttgtcactctgattaatcttaccgacagaggctgggaccagatccattcagtttttcttataacacatttcattacagttactgtcaacaggatagcaggatgaggccagactgcaatattgacttcaattatgctccccagggtccaagacccagccaacagaacaaatgcaataaacctttagggtctacctaagagagccaggtggctttctctttgtttctgtgctgactttactcttggcccaaggcattaatctagttactgcagaatatagagcacagatttggccttggtctacaaagaggaagcgtagggctattcttctatctgtaac

SEQ ID NO: 60311 - DNA, 2173 bp, Homo sapiens
ggtgatggtttttctaaaatcttttttttttttttgagacggagtctcactctgtcgcccagactggagtgcagtggtgtgatctcagctcactgcaacctctacctcccaggttcaagcaagtctctctgcctcagcctcagtagctgggattacaggtacccaccaccgtgcctggctactttttgtatttttttgtagagacggggtttcaccatgttggccaggctggtattgaactcctgacctcaggtgctctgcctgcctcggcctcccaaagtgctgggattacaggcatgagccactgtgcttgtccattttttctaaaatcttcagtgcctgaactcatcatggtagactgtgactattatttttcttttctaaaaagaggagtatttgaggctattgggatttgttgaactgaaatagagaaagattcattcaacaaatagttaattgcctactctatggaagactgtctgttaggtattatgatgtggtggtatgatgtctatattattattattatttttgagacagagtttcgctcttgttgtccaggatggagtgcaatggcacgatcttggttcactgcaacctccacctcccgggttcaagtgattttcctgtctcagcctcccaagtagctgggattacaggcacatgccaccatacccagctagtatttgtagctttagtagagatggggtttcatcatattggtcaggctggtctcgaactcctgacctcaggtgatccgcccgcctcagcctcccaaagtgctgcgattataggtgtgagccatcatgccctgctttgtgtctatattatttataagctatgtagaaatcactgaaaagccttaaatctaagaaaaagaaaattggtctatagtatgtatagttaaatgaggaaatgttctgtatggaagaaaaataattgttatttttgaaagggttttgattttagtttgggcagtcagaagtttgcttatggaaagagaatatgtcaagcagctttttttttttttaaagcatttaggtaatatgttcctataaaagggtcaatacagttgtattaaaagtcaaacctaaaatgtctcttcttcttctccccatactgctattatcctctcccctcaaactgtatgcttgttttctgcctttccagtttttgtacaaaggatgtgctttgggaagattcatcttacattggtacgggatggattggagaagggagagactggatggacagtgaccagttagaggactgtcacatttgtctcactgtaaagagtatttcatgaattgagatagctgtagtaagattgaaaaggaagataagaatcagcaagccttggtgaaggagatatgggtggctgcgggaaaaggagaacccaaagaaggcttatttaaccggtatctattttcccctagcataaagctaatgcgcctacagaaggtaatttgcagtcacagaagtgaatctatagaccccctctttttcagctgttagtacacagttggtttctgacactttccagcttttactcctccacaattgaattgattggcagagcagtgggttggagaataggaataaagcttgactgctagctggctgcgtgggcagaacagggaagggaagagggaagaggagaggaaagggattccagtttctctggctatatactgttgtggcatgaggtgcatgtcttttgatgttaattttgatgttctatcataaccttctgcattacagattgttggtatttttatatgtgtagtctttataaatttcaaatacatatgacgtgggttgaaaatgatctctttttgaaaggaacttttagagagaattctaaggaacagtagtgtttgggggttctcaggcaaagtttctcctaaagaatgagtttagccgagtcattaatttaaagagttgaggggaagggggattgggaggcaagggatatatataggtagtaggaacagaaagatagcaaggcatgtttgggagagctgtgagtagtgtcaagtgccagggaaggtggaggagatgaagtcttagtcaaaaacatacttgaactgctgtcactaaactgtagaagatcggatcagtgtttcccagatttgaaaatagaaaccgtgttttaaatttaacactggtaaga

SEQ ID NO: 60312 - DNA, 1012 bp, Homo sapiens
ggaggcggagcttgcagtgagctgagattgtgccactgaactccagcctggcagcctgggtgacagagcgagactccgtctcaaaaaaaaaaaaaaaaaaaagtaaggtaaaattgatagttaatgctaattttgaagcatttacaaagttttgattgggaggttgtatatttttcctaatatcatcttgtgttgattgtaatatttattgaaattatggtttgattgtagaagaaataatagtcaaaccccagaactacaaactttgtagatcttaatatttactaagacatcatgttagaaaaaagggattttttttaaaaaaaaaaaagggcattgttgagaaataagacaataggaaagtagcaattactggattttttttttttttttttttgagatggagtctcgctctgtcacccaggccggagtgcagtggtgtgatctcggctcactgcaagctccgcctcccgggttcacgccatcgattttgtttttaaaggaaatagttgacgtggtcattttaacagtaaatatccatcccttagaatggagacttgagatttgactactgtgtgtcaatccaaataagtacttttaactttggatctactaattttctccatctacaaaataaaactttctcagacatagttggtagtgaacccgtgtttatgaagaaaatctgttaatgagggaccacacccagctaattttttgtaatttttgtagagatgggattttgccgtgttgcccaggtttgtcctgaactcctggactcaagtgatcctcctgccttggcctcccgaagtgttgggattacaggcgtgagccaccatgcccgaccagcaaaaacacatttttgaaaaacttcaatttacctttaattcactcatttcctgaatgctttatcattaatttttattaataatttctacattctttgacaaaattgtatttggtacattttatttttccttctatggaaaggcaagtgtggcactttttcaga

SEQ ID NO: 60313 - DNA, 1043 bp, Homo sapiens
tagggctgctatcattaattatcaaacacgaattgttcttaactccttggaaaaacggcttaccctcccttctcccaaaagttcttgagctgtaggcttcataagtaacttaaaatagactggtgtcatcgccggttgcttattttctgaggtttctctcttaacaagctaagtaaatgtatagtatgtgaatccaaatacagaaacgaacagaggtagcctctgaactacaacgtaaaaatatctgttattgtaaattagaaaactcttgggactttgtgacagatgcttgtttgttcgtttctctttggatgattggaagtgaattgtgtgtggtagtttgttttgaagatctttaactgtgtaaaccaacagtttgcgctagaaacaaagtagcacagtcctttgtataaatataaaggcaccaggaatgctcttgcttttggtaaggcaaggccaaaacgtgctttgaaaggttagggttattgcaattcagaactaaattgtttatagaaatgtctcccatgtgattataatttttaagaaccgatgtttctgtgttggcaaatgcttcccctctttatttttagagggagatgctgttttcagaatgttttgaatatttctcagttttcatgttagtaacattgtatcttcagtagcactactcggaatttatcttcacaatttttttttcaagctttcactttaggaattctcctgataagtgaacttgttgaatgcctgccacatctactgtatcactttgtgcaaactttatatttagcccttcgaaaaacttttaaaaatctagtagggatgtggatatggtttgcaaatataaaagtgatctcgtagtttatcgatattaaaaataggcaacttttattcaacttaacatgaaaagccttgaaattgaggagaaccttaatttgctgaaagttttaaagatttttgaaagccaaaaggagagcacagtaagtttaatttctcgctttccagaaaagttatgtgttctctgtagaagtcagtagataagtgct

SEQ ID NO: 60314 - DNA, 1188 bp, Homo sapiens
ggaagtaaaaatctagttttccgtactctgtcccctttttaatccttctctgaatgggtgtccttgattcactgacatttcctaattaaccaagttctgccaagtttcacatgaaacttggggaaccgatttcattcccccagtatcaccctgtggcgccaccttccggagctgtgaggaaactccggacttccccccaacaccgccccctccctccaccctcggtctccgctttctgcgctctgccgcgttggttttcggaggtgtctgggcgcatgcgctttggacgggccgcctagcctaggagagactacaattcccagaagacagtgcgaaagaaaaaaaaaatcccgcggtccgtgggggtgggagaaataaacgctcgcgagagaacgaggttcaggcggctgcacgaagggggtggaggggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggtgaggcgctctggcggccggcgggcgctggccgggtcgaggacccgccggagtgaccagcccactgggcggggtggggaactgccctgacctcagcggctgccaccaacccgagcccctaccgcagccccaaccccagccccaaccggggacagagcgagtggccgggctgagggagtcgggctgcgatacaggaagtggctgtggtggtggaaaccgatagaaggggagagagaaaatgggcgagggagccgggagcccgccgctgccgcagcccggcgcccccctcgcgtccgcttcccccagggcccggccaccggggtcgcgcgccccccaggtagcctccagtccgcagggctggagtcccggaatacccccgagctgccgccgcgccgcctctctgcgccgggagaggaggtccaggacgggagaggggagaggagagggcagggacgaggctgaagccgcagaagggaga

SEQ ID NO: 60315 - DNA, 1833 bp, Homo sapiens
gttaactatgaaatcttttaggtaaggaatataattctttctttttcattctagctgctgctgaattggaatctggatcaatagcttcccctctagggtctactgatgagtcaaatctaaatcaagatctagtttggaaagcatcaagagaatatgtacaggttttaaagaaaaattatatgatctgaaagataagattttattactgggctgtttatgtgacattttgtttctcattaaatattaatatatgacatgtaaaaatattaaaggaacgtatttttgtatcatatatgtcagatcaaaatttatatagtattttaaacaatgttacttggcttctttaacttttaagtggattttgccaatgaaaaccaggaatattgagttttacatactcaaactgcccaaatgtgagctgtttaaacagccaaaccactaagttgtcattaatactttagtgcagttaattgatggcttatttgtattttgtaatttttatcactatatgtagtggtagatgtctaattggacttagacatcattttgttgtgcaggaactgtggtcattgttcatgtttggatgtattacaattgttacagtgccatcaaatttacataattttaattttaagcactgatttatatagctgttctcagggagaaacaagatttgcctgattcaccttttctgtttgtttatttatttttaattaaccttttggaaatagccttcagtttagagaaaatttcgaagttttagtacaaagactttctcctccgaacaatttgagagtaaattgctgacattatgtcatcacccctgattactttagtgggcattcctacaagtcaggacattctacataactacagtgcaaaccttgcaatcagaaagtcaacattaatacattctagtttgttacttctctgtaatgtcctttatagcaaaaggatcccattctaatccatggcttgtatttagttgttgtatctgttagatctttcagtctggaacagttcctcagtctttccttgaccttcatgaccttgaatattttgaagagtaaagtctggtaatataagaatgtccctcaattgggtttcatggtgattagatttagattatatgattttttggcaggagtatcacagaagtgacccagtgatcttctcattgcatcttacctgtgaccctacagttttgatttgccctgttactggtaatgttagcattgatcactaacagtggtatctgctgaatttctcctctgtaatgttattttttcaccttgtggttaattagtattttacagggaggtaatttgagactatgtacatatctctactccccatcgaaccctcaatttattcatttgcttgtatcaaataaaccatggattcatggtttattttattcagtgagttataattcattaatattgttattaaaaatttgtttttcttttaagaaatgttatattttgacaacttcagacttacagaaagattataagaggtagtacaaataatttttggatattattccccaaatgttaacattttactgcatttactttatcctttctcccccttctcctcctgtctttctagatgaatatgaatataggtacttaatacagattttttttctaaactgtttgtaggttgcagacacgatgcctctttatttctaaataatgtgtatttcctaaataaaaggaattaccttacataactgtagtataatggtcaaaatcaggatattaacactggttcaatgttaatatctaatctatagaccttacgcagattttgccaattgtctccaaa

SEQ ID NO: 60316 - DNA, 1058 bp, Homo sapiens
tttaatatctaaaaacctatctgtgtcatcctttggaagcatcaaaaattatcttgatttagcttatgctttctttctgcctctttgtgtgtgtgtgtgtgtgtgtgtgtgtgtagtaataaaatatatcatgaaaatttactcatttcccatggatatcccccatgtatacctgaggtatacatgttattaaacttctgtttgttttaaaacatatatgcctcatacatatacaaaagtatgtatgatttaagagtgaaatgagcaatcatgtttctactatccagatttaaaaatggaatgttacccattgccttggaagcccctaacatggctgcttttctgtttatttgctgagtacttacgtttgttctgattctaattactatttttctctcattgtctttctctaacgtggtttggcatcccttttactttgttaacgttgtgctagtaaagatttctggatctcttctgaaagcagcctttgtgtctttatacatgctttctctgctcatttcctttcttctaaaactctgcctgtttccttttccccttaactcagacgtcaaaaatgtttctttcctgtctcttatctactttgaatgatcttgatgttttttgtgtgtactttctttttttttttgtacttttcttcttataaacagtggtcaacggatatcaaatgtatttttgtgtctttttcaaccattcatgtataagtatgtgtatgcttttcttttctttttttttttccctggaatctctctgttgcccaagctggagtgtggtggtgcagtctcggcccactgcaacctccacctcctgggttcaagccattctcctggctccgcctcccaactcagcctcctgaatagctgggattacagacatgcaccaccacgcctggctaatttttgtatttttagtagagacagggtttcaccatgttggccaggctggtcttgaactcctgagctcaagtgatccgcctggctcggtctcccaaagtgctggaattttaggcatgagccactggtccagcctaagtatgattt

SEQ ID NO: 60317 - DNA, 1059 bp, Homo sapiens
aacaaaatattttcaattacttttaaaactctggaaacactttttttcttaaaactattatttcttatgagttcatgagtaacatatgtttaggcatataaaatgcagtttataaacctaatggcaataagaacggatttgaaaaaatgacttttcttaaaacagctcatatctcttttctggaatttaaattaccaaaatttgttaaaaatagaagtttttacatataaaatactaagtgttaatgaaaattcctttttaaaaagttattttagatgtacgttctcatttctgaagttgctctagaaacactgtcatcagtagttcaagatattccagtttttgttaaatcaaatcttactaagacaatttttagaaaactttcatctggttcccgttacattttttatactcacctgacttcaagatgagctatctctcattctctataaacattcttctatgggtttcaatttttcctgttctattaaccatttctctttaaataaagtttttcttctccacaataaacaaaaacataacttttgcctgattcttgtggcttttttaatcaacctgtttttccattggactctcttttttgtttgtttgtttgtttgtctgtgacagggtctcactctgtcaaccaagctggagtgtaatggtgcaatcatagttcactgcagccttgaactccagggctcaagcaatcctcccacctcagcctcctcagtagctaggataacaggcatgcaccaccacatcggctaatttatttcatattttttagagacagagttttgctatgctgcccaggctggtcttgattcctagtctgaagcgattctcctgcctcagcctcctaaagcactggaattacaggtgtcagccactgtgctcatcaggctctaatattttttaatacacggtctcatctagagatctacttcttcatcacttgtcttcttttatactaaaatctaattttcagtcttataattctcattttaaaattctgaaagtcatcaaggccctattttttagtctttaatctgcttt

SEQ ID NO: 60318 - DNA, 1029 bp, Homo sapiens
atctagttgtcacctaacatgtcatcatgttaatttttataatcactggcattgccatggtcattcacatctataaatatttaaacttatagttcatgtggtggtgcttggaatgcaaaaatataaatgcttatcgtaaggtaatttcctatctttctacattttaccaagtttgtaaatttgagtatttatctgataaaatatagtttgaaaacaagagtaatatgttttagttctagaacgcaggttgataaacttttctgtaaagggccagatagtattattttaggctttgggagccgtagataccacctgctgcaacagatcagctctacagtcacagcacaaaagtagccataaacaatatgcatattgaaggggtatgactgtgttccgataaggtttagttacaaaaacaggtaatggacagatgtgtactagattattagtaaagtgggttttttttattctttgttttagttgcaagaagcacaggatcgacatacagaagctgtcagatgtgctgagaagatgcaagatcacaagcaaaagtaaaatttaaagcagcacacagaaaaacatgattatttatagagcaaataagcagtgtagtatgagaattatatcagctatgatcataagtacatctgtgtgaagtcaaggaaaaatttcagcattaagcaattttgaaatgcggatttttttatattatcctagaattttgtgcattatccacaaaccacaactagaaaaacgatagagttgccaaatcacctacttttgaaatctttaagaatttatgtaattatgccttcaggtgtttgctaagaaattacacagtattttaaaaatttatctgtgagaataattattttaaaatatacatttcaggcttgaaaaagataatgccaagttaaaagttacagtcaaaaagcaaatggacaaaattgaggagcttcagaaaaacctgttaaatgcaaatttggtaagtcagccacttaatttctgtcgtactgaaaaggaatttta

SEQ ID NO: 60319 - DNA, 1105 bp, Homo sapiens
agttagtacctgaagcagactgcagtagagcctcagcacacgctgcagactgcctggaatgcttttcttccccatttgcttaactgctgccttctcgtccttcatttctcagtgtagccacctctccctcagggaaatcttccctggacccagtatagatcaaattctcttttgtggtcatagaactctgtttccttacagcatctatctgaattcataattgtcactttttttgtattttgtcactttttttgtcttcactatactttaagctaagcaagtgcagaggtcttgcctgttttatcttcagagcttagtttaatgtcttccacattgtaggccctcaatatgtaattggtcagtgtcttaatgagtgaatgttatagtgcacagtgtgttatatggaaaaatgctcatatatttctatcttgttttcttcctgatacagattctgttagcctattgaaaatccaggatgcagctctttcatgtgaaagattattagaacttaaaaaaaatcactgtgaactacttacagtaaaaattaaaaaaatggaagacaaggttaatgtactacaaagggagctatctgaaacaaaagaaataaaatcacagttagagcatcaaaaagttgaatgggaacgagaactgtgctctttgaggtatgatagcctagttttaaagaaatgtttaactatttgtactaaagatatatagaattcttgtaattgctgacttatcttctggggcttagcagggaagaaaacttcttagtcttgtggagtgtgaaattcttggaaataatataactagttcttaactatgaacttctactaaatatatattcttttaaatcactttaatggctatgtagaagtttgtcgtatggaagactcattatttaatacagtaagttttgggtttacagtttttttgtattatagttaatgctggaaggaatacctttttataaatctttttctacatttctaattatttactttgaataaattcttcaatatagaattattcgtttaaagtataggaattttttttaaaaaggcctttggtccagatttttaaattgttctcaggaaagtttagt

SEQ ID NO: 60320 - DNA, 1067 bp, Homo sapiens
ccaaggcttaaaaagtaaattctgaacatagtggtacgttgaggaaagagcatttcattgtaataagtttttatttaaagtttatttattaaatgtttttgtctttagaacacacacacaaacacacacacacaatactgtcatccatatttaaacctaaaatggttagacataaagtttgttcataaaaaaattcatatccctgaagaatcttaattattaataaacaaatctcttatggaaaacaaaataggtaacagacattgctgagtgaatcaaagtaaataagtaatactgaaaaataaaaacagaaaaaaatccgagagatgacagtcagttaaacttctgtgagcaaatggcaagtaaaggacatgtaaaatacaattcaccatggaggagtagtgtgtttgtagcatagaggttgacatgggacttcttctatgaagaaagttagtcaaacctatattatttacattctaataagtgaaaactttattttcagagttttcagattgggactctactagtttgaccctcagtaataagacttgccaaagacctgggactttgaaaatcaatgataaatatctatctgtatcacagtcagtgaccaaaaatcagtcagcatccgcagaactgggacaaacagctaaaggaaagattactattggagcttagtttctattagagaataatactctccatgacctttgtgaatcacagctaccagaaaacaaaaagcaaagaaggtaacacagaagcacagagaattcagtcctagagtacctttgcttggcttcataatatcatagttatgacttttattttttattttattttttgagacagaattttgttcttgctgcccaagctggagtgcaatggcatgatctcagctcactacaacctctgcctcccgggttcaagcgattctccttcctcagcctcccaagtagctgggattacaggcatgcaccatcatacctggctaattttgtatttttagtagagacagggtttcaccatgttggtcaggctggtcttgaactcctgacctcaggtaatcc

SEQ ID NO: 60321 - DNA, 1144 bp, Homo sapiens
tggcttttttcttaaagttgctttttgataacgatagctgtttcataaaatcctttagaggataacattttagaaatgaaaaaattacagttaataattccttgaatactaaaattgttattttaaataaacactgcattgattttaaaaaactgcactaattttgaaatataaaatgttattaatatctaattctgtggcaattaaattttttccttttgataaatattacaatattgaaagcttattatgtattatttcttagatgtgttttatataccttcttgcatgagtggatcaagaaactttaagatggctaaactagaggatacaagaaatgtaggcatgccagtagcccacatgggtatggaaaaaaaatgcgtatttttgttaactgttattctacaagtgtatatccaagctgatcaattcagaacactttctctgatgagaaataagttatatatccaagtaaagtggcatcataactgtgtgcttcctaaattacaggacaagttgaagaacatgataaatacttgtagtataatggtataaatgattctgatgtgttgcattaaagatatgctgtcgcattttaccatcagccttgacatttctcctctcagggtcatgatttgctcctctaattaaagattacttttctccacatcgaccagcatgctcacattggtatatgtgcacttttctattttagttatagtcacttggaacataatcttacattcaaatcataactgcatgttttattaaacctatattcctgtttttttctccagtatacttctgtcatgttgctgtcctaaccaaaataaaaaacatcccaaaaattaacataatcattttcaaaccaagcgtgatgattctggtcatactaacactgcatgaatttatgattgactttgtcatatttatgtataattgattatatgtcccttttggtttttagagtctcctgagagatatcttcacttgaaggtaataagttttatatttttatcttgaattattaagtgcatattgtataaagtatacattatttattaatcattttgtttcaaaacccattcagcctaccattgaaatgaaagattctgttccaaataaagcaggaggaatgaaggat

SEQ ID NO: 60322 - DNA, 1022 bp, Homo sapiens
taattagaaatattttaaatgtttaacgctgtactatagcaagtgtattctattttttaaaatacacttttttttccctcttaatcaggcatcccccgaaccggaataagttcagagaagctcccctcttatttttggtggggaatacaaagtagagttaggtcttttgatattagttccttgttgaactgtgcgcgtaagttaatattttgtctgttaatatgtgtccttgggacttccatgtttggtttgcagagtcaatagccatctgaagatgaaaagataagcttaatctagtgagcatatatgaggttctttattgaaatgttttggttttcaatacatgcttatcttatttttaagcctaattgcttttaaaataggaaattcatattatatttgaaagtgattagaaaatctttagcaattcattctttttgtaaaattgaaactcattattgatactaattttaacagagtatctctgagaattttccacagaagtatgttgatcctttagctggggctgcagacggaaaagaaaaaaatataggaaatgaacaagcagaaggtaagagctatatttcatttttaaaaagccattggacagagtgtttatttaaaaacatgactgttgatatattctaatagccgaagaaaatcacctattaaatgcatagtaagaataaagagaggtaaaattgtgataagttgtatatcttaggtgtcagcaacagattaaattgctagtgccactaagggaactgaattattagatccatttcaaaatacattaagacctgagggagccaggaaataaggaagaggagaggagtaaaagaggacatgagagtgaggaaggcagagagtacagggagtgaatgaagggcaaagaagcaagtgtatgtaatggagagtggtaaaataaaataattctagggccaggcgcgtggcttatgcctgtaatcccaacactttgggaggccgaggcgggcagatcacttgaggtcaggagtccgaga

SEQ ID NO: 60323 - DNA, 1027 bp, Homo sapiens
ctaagacaaccaattaacatatgcagacccaaatattatattcattttaaaaatatttttcttttgctgtctttcttcatattaccaattttttcctgagactgcatcaaccttgtgaaattctttttttgctattatttttattttattgaaatattcatgaatggagatagacttgtatatgtatttaattatgtatttaaaatttacaatagtaaatgttctcatgaatatatctgtgtatcacatttgatagatatgatgtccgcattaggattaggacaagaggaagatatagaatcaccttgggattctgaggtactttctatggttgttactattattttaaaatataagcattgagtgatgttaaaacataaagagatgctttgacttgacttttttacctctgcatacatccataaggaactactttcttatatttttcagttcataattaataaagtatgtgctaagtatattactgctgcatagtataattctgctaatttgcaggattcatttaagaatccagtgaaggatagtgcaaaaaaaaaaagaaaagaaaaggcttagaagtcacatggaatcagtatgggttctgaagttaagtttatctaaaaactaaagaattatttcaggtcggccaggcaaggtggctcatgcctgtaatcccagcactttgggaggccgaggctggcggatcatgaggtcaggatatggagaccatcctggccaacatggtgaagtcccatctctacaaaaatacaaaaaattagttgggtgtggtggcgtgtgcctgtagtcactactcgggaggctgaggcaggggaatcgcttgaacccgggaggcagaggttgtagtgagctgagatcgcgctgctgcactccatcctggcaacagagcaagactgcatctcaaaaaaaaaaaaaaaaaaaaaaaaagaaagaattatttcaggttagcctatggccaagtgtatgattctgtgttatgtatggatgagtaaacggcctaatgagattc

SEQ ID NO: 60324 - DNA, 2236 bp, Homo sapiens
gccaccgtgcccagcctatttatttatttttatttttttgagacagtgtcttgctgtgtcacccaggctggagtgcagtggcatgatctcggctcactgcaatctctgcctcccgggttcaagcaattctcttgccccagcctccttagtagctgggattacaggcacatgccaccacgcctggttaatttttgtattttagtagagacagggtttcgccatgttggccaggctgatctcgaactcctgggctcaagttatcttcctgcctccgcctcccaaagttctgggattacaggcacgagccaccgcatctgatctccaccttgttttagattatcaggtttgtgctggttcaggtaacgaaagttatatcagccattaattggattttcagttcagccttcgggacaatttgtgaagacaaagtattcccaggttctgccattatcttggctgtcactattagttatagaactaaggttgagtctttatcgaatattttatagtttcggagaggtagaggcagcaattggtaactaaaatatttttcaaaaacaagatcaaattttaattagatcaagaaacatcatttaatatgcagacagttgacctttcaccaggtttttgtttttttggagggggcatccagattgaaaattgtaagctggtttttgttttgtttttaaagaaatgaattcactcatttttctatatttttgttctaaaggctttctggcaaaccgggtgttgatgattcatggcctacctcagatgacgaagacctcaattttgatactaaggtaaagtgctctctcatgaacttaattttcttactctgaatctagtttcgtatagtattctcttaaaattttgcagtggtctacttatcattgttttctgtttgtaatggaaaggtggtcaggggaagccattttatagaaatatggccagttgaattctttttttttttttttttttactttggtaaataacaaaggattgataagtactttgagggagtggggattgcaaaaaaaagaatatactggaaaatacatagtgacaggaaaattatattgggaaaagttttcctacaatagaggaaatatgaaatttggtcaaagtttatatggataagcactcctactatgattttaaaatctttttccatttttctctctctgtagtaagaatgttacagctttcaggtagtagtagatgatcatttttaactaattggatgacttaaaattaaactgtttactacagaagtattttttaaaaaactggttgtaaatactaatcagtattatcagggatatcctatgaacaaaagtctgttacaggtctgtgtttctcagtgtgccttagtatacttaaagcctttccttttcttccttgacttaagctcacactcgaatggtcatgcctctattttttttctccctactctttcatcttttaaaaatgatttatctcagcctaaatgtttccttgcagaatacatttcttcagttctgttatttcagtccatgtctgtctccatttgcagcatatttaggtgcagctttctatttatgtagttatgtgtggcttttgttcagcaatcattgccccacaaggattatttttgtttttttctctgtttcttgtaaggagctgaatttatacaatcatttatttttagctttttgacagaatagaagcagcctatactatttgcagtgccaacccactttcataaaatatactaagaacaaaatgctcacagtttttctcacaagaggtaattcatgcaaatataaatcatgcatacacatttcagaaaataatatgtaattaatttaaatgttttaatgtttgacttttataatactctacctaggaaaaaattttcattttaggctactgtggttaagaaaataatcgaacagatatcatagtatttatataataatcaattaggggtaaggggagtaacctttggaggatatctgtatcatctctcataatccttaccccatgagaagatgtagcaaagggcagaactgaggtttaaatctacatctgagtgactccaaaatctttgttctttgtgttagatcatgtagtaatggtgactatctattacgattattttatcaaatttgatacttgtttttttaaaacttgttattcttatttttgttttctagaatgtcccaaaaccaagcttagcaaagctaatgactgc

SEQ ID NO: 60325 - DNA, 1024 bp, Homo sapiens
caaaccatatcaacatgctatttaatgtttataattttatgaaccattgtatgttttgagacagtgcactacagtttataaaaagtcctgtcactctcataggacggctctacatttggcctgtgccaatggtcatccagaagtagtaactctcctggtggacagaaaatgccagctcaatgtctgtgacaacgaaaacaggacagctctgatgaaggtatatagtagccagctctttcagcatcagatggatttgacttaaatacatagaatgaaaatgaatttatctcattaaaatataactaattggtgaaacctgtggagtgtttattttgcattcctagaatttatgatctgtttcttggtctaatactcccaggctgtacaatgccaggaagagaaatgtgcaactattctgctagaacatggtgctgatccaaatcttgcggatgtccatggcaacactgctcttcactatgctgtctataatgaggacatatcagtagcaacaaagctgcttttgtatgatgcaaatattgaagcaaaaaacaaggtatagatcaaccaactttatttttacagtatttgaaatgcgtttgtttcaacagtgacatatgtaagggttagttttctgtatttggaagcgcaagcattccctgactgaaagtattttaaaataacttaattgtctaagattttactttaaatgttgatacttttaaagaagcattaggcagtacacctttcttttatgcatttattgtaaatacttgtgaaaacacaatttgttaaaggcaaatcttttttttttttgagacagagtcttgctctgtctcccagtctaaagtgcagaggcgcgatctcggctcactgcaacctctgcctctgcctcccgggttcaagcaattctcctgcctcagcctcctgagtagctgggattacaggtacccaccaccatgcccagctaatttttgtatttttagtagagatggggttttgccatgttggccaggcgggcctcgaa

SEQ ID NO: 60326 - DNA, 1023 bp, Homo sapiens
ttacctgggcatggtggcaggtgcttataatcccagctactctgggggccaaggcaggagaattgcttgagcctgggagatggaggttgcagtgagctgagatcatgccactgcactccagcctgggcaacagagcaagactctgcctcaaaaaaaaattaaaataaatttaaatacaaaaaaaaatagccaggtgtggggtgcatgcctggaatcccagctacttgagaggctgaggcacgagaattgcttgaacccaggaggtggaggttgcagtgagccaagatcacaggagccactgcactccagcctgggtgacagagtgagactctgtctcaaaaaaaaattaaataaattattataacctttcagaaatgctgtgtgcattttcatgttcttttttttagcattactgtcactctccctaatgaaatgtacttcagagaagcagtattttgttaaataaatacataacctcattctgaataatgtccctcattttgactataactgtgcttggtttcaaaagcaaaattaaacaaaaatctcagtcccctccgaagtgaactttgtgttaccctgcgtcagaaatgccaagttgtgtttacttttcattcagattttgtgaatatgaacatgctgttataggatctacagatgaatatttaactcaatagaaaaattattttagaacacattgtattggtattacaaccagattatattcttgacgttgacttcattaaaattatctacaatttcctaataatttaagctgtatatggtcttcattgaaaaaagatagatattgttacaggaagcttgttacattatattcttgaccttttggttgataatcttaaatcttaatgtaatttcaaactggcagaaatgttgccagcataatacatggatgtctcatataccctgcatccagatttaccagttgttatcattctgcccgttttttattgccccaaacctgttctgtctccctctctgtatgtacatacatacacgtat

SEQ ID NO: 60327 - DNA, 1101 bp, Homo sapiens
tctgaaagaggtaatgggaacaatgagctcagctgtttactgtgaagtaactagggtaaacatgaacaaatagcacttgagagggcttagggaatgcattctccacaggagggaccatgggtttgattatttcaaggaagtagagggaatgctttagagtagttaaggatacagaaagtttgtatgatggaaaggtttagagagtgttatagaagaggtggtctctgccttctcaggtgtttattctcttttccttactatgttataatgcacaaattatctctactgtagaatcaagattctacatgattttataaatataaacagatttcatattttttagggtacataaagtttttctttctcttcccattgactggttttcgcatccctgcatttgctgctgcttacgtatctccttttctgtttcaggactcatatgaacgagcaaaacatatcttgaaaactcatgcaaaggagcataagaatctcgcagaagctttattgacctatgagactttggatgccaaagagattcaaattgttcttgaggggaaaaagttggaagtgagatgataactctcttgatatggatgcttgctggttttattgcaagaatacaagtagcattgcagtagtctacttttacaacgctttcccctcattcttgatgtggtgtaattgaagggtgtgaaatgctttgtcaatcatttgtcacatttatccagtttgggttattctcattatgacacctattgcaaattagcatcccatggcaaatatattttgaaaaaataaagaactatcaggattgaaaacagctcttttgaggaatgtcaattagttattaagttgaaagtaattaatgattttatgtttggttactctactagatttgataaaaattgtgcctttagccttctatatacatcagtggaaacttaagatgcagtaattatgttccagattgaccatgaataaaatattttttaatctaaatgtagagaagttgggattaaaagcagtctcggaaacacagagccaggaatatagccttttggcatggtgccatggctcacatctgtaatcccagcacttttg

SEQ ID NO: 60328 - DNA, 1618 bp, Homo sapiens
gctgagactacaggtatgagccactgcacccagcctgtatctgaatttctttcattacattttattttattttaatttaatttggttttattttatttattgtattttatttttgagatggagtttcactcttgttgcccaggctagagtgcaatggcatgatctcagctcactgcaacctctgtctcctggcttcaagtgagtcttctgccttagcctcccaagtagttgggattatagccatgcaccaccatgcctgcctaattttgtatttttagtagagacaggatttctccatgttggtcaggctggtctcgaactcccaacctcaggtgatccacccacctcgcctgccaaagtgctgggattcaggcgtgagccaccgcacccagcctctttgcttattttttatctgattaatttttaattgtctaggtgtccctgttacctgagaatgacagatggaatgaaactagagcccagctgcttgcacaaatggatgttagtatgggaggaagagtggcagaggagcttatatttggaaccgaccatattacaacaggttagctttaaagaatggctttagttcaaattatatgtggtcttaaagatatgttttaaaatggtatgtttttattttattttaggtgcttccagtgattttgataatgccactaaaatagcaaagcggatggttaccaaatttggaatgagtgaaaaggtaatagattttttaaatccttttcatgtatcaaattatgtgtcaagtgttgatttgagagctggttctgattataaattggtaatattcactttttctctcactccaaatggatttgaggctctttattctgaacattgttattctctgaataaagaaaatggaccttctcttagctgctgagaatgagctgcccagatagtaactattacttcacgagttaattaagtgataaagcaaggtgaattccttagcttttccatgtggcatgaaagagtctactttctaagtttggttactttactgtttccctctatttcatattttcatcttgtcattgttccttgaagcactactatactctgtgaattatggatttctatatttgaagtagctgccaaggtttttcaagaaagtactgagaaccagacttaaaatgattttaggctgggcactgtggctcacatctgtaatcccagcactttgggaggctgaggagactgtattgcttgagcccaggagtgagttctggaccagcctgggcaacatggcacaaccccatctctaaaaaaatacaaaaattagccaggtatggtggtgtgtgcctgtaatcccagctacttgggagtctgaggtgggaggattctctgaacccaggaggtcgaggctacagtgagtccactgcactctaccctgggtgacagagcaagaccctgtctccaaaaaaaaaaaaaaagattttaaatgttctgtcttgctcatacttttactattttgatattagtgtttttttgtttctttgtttttgagacggagtcttgctctgttgcccaggctgtagtgcagtggcgtgatgttggctcactgcagctaccgcctcccgggttcaagcgattc

SEQ ID NO: 60329 - DNA, 1137 bp, Homo sapiens
ggtgggtggattgcttgaggctaagagttcaaggttggagtgagctataataagaatgactttaaggagaatgagttttttgttttataatattaatcccatatcagatacattcacctctcagtatccactgaaggggtggggattggttccaggacccatgtggataccaaaattcagggatgctcaagtgtcttttataaaatggtgtactatttgcatatacctacataattctcctgtatacttcaaatcatctctagattactaatacaatataaatgctctgtaaatagttgttataatgtatttttttcatttgtattattttttattgttcctcttccccatagttttaatccttatttggttgaatctatggatgcagaatctgctgataggaagggtggagtgtatttgatttgcagacaagaatgtgttttgttgatttaaatatacctttctaatggagtatttactcaattaaatttatcttagggcctgaaagaagaagtgtggaaattgataacaaaaacaaaaccatcacagcatatcatgaatctggtcatgccattattgcatattacacaaaagatgcaatgcctatcaacaaagctacaatcatgccacgggggccaacacttggacatgtaagttttttgtagtgtctcgccctgtcacccaggctggagtgcaatggcgcgatctcagctcactgcaacctctgccttccggattcaaacgattctttcacctcagcctcccaagtaactgggattacaggtgcccaccaccacgcccagctaatttttgtaattttagtagagatggggtttcaccatgttggccaggctgctctagaactcctgacctcaggtgatccacctgcctcagtctcccaaagtgctgggattacaggcgtgagccaccatgccctgcctaattcttaaatatctaattactccgctgccccaaaagggaaaacattatgttttgtagtaactgattcagtagtttctctaagatttttatcatttagtacaagtttatcagatctttcaacattgtagacatttaaaaaatttctatgcacctggggagaaaacagtcctattgcagcattatccacctattgtt

SEQ ID NO: 60330 - DNA, 1071 bp, Homo sapiens
taaagtatttccagatgaaattcagagaaaaagtgactaaactatggctcagaatagctagctattttcttttttcccttggaatgtgaggtgttttttttttttggtttttttttgagacaagagttttgccctttttgcctaggctggagtggagtggcacaatcttggcttactgcaacctccacctcccgggttcaagtgattcttctgcctcagccttctgaatagctgggattacaggtgcatgccaccatgcccagctaatttttgtatttttagtagagatggggtttcaccatgttggccaggatggtctccaactcctgtccttaggtgatctgcctgccccagcctcccaaagtgctgggattacaggcatgagccaacgcacccagttggaatgtgagttctttgtgaagagctttcttttacctgttttagacttattagcgttgtgttctctttttacattagccgttgatccagaaattatagctcgaggtactgttggcttttccggagcagagttggagaatcttgtgaaccaggctgcattaaaagcagctgttgatggaaaagaaatggttaccatgaaggagctggagttttccaaagacaaaattctaatgggtaggtttcctttcttttttttctgtcttttacttttcattgtgttagataattcatttaggggcaaatactctattcaaacagctaaagccatggctatgttgaatctaatcttactctaaaacttcagtgtctgggttttcaagatttgtaataaatgattttacaaaattcccaacttaacatcaaacaaatgccattaaactgtaacattttcttgacaataatcttgtcagtgatacagaactgattttatagtgtaccacatttattagttttgtctctttcttagaaaacctttttttctgactggaaagctttaaaaagtgatgggaacatgaaaatatatacttgacaacaccacaatttggcatcttacgaaacaaatatattctagttgcttatgtaattatatagttaaactggtagtggggagat

SEQ ID NO: 60331 - DNA, 1049 bp, Homo sapiens
attggggagaaaagatttaaaaataaataaaaaataaattagtcagatatgttggcatgcacctgtcattccagctacttgagaggttgaggcagaaggttcacttcaacccaggagtttgaggcagcagtgagctatgatcatactggtgcgcttcagcctaggccacaaagcgagtcctagtctcaaaaaaagaaaacaaaccagttttgtgtagagcatttctacatgtgtgctgtgcttcagtgttagtaaaagatactattttttttccaatatagttttaaacccaatgaaggagttatcataataggagccacaaacttcccagaggcattagataagtaagtattaaaagaagatttttgtgaagtactgttacatgctacaaaattgtgctaaaagaagtccgttgcaaaagatcacatcaacactgtatgattccatttatatgcaatatccagaataagcaaattcacagagacaaattgggttagcggttaccagaggttagggagaatggggaatggctgtcattggatatgggatttctttgtgggggatgggaatattctaaaattagattgtggtgatggttgtacaattctgaatgtattaaaaaccactgaagtatccactttaaattatgtgaattacatctcaataaaacttaaaatatttatttgttatatgtcacaaaagttgtatgtagagagggtttttaaaataaattaactgtagtattataactaggtttaaagttactatgaaaaaattttactgtagaagttattcgtattttcatttgatcagtagtttgtcactgcctaagactctagtctaacattctgtacttagcagttgagatggatgtgtggttctcataatagtttgttgtggaattatttgttcctggactgaattacctgcatgcttttgtttctgaggggtaggctacctaggtacacacgtgtatctaaatgaacctttgttctgctttctggttattgacactgttacttgagccatgttttaaaggaactatctga

SEQ ID NO: 60332 - DNA, 1909 bp, Homo sapiens
ccatagaagtattaatagttacactcttcctctttctaatcacaaggagtattttaaatttgtagaaaatttgagtagtataaatttgtagaaaaatcttcagataccaagatgtaatccacagaaattaatatgatttaaaccagttaagtataactaaaacatgacaatactaggatagtcttaaagctatttttgagcttgagctttctttaaaattttttttatgttaaaatgcagcaaacatgtatgtaaagaagttttgttgctttttaaatgtaatatgtatatttataaaaacatataaatcaggtaattctgtttttctaacgtgaaaatctttggtgttatgaaaatttgcaaacatggaaaaccttgaaagaacagtacaattaacatccatatcctatccacttagactcaacaattgttaacattctgtcatatttgctttctgtgttatgtgtgtatttttccccctgaacatttgaaagaaaactataaacgtcaactacttgacatctaaagactttcttgtacatcacctaagaataaggacagtgtcctaaataaacataataaccttatcccaccaaaggaaattatgcctatttccttaatatcatgtactctcagtcttgtttaaatgttttcaccagatgtctctagaattttttgttctttatgaaaaagcatcaaatcaggattcactaattacatttggttgtttagtcttttaatctatttttacatgaattttatcttatttagtgataaatgggtttatatttttttgcctcaagattctccctgtcatgtctcttgttgatatggaaacaatatttatataatacaggaacattaattttggacaagattctgaagtgaaccattagcagagacaagtacggtttgctgtgtttcaaaatattggttattggtgtgacctcagcctgaaaattatataaatgaataattatttattttataggttcatatcgagggattttttaaaaatactttgaatcattctcgttttcattttcttttaggaattcttttagttggacccccagggactggaaagacacttcttgcccgagctgtggcgggagaagctgatgttcctttttattatgcttctggatccgaatttgatgagatgtttgtgggtgtgggagccagccgtatcagaaatctttttagtacgttttggtgtatctttgatgcagtgctaaattttgttaagggaagtgtgtatcttaccctttctttgctaattactttttttcttcctttttttaatttctattttttggggcctccagctttgcatgctaattagttttgattgatagttaaaatagccattgtgggaccttggtttgggtaacttactatatgaattatcggaagagctagtggaagtgcaagatgaagttggaggctaccaaaaatctcttagtgttttttcattttattcatcaattttgtagtatggaattaaggagtaattagcttcaaacctgattgtatatatttgtatagctggaaagaatgaatgaatgcccaactgttttgttttatatcatttctttggtatagttttttcccccctgaagatactatttttaagtcagtaaaaaatgacgtccttttctttcagtgaatattttttgttggcttttgacagttgtataggattttaatatttatctcgttttgttcaaaagtgttgactttctttcagcttatttgaatgttttttgttttcttaggggaagcaaaggcgaatgctccttgtgttatatttattgatgaattagattctgttggtgggaagagaattgaatctccaatgcatccatattcaaggcagaccataaatcaacttcttgctgaaatggat

SEQ ID NO: 60333 - DNA, 1105 bp, Homo sapiens
gggacaatttcctgtctaataccatacatgaattttccctatttttgaattttagataaatgtaatccatatagaatatcctcttttgtatgaggcttcttttattcaacatgtttgtgagatccatctatgttacttggagttgaggtttatttatcctttattgcatagtatcccattataagaatactacaacacggtgcaattacactactttagggtggacatttatttctagtttttggttcaaatacagctggtgtgactatttttatacaagtctcttggtgaacatatgtacacgcttctcctggacctaggaatggacaaagctttgttttgtatttttttaaatactctgaaaagaaaatgctatgtttttaaccattaacttgattaaaacattattacatttttaattatttaatcagaataactttcaaagatcatttcaagtctaacaaaaaaacataactttgttctttaataagtgtaatatttcctggaaatatgcctgggaatttttcttgaaataataagcgaatcttgacattaattggacattttcagaatgccctttggcgtgaagctatgtttcatgttttagaatgctcctctctaggtactttctttttaaccctgtccaatgtacttgacttttgttttctcactgagaaaatgaaagttcagaatgatttttttggggatagtaaggagactttgcataatgggaaataatggtcaggggaaaaccctttgttttataaggggccatttttgtatgctttttttactgaaacagagaaggtcaggttaattccatatccaaattaaatttatgattttcaaaagggaagccttgataatctaaccaaacgtgtccattatctaaagttatttggaaaattgtgtcactttaggtggaggaagctaaacaagaattacaggaagttgttgaattcttgaaaaatccacaaaaatttactattcttggaggtaaacttccaaaaggtaagatatcttttctttatcatgatttgatggaaaaaacaaaaacaaagaaacaaacaaaaaaaacctatattacttatttaattttaactga

SEQ ID NO: 60334 - DNA, 1909 bp, Homo sapiens
gatttaccaccatacataatacttctaacataatatcaaaatgatttaagaaacttagttatttatatatctttttccagtagactgaaaactttaagatcagtggtttatttatctttacatcttcagaacttatataaggccaagtatatgaacggtgcttagtagacatttagtaaattaatgagattttttcctctagcaaagatagagggatatgaacattaagccaatcaaaccctaaaataatatgtgacctgttttcagtgtagtgttcgtgcagagaataatgccactttctttatattattaattgattgatgcaggaatgggatctagtgttagtttcctagttattgattaattcattgctgagtcttaatctgtttcttcacattgacagtaaaaattatacagaattttagtgaatttttttgagtggtcacaatattgttgggaagtatcactgtgttgttaaccagtactgatgtgttgtttgtgtattcaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatggtaagttgaattgacaccatccgtgtttgagaagagtaactgaaaggaagtcatagtcctacatttaagttttaagtaacttttctaagaccatctattgattaaattccactatatttgtaacttaatctatgtagaaatggcgatactgctgatggtttccctttctcaagagagaaaacaaattggagaacaggaagtgtgaatggcttcataaaggtttttgtttctttattttttgtttgtgtttgtttttgagacacggtcttgcttcattgcctaagccagagtgcagtggtgcaatcatggctcattgtagccttaactttctgggctcaagtgatcctctcacctcagcctcctgagtagctaggatcacaggcatgtgccaccacgcccagctaatttttgtggagatggaatcttgccctgttgtccaggctggtcttgaactccagggatcaagtgatcctcctgccttgacctcttaaaatgctaggattacaggcatgagccaccatgcttggccttaagtttttgataatagggtacttacaggaaatcatagcagttgtgagaaagaatgccagattccaaaattggatgtgatgaaatatgattattaacaataacctaatatttgcatttcattgagctgtcatatttcataaatgtgatttcatgtaaagctttttctttctctcctagattccctaaggcgaacccgtctgattctcttcgttctgctgctattcggcatttatggacttctaaaaaacccatttttatctggtaaaagctttttttatttgtctaacttatttcttattcctttaaatacatgattccttttaatgcctaatctaacccttaaagaaagaacatattaatgtttacagtactagaattaggctttcattcctagtagtggttagtttcccagatttttagaaaatgatacctgtccaattataaaatttaaaaattatcctggtcaacagggtgaaaggaaaattaattaattaattttaaaattatgtagaagaattttataatggcaatacaagctgaaatagtcttctatttcaaagataaacaaattcagtttattcataaaatcacattaaatgtttcccttttttttagtttgcttatctgaaattaagcaatagtgtcagacttacgtggttccaattaccttttccactactgtgcagttttcaccctgtgttgcctattctcttaaatat

SEQ ID NO: 60335 - DNA, 1918 bp, Homo sapiens
acttgtaatctgggaaatgcaaagtaaaacaaggtactgttatttttgcccgtcagacttgcacaaatttaaaagattcatattatttagtgtcggcaaggatatgaagaaaaggaaactcataagcattggtgggcacataaattgataacagccttttttagaaagtagtctcttagtgtcaaacaaaatttaaaccttaacagtgtttctttcaggaattcagtctacatctgctgacatacatatataagaatgttcaccacagtattgtttccagcaataaaaaccagaaaacaaataatgttcagggaaatggttgaatgaattgcactgtgataaattggaaaagtgtaaacagccattaaactgaatgcactgttctgttctgaaaaatatgcacgaaaaatgaaaattgcaaaaaattaggtactatttctagagtagtttttatagaaagagcacctgtgtgcatgcatacaagggtagtcagaattgttaacaggttatacttctgggaagtgggattggggcttgagaaattagaagacactaatttgatacacttacccttttttcaaaaacattatgtaattaccaaaaacatgtaaaaatcagttgtgtagattcaatctattttaattacttggttgggtttttttttttttttgaaatcacagtttatcagagttgatactcagttttttaaattatattgtataaccctctgacttctctatttacctttatcccctatcaacataaaaaataggccaggcgcggtggctcacgcctataatcccagcactgtgggaggccaaggcaggtggatcacctgaggttaggaggctgaggcaggatagttgcttgaacccaggaggcggaggttgcagtgagcagcaatgccttgcactccagcctgggcaacaagagtgaaactccatctcaaataaataaataaataaataaataaataaataaataaataaataaagttccttttgaaaaaaggaggatagaaaaaactataagctgggcatgatagatttaagttctcagacctaatcccagctctttgggaggctgaggcaagaggactgcttgagcccaggagttcaaggccagcctgggcaataaaaggagaccccgtctctacaaaaaagaaggaaacaaaggaaaacgtattgaagtgtcaggcaaattagatagactaggatatacaggtagggtgtcagactttagaatcttaggcatttttcttttcctgtaacaatttatagtgacagtgaatggtattgttttatttagttttcatacagtctcggggttttaaaactttgaaatcaaggacacgacgtctccagtctacctccgagagattagctgaaacacagaatatagcgccatcattcgtgaaggtaattagacctttttatgatccaaaaagcaaatattttcaagttgttagagtgaggagcttcaatatctgatttcttttgttggctgatagatattcttccttctttccactaataataagggattagtaacctgtgtaatcattatacctctaactcttctgggcaccagacttgcctctccacttactagatttttttcccacaaacctacacctgtcgaggtgttctctgtattaatgagcagcatccacccaagctaaaaacctggctatcaacctacgtttgtccatgttgccttacctcccacatccattaaccactaaagtcctgttgatccaacctcctaaatatttcttacatctgttccactgccatagataggctataactatttgttgcctaaattactgtaatgaatacttgtttagtctccttgcctctagtcttgctgcgttcagtccagcctccagactgccacccatcaatctttctaaaat

SEQ ID NO: 60336 - DNA, 1034 bp, Homo sapiens
tgggggcttagactaaaagtttgcctctgcctaaagttgccttcttataaaatatttggcccataccaagtgttcaatagaataaaattctttttgttactatgttattatgattattcctactgctcttctagtctgcatatttacatttactcttaagattgttcctcataccaccagctgcttgctaggtttaggcaggcagaggtattaggaagagattttttgactggatgctaagggaccttgaaaaaagtccctaaattctaactgagacacacaaatagatgatagccactgtttgtttctgctgttgctgctgatgatcttttccctaggatcttggatataaaataggatgagacacactagtcaagagaagcagttaggaaggatcagtgaagtattcatggcttgacctttctttttacccaatgactagggaagctttatgagggaaagataatagtagctatgattcacagtgttttattataccattagagcttttgaaattgtctctaagaaacagcagttctttatctctttatgttcttaactaaaagtaattttagcctaaacacagtacatctttttttttttttttttaaagagacgagtcttgctgtgttgcccaggctggagtgcagtggggcaatctcggctcactgtaagctctgccttcccagttcacgccattctcctgcctcagcctcccgagcagctgggactacacgcatccgccaccacgcccggctaatttttgtatttttagtagagacgaggtttcaccatgttagccaggatggtctgtatctcctgacctcgtgatccgcccgcctcagcctcccaaagtgctgggattacaggcgtgaggcaccgcgcctggccttaaacacagtacatcttttatcactggttttgttttgttttgtttttgagactgagtttcactcttgttgcccaggcgggagtgcaatggcgcgatctcagctcaccacaacttctccctcccgggttcaagtgattctcct

SEQ ID NO: 60337 - DNA, 1459 bp, Homo sapiens
tctttcagctcatgtggacaagaaaataatccctatcctgttgtttaaaagtgggtatacacacatttttgtgatttttagacttttttgcctgattttcacacagttttgactttaattttcttctttattagaagatatgggtaactttagaacctctgagttcaaggaaggatctaagcaatgaggccagaggagtgagatgtcctatggtaaccaagcataccatttctttgtcaagtgggcttttgtttatggctgcttaggggcttaaaagctccatggactggtgaggattatcatttgaatggaatttccccaattcaagaaccttactattatcctccaatcagttctacactgttggggaaaatcccctggaccttatataacatactttgtaaccctgcagttagttactcttacactcttgtcattataaatgcttgatcaatagttgatagactagctcttgatcagagtacccttgtatggagagaaggaaaaaatgccatacatttcacttgattctgtgaaccataatgcttaggacagtagtggtttgggtttgatttaaaaaaaaaaaaagtttttctcattcatgctgaaatgtcatctctttatttaaggataccattaggaatataattttttaacctatgtcaaacctcatatgactgatctcagtaaaacgaactgtgaaaatatttgcatcaatttatttttaaatattaaaaaaaggaaatatatttgttagacttttaaaatctgattgttttaactgataatatgtactccttaggttaaatatcttgataatattaatgcatacctggttgacccaatcttttacagccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatggtatgttaatgtgttttttgttccaattaaatattttagcactattaataattatagataccatttcttagctttcacagtagcgtttattgtgggctgggttctttcctgaagtgttttttttttgtttttttttttgcaatttttcatattgaaatagtaccagatttacaggaaagttgcaaagatagtacagaattttgcttccactaattttggcatcttacataatcatgttacatttgttaaaactaggaaattaacattggtacaataattttttttttgagacggagtctccttctgtcagccaggctggagtgcagtggcacaatctccgctcactgcaagctccgcctcccgggttcacaccattctcttgcctcggcctcccaagtagctgggactacaggcgcccgccaccacgcccggctaattttt

SEQ ID NO: 60338 - DNA, 2064 bp, Homo sapiens
gattgtctgtcgttgcagtagctgtaggaaggggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccaggtaagccaggcattcagcccattttttttcctcccgccctgcccgtggctgtttgcaaattgcgctcgtggaagcgatttctcagaagggactctagaaatgaagtgatgtactcaatgcgaatcccaggattgaggagtggatcaggggacgacgctgagagtgggccggagacttcagtgctgacgatgaagctgttgagggcagaggcgggatgtgagctcagtgatagagagagaccctggcttatcgaactgattgcgtggaatttctgctagagaatccgtccggcattgttcagtgtccggcgttctggggtgggaaaatgtctgtaccatacattaaagggagcaggtaatgttcccttttttccgactttccagtggctttagtgttcacagcccctatcccctgctctttatttccttttaaatggaatttaaatttaacccaaacatggtataatatttcggatggccagccatgcaagtttttttctcattttgaccagaagtaactaaaatgtgtatttccgagtcgtaaactgtttgcagttaaaattttgattcagcctcatcctcatcgttttgtaaaacaaaaggtagtgaagagaaaaatgatttcaagggttttcattacgctcttgggcaatcacttgtgacaatgttttattcttgcttcattccagtctctttttttgatggtaacattttaatagattttttgagagttcctacagttttgcaaagaaatagtttttaaaacattgagtttttttaaaacataatttttaagaaaatcgacactcttaggttcttgatttaagcatatgattgtgttcctttgtgtaacttttactccccctcattttaagaatttttaattttttgtgctagtactggctaacaaactgaagcagctgcttgttattgggcatcagttatgtaccaggtgagcaaagcaaatgtggaatcttctcttaatattgatatgaagtaaatatgagtaggacttagcaaggtgaagagtgaacaggtatcacaggcatacagaaaaatacctggaggtcctgagttaggaaagggtttagcaggttgaaggaacaaaaataaggctagtgtggctagaacatagtagttaaagggggtagtgacagaagaggttggagaaaagacttgaggcagatcatacagggagtaaaggatatattatggctgatttcattttaagtgtattgggaaccattgaaagttttaaaacatgattagattttcatttttaagagatgactggcttttgctatatggagaataggagagggcaagagtggaagatgttatcagctaaaaatacccacccaccccccaattaaagctgttgcagtggttatggaaagaagagaatgagatatattttgaagaaagtggaattgcatgagagatcagagagatgatggggagaggtgtttctgggtttgatcagatgaatgcattgaaggtgctatttaccaagatgacagtgtctggagaagtcctagtaattgtttgaaaaagaagtctgacatggcctattgaatatggtattgaagtttttgaaactcaactctttgccttagttcacatcaagaggcctgattttaggagaatttaccatcaactgaatggacagttagtagtatgtgatgttggtagagatgataaagggatttttatgtaccctaggcagtcttaacagggctcaaatatagtgaggactctcaggcatttcttgctttgaaggatggtaacacatttggaattccttgttgcttaattggttgaatacacttgaaattaaatggtaaaaaggaagac

SEQ ID NO: 60339 - DNA, 1045 bp, Homo sapiens
aaaattagccgagtgtggtggtgggtgcctgtaatcccagctactcgggaggctgagacaggagaactgcttgaacccggaaggcggaggttgcagtgagccgagattgtgccattgcactccagcctgggtgacaagagtgaaactccatctcaaaaaaaaaaagaaaagaaaaaaaagaaagtaaatgtaaatttgaactggcttgaggttgattttatctaataaggtttctttattttaatggaatatctaaccaatgataccaaagataatctagtattaatttatcttttttgtagattctgataaacagtacgaaagatgttttgcttttgagagatgttttctgtacttttcaaagccatcaatgagtatctttattttggaggaaataaatagggtttgcctcctttgtaactctttttttctggaaattctaacattaaaactagcccttttttggttatctaatatttgccttttgtgtgtgcagggacttgaaaccggacaatatgcttatttctaatgagggtcatattaaactgacggattttggcctttcaaaagttactttgaatagaggtaagaaaaatatcaagtaagtacttttttaaaacatccaacaggccaggcgtggtggctcacacctgtaatcccagcactttgggaggccaaggcgggcagatcacctgaggtcaggagttagagaccagcctagctaacgtggcaaaaccccatctctactaaaaatacaaaaattagctgggcgtggtggcatgcgcctgtaatcccagctactaaggaggctgaggcagggagaatcacttgaacccaggagatggaggttgcagtgagctgagatcccgccattgcactccagactgggaaacaaagtgaaaatctctctcaaaaaaaaaaaagtccaactaaaaataaatataaaaaattaaaaaaaatgaaaagtctaacaaattatagagactacatttcattaacttccactgttttctttgttagtttacactaaataaaatttgttatt

SEQ ID NO: 60340 - DNA, 1307 bp, Homo sapiens
taatattgattccataccatctccttatttatttatttagtttttgagatagagttttgctctgtcgccctggtcggagtgcagtagcgcgatctcggctcactgcaacctccgcctcccgtgttcaagtgattctcctgcctcagcctcccgagtacctgagattacaggcgcccaccaccaagaccagctactttttgtatttttagtagagacagtgtttcaccatgttggccaggctggtctcgaactcctgacctcaagtgatccatctgcctcagcctcccaaggtgctggcattataggtgtgagccaccgtgcccagccactgtctccttttttaacatttggtttacaaaaaattgttttgttgtcatatacataacattcatttttagtcaatgggaggtaaaggttttaaatacatttatatacttttctttgcatacatagatattaatatgatggatatccttacaacaccatcaatggcaaaacctagacaagattattcaagaaccccaggacaagtgttatcgcttatcagctcgttgggatttgtaagtacttgagaagaaaattaacatgacataccccttcatgatcaccacttaaaatttaaaatcacctttaaaaaaaaagatcaaaatagatttaaatatcaagcatttggatttactttaacagtttgtctacttaggtggtataacagtctatgtacttaggtggtgttttggggaaggtaaacctgttgtttttatttttctctttttaatagaacacaccaattgcagaaaaaaatcaagaccctgcaaacatcctttcagcctgtctgtctgaaacatcacagctttctcaaggactcgtatgccctatgtctgtagatcaaaaggacactacgccttattctagcaaattactaaaatcatgtgagtataaaagaaaaggtaggccaggcgcagaggcttacacctgtaatactaccacattgggaggctgaggcaggatttctttctttttgagacggagtcttactctgtcatccaggctggagtgcaatggcgcgatctcggcggctcactgcaacccaggagttcaagaccagcctgggcaacaaagtgagacttcatctctacaaaaattagctgggcatgttggtgcacacttgtggtcccagctacattggaggctgaggcaggaggatcgcttgagcccaggaggttgaggctgcagtgagccttaatagcgccattgcactccagccttggtgacagagtgagacccttcctcaaaaaaacaaaaaatgc

SEQ ID NO: 60341 - DNA, 1074 bp, Homo sapiens
ttgcttgccaaatgaatggacttacttaaagtcactttacttaacttacatattgtttttgcctttttaaacagttattagagctaagcccttaaagtgtctgttctgaggatattgcttgccaaatgaatggatttacttaaagtcactttacttaacttacatattgtttttgcctttttaaacagttattagagctaagagatactaaaggtggtaggaactaaaatttaaaatcataataaggtttccttcatagaaggctgataaaataatgatagattaggataacactaatatccaaagaataaaccttttatttgctaaaataattttgattctatttgctgcttattctcagcaatagaattttattattattggatatttgtattctataagcaagatcaaattaacgtttaactaaggcagagtttcttaatcttttttccttctgtctttataaagtaaaggtactatatgctgcaagataaacagatttccattcccagtactattactgcactcctttcctattgaagaaaacatattgtttactatttcaaattatacacagctttactatcctcccacttctgcatccctgagggatgcaccgatgggattatagtggtgcttctcaagttatgatcagaggaatgataaggcaccctctgaaaaaccttacactgatccccacatgcatcattttctgtgcttacagatcagtgagatataattcaagaatatccttttttaggccaggcgcggtggctcacgcctgtaatcccagcactttgagaggctaaagtgggtagatcacctgaggtcaggagtttgagaccagcctggccaacatggcaaaaccccgtctctactaaaaatacaaaaattaactgggcgtggtggtgggcgcctgtaatcccagctactcaggaggctgaggcaggagaattgcttgaacccgggaggcagaggttgcagtgagcggacatcatgcctccagactgggcaacgagcaaaactccatcttcaaaaaaaaatatcctttttgcttgagactaaatgctcatt

SEQ ID NO: 60342 - DNA, 2027 bp, Homo sapiens
aattagccaggtgtggtggtgtgcccctgtaatcccagctacttgggaggctgaggtgggagaattgcttgaacccaggaggcagaggctgcagtgagctgagatcgcaccactgcacttcagcctggacgacagcaagaccccatttcaaaaaaaaaaaaaacagaatcatccatatacctattgcaaaatagatatgtacgtaatgcagccttaccccaaaatgtgcctgaatatgttgcctgttaatttgtcctgtttaagtagcctgtgatatacaatcaaaataagtattatagaataatttatttaaagtttagaccgtttcattcagaataatgtatataagcttataattgcttacattgctttttaattctctgttgtttattttttccatttgaaagtggcaacaggtagcataatagtttatggggtcatttatcctaccttaacggaccatagttaaaaggtcaatgaatctcagctttatataactaaaacaaatatttttttccctcttaggaaagtgatgaagcattgggcccaacaatgatgagttggaatgcagttgaaaagttatgcgcaaaatctgcaaatgccattgagacgaaaggtttcaataaaaaggatctggagttagctctttctcccattcataacagcagtgcccttcccaccactggacgctcttgtgtaaaccttgctaaaaaatgcttctctggggaagtttcttgggaagcagtagaactggatgtaaataatataaatatggacactgacacaagtcagttaggtttccatcagtcaaatcagtgggctgtggattctggtgggatatctgaagagcaccttgggaaaagaagtttaaaaagaaattttgagttggttgactccagtccttgtaaaaaaattatacagaataaaaaaacttgtgtagagtataagcataacgaaatgacaaattgttatacaaatcaaaatacaggcttaacagttgaagtgcaggaccttaagctatcagtgcacaaaagtcaacaaaatgactgtgctaataaggagaacattgtcaattcttttactgataaacaacaaacaccagaaaaattacctataccaatgatagcaaaaaaccttatgtgtgaactcgatgaagactgtgaaaagaatagtaagagggactacttaagttctagttttctatgttctgatgatgatagagcttctaaaaatatttctatgaactctgattcatcttttcctggaatttctataatggaaagtccattagaaagtcagcccttagattcagatagaagcatcaaagaatcctcttttgaagaatcaaatattgaagatccacttattgtaacaccagattgccaagaaaagacctcaccaaaaggtgtcgagaaccctgctgtacaagagagtaaccaaaaaatgttaggtcctcctttggaggtgctgaaaacgttagcctctaaaagaaatgctgttgcttttcgaagttttaacagtcatattaatgcatccaataactcagaaccatccagaatgaacatgacttctttagatgcaatggatatttcgtgtgcctacagtggttcatatcccatggctataacccctactcaaaaaagaagatcctgtatgccacatcaggtatatttataactttctaatactgttttttggattttagaaaaactatgaagacagacatttgcctctaagctagactatgcggtattaatcatatagttctgttcttcttgttgagaatctgtgggctgttggaagttttcacccagaaaagtaaagctggtagaaatcatgtttattatttttagctgtaatgcctccttccatttgtgtcgttttatgtactttcctaagaaaatacaatcacatattttcacttgatccccacagtactatgagttacaaaattaattttcacttgatccccacagtactatgagttacaaaattattattattattattattattattattattat

SEQ ID NO: 60343 - DNA, 1113 bp, Homo sapiens
agagcgaaactccatctcaaaaaaaaaaacttgttgtgaaataacaaattatcctaaaaatttttaaatgctatttagtacaataggttatatgtagttctgtcttacgtgttgtcttaatcatttgttagccatagccttcctcagtggctcttcttaagcttgtattagtccatgctatcagtcttcttgcagattttttcactgaacatttttcttgcagattttttttattgtttcttatctagatcttattggaataatcagtgttgtctaagcttttgaacttcaccagataaaaggactttttcataattataactaattatgcattcattttcaaaacttatcaaaaatttgactacatcctttacgcctagtagcctatgagctagttatttggcttgtgtgtttcaccattttctattcggtgtaaaaggaattaagatatttgttatctcttaaaccctttttgaattagcagaccccaaatcagatcaagtcgggaactccataccgaactccgaagagtgtgagaagaggggtggcccccgttgatgatgggcgaattctaggaaccccagactaccttgcacctgagctgttactaggcagggcccatggtaaggcatgcatgtcttgagtttttgaagtgttatctatcactacattatctttcaaggttaaattttaaaaaatttcttcagtacttacgttacctaaagtaaaagaaaatgaactcatctagtatatatatggcatttgtcataggaaaataaactagcagtagccatggctgtcccactctctgaatgtaaaagaccagatgctggagtacatgtagtcatttgtcctttgccttctggttcagtctcaatgttccagagaagccccacctgccacccttgatattatcttatctctttttttatttttttatttatttttatttttattttttgagacagagtttctcttttgtcacccaggctggagtgcaatggtgcaatctcggctcactgcaatctctgcctcccaggttcaagtgattctctggcctcagcctcctgagtagctgggattacaggcatccaccatcatgcccgcctaatt

SEQ ID NO: 60344 - DNA, 1106 bp, Homo sapiens
tagcacttcgggaggccaaggcaggtggatcacttgaggccaggagttcgagaccaagctggccaacatggtgaaacctcacctctactaaaaacacaaaaattagctgggcatggtggtgcatgcctgtaattccagctattcgggaggctggggcatgagaattgcttgaacctgggaggccgaggttgcagtgagccaagatcgtgccactacactcgagcctgggcaacagagcaagactctgtctaaaaaaaaataaaaataaaaataaaaagatgacattttcacctatcttcttttcttccctttctctctgaaaactgttcccttcctgcattctgaaatgaactgtattcatcttcctagggatgctgtagcacaaactgggtgtctcaaaccaataaaaattcattgtttcacagttctggaagctagagttccaaaatcaggtgtccacagggctatactacccctgaaacctgtagggaaatccttctttgcctcttcctggcttctggtggcttgctggcaatcctcagtgttccttgacttgaagatgcctcattccagttctccctctttctgtgatggtgttctccctgtgtctctatcatcatagagctggcttctgagaaggacaccagtcattaggagcccatcttactccagtatgacctcatcttaacctaatcttaacctaattaatcatagttgcaaaaacccatttccaaataaggtcacatttttaggtacgggttaggacttaaacatagcttttttgggagggacacagttcaacccataacatcaacctcttctacatgttgatgttagttacttcccttttctttgagctcttttcatgatcatctgtttcatcctccccaccccacctctcacaccctttcttctgtttgtatttccttgccggcttttatcctcagcctgaaaataagtttccacccttgtctccccaacattgcctaacttctcaaaggtttcctctttgtttgattattttgctctggcaacttatcatctcactatttaactgaaaattcttttatttattatttatttatttatttatttagagatggagt

SEQ ID NO: 60345 - DNA, 1038 bp, Homo sapiens
ctttgagcattatcagataacttttcttcaccttctggccaagggatatctaaaattatacatatacaaataaacttgtttattactgctcaaaataatagtatccagagataaatgactacttttttttgttttttgagatggagtttcactcttgtcacccaggctggagtgcaaaagcgtgatctcagctcactgcaacctccacctcccaggttcaagcgattctcctgcttcagcctcccgagtagctgggattacaggcgcccgtcaacatgcctggctaattttttgtattttttttttagtagagatggggttttaccatgttggccaggctggtctcgaactcctgacctcaggcgatccacccgccttggcctcccaaagtgctgggattacaggcatgggccactatgcccagccagtaaatgactatcttaataggagaaaaagaatcacctcttttcagaatattctggaatacttgttgtggtgtttcatcattgaaagggggaattcctgttagaaattcaaacaagcaaactccaagtgcccaccagtctaccgcaggacctgtaatcgaagaggaaacagctaaagttgcaagcattctctacaaatatttgatgaacagaaatattaattgtggagtcctaattagggaaaacgagttaggctggtaggaccagggggaagcaaaaagaaaaagcagataagctgcaagtctgcctttcctcatggtccaggacgcacagccctcctgtacaaataactcacaattgtcctgtgcccacgtatcaccagacccttgattgatacaaaaatgcaaggtagagctgggcgcggtggcttatgcctgtaatcctggcactttgggtggctggggagggtggattacctgaggtcaggagttcaagaccagcccagccaacatggtgaaaccctgtctgtactaaaaatacaaaaattggccaggcgtggtggcacatgcctataatcccagctactggggagactaaggcaggagaatcgctt

SEQ ID NO: 60346 - DNA, 2592 bp, Homo sapiens
tgactctcctgcctcagcctcccaaatagctgggactgcagctgcatcccaccacacctggctaatttttgtatttttagtagagacggggtttcaccatgttggccaggctggtctcgaactcctgacctcaagtaatccgcccacctcagcctcccaaagtgctgggattacaggcatgagccattactctgcccaaaagagcatacttttattttactaggtagaaggaaataggaacaatgacaggtaatgaaatggcagtaaagaggtgaggaaggctttgaaatcttgtaagcagagcagctcagtgatatagagcttccaatgtagccataagctagaagtcaatatgttgtagagatgcaagtcagtgaaatcaaggaagtcaaagaaccatgaagagaacgtgtcagaactgtcatcagtatctattcttgaagtcaccatgaaggataaggatggagcacagggaagaaagggagaagggggtgagcttcatgctaaagctgtctagggcaatagatactgctaaggagcgtggtgatagaaacaggtggcaaggccttagagtcaaaactggagcattcatcatggaagatcaatggcatggaaggtttatcaaggagcagaaagtaggccacactctcttcccctgagtcagggattctttaacaagatgcaggcagggtgggcgcggtggctcacacctataatcccagcactttgggaggctgaggcgggtggatcccctggggtcgggagttcgagaccagcctggccaacatggtgaaaccccatctctactaaaaatacaaaaattagccaggcttggtggtacacatctgtaatcccagctactcaggaggatgaggtgggagaatcgcttgaacccgggaggcagagtttgcagtgagccgagattgtgccattgcactccagcctaggtgacagacaaaaaaaaaaaaaaaaaaaattagccaggcatggtagcactcacctgtagtcccagctacttgggaggctgaggcacgagaaccactcaacctgggagatggaggttgcagtgagccaagattgcaccactacactccagattgggcactggagagagactccatttcaaaaaaaaaaaaagatgtgagtgccgggcatggtgactcacacctgtaatcccagcactttggaaggccaaggtgggcagatcacctgaggtcaggagttcgagaccaacctgcccaacatggcgaaaccccgtctctactaaaaatacaaaattagcctggtgtggtggcacacacctgtaatcccagctactcgggaggctgaggtaggagaatcgcttgaacccgggaggcggcggttgcagtgagcagagatcgcgccactgcacttcagcctgggcaacggagcgagacctcgtctcaaaaaaaaagctgtgagaaagataggcttctaagttaaggcaaatcattcattctgtcattaaacaaatacaaaccaggcacctgtcatatgccaagtgatattcaaaatggcccatgtagacctttgtgaagtatgtggcctaacagacattaaacaaatgtctgtgaaactgacataataaagtaaggtaagttatatgtgagacattctctttttataataattcctgtaaagcagtacttacttaggtaatgatatcatactgttttgttttatatttttcctaagagctaaaacgtcatcctctcttcagtgatgtggactgggaaaatctgcagcatcagactatgcctttcatcccccagccagatgatgaaacagatacctcctattttgaagccaggaatactgctcagcacctgactgtatctggatttagtctgtagcacaaaaattttccttttagtctagccttgtgttatagaatgaacttgcataattatatactccttaatactagattgatctaagggggaaagatcattatttaacctagttcaatgtgcttttaatgtacgttacagctttcacagagttaaaaggctgaaaggaatatagtcagtaatttatcttaacctcaaaactgtatataaatcttcaaagcttttttcatttatttattttgtttattgcactttatgaaaactgaagcatcaataaaattagaggacactattgagagtgagccactagcttgattttctttctcctctgatttcagttcactgttcagtttagcattaaaataataaaataatcatacagttccatttgattgtaatttacttgcatatgattaccttcaaaagctgtgttcttgagggcaatcatttaaggccatacttgtgacctcagaaatgcagctggaaggccgggcgcagtggctcacgcatgtaatcccagcactgtgggaggccgaggcaggctgatcttgaggtcaggagttcaagaccatcctggccaacataatgaaaccccatctctactgtaaatacacaaattagccgggcatgttggtgggcgcctgtagtcccagctactctggaggctgaggcaggagaatcgctggaacccaggaggaggaggttgtggtgagccaagatc

SEQ ID NO: 60347 - DNA, 1032 bp, Homo sapiens
tgtcaacatcattcttttcaacaaagcgagaccccatttccgggggaaaaaaaacttgttccttttgcacatcgggtttagtgtttttactttccattaccatcccaatcaacagccctgttgcaatgtagttgacaaaatgtacaaatttaaaatggttacagtgaaagatacaccattataattagtgctatataactgaatccatgggttaatggttttactgagcttgttttagtaataactacttagatttaatggtcacttctagtaaaatgttcaaaatacagttgttcaaaactttgaattacatctttcccttaaattaggcaaaagcatagaattatctattatccttttatggtatttgccagtagtagaaagaaaaaaagtttgggaatcaaacacaaattgttgaaatcactgctctgccacaataaaaggcctctggcaggttaaactgagctattgatgactcactgtatagtggggattaatagtgattaatttggagagttggaatgaacagagtagattgaggaacaagccaatttagttgctacccaggatattaaccttaacagggacttgaaacattactgaataatcggggaaatgttctctgagcatattcccaatgcacaagacaatggccttgagtggaaagttacactgtttactaacagacctagcatgtgaagctatagtcacttgaaattcagccacaggtaaggcatgctgtaatggtatttattgggaacaggtgacttattatctaaatttatacctgtcaagatgtagattcagacacttgctagggaaaaacctaagaggaaagaacaatgggaaaaaggggatggttttgacagctgatgtatatgtgtgcatgcacgtctttaaaaaacaccaacggccaccaatagaaatccactcatcttttgctatgaaggaaatcagaacatatcatcctaaaatgcctctttgacataaaaatatttttgagctaaaggcagttaagaagcagcaaactga

SEQ ID NO: 60348 - DNA, 2581 bp, Homo sapiens
gcaagactttgccccagtaaataaataaataaataatttaaaactgtttggtaatttcagcacttgtaattggatctttcctatcaggctgcaagtcatatgatgtagttctataaagactgttggtaatattatggttttattttgaatttgtatgttattattattatgttaccatccagagaattatttgcattcatactcacaggaaattggtttttattttctttttaaagaaaactgaactgaggaaaatggtgttttcctcaagaagactactggaactggatgacctcagaatgaactggattgtggtgttcacaagaaaatcttagtttgtgatgattacattgctttttgttgtccagtagtttagtttgtgtacatatatacacatatatattttgcactacacaaacgataacattttaaggactaatattgctgatacttgaataatcaatctctactaggttataagtagtatacacagatttaccctgcccttgaacttgaaggacattaaattattaatgatcatttggtaacatgtttacctgattatcttccatagagtaacataagctgcttttcaaaggtaccattgtgataatgagatcaaatttataagttattatttttaattttctaaattaaataaaagaaagaatgcaaaccaggagtgaatttcaaatgagatgtaatcgactttatatcttagtcacggagttgccatggcatgtagtagaaaaccacaggaagaatggtcatattcactttgtgggctgcccataatctttcttgggcattcacaactcttgagtttggtgttcaggcatcattattaaaaagtggagtcctatgtaccagactgagtttttacaaatgatttgcaggctagacataacccactgatggaaatggtgaagaatgagcttcatgtaggtttaaaagtgtattctgagcctgtagatgattaatcaggtttttattcaatcatataaatgtattcctttgtaatcatttttgtttaactgaggatatctagtgtctgcttcatagggtgctttgaaatataaaatgaaaacttatttatactgtttttacaacagtcaaaaaggaaacacacgaaaatcacttttctgcaactgatgaactatatagactggactcttaacctcttagtgcctcagtttttccttcggggtatactattttagatacacctacttcacaggagtactggagggatttgcaagctaacgggccaaatgcttccataggaataaggcatgcccagctaacagaaatttaagtccctcttccccacctctctcatctagaccaaaaagaagactacaatttagatccttggagacttttcctgtatgccttccaaaacttcctgctcacttagatgtaccttgtgctttgaagatttctttgatgcagtctttgtaacaaataatttttttttttaaatggagtttctctcttgttgcccaggctggagggcaatggcgtgatcttggctcactgcaacttccacctcctgggttcaagtgattctcctgcctcactcccaagtagctgggattacaggcatgcaccaccatgcctggctaattttgtatttttagtagagacggggtttctccatgttggtaaggctgatctcaaactcccaacctcaggtgatctgcctgcctcggcctcccaaagtgctgggattagaggcgtgagccactgcacctggcctgtagcaaataatttttaagcattctcaagatgtatgatgttgggtttaacatcatatgttcacagtgttttaaataagaaataatctgtctttagtatacagaatggttctttgtttgcctgaaaagtataagaatacaatttacttttcccaaactctttttccttatttttttctttcaaataactttaattatttaatcccatactgattaaaatatgtctgtctaaagggatctactactatttgcttttaaaaaagtgttccctatttatttaggaaaaagtgaagcaagcaactgaatttatatgtaaaaataacatttagacctgtggatcaaagattattttcaaaaatgagatatcaatttggtatcagtaaaaagtgtcttttctcttagtatataaataaataaaatgcaaattaagagtgtaagcagttgtgaatcattacaagcagtctgggataactaactcctagggataaccatttctatcctgttccaaagtcttattttatagtttgaaaagcactttgcacacagttcttgtatataaaagtaaagatgtaattataggatatagtgttcctgctttgtttaataagaacctcatttaaacttgacagctatggtatttttttaatgataacttcttttctgtttattgtaaaactaagttaaaaataaaaggttaatgagaaatgatatggcttttattacttgttactattagcccattgattaggtaagaattcaatgagagtaagtagtagtcgcacataaagtaattatgactctcaaaataaagccatgctattcca

SEQ ID NO: 60349 - DNA, 1064 bp, Homo sapiens
caatggtacctttgaaaagcagcttatgttactctatggaagataatcaggtaaacatgttaccaaatgatcattaataatttaatgtccttcaagttcaagggcagggtaaatctgtgtatactacttataacctagtagagattgattattcaagtatcagcaatattagtccttaaaatgttatcgtttgtgtagtgcaaaatatatatgtgtatatatgtacacaaactaaactactggacaacaaaaagcaatgtaatcatcacaaactaagattttcttgtgaacaccacaatccagttcattctgaggtcatccagttccagtagtcttcttgaggaaaacaccattttcctcagttcagttttctttaaaaagaaaataaaaaccaatttcctgtgagtatgaatgcaaataattctctggatggtaacataataataataacatacaaattcaaaataaaaccataatattaccaacagtctttatagaactacatcatatgacttgcagcctgataggaaagatccaattacaagtgctgaaattaccaaacagttttaaattatttatttatttatttactggggcaaagtcttgctctgtcgtccaggctggactgcaatggtgccatcttggctcactgcaaccctccgcctcccgggtacaagcgattctcctgcctcagccttgcaagtagctggcattacaggtgtgtgccaccacacctgggtaatttctgtatttttaatagagacgaggtttcgccatttgaactcctgacctcaggtgatctacccacctcagcctcccaaagtgttgggattacaggcgttagctatggcgcccagccatcctggccagtttttaataaataatttaaatgtacattcatcctctcttactttctagattcttacccttttctaattggctattacacaattaagatttgtggaaatgatttcataattttatcaaaatggaaaagttatgaaacaaatgcgtaacaaaactgtaagaggataatagatgtacgacctggagtattcacttaa

SEQ ID NO: 60350 - DNA, 1359 bp, Homo sapiens
aacagtattttgggaggccaaggtgggtggatcatctgagctcaggagtttgagaccagccgcaccaatatggagaaaccctgtctctactaaaaatgcaaaattagccaggtgtgttggcccatacctgtaatcccagctactcgggaggctgaggcgggagaatcacttgaatccgggaggcggaggttgctgtgagccgagatcgcaccactgcactccagcctgggccacaagagcaaaactccgtctcaaaacaaaaccaaatgaaacaaaaattagctgggcatggtggtgggcacctgtaatcccagctacttgggaggctgaggcaggagaatcacttgaacccgagaggtagaagttgcagtgagccgagatcacaccactgcactccagcctgggcaacagagcaagactccatctcaaaaaaacaaaggaataaatttgtttttcttctactatagtataattaccctatctgcacttttgttcatatttagatataaatgatgatcatgttgaagatgttacaggaattcagcatttgacaagcgattcagacagtgaagtttactgtgattctatggaacaatttggacaagaagaggtaaaaatgacattttctgattggtgtattttcaaagtggtgtattagaattcaatgcgtaacttctgttagtagcaaatatacatgctatttttcattttgaaaagatactcctaaaatgtttaaacatttgtattttaaactattttttatgaattcaaaaataggtaaaattctggaaaagtcaaagaaaaattaataatattaactactccattataactaataatatacatatatttataaatattctaggagacgtgggatggggatgcagagaaaacactttttatgctagtcccaatgtttgaaacatttattaatgttcaggaaaattgaatgatcttctttgttgttttttttgttttttagagatggggtctctgtctgtcacccaggctggagtgcagtggcgcaatctcgggtcactgcaacctccgcctcctaggttcaagcaattctcctgcctcagcctcccaagtagctgggattacaggcatgtgccaccacacctggctaatttttgtattttcagtagagacagagtttcaccatgttggccaggttggtttcaaactcctgacctcaagtgatctgcccacctcagcctctcaaagtgctgggattatggacgtgaggcattgtgcccaacctaaaaatgggttcttgatatgttgcctaggctggtctcaaactcttggcctcaatcagtgctcccacctcagcctcccaaaatgccgggattacag

SEQ ID NO: 60351 - DNA, 1008 bp, Homo sapiens
aggtctcatagagcaatttgcttatgcctaagggagtaaaaagactttgagagattactttttaaaagaaattctagaagattgacagggaactgaaacagttttgaagccaacatagtttgggtgagctctcagcgtatagtaaaccccatttcaaggagcacgccttctctttgatccaagtaggaaacccttcaaagggattgtggtaggttagggaaataacagctggatattaaaacatggtatgcagaaggtgacctactgtgaacttttatgaatctttcccattttctcgtaaaagataagaaaatgatgaagaagtcagcagaccataagaatttggaagtcattgtcactaatggctatgataaagatggctttgttcaggatatacagaatgacattcatgccagttcttccctgaatggcagaagcactgaagaagtaaagcccattgatgaaaacttggggcaaactggaaaatctgctgtttgcattcaccaaggtattgtccccaaataattctgtgtccagcctctttcctatgaatagtcttttagtaattataggatctttaggatcagtttaatttaaaaatctcttatttaataatatcttagggcttattaatattataagcatttatagttttgaaaaagagtgaattagggccaaggttatatatgtatctctttctgttgcccaggctggagtgcagtggcatagtcatggctcactgcagccttgaactcctgggcaattctgcctcagcctcctaagtagctgggattacaggcatgtaccatcatgcccagttaatgtttaaattttttgtagagacagggttttgccaggtagcccaggctggtctggaattcctgggttcaagtgatctgcctgccttggcctcccaaagtgctaggattacaggtttgagccatgcactggcttattttttaatttttagggatacataatagtacatgtgagaaacatcatttcttt

SEQ ID NO: 60352 - DNA, 1094 bp, Homo sapiens
gtgcagtggcaggatctcggctcactgcagcctctgcctcctgggttcaagtgattctcctgcctcatcttcctgagtaggtgggattacaggtgcgcgccaccacacccagctaatttttgtatttttagtagagacagggtttcactatgttggccacgctggtctcgaactgctgggttcaggtggtccgcccacctcggcctcccgaagtgctgggattacaggcgtgagccaccatgcccagccttcccaggtgctcttagtacaattttacacaaataggaaaatcttggggaggagaggaaaacagtaaaaccaaaagggataggtgcatcaaagataaagaagcattatcagttaatctttactttcatggagttttccctttttttttttttttttttaaggcaagagcaactcccaacctaagttaaataaacaaacttttaactgcctcttttgcctgcaagaaaaataatggcttttccttgtttgtactgagccttgaagataataaataactaggaatatgactcaggtactgccatgctaactttttatctaagctgtcacttctgacctactgtaattgaatagaaatttgatcttttatatacttaaaagaattctaaactaaaaagtatacttaaatgaattataaactataaactaaaagaattatagatacaggtacctgtactcatccgtgctgttttcccagttgactaacagttgatactctaatacaattgaagccttcacaaatgtctgagaaaagtcaattttagactgtacgttatgaacagaatatgctaattggtgaagcatgttttatttatttatttatttttgagatggagtttcactcttgttgcccaggctggagtgcaatggcgtgacctcagctcaccgcaacctctgcctcccaggttcaagcgattctcctgcctcagcctcctgagtagctaggattacaggcatgcgccaccacgcctagctaattttgtatttttagtagagacagggtttctccatgttggtcaggctggtcttgaactcccgacatcaggtgatctgcccgcctcggcctc

SEQ ID NO: 60353 - DNA, 1053 bp, Homo sapiens
taacaataagaagcagatgttctaagaagtgttactgtgtctctcagagatggagaaaggctaagaaagctgggtagtatgacaaggcagttataaggtagagctggacctaaatttaagataatctgcttcaagcacagtgcttttcccaccgcagtgcagctgttatgagcagctgccgaaataaaacagcttgatattctcctgactgagtcctcccactgactcaaaaggagggttaggttgaggctggggcggagctagacctcaagaagaagccaacaaagtcacacacagcgctccccacctgcgcttgcgcaggggaggaacacgcagtccggaaaaacgccggggattctgggtcgcgcagccgtggagctacctcaaggcggaactggggagtccagggcttcggcagcctgaacacccggtgtgaaaggaaggtggcagacgtggagcggcgcgcatgcgcagcagctcactctgctgaagggctgagaggcgcacccgggcggccagctgggctcggagcggaacggggtcaggatggacgaggacgtgctaaccaccctgaagatcctcatcatcggcgagagtggggtgggcaagtccaggtgaggcggaggtgcgggtcgtgacgagggtggctgggctctttctgccccggtggctgctgtctcctgggccgcgacgggaactgtaaactgcagcggcgggctcgggccggctccgctcgcgccctcctcggcctctgggccgcgctctcccgcgacgtttgctttcctctccccacccgcgcctgcctggttcccggcctttgccaggcccaagttctctgggtcgctctccctcctgtagcgccgagaaaacaccattccgagggccgccgctcggccggcaggtttgctgcgcggagctcagggcgtggcgggctggtttgggcccgaatccggccgggggcgccttgcctcgaacctctcggggttcaggctgcctgccaccccgagacccgggagacatagctttcccacttgagggtttctgtggggcctt

SEQ ID NO: 60354 - DNA, 1117 bp, Homo sapiens
cacccaaccgaggttctccttgtagagtaaggcctgttaagtggatttatcagtctccctagttcatgccaccgaaacaaagaaacaaatttaccgtgggcctaatctgttttaaactttttcctcaatacgtagcaatggattatcaactgctcgatgcaggattttgtcactttatttcttttgtgaaaggattacatatagtgagaaagttgtcttatttgtctagctagatatacattattggcctgtgtgatatgctgtggaaaacaatcttaaacactctggataagatgagaataaatgactccactgaaatagaagtctatgccttttaaagtgaattagtacaaaaacatttgctgtggatatgatcttaaaggattgttttaaccaagtttgtttctatttcattacagagctggagctagtggaagtgagatagcacttgtgctgttggggaaaacaaaggatatgtttaatccgaattagtggattactttctagtgatttcatagtgttagagtctaaagggtatgtgatagtagtcaggagatcaggattatgaaactggggctgccacttgtgtgaccttgtgtgtgatacttgaatgctgtaggccttcatttcaaaagcgagggggttggaatagaaacctctcagaccctaaatgtgtaagactccaattctgtggctaggcctggtaaggtaaagagtagcagaatatatcaagaactggaagggattagagagacctattatctaaattgctgtccctcctttgccccttgccttcccttttttttttttttttggtgaatttcatatgtaaatttaaaaaatgcagattagttataatcacactctgtttattataaatttggtcacatctaagtgccatggtggtagttactccttccatctctacttctgcatgggaaacattttgctcctttaactttgaaaatatgagggtgtaaatatacaatactataagaatggtgcttctgccaggtgcagtggctcatcctgtaatcctagctactcgggaggctgagacaggaggatctcttgaggccaggagtccgagaccagcttgggcaacataacgagacca

SEQ ID NO: 60355 - DNA, 1033 bp, Homo sapiens
acttgtctatattgcttagtaatgctaactcctagctacatatcagaaatacgccattgcttctttctttaatgcttatttaacaaatgactccttttatttcagtttatgatgtcacaagaagagatacatttgttaaactggataattggttaaatgaattggaaacatactgtacaagaaatgacatagtaaacatgctagttggaaataaaatcgataaggtaagaaggcagacacttggcattttggttctatattttggtagcctttcttaatcattgcatttatattttaggaaaatcgtgaagtcgatagaaatgaaggcctgaaatttgcacgaaagcattccatgttatttataggtaggtgtgtgaatgaatatctgtcctttcattattaatgaggaatttttgaatggagtttttgccaagtttatttctttatgaaccataaaatgtgtttagagtattgttcctagttgccttgtgttacaaaatctaactatataacaaggttctttattcttcttcctgtaaaatgtatgatcatattatgtgaaatcatattaaaaaacagtcaaatcattcctcacaggatatagtggcattcagtaaagtttggcacccagtgctaaagttatgccttgctggtccatatgctgataccatcagcaccacctgggagcttgttagcagtgcttcagctcaggccctaccccagattttctgaattagaatctgcattttaacaagctcttcatatggtttgtatgcacattaatttttgagaaacatggtccagcaagagttgccaaactacagcctggtccaaatctggccccaccatttgtattggtacacagccatgtccatgtgtttacatgttgtctgtagctgcttttgtgccatatggcagagtttagtagttacaacagaggccatacggcccacgaagcctaaatattttctatctggccctttacagaaagagtttgccaacccctcatctagaaaattggatgagctatgtc

SEQ ID NO: 60356 - DNA, 1497 bp, Homo sapiens
tcttaatatattgtaggctgatatttatgccctgatagtttcccagaaaaacatgagaatatggccagaaaggaatatactatgaatgacctttttccttgaatttcagaggcaagtgcaaaaacctgtgatggtgtacaatgtgcctttgaagaacttgttgaaaagatcattcagacccctggactgtgggaaagtgagaaccagaataaaggagtcaaactgtcacacagggaagaaggccaaggaggaggagcctgtggtggttattgctctgtgttataaactctgggaaattccatctcttgcatatttgatcagatagtgacatctttctgtatataaactctttaactgctattttagggaccttgcagtttgcacataattgttttatatcatagcagtaaatatttgcaagaaatcccactcatcgaccccgggtaaaatgttatggtaagcatgcacagtttgcagtctacagtttttttatgtagcacaaaataggtgtacctttataagtacattcaattttatgatttacatttatcatgtaatttttaaaaaaatccatctatctaggatatgttgatacaaagtctgcttttgctattctttttgcttaaatactcctatcattttctgaattacttggtatttagaactcctagcaccacggggaagaatagaggtatcatcaaacgtggcaaattttctttcaggaataataaagagcatgattccacagcttttctgggatgtttgagattcttttttagtactaagcaaaattctcatcacagaatgtagcccaggccaatttataactaaatctctatttgttcagatgatgcttctaaaacagcattgataggttaaagaagcttggtatttttaatttacttcaatgattagctcagttgcttaactggagttttaatcctgtgatatgtacattggattcatgactgtgcagcatttttagttatgtggtgtttggcagaatgacaataaggttttcccccattttggtttcaggaggacatgaatagtgtgtttattgtaactcctcatacacttttaaaaccaacatcttttttcataaatgttggtagtgtttgtccaggtaccttaactgtagcttgtgtaatgttgatgaatatctgtatcttacggcttccataatggctagttgatattcaaaaacctatttctgtgttttgaggggtggggaaaaaaaacactaagtgataatttgaaaaaggcatattgcttccagattctgatgtgtgagggaaaatactgtcacaatgaaaatcttgacaatttacttaacaagtaaccagtagttcatcaaaaccaacttgtacagactaataaatctttttcacagtattcagttttctcacctcttgctattgtatattgtagatttttttcattcatgtgttatttaatttacactgatctctgctattttaaccccccaaataagtt

SEQ ID NO: 60357 - DNA, 1057 bp, Homo sapiens
agtagtcagtgaaaggagaccaaaggaactaacacttgttgttccattctgggccagacacacatgatctcatgtgttcttcacaacaaccttgccatttgttcactaaatccttttgttttgtttgttcgccttgtttatttaagttccttacgtgaagggttgtgaaaagagctcagagtgacccatgattgtctcgtggtctacaccttaaggcttaactcaggataggtcagcaggctttccccattcttttccttcagagagggcatcgaagcttggctgcctcatgggcatataatttattttctcttgactatctcttcctgggaaattttgccctggttagactatatgacgatcatgttgacgttattcttctcagacctcttctagttctgtgactgtcttagagctcagaattggaaattaggttgcatttcctaactagccttgagcagtgcagagaaaaagaaattgtgagaaatattgggttggcaggggcagggggcgtaaaaggaagggagaggactaagggcaggaaaagacagttttgcaaaggccgtagaactagcagagggccttgcgttttccaggtttcctgtgtgcagcacagtgccaagtgcagtagctccccagtaacattgattattgttgtggatgatgatgacgatgatgatgaagaggggcttacccactatctggttttggagtctcaaccccactcctttgctcggatgccatgccagtagcctctctcctaccaccctacatctttcccttcagtaggtaaatttttgtgttactcataccagattcttttagcctaaggagcttgagaacccattttcgtgggttctttatatttatgtggtgttgggagacattcgtgttctgagtgaagcagcaaatctaaaccaaagatgtgagtgcagaagcaaaagctagcatcctaactttcatttcctgcagcagcaggaggaggcgttgttttggaaattgaggaccaatgcctgcttcttctaataaatatgccaggaaatcctgtattgctatc

SEQ ID NO: 60358 - DNA, 1074 bp, Homo sapiens
cattacactacacggcctctaagtctccctccagaccaccctcgtggtgaataccaagagccaagaatagaaacgagaatacttaacatttccagaccctctttctcatcccccgctgacactggcctccccatagactgcattcaaatcttcaaagtgaaacttcaggctgaacattttaaacttggggaagatggagcctttgagatcacagaggagcaatcttggaaagtgggactatgctgaatgagttagcatcaagaatatttaatgtgcttagtgaaaacgatcactgggtggtggtctgtttattctgaaaagctacttttaagttgcaagtcccgcttcctgcacctccactggcccagactgacgaggccagaagagctgtgcattttaccagaaaaaaataaacatcaggaaatgactaaagagccaccagccagggctgtagctccctaacataaggagccaagcagcactttcccacatcgacccgaggcattggtactcttgtagaaagaaagatgtcctattgttgttattaatggaattataacctagcctgagagcttcgagatatgaaaatatccccattttaactagggagctcttcactgttggttcaaaatagagaagtgtgggctgggcgcaatggctcacgcctgtaatcccagcattttgggagggcgaggcgggtggatcacgaggtcatgtgttcgagaccagcctgaccaacatagtgaaacccgtctctactaaaaatacaaaaattagccgggcgtagtggtgcgtgcctgtaatcccagctactcaggaggctgaggcaggagaatcacttgaacccaggaggcggaggttgcagtgaaccgagatcgtgccacactgcactccagcctgaacaacagagcgagactccgtttcaaaaaaaaaaaaagagagaggtgtggcttttaatttttattctctagcaggagctagttggggggactatgcattgacagaaaggcagttgaaggtgaggaccctgtggatccaggacatctgggtatcattagccatcatgaggggcca

SEQ ID NO: 60359 - DNA, 1017 bp, Homo sapiens
agaatgactatttttagctgcatatgagaataggagaaagtccatacagaaattttatactttctctctcctccatgtgcaagagcaaagatcccatacatttctgatattttcctgttaagaacaagtttaccaacgttaagttttgatcttacaaaggcattctctgtattttggcattatggttctactgatatttatcagcaaattgatcataattgactttctgatactcaatgcatttcagacttgcttcagtggtcagtcacatcccggggcagcttcacagaagtgcttgttcatgtcactatatttaagactgtgtcagtatttccattaagagactttctcattccctagggcttctaaataagtcgtaaaaaatcaagccaaactcaaagctggcataaaggggtccttttctttcttctcctatgtataaggaatataagcacgtaactcccattaattctatatttagttaggtttgtaaatgctttatacactgacgagaccaaatatgatccattgatgcttctgtggcctaagattaaaaagaatttcaagaagtttttactgtctatgaaaataacaagacattctaattaatgaatatggaagtggtttcttttctcccttcttttttttttttgttagttgcagttagttttttcctttctgcctccctactttgtttctaaaattaagaaggtatttttctgtgttaaaatttgtcttgttgatgtaacagaatttttacacagggtaaatatgtgctttcttccagtccagagttttggtacttttaattttggaagcctggtttcttgttttccattataaatgatatcatttataattgtgagttttgaggaagtgaaaaaatataataataaatgtgttcactttgcccaatttccttcacaaaatttgaatatttttctcagttttcagtttaaatgaagggtggtgtgtttaaataacagctgcgtaatgaactttttctctctttcctct

SEQ ID NO: 60360 - DNA, 1048 bp, Homo sapiens
gactcactggagccctgtgtttggtgctggtcactctatccatgaaaccatatttaaacgaaccagaagaaaggtttaaaaagatgccttggcagatctttttgagcagtgaatattccccctgacaatatctgtttccttcatttcagctttcgttttggggggtagcttaaaaaagtcttacggcggcatcaagagccatctgtgttaagggccctgtgtgagtgcctcggtgcacacgcacggtttctcttttgggcttttgttgaccagtaagtctacctcggatacttattttcttattttatttccctttctgtgctgtcactttcttggttttagtgaaagaattaagctttgccttttttggattattccagacattcttttcctggcatgcaaatgactgttgatgtactccagcagagaataataaaagcctctatcaccagtccagcgagtgacatttaaaggatatttgaaaggttgtccaattccttgtcttgtaccttacctaacaaaggccatctgggaatgaggtatttcacataagtccagtttccagatagcagaaatctaaggaccaatttaaaaaatagagaattttcttctcttctaaacttacactattcagcacagctttggagaggtactttaataatctttctattctctaaatgtcctcttccttgtatttcttatatactgttccaccctttcaaatcagtaacctcagggttaatcacaatcggaaacttgcccctcactcctttgaataaagagccttgtcttcctgacagcctttttaaaagagaacttttctaattacttatttctaagcagaatcttttaaaatgagatttatacaaatgctgaccctttgaatatgcatgggattgctatagaattataaaaacttaagcactattcggaataccatagattcttagtaaacatttatgagtgatgattgtagcaaaacacattgacatggattctttctgaagttcaaattaatttgatgtttgaaaattacatttctttctgg

SEQ ID NO: 60361 - DNA, 1042 bp, Homo sapiens
ggaggtcaaagactggagtaagatctggacctgtggtgatgtggtgcttaaaggagggaagaaagaatggttttcatggcactacagcacagaagggattctgggaaaaaggctgtcaaaggggctttcagattctctgatgtgggacacctcttctgtcccacagaagataatgttaaatatctcttctcccttaccaaattgtcaacaacttgcatgttcatcattaacttattttttcagtaaattcttttgagagagctcagccaaaaagacaaaggaccagtaggcatcagcattatagtagtctgactacattgcatttcatttggaaaatcaagacaaaggcaagcaaaacagccatggtcctataacccgaacatagccatgactacaattttatttggttcctggccatccatttattttcctatgcatttttacatagttgtaatcatagtctatatgcaattttgcatcctgctttgtaaatttgttgttcaggtgtatgtgtgtactgataaaacaaaattacaacatggagaaacaaaccttttatattcttatttttcacttttatttgtaggttttattgtggccagaagtaattatagacatatgtatatagtgaatgtttgggattctgttctcagggttgaaagttcagtgcatatgttacacagccttgtttggagataaaaaatgtgacaataaataagttgctgagggctgttgatgtcacttttcagttctaaatatagaaagtggtgttgactgaaacatctactccttcaacttttacagatacaacttttgcagctacactaacaaaagttagtattttggttcttgatcagattgaattaattttcttttctagagctagagtcttgccctgttacacaggttggagtgcagtgatgaaatcatagctcactctaacctctaacccctgggactgagtgatcctcctgcctcagcctcctgagtagctgggactacaggtacatgccgccaccatacccagctcatttaaaacatg

SEQ ID NO: 60362 - DNA, 2027 bp, Homo sapiens
gaatgatgggacatatgtaataattcaggcaatcacctgagtaatttaggcagtccaaattctttaccctgaaatacccacattttaaaaaaattgcagataattgcttcagttatttactttggggacagagatatagtgtaaagtgggagaaactgagtccttttttggtggtggtaataataagatgttataaaaatataacattttaaaaaagaaaggtccagaccttaagcgcagagctagaacaatattttttaaataatggggggaaaagggggcactttggtaattttagaaatcaggtagtatacttttttttttttttttgagacagggtcttgccatgttgctcaggctggtcttgaactcctgggctcaagcaatcctcctgccttggcctcccaaagtgctgggattacaggcatgatccaccgtgcccagccggtagacgtggtcttaaaaacagtgtttacatggccatcttgatgcttagaaagataattgattaaaatttaataaggcagggccaactccgagagttcattgacaacggcagcaaaaaggccctgaattctgtactttcttcccccagcctccttctccagcaaggagaatagcactcctccctccagaagccagctccctaagttggagccactatgtaagagaagaggaacgttcactttttaaaattcatatatttaaaaatcaagaccaaaaagtaaattctgtactcctattattgactgtagtcaatcaaacataaaaaggtgaaagtaaaatttaattttttacccttattttactgaccaatatggaagttcttggtatctttaaggctgaccttcctggtattgtgtaatgattgaatgtatctaaactgtaataatttgaaactgacaaacataaccttctcagacttacaaaactatgttctttctaaagatacagatttttattattttattttgactaggaaggatttataaataaatgtaatgaaaaatctttgatcttaataaagtaccttcaaacagtgtgtgtacttacttgaaaattgtttttgcacttggatattctattttattatactactattgtgatctattccattatactatttcccatggtagaacaaattatattttctactgtgatatgaagtgatgtaattgaacttgccatgtctaaaattaaatttcatatttttttcaatcaaacactgctttcatcgaggctgttggagagatggaattcactagtgttgttcttacccatacattccagcaatttaaaaatgtggagaaccttagtgggaaggaagaattaggaccatcaatgatgggaacacacctcccccactccccacctcctctccctccctcccactaggaatcagtgtcacacatatcctcttcctgagctccagttaggcgaaactcaactttttcaactgtgcatataggaacagattgtcatctgctatgcaaactagctagcattggccttgcttcagtcctcgagccagttagccccagctgtgcatccatagaaaggttgctctgaagagcatttaaaagcatttaagagcatgggatctggagtcagaattcttcagttcacattctgattttgcctgtttccagctctgcagccttgggaaaaacactgaacctctctgtttttcattttctcatcagaaaaaaatagggacaagaacagtgattacctcatgggattggtgtgggcatgaaatgaaagaatccatgtatacttagaacaaaacctgggacagaagtgttcagtaattgtgagctcctgttgtataatggtcattatcatcacatcacacaatttaaaaatagctgtgtaagtattctcaatcaccctacataaacagttttcctattagtaagcccactggaagtttacaataaatcattttttagaagctttatttttttttttgtttatttttttgagatggagtctcactctgttgcccaggttggagtgcagtggcg

SEQ ID NO: 60363 - DNA, 1014 bp, Homo sapiens
caataccgctctatctccaagatgaggctgaaattttcagagagacttagctagaggcttagtatgtatgggagttcagcgcttctgctggtctcaggtgtggctgctgctgtcgagtttgaatgttagctgttgaaggtatcaattcagcagccatgagcagctccagacagacaggtgagctctgctgtttctgggtggatcatcacagatttagccgggcaggcagtaaggtgtcctcttactattcaaaaagtgtagactttcttacatattcgcaatacgttcacagtgtgtgcattttaaaataattcttaaaggagtaactgaaattttaccttgagtgaatggccttcataatatagcttgagaagtccttttgagtacctgtcagtgactcaacaacatttaataagggaaagtagacttttaacagttattatatatgtaacgaaaagcctttcctttgggattaatataagtaagaatggtagccttgtggcaagaaatgattacaaaggatatttttatttgtaattcctcagaagacaatttatgaagtcacccaaaatgttattttagctggttttggatttttccaataaattagaagaaggatttctattctaaaacatgtaaaacctgttttacatattactgatacaattaaagattatttttcatctatgtgcaatagatcacccctctttaaattgctctaagatttattttagaaaacttttcatgtgatgttatttctttgtcatcaaaatgcttgttaacactgtccagacaccatcctaaccttgccattgttaaagaagtttaggaaagactcttatattgtaaatatttagatgggttctctcacttttctttgatactactgattttcagcaagtgaattatataattcaaaatgctagaaatgtctatccgttctataagagagcatatcctgccgttcttgcatgcagtgaagccctgcccgtcgaaaatcattgcatctgtgac

SEQ ID NO: 60364 - DNA, 1015 bp, Homo sapiens
cagttcggtctgtccttgctaaaaacaaagtttgtttgttggatgttcagcctcatgtaagtaaacaatgagctattcaatacccttctgacccatgtcatctacagcacctcatgtgagcatttcagtatgaaataatatgaagtcaactcacttttggcatatatgtggcttttctgagatggcaaaagcatttaaatataattggagacatctttggtggagaaaaagaaaagcccataatattattagaaagagaagtggaggaagctccaagacctgtgtttgtaactcttatttatattcagtttttgtcaagtaaagcaactcttagatgtttctacatattctgtatttttaaaaaatacatcacattgttacatgcataatgcattcttatgtgttatgtattagtaacagtgtctataatttttaacgatggacattttggttccaagtctttgactttggttctgtatatatcctagcaaataaccccccactagaactgaagggcattttgcaggaaatgtactgaatgaaagccccattgcaactgccatgtctgcacctgtcatcctggaaactccattatgaacattctgaactgagaacttcagtggatgaggccattcaattccctatcaaaccatacatcttccagcagatccccagcccacagcattttcctcatcccccagggaccatggtttctccttccactgatggctgtaccctggggtgcaaaacctccaaatgctagaatgacctgcggaagccctttggacctctaaaggaagatgaatctggagtaaaagtgtttcaagaatcaggaaggctgcctcctgacttgggcactgtgttagtcccttgttgcactgctctgaagaaatacctgaaactgggtaatttactaaaaaaaaaaaaaaaaaaaaaaaaaaaaaagaggtttaattggctcactgctctgcagactgtacaggaagcgtgatgctggcatctgctcagctctggg

SEQ ID NO: 60365 - DNA, 1344 bp, Homo sapiens
gtgggatgccgtgtgtcagggaagtgatctttcaaccatgtgttgcagattttcaaccaaagtgtcctgccatcataattgaataaaaacaatcttttctctgtccgtaagaaagaaatcaatgcacagaaaattctcaatttgattttcaacaatactttttacttaggcttactatttgctaaaggaacacactagcaaatagcaacaacacaactgattaagtaatgaatgaatattaagcctaaactccaaagcagggcattatactaattttaatatatctcatgtttttggatattaatcgtgttatataccctcagtagggtatttttctgctgcaaaactttagtgtttgtgatagagtacaatgtaccagtttagaagacagtgcaccagtacttcatgctattcctgtaaagagtgtgacatttcattttaaagactagcactacctcttggtgcaccacctgcagaacaggtatgaaaaactgtttcaagagatctgagcattgtattaaaatattcttgctaactaaataaaagggaattaagctttgggatataacttaaattagttggattttataaattcattactttttctattaagttacattttccgtacttctcagattcttttttataacatcaagatgtaattggaataaactgcacatatttaaaatgtgcaattacatcagttttagcatctgcgtacacatgtgaaaacatcagcacagtcaacataatgaatgtttccatctcaaaaaatttccttgtgcccttggtaatccagtcttccaccctgttcccaggcaacactgatctgcgttctgtcacaatagattatttggaatgatttagtatgttatctaaataggattatacagtatgcatccacttttttctttgccagactttttccactcagcataatgaatgtaagattcacccatgttgtctcctacatcaataattcattctttttcatcccttttcatgctgaatagcattccattgtatagaactactacaatttgtctatccatgcacctgttgatgaggatttaggggtttcttcctctacccctatttttggctattataaataaagttattacaaggtttttgtacaagtcttttgacaaatatgtttttgtttctcttggccaactatgtaggagtggaatgctgaggccatacggtttaattttttgagaaactactaaactgatgtccaaagtggttataccatcttacaaacctctagtagcgtatgtgagctccaggtgcttcacatccttgccaacacttggtgtagtcagtcttctaaacttttgt

SEQ ID NO: 60366 - DNA, 1086 bp, Homo sapiens
gactgggactctccaaagaaatccccaaagtagttatttttcactctgatttacttttagacagatatcaatgtcaaaatgtcttcatatagtaatgtttcactggcttgcctgatgataagattctcatggagttctataaaaagatatgcccaagtatctgtatttatagcatgtttggaaaataccgcatcaaaccagcgtgatttaattaattaaagaagaatatattttaagagtaattttagaatttcaggtagttttgctttgtaaaatactttgggcagaatcttgaatattggagaaaaatgattgctttgcttataccaccagtattgtttgatgtttatttctataattctctttttgaaagcatgtattacatatccaccagaaaaagttatggagcaaaggaactcctgcacattgctgatgggaatgtaaattaacacaatcattttggaaaactaagtagcagtatccactaaagctgagcaaacacatacccttgacccagcaattccgctcctactgcacacccaatggaaatgcataagtacgttcaccaaaagacacgtactgagctattcttagtcattattcataagagctcagaactggaaactactcaaatgcttatcatttgaatgaataagtaaaatggagaagtaaagtatagtatatgcatacaaagtatagtatatgcatacaatggaatactgtaaagcaatgagaatgaacaatcttcaactacatgcaacaataagaatgaatcccgcaaatgtgttgaacaaaaggaggcagacacaagagaatgaatgaggcagcgtgatttcatttttataattgcaataaaggcaacattcatgtgtgctgttagaaatctcaaggatttgggttagaacaggaactcaagaggtgattctggagtgctagcaattttctgcttcttgttagagtgctggctacatgggggtgttaaacacttttatgtgtatatatatcagttattgtataatactcaggctttaaatgttaaaaagaaataatagtttaactgtagtttgctgattttctggttttcct

SEQ ID NO: 60367 - DNA, 1039 bp, Homo sapiens
agctttaagattagaagaatcaaatcacagagagctgaaggagacttaattataatataaacctttcttaattactttttatatgtagtaattggcagatgatgttaaatgggcttttcatggctatatagtttaaatatggtaagcttcttttcagtacacagaattagatttatttttataaaagtggttttcataggcattcttacaaataaaatgtgatgcttgaaacattttgatctgcagaataaaggccatttgactacttaatatgttgataatagaaagctgtctaaaaggctaaattgaaatgttggcttttttcaagcagttttagtactgttttaaaaaatttacttgtatattgcccttagcgatgttctctagttttggaagagttcaactttattttaaaattatagttttctgtgacctcaagttccttctttttacatttttctaaattattgcttgtaatcattttcagtcacaagttataggactgctgctttctaccaacagagatgaaagttaatgaaaatgtggaactagacattttttttgcctgtaattattcacctcaattacaaaagctgaattgcaatatataagttattagaaaattttacaaaataatttttaagcttacaggtgagcaattatagaagagacctagaagatgcaaaaacagattacaaagaaaaaaaaacgaatttttaaacttcctactgtgtattcatctcctttgtttgtcttaatttttgtagccttcccagtcaagtataagatggttgatattatctctatttcacagagaaggagatagggatagaaaggatatgttgacttgagttccatagatgataggtgcacttggattcgaaaccaagttttttttgataccagttctcatgttcttcctcctatattaacactagcaatcctttaaaactacagactatctttgttgtattccagtaagtagtcaaaactgacttcttttgaagatgagaaatatccataagccaatctatcccat

SEQ ID NO: 60368 - DNA, 1026 bp, Homo sapiens
tcagtttgcatccctaaattgcttggaatgtaaatagattttgtattccaaatacaaaccagacaactaaaaatgttgtgaacttaggcctaaccctagaaagaggatacgggacaggatggtgcatctgagctgtggtcttttaaagtcaaggggagactctagaacttctccagtggggatggcagattgatccaagggcctgactgggaaaatgctgtttgtaggcccactggacaatttggcagtaagaatgattgaaattatgtctctatttttaacctttcttgggaggatacttctacctttgaagatgatgacctagaataacctaatttagggaaaattttccaaataaagtcatttgcctctgaatgttcttggcaccctacatgggtgtcgtgagcttgcttgtaagggttagattataaagttagcatattacctaggcccaaaatcgaatatagtcaaaatttaaggatatcacattagagatggcatattttttcccactaattcaaatatacctagtttttttttccctagagagttgattttttttttttttttgtagttagagatttttaagaataagaaaggaagtgctagacctatctcacttggcaaagtatctcacactctagcagtcactccggagctgagaccttctaaggaaatggtgaatttacatcccttcctgtagttctagttgtcttgagggacaaggcaggctgggacactctatttgcatttttttttttttttcagacggagtcttactctgtcacccaggctagatcgcaatggcgccatctcagctcagtgtaacctctgcctcccacgttcaagcaattctcctgcctcagcctcccaagtagctgggattacaggtgtgtgccaccatgcccagctaatttttgtatttttagtagagatggggttttaccatattgaccaggctggtctcaaactcctgacctcaggtgatccgcctgtcttggcctcccaaagtgctgggattacagg

SEQ ID NO: 60369 - DNA, 1623 bp, Homo sapiens
ggagttggaggttgcactgagccgagactgtgccactgagtgacagagcaagactctgtctcaaaaaaaaaaaaaagagaataattttttgcccagtgtttccaaagccattgggaaaagtgacacttgctttgaaaccgtttcataaatattgttgagaaaatacaaaatattatttttctatattatcataatgctatatggtttttattcttatatttaatgatcaagaaataataatagaccaagttgttaccatggcaaaaatacaataatggaggactttgagctgtgatcagaagtattataattttctcttcattttgaaaatgtattcttcttaagcctcattttagccaccaaaacatctcaatgacagtttctgttaaatttccttctgcatttaaaagcattttctagaaagtatgttgaaaccaaatgtcaggcttttaatacattttcctacatgacaagtcttatcttcagtgaaacccaactttttgaaaagtaaagtaataaagtcaaataatgtgtgtgtgggtgagggagggagcagggagaagacttaggtgttaaaaagcaactaaaacacttttcacgtttaagccaaaacaagagcaaaaattcatcttgtggatattcagacaatttgcgacttgttctgtctggctgggaggtacaagagaaactaataataaatctttctgtatatttcacatttttagcttgagcatcagtactattctgctctcctttgtgctgaatcttatgtgctgcccaaagactgcttgcagaggtaatttgaataaacaggcatttattataagactgtcactattttttcataaaactgtggcataacacaaagcctcccacataaagcagagtgcaaagtaagtgctcaaaactaaatgtgttagtgtgtttattagaattctcatatcttttgttgcactttgatggaaggcttgtagaattagagttggctctggaggattttatatagataactgtaaaactgaaagtcataatgaaattcctgagaatgtgatggatttaaaattataacccttgtatgtaaaaggtaaatgtgatcttcactggagtcacagttggctttttatgccgttggccaatcttaaatatttattttcagacttcatttctgggcataaaccacaaatctgttcattcaactgagttttacggtgtaccagctatgccaggcactgttctgagcacacaaacatttttgcccttgtgccatttatgttctaatgggagaagatggaccaaaaccatatttataataaattagtaagaaatgataaaatcacttgtacagttgttagaaggcgataagtctatggaagaaagtaaagtggaatgggataaggggaatggagagttggggacacagacaggatagattttgaattgggagcttggtggccccattctgagcaaactctgaagtaaggcagtttctcatgcccccgtctacttagccacggaacactcagggatgattttattttgacctcttaattttattgcactcttgtcatagttttgaagtagagtgagatgagtattttagtcagtctatataagcgtagagta

SEQ ID NO: 60370 - DNA, 1078 bp, Homo sapiens
gcctgtaatcccagcactttgggaggccaaggcgggtggatctcctgaggtcaggagttcgagaccagcctggccaacatggagaaaccccatctctactaaaaatacaaaaattagctaggtgtggtggcaggcgtctgtagtcccagctactcaggaggctgaggcatgagaatcgcttgaacctgggaggcagaggctgcagtgagctgagattgcaccactgcactccagcctgagccacagaagtgagaccctgtctcaagaaaaaaaaaaaaaaaaaggaaagtaaaaacttaagtgaattttaaaggctcaattaggtaagcacattgaaattcaagatttagctgtgatttgctcatcagaaatttgtcaggtttttacttttggatgttatttcctgtggatgaagcatttatgttcttgttatatccattcctgtgccaaaagtttgtagagacttgacagcaagcctccctccatacagggaataattataaaggaatttatagttctacctgcttattctgtaattgcctctcatgaggcaagagctgtggaaacatgaaattagaatgctgtgaaatatcagcattctaacttttgttgttagagtagctcatgtatcatctttgttctaaaccagaagccgtgctaatactgggctacagtctgggccagcacacatccgtgacagagtaggtgctggggttggtttgggataactaaattctgcaattagaaagagacccttgtctgagaaccactgtgctcaagcacaaggggtagttgtaaagaccttggctacttctggtgtagtgtgttatgtctgtgataggaaggtggctgggttcagtgtctcatgcctataatcccagcacttttggaggctgaggtgggcggatcatttttgctcagggcttcaagaccaacctgggcaacatggcgaaaccttatctcttcaaaaaaaaaaaaaaaaaaaattgagccaggtgtggtggcacatgcctgtggtcccagctactcagggggctgaggtgggaagatggcttgagcctgggaggcagaggattca

SEQ ID NO: 60371 - DNA, 1076 bp, Homo sapiens
gaagagtaatttcttttgtaacattggtcagatttacagactgttttcctctggttaattcattatagaaaacttgttctaatcaattcacaaagcatcacttaccatgcatctcttttctaacatactttcttacaaataatttcctgaaaagtcactctttctctacttttcccttgctctggagtacttcatacattcttttaaaacaagatcagtttggggacttaatgtaagttaagaggggtttgccataaagttaaataaaaatgaaactgtccatttgttgttatttctttcaaatgttattatttacccacatctactcctaggtgttttttcctaatctgtttcttatttctgtctgtcctcctatgttgaagcaacactgatcttcaacaagttatctgcatgttttataaatccagtaaatattccatttattcaatattcaatcattttattaaagaatgtcatgcaaattaagtacagctatgtctaaatatactgccttaatatttttcctaaacattatatttatgcatagggaacacttagaggtattctttcagaagtgacacaggttctttcttgaatatgaaagaacgctgcataatctcagcatgtctggaatactacttggaaatatttttttctgacagaaagaaaccatttgtgtttggagaattttaagttgcacagactcaactgagaaaacatattaaaatttcaaatcagtttttctctctgttcagaaccatatttttatatacaattttacatatgcataactgtattttctcataattttgaaggtataagtaagagcttatttctttattagccggcttacaaaaaattaaattctcatatggtttcttctctctctctccatttttatggtgatgttctgtgctgtactttaaaaacgaattgtaagtggtatcaggaaaacttttaaagacctaagtaatatttttctttgaaaattgcaaattgatatcttttattaacttttgtggtttcattaggtactttgagtttctatttttatttttagcctgagatgagctgaa

SEQ ID NO: 60372 - DNA, 1043 bp, Homo sapiens
acaggcgcctgccaccatggccagctaatttttgtatttttagtagagacagggcttcaccattttggccaggctggtctcgaacttttggcctaagtgatccacctgccttagcctcccagagtgctgagattataggcgtgagtcaccactcccggccaatactgtatgcttctgatggaagtcagcatgaaagtgactatcagagctttggaaatgacaggacgaataactcaaattgaacaagggagtgctgtgggatctgctgtgtcaaggctgtgtggaggctagttcacacttcttgtggttgtgtaaaaaggtatacaggaatacacattctgcataaggaaaacttagtgtcagcatggaatttcacatgatagatttaaacatgtttttgtgggctggcttggaggcctattcaccaccacatttaattatatttctagagcatgtgtttgaagatctaagaaaaaaataagaattacgagcacactttttgtgtaaactctgcttgatttggagtggagggactggataatattcactgaagtgtagtttggaactttaggcctttggttaataatcattaaatgattggatgtgtgagtgtaataatgtatggctgaaggagacaggtaatttctagagagaggacaacgacttccatgattccttcacatcaaattgggaccttttgctgtctgcatcctgttttcttttgagtctagtgatcatttgcttctcattgagtctgtctattcacccttttgtgttgtctcagttatggacagtcaggtatattgagtacttttctgtgcttccagaaactcatgtcccacccttttgcaaagaggcaactgtagtcagaattcagagctggcattgtgagccacattgcttggactcaggttctggctgtgccaagaataagataataacttatattattatcataataatgtaacaatatacaattatatttatcttaatatatcatattatactatattatatcatataacaacataataatttataac

SEQ ID NO: 60373 - DNA, 1051 bp, Homo sapiens
cacccccttgtttagagaaagaatatgaaatagtagcaggaaggtttagactcttttacggtcaacattcatgagctggaatttaacttaaataaatgttcacagcaaaaattagaaggaatctattttctgaggtcaaggatggcagcagttcagtagccacattaatttaaaataatttcctttaacaaagtcaactgaaattctagtaagctgttccttttattggcagaactccattgaagtggtattttgtatataaatacactgaagccgaatgtgagtaaaaacagtttttggagacagttttagtaaagcatcatgccatgaaaatgatcagccagcagaaatcgggtctggccatacagcaacattgggagtgatcagaactcctaaaatagtaaaatgagaacaagaagcttactggaaaatatgccacttgtgcttctggaaatatgaattgcattttctctcatctaactcaagctgaaagaaatttagagtctttctggagtttatgaggaggtagaaaccagtgcctcaatgataactggacctatatttttaaattcagctaactttgttatggctgcctgtcatgataagaggcttttaattgatatagagtattagaaaatgagcaatttctgagttgcaattgcttttcagaacagaattcctatatttcttttgtcaaatttactgaaatttgtgtacttgcagcagtgacaattcttaagaaatggaagtgttgatatgtggcatttccctagcagtacatttaaagaccatgtttatttgttcatttctttattttttcataacagtgtaatttccaaggcatccttgtgctctaaataatagttgccctctggggatttattaggcatggtcttgggattataactgatgacgtttatgacttggtaatacaatcataaaaatatttttaagttgactgtgtggaagttggatagctatgggtttatttagattgagttgaccttttgatagcaggaataaaatatatttgaggtgtcatcatcatcct

SEQ ID NO: 60374 - DNA, 1021 bp, Homo sapiens
gatctgccatctgcaacgtggagaaccaggaaagctggtggcataactcagtctgagtctgaaggcctgagagccaagattatggggtggaagggaaagggctgcagtataagtaagtatcaaagcacaaaggcccaagaaccaggaagcctgatacctgagggcaggagaagatgggtgtcccagctcaataagagtgagggggaatttgcccttcctctgccttttggatctatttggactctcagtgagattggctgatgctgcccatgttggtgagagcagatcttctttcttgagtctaccaattcaaaggataatctctttcggaaacatccgtgcagacatacccagaaataatgtcttaccacctatctggacatctcttagctcagtcaaattaacacataaaattaaccatctcaagactgtttatttgtcatttgttgaacttagaactttggcctagtgctccacctgagctgttggggtcaggcttagcatattgttaagacaggcaaacattgtcaatacaagcctttgatgtaatagtatttccctttcaaatctgtattagaaaaacctttactttcactaatcactaaatatttttcattgtatctccaatgccaaacaacagaaagaacatcgaaaacaaagcagaaagacaatattcctctcccccagaaagagacacacacatagttttttttttttttttggagataggatttcattctgtcactcaggctggagtgcagtggtgcaatcatagctcactgcagccttgaactcctgggctcaaaggatcctccctcctcagcctcccaagtagctggtgctatagaggtgcacaccactatgctcagctaacataaaatttttttttggtagtgatggttctttctaagttgcccaggcttgtcccaggctcctggcctcaagcgatattcctgcctcggcctctgtgttgggtcgttctttgcattgccctagaggaatacttgcgactgggcaattt

SEQ ID NO: 60375 - DNA, 1033 bp, Homo sapiens
aaaggacatatgttggttttatattaatcattgaaccccattggatttgtaaaatgtgagacattttgatccttcataatctttttttcttgaaaactaggaatttttgtttttggttgtataaatcatcttttcttacatacaacatcctaatacttggccagttgtaagtctgtttttaaattctttatgtatagtgacgagtctgagatacttgagatagccaaaattgaaatgcaattttgtttatgattaagaactgaatctttaaaaattttcacagttttgcacaacaaaacaaaatagatttttttaactttctttttgaatgtataaataatgaccagtaaaaatgttactagaaagcatgctacttctagatccttaagtcactagcagataggatgtaaggatatagaatagtggtcagcaaacttggccctcattcatttctggaaatcaagttttatgggaacacagtcatactcatgtacctattgtttaggttgagaccatacggaccacaaagcctaaaatgtttactgtctggccctttacagagaatgtttgccaaaccttggcattagagaagcaattctcaacatttttgggcctcagatctatactcttaaaaattattgaaggctctaaagagttttgattatgtgggttatattggtttaattaatttaaaaataactattaaatttgcttcatgttaacacaaataacatttttatgaaaaataattttaccctcaaaacaaaaacatgagtgaattgcaaatttctttaattcctggctcaacaggagacctttatatttttgtatctgtgtctactttcattttgttgctgtatgttccggttgaaggatatgaagaaaaactgaacttacagagatctgtagttggaaaagggaggagtattttaatagcctattcagttaactgtggatatttgctgttacaccaaagatatatggcagtttcttaaagataagtttcagtgtaaaatctgaaagtatagaaata

SEQ ID NO: 60376 - DNA, 1044 bp, Homo sapiens
aaaaaaaaaagaaaaaggtgggccaggcggtggctcacgcctgttatctcagcactttgggtaggctgagggtggatcatttgaggtcaggagtttgacaccagcctagccaacatggtgaaaccccgtctctactaaaaatacaaaaactagtcaggcgtggtggcgggcacctgtaatctcagctactcgggaggctgaggcaggagaatcacttgaacctgggaggcagaggttgcagtgagctgagatagcaccattacactccagcctgggtgacagaaaagatgagttcctatcccttttctttacatttgttttttcaaagtatgtttgcactatgttagagtgagtgcatacatttagagaacaacaggggaaaatgctagaaattcagtaacttctagtttccattttataacaaatgtatttttattattagcttcctactggaatcctactccccaccattatgtcatcattttcacatccacggtctgtagcgattatgtccatgtggggcctcagtagttttccctttaattttgtgcagatttccttactgcataaactcaactgctctcactgaggtcgtcattaagtcctgtgtgtgtttgggcaggccgacttgatttacagccagcactccactgcgggtgagtaagatggcaagtttctccctgtttttcctctcagcccttcctatctagagtgcagataacataattactcagttaaatatcatctgcccaggttttcattttgagataaatctatattgtggttatctgcattatacttaaaacttacaccgaagataattctgttggataggttttaagtaattatcttcagtatttccttttcatttatgatatgaggcatagcaaatcttggattccttgatattaaaatagataagatcaagctgtgaactcaggatgagtcagtactgttttaagagttggatttgccatgcttttggcaaattagtacttcagagcaggagcccagaggtttcaggtaatcccagtcaccaaaatg

SEQ ID NO: 60377 - DNA, 1075 bp, Homo sapiens
atgatattatttccagttcgtgtcatgacatgaaacgctgaattgcgcttgttgctttttaatactgtgacatctcaactgctgtcattggttttaatctgtgggtgatcttggaaagggataggtttgatgtaggtagcctagaaccttctcagggattgtggaatatgttgaaacttatgctgtttctgagaactatctttctcctttctgtgggtcaggctgacataactcagagcacttgtaatcatgactgtagccaactgtggttacctgcagaggcttagatcaaataggaatttgtctcttcatttactcactcggcatacattgaatgagcatctctgtactgggcatgggggaagatgacttattatttgtcttggttcttaaggaatttatagtctaatggaggagaaagacacacagattctcatataaatggatggcgtacaatgatagattaaataggctttgagacttacagtggaactgtgggccatgattgccatttgaattttaaaaaattaatagaatgtatgatttttctgttcttagttatatacgtaagacttgaataaatactcattgtgaaataagaaaggtagaaagattatagcctaaaaacgagtccaattttatatcccatcctcctccctgtgccacttttcattattattattttttaaaaccattgcctgattgatgaacattttaggtcattacttttttttcctgtctaatgatgcttagtcagtttttttgcacatatatatatttgtttacctgtgtgaattatgtctgcagtgaaattcttagaagtagaatcttggctggagtatttttctgggggtgcatttaatctgttattggaattcatattaatattagaattaataggctttttttttttttttttccctgaaagcaactgaaaatgtatggcaatgtggagttgcagggcagtagtcctaatggtttagctacagcatctgcataggtcttttatatagaaagtgtctgggtagtggtgtttgaccttggtaacttttctctctgccatttgagccgctgc

SEQ ID NO: 60378 - DNA, 1047 bp, Homo sapiens
atatatccttttatctttttctaaatttacttttactatatatgaatatttccttaaggacctatacagtgttacatgttcattaacataaatgatacactgtgtgtttcattctgttacttgcttttaaaaatctatcattttgataatatctagccatgatgatatagagaccagatgacattttagttttttgtggtgtcttcaggtgttttctgtaagtacctggttgctcatgtaaatccatcagtacctctaacatttcctaaaaatctttgtttgtatgccttaaattgattaggaatttaaaaatggataccaccagtaagtcgaaagtctgatgtttggtggaaacttccatatgcaatttagcaggctgtctcaatattttgtgttccaaaaagatgctgcgaagataatgcagtgggtatggaatcgtttgcaaaggacttgagtaggtggcagggagtttttgacttgtactaacatacataggagtgctgttgctagggccactttgggaacttgttattgtgtgggaaagtgttatgctattaaaagctttatttttctttttttggtaacagtgttagttttctatattaaaacaatattctctttggtttaagaaatatgcatggatataaaattgttatttataatattaatctggccctgttcttctaaccaagctttggtctcattgccctggcagcctgttggacaatttcacgtggatagctcttcatgtcactcaaaagatcaaaaatggaaaaatacgtccactttttcatggattccttttctgtttagggtaccattattctttttgtatctaagatttggaaccgtggacttaccttcgaatcccaatacctctttaatttttcactttcagacctgctcttttcccctttgacattctcttgtgcgataatctcttgtattctaatctcatcactatcattctagtctaattatgctcacttctgacctagattactacagctgctgctttgctaagtatatatgcagccttcggtttac

SEQ ID NO: 60379 - DNA, 1546 bp, Homo sapiens
tttgcatttctaataagttctaaggccatgtgctacagccactgcaggggccagccactctagggggaaacgtaagtgtagtggttaacactttgaaagacctgggtttgaatctctgctctgctgctttctagtactttgactttaggcaagtttcttaacctctgttgttccgtctctaaagtggaaataatatagtattttgttgtgaatgtaagtgggctccaatgtgtagaagctcagggaacagggccttgcagattgcaagcatgcaataaatgttttcttttatccataaaaacagtacgtatataaaataaataggatcctgcatcttatacaattgaagcaaagacagaaaatttaatacttaacctcatttcctggcactgtgctggggaaaaaatatgattactcaattactttttaaggagtgaaggaaaagtttgtggatcctagtaattttccagaaacattttttagaggcatagcacattcatatcgatgctgcctcctccctcttccccttcaaaaagtttgcattctttaatcaccgtatgttggactctcacaataacccttatagtttacattttatataacaggtattttgaaggttgcttctgggagctgaatgacaggaagtacctgaaagtcatctttagaacacactgtcgcctgtactatgacaactttgtatttgatgaccttgaacgcagttcttctcgagacggagtcttgctctgtcccccaggctggagtgcagtggtgtgatctcagctcactgcaggttccacctcccggcttcacgccattctcctgcctcagcctccagtttaaaacatatttaaactggactacaggcacccggctaatttttttgtatttttagtagagacagggtttcactgtgttagccaggattgtctggatctcctgatctcatgatccgcccgcctcggcctcccaaagtgctggtattacaggcgtgagccaccacgcccagcccttgaacgcaattctttgggatctcatctctcggcttgctgaatgcctggttcattttctttctgcagacctgcgggatctcacctctggctatcctttcattagtgaaaccctctttccatcactttctgtcactatcactgtcttacttgttagctgttaacactctcttatcattatcttatttgtttcctttttattgtttccttcactaggacataaaccctatgagggtaagggcttgatcttttgctactcggtcgctaggatgggatgcagttcctggtatgtagagactgaatacctgctggttgggtgaagggacctgtgacgcggagctgccccgctccgctccctccccagctcaggggctcggactggagttagcactcacttcatggcacactgtcatgattggtccgtgtagagtctcccaccttattttattgtatctttccccttcatcacctatccccattcatgttcttccttgcccccaggggaccctctctctggcatatgcataattcccttaagt

SEQ ID NO: 60380 - DNA, 1053 bp, Homo sapiens
tctgttgtccaggctggagtgctgtggctcactgtgatctctgcctccctggttcaagtgattctcctgcctcagcctcttgagtagctgggactacaggcgcatgccaccacgcccagctatttttttttttttaatatttttgtagagatggggtttcactatgttggccaggctggtctcgaactcctgacctcaagtgatctgcctgccttggcctcccaaagtgctgggattacaggcgtgagccattgcacccagcctgaatgtaactgttctaatcatgaagttatctcttgttttgtggctaatacctctgtttcacatgtacattttaacatattcatgtaacatataaggcaactcttcttacacaaggctgtcactctagcccagcatttatttacttatttatgttttagtggctttatttaacttttactctcctgtcaaaatttctagcacccaagcaaaaatttccataaaggaacttttatcatctgttgattatacagaaaatgaatcatttattctcataagcccagccctcttgcattgtgggacactggaaagatattttggctgtttgtaaagtatttgcttgtattcttacctgaagctttgacttctccccctcccccaatggttttcagagtttctgtgacttttttctttaaattaattatgacactacctgacttccactagatggtgcactggggggcgcttactggagatttcaaacagatttttgtttttccttgttataaacatttcactgacaaagatacaaaggtactgcagctgtttctctcctaattgcaattcagacaaaattgtaatgaatgacttaagtcttgagttttggccaggcatggtggctcacgcctgtaatcccagcactttgggaggccgaggcgggcggatcacaaggtcaggagattgagaccatcctggctaacacggtgaaaccctgtctctactaaaaaatagaaaaaattagccgggcgtggtggtgggcgcctgtaatcccagctactcgggaggctgagg

SEQ ID NO: 60381 - DNA, 2011 bp, Homo sapiens
gtctgaatccaaaggaagttaaagattacgttattcaccaagttcatactgaaatcagagaatcgcagcggcttaagaaaactcgcatctggcgaatgaacctgcgtatccggggttctcctcagggaggttgctcgtccatgaaacacactccagtctgcagccacctgggagtgggaaccaagggcgagcgaaccgggcgggcaggggtggaacttgcggggactgcgggtatgaggaggagctacagagctgtcaccaatcagagcccagctttgttttctcttgccgaccaatgagggagttctgctggagaggcgtcttcaagtctgagacgcctatcgccttcgcagcctatcagcaggcccctcttacccgcgggcggtgcagccccgccccgcccctccaaccgcggtcccgcccctccgagggtgggggccgtgttggttactagccgggctggaggcgggggccgggctcccactgggctcgtgcgttctgcgcccgccgcggcggtgccgagcccgctggctcccgattgtcctctgcggcggtggcggtcgctgcctccttgcctccgggcccggggctgcaggggccagagcgagtgcgcctcctgcccgcggaccgcggcagcccagagcaggtaatggggcgcctctggggagcgcctgtcggagcccagggctaggctcgggcggtggggtcggcccccgaagctgctccctgcgccggcgaccgggccgagcggtgccgcggtcctccggagcctcctgccggcctctaggcgcctcagcctgggagcccgcggcgggcaccttgtgaggaggtgggggcggggccggggcaggggcggggccgcctcgggcgggaccctgaggacccctggagacccctgttgacgcgcgggactccgggcgggggcggcggcggggcagacccagagcggggagaaccgacaggtggaggaaaaactgcggagttgagtcagagtccggctccccggggaaaagaaccgactgaaagggagcgataagctggctggcttcttttttttctttccctaagccagaaaggcgtcttcacttgggtcgtgttaattacatgttttctgagaacaggcgtttggccgtgtaatctacacgatagcattatttatttacttatttgctatttaaaaaattaaaagcagcatttagcgtgaatctatttgggggctttttcttaagtgacaggtagacccagccgagtaactcagctttgtctgggctgaagtggggagcggtgaggtaggaatgagggggaggagtgttcgtgaggaatgcctgtgcaggtttgaaaggattgtgggggtgggaccttgtttctgtcactgtgccatgggtgggagtagaattgtgatttttttctttttctaatttttaaaagcaatattcacatttaaaaaagggggggctctctaaaaacagtctctgtactcgaggctttggggatgcacctgctagtcaggcagtaatagtttgcaggtaaatcctgggctattaattacgtaatttgatttacttataaagaagtatcttgaattgttgctgcctttcctttgacttgctcaatatattgcttgtttacaagtgaattgatgaaggtcactgagttttagcggtaatgtcacagcgatggcccttggagagttttctatgctcaggttcactctggttctataaaaacagtatttccatttaatcgtgaagctcatagcactctatcaattatatagtatgccatcctcctactcttctgaggcaggctgtgcatagcatgtccattttacaggtatgtcaactgaaagccctagaaatgaaaggaatcctgccccactttactcctactttattttatacctataatggatttaatccaaaatctgggtaagattcccgccatcaagccaacttctgcataccaatttgatcccgtatacacaggtcagaggtggagatggttattttca

SEQ ID NO: 60382 - DNA, 3251 bp, Homo sapiens
gttttcttttgactatcaaaaaatgattctaaatattctcagccaaatttttttattttttgcagaatcagtgtgcaaggtggtttataagataatggagtgggttttttttgtgtttagtgtgatttgttatcaggagtcttattgtaacgcttaagcattaggttttttgtctgagaaactttaaagagtaaagcagaattgaaagtggaaattttaattttgtaagttcataaaatttaatgataatacaccaaagtttatgtttaaattagggagtttaaggtttcaattctttctctctttttttgggggggtgatgttttacaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtggtgagtatctttcttgttgaaactttgacatacagttttaacaatagctctatataaaaggcggcagtagtatttctagcttgaagaagttactgttcagttatgtcattaaaatattttaatcctatcattttttttttactctgaacaagttactgtagaaacaagatgctgatgtgagcatctaaaaagtggactcttaaggccaggcgcggtggctcacgcctgtaatctcagcacttgggaggccgaggcgggcagatcacctgaggtcaggagttcaagaccagcctggccagcaggtgaaaacccatctctactaaaaatacaaaagttagttgggcatggtggtggtggcaggcgcctgtagtgccagctcttcaggaagctaaggtaggagaatcacttgaacctggttggtggaggttgcagtcagcctgagatggtgccactgcactccagcctgggtgctagagtgagactccattaaaaaaaaaaaaaaagcggactttagtgtttaataataagggaatgcatttatgaatatagtttaaaacatgctttcttaaggatgggaaaaatgcaggacttttttccaagaaaggaactttgaccttttaaagatttcagtttgagatccttattgttgcttcagtttgttactttttaaggtgttcaaatctgttttctaattacaatgataaactatgaatttaaaaactcattatgttttttcaggatagttcccagatttaaaaaattatttatgacttagaaaatacattcttgctttttgttgtaaacattttcagtattctccagttttggtgatgtgatttttatacctggttcattgaaatattctttttaaaagttagtctgatttcttttgcacagtcctgtaccttcaattataagtttgcctcaagctctttgtggtaggagtctgagaataagtaaacaaaaccaattctcagtaactattttcagacttaatttgcccgaattacatttcatgtcaaaagcatgcattaaggaacaaagcaatttcagtaaagacacctatattctctcctacatgttgcttaagtagataacatatcttaagcagatttacaatattaaaagcttccaaggaaactcagtaaagtaccatgtgactttttgcccctattggcagctagttcttcaatacttggcttactttaaaaaaaataccttgcatcttgccccttttgtccacctaggatagaaatcagctttattcagtgtgatcatatactgagaaacattggcttcctctacataattactggtttgagaaaatacagtcagaagattgcactgggattgaataatttggatgagaagaaagtagttctctattgaatgtagttatagcttagtgctatttatgcagataaaccacatttttgtaacagtagtagcaggtgtatttgattattaaagtgttacaagttattgggttgcaaaattaagcttttagagttatcagttttgtgggtaagttttccatagtattatgtaaagcctgagatggtactctctatcaaccactcttctatagtggatttcatttctaatgttagctcttggagagcaggtactggttgtactatactgtatttattttgaaaaatttggtgattgtaacaaaataggatatggcacctcatcttcttacaaataggctcttattttagtgactatgatccagtttatccccaaatgcaagaagtcagtttttcagttataaatgctttcaatcatttccagcaaaccttgctcagccaattcttttacaggtgaagtaatcccaagaacattctgttgcttattcattcaacaaacctggggcatctactgtgtgccaacatttgtgtgatactcctgggagtcaagatgtgatcctggccttgaagctattcttaaatgctttgactcttgagagctagtggtgttttagccacttactttttctgtacccattttttcttcactttgattttttcatttttctacctgtatgaactccaggtacttgttagcttttcgtttttaaaaatttgcatctttcctgatgtttctttagcttcatttgcaagaaacttgatgtttttctgatctaatcacttgctaagttaggccccactttccaattttctttctagctgattgtcgtcttctggagtcttccagctaatactgtgattccattcctgtctctaccatctctaacatacctggctgccatattcctttatattatatggaaataataatatgaggtatatctccattctggaattgagagtacatctttgatattctctcttcaaaaaacgtaaaatggtgatttttcctcattttatagtgagatatttagtcattataatttgttttctggtgtttattttttattgctaatgatgtgtttggcactaagatgttaaaagtgtatatgtatgatttttattgcaggcattataaactcctttggatttttatccaaaaatgaattcaggccgggtcagtggctcacgccggaatctcagcactttgggaggccgaggcaggcagatcacctgaggtcaggagtttgagaccagcctggccaacgtggtgaaaccctgtctctactacaaatacaaaagttagctggttgcggtggcgagtgcctgtaatcccaactactagggaggct

SEQ ID NO: 60383 - DNA, 1026 bp, Homo sapiens
tgtttcaagagaagtggaataagattgaaggagtagcagtcttaatgtttcaactcttcattgttttttttttaattttagaaaacagtgtctgtgatgtaagcatctgtgcatgtaaattgttaaatttgaacactagtaccaagtcatttgtcttacgcttctcataatcacattttaactttttatatttttagagagatggttattatgtattgtttataatttaatggtatttctattttacaatcagtattttggaatgagttcacttagatccttagatccttaagacagtcttaattgaactgttttctagttgtgcaggaagtatttaaaatttttggtgtaacatacttggggttttggtctgtaattcacagaaaatttatatattctaatttgtgtctattaagcatctgttaccttattctgttgtgcagaattgtttggggggtagtgcatcattttgttatgatgctggaaagagtgaagatggaaataagctgggcatttgggatgctataccaggcactagatataactcattgtcaatttgataattacaaaaccaatttttgtggggttgtgtgtgtgtgtgttttgttttttttttttttttttttttttttaagacagtctcactctgtacctaggctggagtgcagtggcacgatctcgatctcacctcattgcaacctccaccccctggcaaaatcagttatttggttatttggggcttgcaaatatattctatgaacagtccttttcaggatttgtatgatgctttataattttcaaagggtttctatattgtttctcatctgactccacagtagctctttgaaataggctgatcagtattattcctgttgtactgatgaaattataaagtatttagcctactgttgttgaaactggaaaggaagtctcttcacataaaattttatctctgccttcaaattatactccaagtataactaattctcactattttatcattttagttctggctaccaccttttc

SEQ ID NO: 60384 - DNA, 1045 bp, Homo sapiens
gattttttgtaaaattgtttcgcattgtgttccctttattcgcttgtattaatatttgcgtagtggattaaacaaatacttggtgttgactgtcagtcttagaggactgactagaagtagttttcatttggggctcaggaaatacctactttatatttctagctaattaggaaagtcatttttcagttaggttggtgttttggttcaggcactcgctagctagatgacctaacatgctacttaatttctgagtgtttgtgtccatccctgtaggattgttgcggggttaaatgaaattgtgtatatttgtaaagcatttacctcagtgcccagactgtgacagagtagattattaggcttgctcttatttctgtgattaaatttagtgtcagattagcaacctatagctacttctaaagctgctgctgctttctttgtttagggttaggaagaaacatgctggacagtttgccaaatgagagttacatgatgtggcttgtgggaacattctaacttggaacttgcccatttccaggactttgtggttcagagatttttggggatagatgtaagggttaaaaaaacagaaaacggccaggcgcggtggctcacgcctgtaatgccagcactttgggaggccaaggcgggcagatcacctgagctcaggagtttgagaccagcctgtgcaacatagtaaaaccctgtctctactaaaaatacaaaaattagctggggcgtggtggtgcatacctgtaatcccagctactcgagaggccgaagcaggagaatcgcttaaacccaggattgcaccactgcactccagcctgggtgacagagtgagactctgtctcaaaaaaaaaaaaaaaaaaaatggtagtgcaagtttagagtaatggttcccaaattaggctgcttattaggctcccctgagaagcttttaaagttacagcttccttgactccctccccattacccagaatcaaagcaatagttgatggagcctagaaaactgaatttttaggccgggcacagtgggtcatgcacg

SEQ ID NO: 60385 - DNA, 1061 bp, Homo sapiens
agataatacctacttaggtactacatttccaccataacacctcgtctctagcattaagctgtcctgagacacttcagtggtaaatttcatttagcttttatctcagttggaaaaatagcctttctccaagttagtagagtatacttaggctgatcttaggtgttaacaaaagatttcctaaagtttactcttaggagtatttgcattttaaaggaaatttagaatgtatgtggttgatatatttagatagtgttagtctttctgtgtaggctttaattacttctgactttgtatgacagtgccaaaagagcatgacctactattggcgtcttcctaaaggttctgacctgttctgtattcatagaactaatcttttctggtagctaaaaaagcaatgctagtgaattatgttacattggagtactttggttacgatgaagagaggatcatgatgaaatatttctgcatttaataatttgttctaacttcatagaattgtgtgcctgttgattgtgaaaagattcattgtaatggaagaaagctggagaagttggggtacagagtgacaagctgctagaagtactgttctctgctgccttcagccttttctgtggttattggggctggtttctgttctgctgcctgctggctccttgtcagtcttctaagcattcatatttaatatgcacggatacctgaatcgcagttatgatactttgatttttttttaaagaataatgagttaagtcccaaagtagtactttctaaaactaaaataattttatatttttgtgtaattatgagagttccttttttatatagctgttaaataaatgccagtgttaattattttggaaaaacagaatgaactctcccctttgagtttgaccaattttatttatttaaacatgtaaattttgtgaactttgctgctttgttcatattgcataggttttgatggaaagttgaagagttatctcgttttttattcaagcctaaatgtaatttcagttttgatttgtcttttttttttttaacccaaatctattaagggtatttta

SEQ ID NO: 60386 - DNA, 1271 bp, Homo sapiens
tgttatttaaaagggggtttagggtattctatctatataagtagaatactgtacagcaagatgaaatcaaaataagtagaagaacccatcagacttcttaggaaatatcctctatcataccacctacgttgttcttaagtaaccattgtacttaggtaattctctttgatcttttgtgacatcactagctttcttgagtctttgaatctgcatgtagtttccattataagcagacccttatctgagggtaaatcttggccattgccttttttcctgtcatactcttacttcgtccatgaacttttttagtgcctgctgcttacatgcaaagcagttagtcacctctcctacctttgacttctaatagaaaagacttccaaatccacatctacttaacaccttttcttctgaattcctagttctgtattaatcggaccattttcacttggatatctaaaaccttatagtcatcatctgtctcagttcacctttcctcttaccatttagttgtttctattgattgaaataatattcctaactcatttctgcttttatccaccctggttctaactgataattcctggaccactggagcatttaaattgctctttgcacttctagtttttgttcataatagtgtagcctccatgccactcctagatcacttactaaaaaaaataccagttggattatgttactttgttgctgaaaaatctagaattaaggaatgatattgaaatactaacattagacttctgtggtgaacctttttgtgtcattcatcaaagtgtttttgcaagtctggatttttataccctgctttttcttaaagcaagagaaacttttttctgtggtcactgacatatacagattttcataaaacttgagttactcttaagcaatttttagatagagttggacctgttaggaaaagagtcttgatgtcatctttatcatcttataagtgagcaccttccctgagactctttaacttcttgaaaaaagttgatgctgttttatttgaaaaatcgtcaagactattaaaaggcaaataggggaaactgttaagaaattgaaatacagttgcaaaaacatactgataacagtgacttttagttctgtatcatttgagttcttgtgccttttttctgtgcacattgtacttctatttttgtccagtaaaactttaagaaaacccagaagttgctacaaatgataaagataaggttttgtttctctcaaaaaggttgttatatgctgctgttccagga

SEQ ID NO: 60387 - DNA, 1134 bp, Homo sapiens
cttaaaggaattctgggacctgtggtagagacagaaaagtaaacaaatagtgcctgttaaagttgctttggagggtgctcaacacaggactcccagcttgggtgaggaagatagtaaagtataactaatgcttcccaacaggctgactaaaacttgggcagtaaaagagctctggacttcatagcatacaaaggaatagagcttgcaacgatgtagaagtgtaaaatagtgtagcacggttagagaactgccagaattttgacagtgtggaaaaatggcaggagctaaagttacagaggtaagtgggaggcatatcataagaagctctatgtcatgccaaggaatattaattatacatatataaggcagtggagaggtattgaaggatataatcagtaaaataacatcatatttgcaatttaaaaaattatctcgggtagcagtgtggaaatataggaaagaatgaacaatgagaaggctgacaaaggtgtaggttgagtccaactgattttgctttgagtatttgagtgatcatcatgtcttaattgacgttgaaagaccttcagattttatttttgtttcttgttgaagcagtgtggatagtacatttccatagaaaattgagacattaggataatatttggataaaaatagatagtattagtgtccatttagaaaattatactattggccaggcacggtggctcgctcctgtaatcctagcacttgggaggccaaggcgggtggatcacttgaggccaagatggtgaaaccccatctctactaaagatacaaaagttatcctggcatggtggcaagcacctgtaatcccagctacttgggaggctgaggcaggagaattacttgaacctgggaggcggaggttgcagtgagccaagatcaccccattgcattccagcctgggtgacagagcaagactgtctcaaaaaagaaaagaaaatcatgttaattgttttaacacagaatttaatatatgggattggttaagcagatactgaaaaaaaacaaaggaaccctcaggtaacacatacagtaatcaccactcaaggctattgaacaaccggatgaatttggggttttagaacccagtagcatagaggaggagccccacag

SEQ ID NO: 60388 - DNA, 1052 bp, Homo sapiens
cttaatagaaaaagacacttagaatttcataatttcgtatctgcttctgcattcaatctgttatgatacatccagtgttttgttgagcctctgggtaaacttcactgtatgcttgtggtaaaatgaggaagaaaaaaataatcatgttagtattattatgaaaatagttctggtcttgtgaaaggctgttggggttccccaaggtttcctggataacacttggagagctgctttagagcatatattggcaaccatcccaggccaaatctagaaaactttaaatgtttgcaggcctttcgtttaagtcctcaatattagttactctttttgtaaagttaagaaatttgacacctgctattgcacatcggcattgtaaaaattatcccataatttgaagggtttctttttccttaactccttgaggatggcagtggggtggagaaaataaagttattggtatgtgattgtatgctctaccctggaattctgttaagtgtaaggtatcagcttggactaatctagaatttgataggcaaaatcaatgtagtgtggtagaccggtgctcgggtttgtgaactttctgtcctggaggttgtgccagaatgttaatcacttaaatagaatgtttagttcagctgacttttttttttccttaaagcacaacttctgtgaaagaaacagtatgtttatatattcaaatgcaaactccttatttcctccaggataagttggcaaaccatcacttggaagagcactggcctagaccatactgacctctggtgtcctctgtccactagtctcaaatctcattctacctcttcagttcagtaattccacataaccacttggcaagcaaaccaagccttccagataacatccgtagaagggatcagttgcataataatttatgtatagggaggagtaggtggtagggaagaacttcctgaatttggccctttgtgattgggttcctaaagcttgattgtaggcttctggaagctagtgggattgaaaattaactctccactgctttttgaggtgtgagggcgcag

SEQ ID NO: 60389 - DNA, 2141 bp, Homo sapiens
ctgtttatgtttacatattttggttccttttctcactgagtaacagttaatacaggcaagattgttctcttttataccatatataattagtattgtgccttagaatttagaactgatgatttcatgccatcatctagtcgagagtgcattccccacccccatgttactggatttcaacaattaaaattgtggtgggagattttgtcatgctttctaaaatcaaggtgatgttaatttcacagttttctttctgtgcctaacaatctaatttttattctgcttaattttgatattttataaagttctgttgtctttgaagattttcataaactaaggtcttataaatacttacacagataattgcattctagttcagagtacctttatctcataagtgttttcctgtatgtgtgctttgatgttgttgatatttcatgtgattaaatagtattaacattttctaattgtaaaaaatatatttttaagccttatgattctgcagatgactggtctgagcatattagctcttctgggaaaaagtactactacaattgtcgaacagaagtttcacaatgggaaaaaccaaaagagtggcttgaaaggtaattagcttttaatctaattaaacattatttctctagcttggttctactggttaacatcttacagcattaaacattctaatttagcttttttatagtgctgcccatctacactttttagttgcggtggttggttgccccttcgtgttttccatagtttgtctttacttttaaaaacaaaaaacctggctgggtgcagtggctcatgcctgtaatcccagaactttgggaggccaagacgggaggatcacttgagcccaggagtttgaggccagccctggcaacatagtgagaccctgcctctacaaaaagttagctgtgagtggtagcatgcacttgtagtcctagctactaagaggctgaggtgggaggatggcttgagcctaagaggccaaagctgcagtgagccatcatggtgccactacactctagcctgagcaacagagcaagatgctatctcaaaaaaaaaaaaaaaaaaaaaaaatctaggatagataggcagctgtccacaaaggacttttgaatagtcagtatagttaataaaatacctacatttatgcatctttaattttgatggaaattttaatagtttaataaggccgtaatgtttctttcacatgtagaattaaaattgctgagctttggttatggcgttagtggtataacaattggtataattttgccattagtgagacatgttagtgttctgtttgctacgttccatctcacacaccagttaaattatgaccatgttcactccttttgttttctgtataccatttgttaggcatttggccagagctgtttagtatggaaactcatgcccttaatgtaatttttatatgtttatctttttttttatttttagagaacagagacaaaaagaagcaaacaagatggcagtcaacagcttcccaaaagatagggattacagaagagaggtgatgcaagcaacagccactagtgggtttgccagtggaagtaagtattaattttttttctttgaaatgtatgtttgacttattcgtatttatttttcaaatctgtatccattgccatctacatatgtaaattaaaataaatagaaacatacggagattcttttatgttggatttattataccctccaccattttggtccctgaaaagggaaaagatacacggtcgagtagtacaggtatgtgtttcccactacacattatggctataatggagttgaattgcaaacagtaaaattttgttttggattggtttcccctgatccccccagacaggagcttcctctcccaccctacctgcctgcccttaagttgtgtcctattaaactggacacaaatctcaccggcttttagtctaataattgaatcatagctacacacagtgacaccagaatagctacttgtttttttatgttaccagtgagtaacttgtttatccttgtatgtagaaactaatttcaccatgatcacagatctgtgtaacatctctagtttgaatttccacacaattttaaaatgtctactagaaaacttacacctt

SEQ ID NO: 60390 - DNA, 1091 bp, Homo sapiens
attaaaaatgagaccgaggttttcctctagacataaacaagttgcacccagcttgtgggttttttgagcaaattgcaggggaggggatgcacagaaaatgagtgacagatggctgggtgtgatggctcacacctgtaatcccaacactttgggaggctgaggcaggcggatcacgaagtcaagagatcgagcccatcctggccaacatggtgaaaccccgtctctactaaaatacaaaagttatctaggtgtggtggtgaatgcctgtaatcccagccactcggaaggctgagacaggataatcgcttgaacccaggaggtggaggttgctgtgacctgagattgcaccactgtactccagcctgggtgacagagcaagactctgtctccaaaaaaaagaaaaaagaaaatgagtgatgagtgatagataagtataaaaataactttttaacttgtttttcttcatgatttcaaaagtaggccatattcgtaaataggtaaagtttttaaattccatgaccctggaacattttggaatatatacttttttttctgtatgcatataaatgtgtatacaaattacatatgtatgtatttgaaaaatgggattctgtgttgctgttttttacctgttcttttattcagcaatgtgtcaggaatatgtttttatgtctgtttataattctgcagttgttatattgattgcgtaggtataccttcattgacaaataatcccctatcaatgaatacttgggaggttttcagccttttcctactgtaaacaagattatgatttcatatctgcccacttctctgattactgccttcagttaaattcctagataggcaaatgatgagtcattgtgtctgtgcttgtgttgaaatgtagtcatgtatcacactttttttttagtttaggtgatgtttgaggaagaaccttagctgtgttgttgcttttttaaaaaattggtcaacttagtaataaagtgaataagccattcaagtatttaacttagtctatccaaaacatattggcagagtgttaccttgtgtttcggtgtattggtgtttgtgtagagtatggcttaaag

SEQ ID NO: 60391 - DNA, 2992 bp, Homo sapiens
atcccagccacgtgggaggctgaggcaggcagaggtttcagtgaggcgagattcatgccattgcactccagtgagactctctcaaaaaaaaaaaaataaaatattttatcaaatgttaatattctccacaacttgatactgaaaattatatggataaaatttttaatttgcgtttaactgctactaatttttatttttgcaaacctgtgctttatatgttgatggctctatgtttagagaaaccttacttagggtttctcaacagaagcactaatgacactttgggtgaagtaattgttatggaaggctttcctgttttgtaggttgttgagcaccataactggcctctcctcactagatgccagtagcatacctcccctctctccagtcaggacaagcaaagcaccaccctctgggagggtgacaaacaggcactgctttaactgtgtttatctagagttgtaagtatagaaagctgttacagctatagcgtcccctgttcctgtaatgctgctgccctttttgtttttttaattcaaaaatgttagaagtatcatccttaattttcattggagtacatacgcttgatacattttgactagcgatatagaactgaaaggaagttttcttggttgaggaaataaaaattgtatacagggttgggcatgatattattcctgctatgtctgtctctaaaggtttctgtcttagttgtacctcattgcaggtagaaactgtagaataaaactttttaaattttatgttcatgcaagttgatagcttacttatatattactatcatacaacagatgtttgtattctgttcatttttgtagatttttatattgtatcatttataacacggaattttatgtagtaagtcattgtcagaagacctcgtgctttgatgtgattgactttttgggtggtattccggtaccttttgttgtggtgtaccatgtagtggttgtgtactgacagctttgaaactgacttctagtttgaatgttcctccttcgttgttttgtcttggtctttacaattggaggagctgtgaattgaaaaaaactatacaataatcaacagagagggcatcctttagtaaaattattgtacatcacatgcttggattttaggtcgtttctctccttggaggttattttaattctttagttattgttgggaatattgtaatttagattggacactttgaatgaacttcaacatgatagttgaaattttcgttctttttgtactgttttgtggaatcatggtgttagaatttaaattgatagattttgaactgttttcagtatttctgagcttaaagtatttttgtggctttaaattgaaagaggatttgtttttaatacacctagtgataagtagattgttctgactatgctgcgggtgttggacttctattttcagatagcattatgcatcatgattttattaactctctggtatttgtaacattaaaaatactacagattggtttacttactgtgttcacagttcatcataacttcagtcatcttaaaatgatttcatttaagccttcttataaactgctttagaggcaactaattgtagcttagtattcagaaagaccaggctaataaagcctaatattcctttgcagttgaaccactgtgaataattcagttattaaaatctgtgacctgtagtgtaaaagaacgaagcatttactttttctgcctttaaaacattttttaaaattttataagatattataactccatatgttgattttttttttttgtgttttgtttgaactacagtgtgattctaaggaatccttaaaaaatgtgtagcacccttgaaatatgagtatagatgaatatttatagttgagcaaaaactcctcctcttccagtattgcatatttacatgctagtggtaaaactgcagacactaactgggtttgcagttttataaaagaatatgtaagtacaagtatgttgctaaattagctgatgttaaaggtaggattctaatgtaatcttttttcttcccccttctgtcattccaacatctgttttttcgaactgtgaactaaagtggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaaggtatgccattattactagatgctgcacgttgaactatagtttctaagtttcttctaagtttcttatatattacattatttcctttggctctgaattataaatttttaaaaaagtcttttagaatgtttctgtgtagagttaggtgtagagttagcaatatttagcttttttctttaatttataattatccagcctcagaactgtttcttgcctctgaattttaagtcaagtgcttaatttataacaataatggtttaagtaatttgttaaagtcaagtaactgtctcttcaattttctgtttttgtgatcattgtcttgacagtttagtttataaatcgtctcagttttctcttaatacttaatataaatagaggtattttaaaactaatgtctgtataacatttcattattggtttcagtttgtgattagaaaattaagttgtgggccataagataaggcgtgttaatgtctgaattggaccttaagtctgaagagtggaagttaaacgttgcaacccaaattgcgtttatccaactcagtgtcaataatcatagcatgtttaaaaagttacagaaaaatttaagaacaactacttg

SEQ ID NO: 60392 - DNA, 1046 bp, Homo sapiens
tagctgagctgtgtctaaagatgtcagtggttgatgctgtgtataagagcagagtctttgtctttcttaaccactgctctattcctagtgcttgacagataataggcagtgtgtaaatatttgttgtagatgcctatacaacagtgtgtaaatgttggatggatgcctatactacatgtgtgtaatggatgttgtataggcatccatgttctatgtgttaaaatatttgttgtagatggatgctacaagaacaggtgttgagagttgggagcacttgcactggtcatggtttttaaaaaagtatttggagaaaaagaagtttgtgtatgtgttgtgcatctgattaaagcataccagcaatggatttagatctgtttgatgccagtgtgtcatttgagagaaagaacctaaggtgaattcaagttttgtgcctgcatgagtagtcagaacggtagagaaagctgcagagctcttttatttttgcagagaacagtcttgatgttaggtagagtgaaacaagggagtgaggtgaccccatttaggtctatagttgtttgttagggtaacatttgaacatctatgtatgatcactttattggaccaccatacaacaagtagagaaagtctgatacaccaaaaaaatacaaaattgaattttatcagttggcacccaaatggccattttaaacctgctctaactctgccatcccttctagattggtgaaatgacaaaataggaaacgtgggtccttattgtttgctatgaccaagttgtcaggagagtttaatatccttattcagtaagttctctatttagtgatttagaattatgatttattagcagagataaatttgaaaacaaaacaaagtagccatagaattagacctatttagtaatctcaagctagctctccgtatgaacatgtgtaaataatcacatactcacatgctggtgccatatgtaaagggcaggacagactagtcgttttaatatgaggtgtgagtcagtcacttgaagtaaaatttccttctgtttttatgctatc

SEQ ID NO: 60393 - DNA, 2779 bp, Homo sapiens
tgagggtgtgtacctaaaggggaattactgggtcatgtagtgttcgtatcttcaacttttctaaataatgccaaattactttccagtgtggttatatcaatttattatccatcagaaatgttgagtaaatgttctcattactctttgccaacatttggtatgtctgactttaaaatttttgcattatggtgagtgtaaagggttatgttgctttattttacattgtcctgattctgaatgaagttgagcatcttttcttgaatttcctaggcattcaagttccttctttgaaataatgtcttctgtacatttttctattgggcagtttgtctattttgacgtatagaaattctttaaatagtctgattaccactactttgaatataattgttctgctttttgtaactttacacatctgcttggtgttatggatacctttctgtgttttcctctaagagttttaaagacttaaatacctacacaaaagttcagtctacctttaactggctttgttttaaatgtaagtttttatatttggcagggcatgtcctgctggcagtgttctttttcttcaggttatggaatcttcaggatttatgttactagcttgtcaaatagtattaacagtgctcttggggctttgattacagttacattaaatctatataaataattgaaacaacagctttcaaataattttccatgcgtattttatacatcctttatttctaaatactatgaggtgggttgtttttaatattaaagtgtcctttttaataatcttaaaatgaaacaaatagctcattgccttatatattgaattacaaaagggaagtatgtagttacaaaactcagttattaagtataaaagtctcttctcatcacatctttagcccattttgggtgtaaccaccttggtgtacctaccctgatttgtattaagaccagtgtcttattgaggtaggttgttactgtggccataaacatttttcaccttatttcatgagatataaattaaatcctgtagaattatattgtccttttatcctaatggaagcttatttgaatgtgtggttaataaataattatctttgagatagcattggtggtagacagattggtacttttcaaatcagatatgggtatgatttaccaggttttatggcttcaggttatctaacctttcttgttcagctttcttacctatgaaatagggtgagaaatgtctaaatcattattctagtcatgtgaatgtttactgagcatcttctgtgtgctccagtgtgtaagggttaaatgagattacttacgttaggtgcctggcacatgagaggtgttcctttgatgtttgttccaattttctctattcaggtaatttttcaggctgattatctttttatttagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaaggtaaatcttcataacagttttttaaaaatttatttgcattgtgcaaagttatgtaagtagtaaaatccccagtttaggaatggtctttgttttcttttgaaatttatagttgaacacttttttttgttttgttttttgtttttggagtttggaaatttatatccactgtagtttaagaccattggtagtataattgagttagtggtgcttggatcttgtgtatatttttcaatacttgttatgtgtctggtagttactggaggtaagccattctatatacataatgtgtatggtgaaattttacattaaaacaatcgagcgtttgttgaaatcggtattaaaacttctggtatgtttctaaaaaacctgtataaataattactcagaatatttaaaatatgctaattactagaaaagtaggaattcaggtagctacttaaaatactttcaaaaaattctgagaagggaggagataggtactagataaaatgttgccatttttttcctggtgaattgcattatttaattccagccttgcttttcagtaatgctacttacgtttcagaatatttagtcagccactttgaaaaagtatgaataaaagtagatgtgttaatttggaaactattcagattcacacgttaattcctaaaagcactgcaaaattttctgttgaaaatgataaatttttaggccgaggcgggtggatcacctgaggtcaggagtttgaaaccagcctgaccaagatggtgaaacgctatctctaataaaaatacaaaagttaaccaggcgtgatggcacatgcctgtgaatcccagctactcgggaggctgaggtacgagaatcgcttgaacccaggagacggaggttgcagtgagctgagatggtgcctgtacactccaacctggctgacagagcaagaccccatctcaaaataaataaaaataaagtgatcaatttttatgtacattttcacataatatacttaaaagtagtgttaagtggttaagttcttatcctaaaaataaagctatctcaggctagttggtcattagtctgttcttactgtccttaatttttttgtatttttattttattctctaaccacgcagttctcttgtgtggtagg

SEQ ID NO: 60394 - DNA, 2089 bp, Homo sapiens
gatttattagggtggatcttgatataggatttgaatggccagcttgtctaaaagggcaatcacatgaaatagcagttgtttatccagttaattccatataacatactgaacactcacatatgaataggtttctgacataattggaagttcctgtgaacactcgttaaattttgtagagagactttgttcaggtgatcatcttaattagtgtaaaagaaactctgttggtttacctttattgtaaacccattaagtttctttttctctgcctcagatcatttcaaatttgggacccattgtattactcctatctagtaggcttttattttgagagttctaggttgaaatattccagtttcttgtgagttctcttccttgtcaggttgttactaatgccacataagcctcttgtttttatatgaatgtatgaaataatatgtttttagttcttacagcagctgtgacacaagcctcactgcagtctataattcataagtttcttactgctggaccatctgctttcaacataacgtctctgatttctcaagctgctcagctctctacacaaggtattcttactcatcttagatatctctagaatggcatcttgattttgttttggaattaatagcccttttttgtatttagttttttctttcatttttttttttagttttttaagagattagctacaataattttgttttttttgtaacactggcatatacagtagtatttttatttcctttctttttagatgaagcaagctttgacatttgtcttaaggtattgccatcaaatctgtaattatttaagacagtatttaattcagactttgttattaatgagtttttttatgccaaagctgaaagtaaactatgatgtgccatatatctttgtgaaacattgcatgtatttgaagagttgaagtttggttcagattgacgttagatgttttttgactggataatatggaaatgctcattttctgccttgaattagatatccctcttcatgaaggtatccaaatggagagagatacacataggagcaaatgggaagtgaaagggtcactttgtcagaaagctgataaacagcaggaatgccttgtctggaatggaagtataatggtgcaaagactcttgcaaccctctggctagcctcatgagcaggagactgcgtgggatacctgggcctaaatgtagaataagaaagaagaaataaggatggtgaggaggccttccatgtgagattaggttcaggcctagcttcctgttccagccacataaaggagagtgggccacactgggtgtgcttacctctgaacacacagctcacttagtcagtgtggcccagtgagaaggtcagattctgatttattccaataagtgttctctgggtaatatgggggtgggggggtttagagtaatacaaatatctttgccacatatattacaaaggactttagttttttgttttgttttgtttttctttaaaattaattgcttccctcttttacagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggtatgtcacctttgagggacattcggaaaagaaactacttacttttggaaagtcaataacattttagaatctgttatagaaaaagccctctgagaatgaggtgtagtggtggaatgaatgacaggtatgatagtagatgcagcctagaatttctcagttcactgagggatagaggggggctttgaatctgtgctactttaataaaccatctgagtctgttccctaatggttttgggatttgtcacatggagagtgagataaagaggatatactgagtcttaatatttgtagaattttcaaactccaaaagacatgaatgaacatgttttccagtgacttttccatatttgtatttcaaaaatgaggcagtttctgtgctaagaacttaatgtatgtttagctttcacatcgtgagaatc

SEQ ID NO: 60395 - DNA, 1089 bp, Homo sapiens
atgtttcaagacgattacctagattttggggggagagatgtggattagatttggagaccatctcaccagattttgacatttcaggttagtactccagtagttaagcaaggaccagtgtcacagtcagccacacagcagcctgtaactgctgacaagcagcaaggtcatgaacctgtctctcctcgaagtcttcagcgctcaaggtaggttgatattgtatattgagaccacattgttttatttaatgatggtacactgcattgtttgaatattatatctgtaaaatagaacttaacctttaaactccatgaataccctaaagtaggcttacatgttgtaaaatttacaaagacaaacctgtatacaagaggtaggttattgtctctagtagtgaagcccgggttattttgaagaaagtggctctttaaaattttacacagtggaatatgacggggctaaagatttgtgatacttgtaccagaaaggcacacgattttacaatatttgttggaattaccttactttttaacctcctcatagcagttttggtttgagtatattgatgaaagccaaagtctggtatctaaaacttgggccaatgtttcccaactggtatatgtcaggctttcccaatagcttaactgtgaccctatacggatggctttttagatagttctatactgctgtattgtgttagcacttttctttgttcattaacaacacaactttaaatgacatttgttgaatgaatggttttcatttgattgattttcctgttttttatttcatgctatgaggtagcaaaataattcaactgttgtttttattgttgttttctaaacaagcatttcagaacttacacctccaaatgagagttgttcccttcaaaataatgaccttgggaagctgtctacttactccagcaatgttgccattgctctgaacatttttgggaaattcttcttttaaattgtttttagaggctgcagtattattttaaatatcctcagtgatgaaaactcttcatcctttgggagatttagtttttggaaataactgaaattcattcagagccaagtctggtgaagc

SEQ ID NO: 60396 - DNA, 2806 bp, Homo sapiens
tgcctattacagaattgaggacaaacttggcaatggctttatgtcctgtctgtgcaagtcacagagttacaggtcgattgaatcttgtcaagaaaccataaatatttagtaaataccaaatggagtttatagtacaacttgaaaaagtaagtttatttacagttactaaaatatctggaggtactctctgagtaacaacttgggttcttatagtcagattgctctgaaagtagttctaacaaacttcattttggcttgttacatcattcgacttttgggaaattattcattattgcatcttaggaaaacagtatatacagtcaaatatcaagccagcctgattatgcctaattcatgtgtacaggcaataaatattatagttcccagaagagaagagtaaaaacaggaaatatttttacgttcatgggaatctgggtaactggggtttgtgtgtttcaacttttggtttttggcttcatttttatgtacctacatctacattgagaattgctcttctaaatgattaatctcttacacctggttaattctactctttactgtatagtgggccagaaaacatgcagtataggtttatttcatgtataatagctactgctttctttattgtgatgatacggtttataaagtaatacattttaagttgttagagccaaaggaattattaagaaattgttagaaaaggctgggcgcggtggctaacgcctgtaatcccagcactttgggaggccaaggtgggcggatcacctgaggtcaggagttcaagaccagcctggccaacatggcaaaaccctgtctctactaaaaatataaaaattagccgggcgtaaggacaggtgcctgtaatcccagctactcaggaggctgaggcagggagaattgcttgaacccgggaggcggagattgcagtgagtcaagattgcacccctgccctctagcctgggcaacagagcaagactctgtctcaaaaaataaaataaaataaaaagttgtttgaaaactaaaacatcctttcatcatccttatactttaatagatattatgtattaaatgtttactttgtcttaactgtaaaccaatttatagttaaataattttttaaatttctttgccttaattagaaatcacttgttttaatttaaaaaattttaattataaaagctcgggttttctgtaatatttgtatatgtacacaggttctaatgtctgcttttttttttcaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaattgggggggttaatttatcattcagaaatcttgcattttcaaaaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgttaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaacaaaaattgttatttttcttttccttcggtcagtgcacattagcatttgaactacctggggattctttatcagaactgttcttgttgaatatttatacttaattgaaataattccttaagggaggttttgtttaaaacgtattaacaggaaattgtgtatgagatatttaatgaaataagaaattcaacaagaatgattaagtcacttcccaagtggttgtcatttgttaaaccctggtttacctgtcttgctattatgacatttcatttggaaggatgtttgtgttgtagctaactgttcaagtctggtgctgactgctgttcttagccatcacaaaacgctaaatttgtgtaattggagcttcctgctgttatctggaaatagcaggaaagcgcagctttgtatattgtttcctaaagtatattaaaataaaaaaagaaactattgctactataaaattaccttgactttttttttcctttgctgaaatattagtcacatagccttagcttcacactgccagtaatgtatcaaatcacaagggtttccgcatgaaaaaaatc

SEQ ID NO: 60397 - DNA, 1711 bp, Homo sapiens
tagtgaatttttttttttcttgagacagagtttcactcttgttgcccaggctggagtgcaatggcacgatctcggctcaccgcaacctctgcctcctgggttcaagcgattctcctgcctcggcgttccgagtagctgggattacaggcatgcaccaccacgcctggctaattttgtatttttagtagagatggggtttctccatgttggtcaggctggtcttgaactgccaacttcaggtgatctgcctgccttggcctcccaaagtgctgggattacaggcgtgagccaccgctcctggccagtagtgaatttttaaacacagaaaatctaaaattttgtggaaatattttaaatattgcaccttaatacaaggtatccagctcctaaccttaactagggaatatctattaaaataagcataatgttctggactagagtattccttatctagttggttatggatttgaacatgtaccttggtttagatactttgaaaatagaagtactgaatagcctctagggaacttgagtggcctttccctccccctgcccccccccccccccccccgttttaaaagatcagtagtctctattcaaacttttaaaatgtcgtggtattgtaacaatatatttgatgaaagaaggttacagactcccctgaagaaccagctttcctacgctttttatttttctaacttgtctaacctgattttaaaatgactgcaattccagactaaaaacatgcttcagccctgtttcaagacattatgcttcttttaacagtccaaattagtagttttatttttcttctaaatctttgtttcacacttgtaaaatcttgggaaggaggttcttaaaactttgccaggaattgttacccatttccaaaaacagtttattatgttcaaaaaccaccatatctttgagggactgtttgaaaggggagagggcaacgcgggaaataattcactctgcgcaccggaactattgtagttcaggacttccagctactgtatttagatgttgggtttgaatatacagatttcttttcaatacctgtaaatatggctatattcttgtatttgtacgggagtgtacaaaatgacactgaaaagtaataaatatgttttgactatattgtgcagttatttcagaactgtgttttgaaagtcttagaatgcataatttgcatttgagtaaggaaatttaaaatacagattactgctgagattttaatcagtcggtgtgtttcaatagtctctgaaacattttagtgaaaattatgacgtaaaattgggattctttaggtcctgctctaatttgcggtaccctccttttcctgatcacgacctttgatagtgccctaaagtgcagcctgtctagaagatctcatccaggctcttggctctaaaaaccccttcatgtgctactttacatcccgattatctccagccctgatctctttgagttcccaaaaacagtccacttagatgctttccttaacacggcatgcactccaaaaagaactcacggtttgtgcctcagattattctcttttagttttttagtaattgacaccatcattgttaaagttgcccaaaacccaaatcaagtcatccttcttttctaacactcgatatttaatccatcaagacccacaagctctttgaaaatgtttccttaatgttcacctctctagtccaatcca

SEQ ID NO: 60398 - DNA, 1207 bp, Homo sapiens
cggggcgtcaatggatcgccactccagctacatcttcatctggctgcagctggagctctgcgccatggccgtgctgctcaccaaaggtgggtgccgggggcgcacggggcccggggtcccgtcctcgccgcggggctttggagccggctgcagaggctttgttagcggcaggcgaggctccctcctgcgccggagccgcaggtcgcgacaagttgctgtgttcttagaagtcgcggcggtggcctggcgcgtggatgcggactccgatctaagggcaggcgctgatcagagggtcctcctggctctgcctgcggggagcggcgcgtttgcagcccagcggggagcggggccggagtctcggcctcgacgccgccgcttccgcaccctgggggctcgggcggccgggaggaatcgcagatcctggcctgtagctgccgcgtgccctcagcgtgtctgtgtgagtgcctcagggtgtatttctgtgagtgtgtctctgagtctcagtatccctaaatgcatttttgtgtctctgagtgtcgttgtgtttctgaaagtgtgtctgaacctctgtatcactcagcgtatctctgtgtctctttgaatgtatctctgaatgcatttctgtgtctctttctgagtctttgtgtctctgaatgtgtgagtctctgtatctctgatcttgagtgtgtctttctgaatgcatttctgtgtctgtctctaagtgtctttgtatctctgaatgtgcatctgagtctctgtgtgagtgtgtctctgcgtacatctctctgtgtgcgagcgagtgtgtgggtctccctgagagtttaggtgtccgaggtgtgcagaagtgtgtgttgtgttgcttttcagcagccgggaggagtaggctctgtcagcgtctcactgccactcacctcatattttacaaacaggaccaaaaaaaaaaaaaaggcagcgggtcagtttcttctttcctctgcaggctttcaccttttagaaagaaataacccgaactgtctccgaatttcaaggttctcctcacctccctgctgtgaaatctacctactgttctgtgaacagataatttttttaagtaggaagcagtttagtctttgcagccccctacttctctttaattgctatgtagcaggcatgaggttaaagcataagctagcccagcgaggatgatgtgctacagtatttatttatt

SEQ ID NO: 60399 - DNA, 1423 bp, Homo sapiens
tttcctgcagtgtttccagggggggatggtggtgcactcggggaggcgggaagaggaagaagaaaatgtgcaaagtaagtcacttttactgctggaattcgactttgcctttccctctcttggaaagaatttttataagctgggggctgaaagtgagtctgtcttcatctagctgtggctcgacctctgaaagcctcctgatgtttgcctgataactcagctctatgggtgctcatgacccgcctctccctggagaatttactcggggattcacctttgcacgcaggaggctggaaggtggtctcccctcctctgtctgctgtttttaggaagaaagaaaaatcagtggctcttctatgataaattatgaaattttgtgttgaccagcaccccaccccccaaaaaaatcttagctctagagccttttaaaatatgcctgttatagaacttgttgtataaatcttgggaaaatggcttttctacattgtggacttcagatcacctgcttctaactatgtaagaacccactttttaggctggcaggaaggcctgatgcctcagtgctccacagggctccctgtgcagtgcctcagcccctccagtcccctaagtccctggccctggacggaggtggctgccttggacgacacagcggacactaggaagggccgcgtttgctgccactcgctcacgtgctaactcctccgcgccgccggtgccccctgcaggtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacagtgagtgttgtgtctgcggcgagtccccccacacaccgggcttcccagagggacggggcaggctcaggggtaccaagactcccagcagatcccagggtgctgaaagtgactgcagcaaaggatggctgggaacgtggtcaggggcctctgacattccgagcagagaggacacacatctcagtccagacctccgacttgggggccgctctgaggatttatctggctgggtgagaggctggtgaggagccagggagtgactcttggaagcactctgggttctttcttcatagttgccgttcagcttttggatgagaagcctgggggcctttgatatttaaagggagcacatttcaaatttgtggagttttcgtttgccagaacagcagagtgttaaaaagctaaagaagagtgtgggaaaccgccatctgtgtcagacgataagatatcccccattctggagagcagcccccgatggagagggatcgga

SEQ ID NO: 60400 - DNA, 1011 bp, Homo sapiens
ttacaaccccatggccttatcatcccagggcctgcatcgtgcctgggagggactgctgcccagatccaaggccacctaaagctactggcctcacaaccccatggccttataaccccagggcctgcatcatgcttggcagggactgctgcccagatccaaggcttgcaaacctgtctctttaacattcagatgagctctgcctgagtctcctctgctctgtagagtaccagcaattaagagttaacttgctgagtagcagcaattaagaattaactctgggattctttgaaaacaggacaatgccatgtgcaaatctctttattctcctggatgaatgattaacgatagcaggagggaagacagcagagacattcttgccagaaatagatccacactcacccagccttccacagttccaagaaccaatcacatttcctaaaacaatattttctactatggactatattttagaaatggtactggcaagagttgcattttaatttattcctaatagccatttcaactacccctttatttttttgtaaaggccatgaatgaatatgcttttatcatgccttcaaaatcatcctcagagttttgagtcttaatctctctcatttgagcattttacctgttaccaatccagtggatggaaaatcattttatttttatttgtatcatttttttgagacaggggtctcactctgtcacccaggctggagtgcagtggcactatcaccactcactgcagccttgacctcccaggctcaatcagtcctccttcctcagcctcctgggtagctgggacttcaggcatgcaccactacaggcatgagccatggtccagctctggaaaatcattttagatatgaaatactgccacaaaatggcaattggttatgcaaaatgggcacagagattgataactcacagtgagaaatgctttctctcagtgctccctgactaccagctccaggaaacatttcctctttaaggaaaggtgtcctagag

SEQ ID NO: 60401 - DNA, 1024 bp, Homo sapiens
gctggtcttgaaatcctgacctcaaacagtcctcccagagtgttgggattacaggcatgagccattcacctggcctcaccaaatattttgaagaaattactctgttgcacacttggagtgatctgccaccccctccagatgacagatctttttctcagggcaccaagagggcccctcagatcccttttctccctgtgggaagttctgggtcaggagctggaaggaaggtggtttttctcttctcctgggcgtgaccagccttccctccaggtgccaacggtttctcccctgccctaggtccgaggctctttgccactggtccttgcaggcccggggaaagtgagccagacatttgcttctcctcgggtgtctcagctgctgacctgtccctctgccattctgtgtttgcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtgagtcctggggagctctgcaccccggggactgagaggagcatcctctcctgggagccgatggcactcggcctggtccctcccaacatgattctgataatggaagaccacgtcacccaaagcacttcagtcctggtctggcttctgcaggtctcaggctgtgcctcccatttctttcctcctcccactttttgtaagatgatcctggagaaaatgttgtatctgcaaataggaaatccacatgacaagtgcagatggccaatgggtggctttgaaaggtttccacctaaccaatcaaggcactgtaagtaaaacaaagagatgccatcatccacttctcacagtggtagtgattttttaaagaatggatccagggccagctggcaaggcctcggtaggatgaggatgctatgttttgggtgagaagtgtaacttgaacagccatcctgaaattttgtcac

SEQ ID NO: 60402 - DNA, 1068 bp, Homo sapiens
tttttcagattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgatttctacccggaacagaatagacacgagacagaggagaatgaacgctcgctatcaaactcagccagtcacactgggagaggtggagcaggtgggtgtgctatagtccgattgcagtttgtgtgtgtgtgttcttaaattatagcactgcagtattcctctgaggtcaatgatgtaattaaggtgctctaccaggaaactgctacctgtaggtgatttggtaatagctttcttcctaaaaatgagaattctaccaagtatgttgctctttttttgttttcataccttgcttgctgaaatatctagaatgagtccattttggagagaaaaaaatagtatgcccaactgtgtttcacccagaggattttgtttaatgagacgtattatataactatgtccaggaatggttttccactaagagaaacagtgaaactgcatcaaatcgagtatttcagcttctgtcaattcataaaccaggatttatatagatgatatttttcaagcagctttttaatttttaactgtgtccttccaggtgcagagtggaaagctcattcctttctcacctgccgtgaacacatcagtgtctaccgtagcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagac

SEQ ID NO: 60403 - DNA, 1671 bp, Homo sapiens
ttcaaagtgagcctgtgtcccaagacgccaaaccaactggtcacaacagggaagcctcgaaaaagcgcaaggtccgtacccgctctctgtcagatttcacaggcccccctcagctccaggccttgaagtataaggacccagcttccaggagagagctggagctgcccagctccaagaccgaagggccttatggggagatcagcatgctggacacaaaagtctctgtcgcccagctccgaagtgcgttcctggcatctgccaacgcctgcaggagacctgaactgtaggtgatgcttcacacgccctccagctgtgtcacttgcacgtccctggcagaatgattcactcctcgacctgtgttgtgttctgcattgaatcatattagcttagctcacaagtgcgtgcagggcgactatgcggaaaatggctcaaaaactaccactctgcttctgcctactaatggggaactagtggattgggtgtctggaatgtctccttccttacgtgcatggtagaggcatgaagaggggtttggtggtgtctgtcccttgactcacggagatgcataatcctttgccatcttctctttctctgtcttcgtttgccttccttatactctctgccctttgattctcaaagcaaatcacgggtggagaggtcggctgaaggacctggcttgcccaccggtgtggaacgggagagagggtcccggaaaccaagacgctatttttctcctggtgaaagtagaaaaacttccgagagatttagaacccaacctataacttcagcagaacgaaaggaatcggataggtaggcatgcgtatgcgcagtttcctcatccaggaacgtggcaatgacacaggagttttaccacactgacggtcttgacgctatttatataggatgttggcgattccataattgttccatctaacctataagcgttatttatttggcttatttaaaagtctttttaaagaatattagcctttacagcggtattatgatacatacacaattttacattgcattcagatgataagaagtaagaaacattatttttctttatttaatggttttaatgttttttaccccttgttaaattagactccagattgcatattcaccagattttacagtgaaaataactgaggaattttatattcattttataaatgtccatctacttgttgtatttgagttttatactgaagtgtcatatactattgcatagaaatggtaagatttgtctggaaaattgtcatcagtggtgtttaacaagttgttcttgtgcctggtctctctccacggggtgtgtacttggctgggattgtgtgcacacacgctccacagtgttgcttcacaactgtatgtgtgttttcacaactagaattgctaccaggaggttatttcttaaaagaatttaattgcatttttatttttactttcagtatgatgttttatttcgatcttctgctcccacctgctaatgtattattgttatttgctaatgtctttcctaggtgcacttcacattcagaaacgccaactgtcgatggcaagtacctgtttcccttttttttcttctttattatctcatctagactggatttaataataaggtttttggctttttgagagagtaagatgatggagcataacagtgtctcc

SEQ ID NO: 60404 - DNA, 1014 bp, Homo sapiens
acagcgtttggtcaataggtgtctgtatgccaggaaccttcccccacagtccgtgttctgggcgtgtacatgaggaaagcttactgattcaagggaccaggctcattatgccctaatgcatgctggtggtggatattaacgcatttttctgtggcttctgggtatttatttagtcagaagggacccattctcccccaggatagcatctgacccctgccagcttttacaggggtagagttagttttgcacctcctgggcatacatatgcaaattggaaactcaactcaggatcatctgacaagtagttgacattagacaccaaaatgctttttcacaagttattctctctcaggtcagtttccattcactggtaatctgtgatctacgcatgctttcctcctgtgaggccgttactgcactttgcaacttaaatcctttttctttcttaaagagttaaagttagagaaaaattggtgaaagaggaaagtgctcgaaacagccctgaactcgcctcagagtccgtaactcagaggagacaccagccagcgccagtccattacgtgtcatttcagtctgagcactcagcctttgatagggtccccagcaaggcagcaggctctacacgacagccaatccgtggctatgtccaacccgcagataccggtcacaccgccaagctagtgacgccagaaaccccagaaaatgcatctgagtgtagctgggtagcatcagccacccagaatgtccccaaacctcccagcttgacggttctagaaggtgacggaagggatagcccagttctccatgtctgcgagtcaaaagcagaagaagaagaaggggaaggagaaggagaagaaaaagaagaagatgtgtgcttcactgaagctctcgagcaaagcaagaaaaccctactggctttggagggtgatgggctagtgagaagcccagaagatccctctagaaatgaggactttggtaagcctgctgtgagcacagtcaccttagagcatcaga

SEQ ID NO: 60405 - DNA, 1558 bp, Homo sapiens
gtacccgcacgccggccctctggggcttgtgtgcatgagtgttgcttcctcctgcctgaccacacatcagctaacacccactctcctcttgccttctttaataccagtgcacttgaaaatcacgtggaagttactttctaatcatttgcttttcccctccacatgccctaatccatgctaatagtatctctccttccccctctttttcaatctttgtcaatctttcttgattgacaaaccttttacttgaccttttgcttttcccttctcaccaactcacataggactggccagtgaggggcagtagtgagcacccagccaggccctgggctcctttccatagctggactcgctagccggcgtcccatctgctcagcttcccactgctcccagcccttccagcctccttgctttcatatctcctcatctctaaaccagtagttaattttcaacagttaaatttagggcatgtggttttaaaagcaaacaaaaccccctatcatttcatttttaagactgggggcagggagaggcggaaggagtcagaatgagtaagtcatggaaggacaaagctccacacacagagtttctgacagtcactttgttcttggctgaggacaacattcagattgtctctgatcaggagcacgcattccacaggagaactggaaccgcgcttcagtctccttttgattaacaaacgttttaagtatgaaaacctccaacactggctcatctctgggaaaaataacaactaagaatgttttctttccctgagttgttcatagttaccacctctatgtgcgtctgtgtggattgtcctttaatgacacatatatagatacactgcctcgtacgttaaaaaaaatatataggagtttttatcaaatttagcagggtgcacttgtcattaaataaactattcttttccatacagtgcacatcataaataattacttttgccaattaagcttaagtaaacagtctaaattcctctccccgcaagaaatcccttttcccactccaaaagccctctttgctttttaaagctgagccctaatcagttttccattctcaagtagttggaattgtgtctcctttcccactacatggtacttcaaaaaccaaaaataagaactagataacactattaaacatttactctttgctaagcactaagccacgtgctttgcaaatatcacattacattatgtcactattatttccatttaaaaggtaaagcaactgaggcttactaagggcaggtgagttgcccaacactacacagctcaacctgactgagccaggatctgagcagaggtctcttccaaccccacagccagagctcttggtttctttgttttgcagtaatggaaaaaggtctgtagcttttgaaaaggatgtcagttttgctctcagatatttgaataactttagaaacaactggagcaatctctctttatttttattttatttttgttttttagggacagagcctctctctgttgcctatgctggagtgtagctgtacaatcatagctcactgcagcctcaaact

SEQ ID NO: 60406 - DNA, 1040 bp, Homo sapiens
agtaggttgtgaaaattttctcccattttgtgggttgcctgttcactctgatggtagtttcttttgctgtgcagaagctctttagtttaattagatcccatttgtcaattttggcttttgttgccattgcttttggtgttttagacatgaagtccttgcccatgcctatgtcttatgttcgttttaaaaacaaactgaacaggtgtcatggggacactttcatggactcctcacttcaggaccctcttactgggtttctcacacccctttcatagtttatcttttcgccgcttttctgtaatcatatcagagactgatgattgttggtgactgcttttgttgctgtgattagaatcacagagcagaagaagcaccactaaccagtggaagcatctcagtgcagagcacagaagtatgactgcaatatacacgaaatagaactagaatgcctagttctgtaagtatatcacacactaggacacaggtatgtgtgagaaccccgcattatgaagatcagccattagaaaaccactgtgtaaaaggatccactcaagataagagcagctgccatttggagaaattgaaaaaggtatgaaatcagaaagtcagatcacagaagagaatatatgtttacttccaaatttaaattttaaaagtgtgatggctatattaaaagtgcaatttacttaactgtcctgcttaaagctttggggtaattgtctaggtggatcttaagtgtatttctcagttcaaacaagcaatagtttcccaggtgaattgagaagggatcagaacctaaggtcagggagattcattctgaaaaaaaagattcatatgtgggaaacacccctatttttttcccactgggacacaggggtgcacacctggtcatctctaagtggcagtaacacatatgaagcagacccttgtggtactgaaatgtattaacccaaagacctgtcaccacatactcgagcatccagactgaaatacttagagagatcagcttccaacagaattaaaaggtagatcccaaggat

SEQ ID NO: 60407 - DNA, 1095 bp, Homo sapiens
ccacgccttacggggcttgcagaacgtgcaccattcacagcctttgtagatttcactgccgatctcagacttcttcaacagcccaggtaaataatcagtttaggcaaacacacctcggtgagaaactggtccttcacagcatgggcacccaggtgtgtgctgtgtgcagtagagtgtcattctgtgtgtaaatacatgtctttacttgaaatctgcacctctcatccatgtgaccttcttgtaggccgatcaaatgaagaggaggaaacttctgattcttctctagaaaagcaaactcgatccaaatactgcacagaaacctccggtgtccacggtgactcaccctatggttcgggtaccatggacacccacagtctggagtccaaagccgaaagaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgctagttctctgtaccccgggaccgagacgatggggctcaggacctgtgccggtgaatccaaggactatgccctccatgtgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccaggtaagcatccagtccacgctaagcaccctgaacgcaggacaataccttctttttgcctctctgtgtgatagggtttggctattctaagcattatgtggaagtcaaggcttattggagaaatatcatagtatatgattcttttttttttttttctgaagacagggtcccactctgttgcccaggc

SEQ ID NO: 60408 - DNA, 1050 bp, Homo sapiens
ttttacttcttagccaacctatatatgtgacatatacgtgagtcacatagctaggtgttacaatatatatacaacaaaacattctatttaaattattttaatgtatgtgattttaaatatattacatatatatttcatattaaacagtatgttgagtgagcatgtcttagctttgccttgataactctgtcatttttatgggcatcaaatattcagcttgaccttagaagaggatgatgcgtcctagggtgtgtccatgtgtgtgtgtgtgtgtgtgtgtgtgtgtgtctgcacactcttattcatttggcatctgcctcccctactaggaaacagtttccaagaaagcaggaacttggtcagttttgcatgtcactgtgacataggaatcaagaactgaaatttgcagttcaataaacacgttgcatgagtgaataaaatgagcgcacgactactaaatactatattttgttcttttttggttttcttccagttgcagaattaagacaaatctttgaaccaaagaagaaagaattcttagaaatgaaaaggtaagatctttatagtgggagttaggaagtagaagagagcttggcaaagcagtattccattttcctttagattcgatcgctgttgctcactctgcctcttgtggtgtatttcacagaaaagaaagaattgccaggcgcctggaagggattgaaaatgacactcagcccatcctcttgcagagctgcacaggattggtgactcaccgcctgctggaggaagacacccctcgatacatgagagccagcgaccctgccagcccccacatcggtgagcgtggagctgggtggcccattttccagcaggctgcctggctggttacgagttgccctttccacccagtggtatcagaacatgagatattccacagaagtgaattgtgtggatataatttttttagcacaaggtttcactctgtcacacaggctggaatgcaggagtatgatcatagctcgctgcagccttaactcctgggctcaagctcaagggttctcccgcccc

SEQ ID NO: 60409 - DNA, 2060 bp, Homo sapiens
gaccctgcttcatgctttacataaaaaatatcagtgcagtacaataaatcctaatatcagattactgtgttttcagtgtgacattttgtttattggaatctgtcttgtatgtcagtttattgtatattttacttgattttggactaacttgcatgtattatatatcacaattgcccgaacctcagaacgagtttacacgcttttgtcttaaaaatggaaatacaggctgggtgcgatggcttatgcctgtgatcctaacactttgggaggccgaagtgggtggattgcctgagttcaggagtttaagaccagcccgtgcaacatggtgaaaccctgcctctactaaaatacaaaaattagctgggcaaggtggcacacacctgtagtcccagctacttgggatgctgaggcacgagaatcgcttgaacccaggaggaaaataaaaaggaaatgcaatttctcaaatagtaaaggtttaataagccacccacctatgtgctgaaataaccttgaattgataaagatttaaacaaaaactaaatttggtcatctgtataagcatattatttagatatggggtatcatgccatgtcattgcaaattgtgtaggaaaagcatcaacttctgtttaaatttgcttggctgaaataaatgtgaggaagtcagtgtgggagtttatggcaaactctgaattattctgaaaatagtatatttcaaagaggcagatatctctaaacaaatctgaacaggatttggaaaacatttttgtacttaaatttgatattatgcctgatatttaggacttctaaccattactgcccaatgcttgatatatagcaataaatatttgtgaaatgaagaaattaatgaatggaacacacatacttgaatgagcagaaagactgaaagtacacagagctgaaagcctgtttgatttcttcatctgtcaagctccctagtgaaaatttgctttgtgacacttctgattcattcaaaccttctccagaaggaaagtaattaagtgtttttgttttagatagttccatttttatactgcaggtgacaagcgaggaataaccagctttagcttttaacacaatgagtaattaaacacagaagttactgccaacaaaattgaaatcaaatctgtcatttgatccagtgctgtgttgcatttgctttgtgaattggtggggaaaatatggtaaataataatacaccattgtatgttaagaaacagctgggagaagtaggatcattttaaaaggctaagaaacaaggtggcaaacatctagaaaattctttaattaaagctaaagcaaatgagataagatcaatccttcgattgtgatatgatagttttttaaaaaatagcaattgtttggtctgtttcttaaatagatgctgtcatttaccttaaaagctttgctaacctcaagtctgactgtgggccttctctgtggccgctgaagctactagtgttggttcaaattccaacactttttgttatgatttgtattagcatggggggataacttaacttctgcctcaatttcctcatctgtaaaatgggaatgatagtagtacatatcacatagagttgttatgaggatcagataggtttatgcctgtagaacaccaaaagcgccacttgcagcatgggcatgtttattgaatgatgatgattaatcttcattaggacccaaatgattcgtggatttcattttaaccataagctgcaaggattttttttatactttaagttctgggatacatgtgcagaacatgcaggtttgttacataggtatacatgtgccatgttggtttgctgaacccattaactcatcatttacattaggtatttctcctaatgctgtccctcccctatgcccccatcctctgacaggccccggtgtatgatgtttccctccctgtgtccatgtgttctcattgttcagctcccactttggagtgagaacatgtggtgtttggttttctgttcctgtgttagtttgctgagaatgatggtttccagcttcatccatgtccctgcaaaggac

SEQ ID NO: 60410 - DNA, 1051 bp, Homo sapiens
ggctgagggggcgggaattccctgagtccaggagtttgaggctacagtgagctctgattgcgccaccgcactccagcctggatgacaaagcgacaccttgtctcaaaaaaaaaaaaaaatctgctgcaagagcttatttgtaacctggaaggaaaggagtagtccagggtttggggcagagcctattgcctctgaaaagacccagtaaattctctggggactgcttgtatccttgtaactagatagtcgtcacacatgagtgaaaagaaggcatttgggctttgaaggtggtcaagagcgtccaggctgggccaggcatggtgggtctgtgtgagaagcagagcttaggaaggctggggtctgaacatgctttgacttttgctttgtgcaaccagtaatccagaaaaatcctacctgaagccccagaggctgtgcttcttcagcagggtgtcatattgtcagggagctgcaaacagcctgttgtagtcagaaaagacggtgttttcctttccacagctttatggacataaaataaaacttgaatttgacaaacaatacaataaatcctcctttcccaaaaattacgagttgaggtcatggttcctaatcggaactgtgtgcagctgttggatttttggcgctttctagagctttcactaaaatcaaatgcatttaaacaccctccctcctcaagaggacaggattagcccgcctccccaggagaacagtgctctgctgcctgcgtcagcaagctccttacacagtggtctcctgcctgtgtcagcgagctccttacaacagtctctgtgcacgtcccatcactttatcatggattagaggctgcaggatgttttcatatggcccatgataatgtaatgatggctggtactttaggacttgaaaacctcttaacgtcttggccagactgtggactgttctttcaggcatctgtcttttaaatcagttatctccatttgctgtcaaatttggcctgcattggccggctttattatttctattgttccatagagagccacactgaaactaattt

SEQ ID NO: 60411 - DNA, 1062 bp, Homo sapiens
gcacatcacagccctggttcccagaggacaactttagtttccatccatacgtttaaacacgtcgaaagcaaaaacaaacaaaacgctatttaagctaatgtctcccagaacaacaccatgaccttaaaccgaaacacaaacgtaggaaagaacaaccaagcagccaaaggacacgttgtcaacagagactgcaatccccctagttccccaaaccactctgtcccggaattcaaagcacctccatgcaaaccgctccctaagcgagagctgccttgtgaagtgagcttggagcattcaactcaagcgttattagtgatgctgagattgcacagcatggatcttcaaatccataattcaaaatgcagaaatgaacattttatgttttcgggacacaaagaacctacaaaactgtatccagtgtgtgtgcgagtgtgtgtgtgtgcatgcttgcactgggtgtgtgtatatgtgaaagaaataaggaatccccaggaaattttcccctaatacaataagcttccatttcttttgaaaaacacagtattttagatttttcctctgctatccaagtatgacaaattacatggataggtcaataggcaatgcatggcagtttttcagttcctatcagcagatgcaaagtgcaaatccacttcctctggtcctgtgctgtccaacaaaaggggccactgcaattctgactaattaacatgaagtcaaggttaaggtctaattcctcagtggcacttgctaccagtggctaggggctacccaacagaacagtaccagtttgagaatacacccatcaacagattgtccagttctactggccagtactaagtcaggccccatgggttgttctgatctcatttcagtggaggatgggacccattaggagccgtaaggctcagctgggtgttatctggagccatccaggcacgtctaagctcttcatttctatagaaacacagtcatttgccaggcaggcgcggaggctcacgcctgtaatcccagcactttaggaggccaaggcgggtggatcatgaggtcaggagattgaga

SEQ ID NO: 60412 - DNA, 1870 bp, Homo sapiens
ataataacatgccatccattattactgtgtgccagacttaatgccacactctttacctctacaatatatcacttaattatttttattttttgagacagtcttgcctggtcacccaggttggaatgcaatggcatgaccatggttcactgcagcctcgaactcctgggctcaagcattcctccttcctcagcctcccgagtagctgggactataggcaatcactactatgcccagctaattaaaaaaaaaaattctagaggcaggggtctcactatgttgctcaggctggtcttgagctcctggcctcaagctatcctcccattaaggcctctcaaggcactgggattacaggtgtgagccaccacgcccggactctaatttttacagtagcccccaagaaatattagtgcaattgtcttcattctactgaggaaaaaactgagggttagaaatgcttgcccaagcttgggcacataccatgtgcccaaatccagctggatttgaacccagatctagttgacttcagtgcctgtattcataaccgctgctttagccagtgcagcccaaactttaataggaatcacctgcagtcttgttactgcagcgtctgattcagtaggtctgcactggacttagagattcaacaaacaggatccaggtgatgctaattcctgtctgaggacctgctttgagccgccttaggttaattctttgccacgtgcctgagatggaagcaaccagctggggtgcgggactcgaagggggcttccgaggaggagaaggagtctttcaaggctcctctgttcctctaggcttttcatgccaccccttcccgctctctacctacaccattctctcccgtttgtcttattttccactctgctcttctcctggcttctccttgtgttgaaaacatcctcaggtttcatccattctaaataaagctccccttgacctcaagcgatcacttctttctttcctgcccactcactcctcagcactgatcaggagctcttctgtcttctcctcttggacacctttcaagacctcctggttactttgatgtccccgcagcctccctgggatggaacccctctccgtgagaatcccatctcaggtctagtgagggtgatggggctctgacctccatactcagcatccacaccctgctgtgatcttgaggtctcctggcggccttattttaaaaatcattttctgtctctttgcttgctcagctttccttcttaaggtccatttaagattttttaaaaaatcctggtgttcctctttataaggtgaattgttcaacatgtccatttcaggtggaatgcattcatttggcttttagaactgattttctgtttgtaagtagaaattaactcccaattagctgtgtgagaatttgtatcctctgtatctgctatcaatagaaaagaacaattcggttctgggcgaagacccaaagggctttttattaataatgcacctacgatttgtgaactgtgtttaggttcatcagaggcctctcgtttctttctggactttcaattacgttctgagcatggaaagttggcaaataacttaggcttggatggatagatacagtcattgaatagaaaaaccatattgatatttttaggtttttaagatctcacatactttaaatatttcaaaattttaagtaaatactctttcatacattctgaaacattatatctaatttatctcagccaaaaatttaagacatatacatgttgcagttgcacacctgttactccaaaacaaacaaaccgctccagccaaaacccaaatgggaaagcacttgattttcagtagcttaaaatatgttgaattaagaggtaggttatga

SEQ ID NO: 60413 - DNA, 1160 bp, Homo sapiens
gcctcctgagtagctgggattacaggtgtccgccaccacgcccggctaattcttgtatatttagtaaagatggggtttcaccatgttggtcaggctggtctcgaaatcctgacctcatgatctgcccacctcggcctcccaaagtgctgggattacaggtgtccgccaccacgcccggctaattcttgtatatttagtaaagatggggtttcaccatgttggtcaggctggtctcgaaatcctgacctcatgatctgcccacctcggcctcccaaagtgctgggattacaggcatgagccaccgcgcctggcctcgcctcgccatctcttacctgggctactgctttgcccttaatggatcccttggccctcggtttctcctccgtctggtctagccacagaatgaccttcctaaacaaagatctcatcttgcactcggccagggccaaaccctcatcgttcctcactgcttacatgcaaaagcctgggctctgtagcctccccttcagggtctttcatgcccctggagttctgttggcaagtctccccaaaatgttgtcttctcttgcctgccagggaagcaatatcaaaggagatgtgccagaagcttcctctgacatgcctctggcctcctgggcctcgactccagcctgtactctagggctgcagtcactaggtcctggtggccctttccttggcagcagggtacccagtgaggtgcttgggtctcacttctcttaccacccccagggtctagcccagtgggcaatccagaaatgtgagttgtttgaacggattgaattgtaacgacttgtgggttcttcatatcgaaatttggctgtgatccatccagtacttttgccctcatcctatattactcacagtagaagctggtgttctgtgttataagttctccttttttttccttcatctatgacaatgcaagcagaaacgttcgtgttgcggtaacaagtccgatggggtttctgtatatggggtttctgtacacgtgcttttgccaaccgggaaattaaggtgtgccgcatgaagtcagtcacttcattattggaactttgcctaaaatgaagaaactcatctagtggtgcaatttgacctaagtgttttacccatacagtcaacttcaacttgggtcacacatc

SEQ ID NO: 60414 - DNA, 1055 bp, Homo sapiens
atatttcttgggttgagaaggattggacttttttttttttttaaaggatttactttatggtagagaaaggtttaatactaaaaatttgattaatataacttagtacattctgtctaaatgttagcacttaaagtcttggaattaaagtatattcacaatgcaacgtactttaataatcgtagcacaagtatgggggtggagttcagaagggcaagttttatttcactgccattataattcatgtaaaaatagaaaatcaccagtgatccttttgcataatctttgttctgagggttctttgccttggtactctcattcttcagggcttgatttctagaacttgcgatgttccagaatttatgagaaaaacctcactgtaggttctagagtttgaactgcattttatttttaaattctccaagaaaaaatactgcatcagccttttaaagccctggagattgctatggtctctttgtaatttagctcagtgatttgtttctgctgaaaaacagcagtgaactctagaacatagaaggcttatttgacgtgttgcttctttgaaaaaaaaaaaagattatttctttataccacatcagatggacaagtacgggcagtcattatttttaccaggtaggaaaacagagtatttatagagaagaacttcatcggtgaatactgcgagggttcttcaccggagatagtgtggcaaccctagggggcgtttgaaaatgcatgggggtgtttcaggttttctcaatgactcactggcatttgggaggatgtggttaagaattgtaaatgcccaatttacatggtgtaggggacagtcccatacagcattaccctggccaaactgctggtggtatcccctgttgagtaaaactgcaggatataaattgtaccctctgtctccaaagaagagcagcccagtgccaggcagatgtgtgctgtctcttctcaccaaaaccagtgatgtcttttttttttttttttttttttgagatggagtctcgtgctgtcacccaggctggagtgcagtggcacgatctcggctc

SEQ ID NO: 60415 - DNA, 2144 bp, Homo sapiens
ccatgtctcaaaaaaacaaaacaaaacaaaacaaaacaaaaaaaccttgcaagattttgataggaattttgttaatctgtagatcagtttggggacaattgacatcttttgtgtgttgatttttcttccaattcatgattatcatcattggaaagaagtgagtatgatgagtcttctaagccaggcagatagcaaaaaaattaggaaagtaaatggattgcacaggaagaattaactgggatttaaataatcaaagacagaaaggatatataaaagaagtgacgaaggagatttaccctattagactccagtgtattaatctaggacagtttggttgctatggggaagcagtgtgcaaaaacttaagaggcacacaaaagactgatgtttattttgtgggagtgaatctttttttaggaaggaaatagcactattgtggtaacagtgattcattttctcctcctatcttctctttacagagaagacccaaatagtgaactgtttcatgtaagtttttatttatttttgccctacttttctctagggaggggcttaccacagcttataaaaatacgtaaaacaagatcaaataaactttaaaatgaggaaaaagccaatatggtccaagggaaaagaagatcagggtcaggactgagattaggatgcaaaagccatgctatgaaattttgtttgtttgttatcttgagatgggtaaaaaaaaaaaaaaacagttgactgggacaaatacccctagcacaaaacagtcatgaagccaatgtttaattattatacctgtcatcttttcacctggcctcaggactgtcctcttagggagaggcattgttctgtagggttaattagtaacaggaatttagatcctgctttgagaggcctcctgtgctggccgaagcagctggtggtctgagaaccctgacacccagaggcataccactgggaggccccgcgcagcacacagcttttgctgtactccagcccaagtcttatggggtttgtggtttatactgaagttggtgcagacaattaagactctctgttcttggtaccgacagggacagagacctacaattgtaagtattttgtaaacagggttgtgatatttgtttgagtgtattcaacatgtcagtggccttttaatgtttaaaaaaatgcatatggccatttaagaagtggttgtgcttcatagttaatatttttttcattaggttaggttcatctggtttttcagtgaggtgagctacctgagagccataggaagatagatcttgccagttcagaggactgactttggctttaagagaaaatatttgtgtcattttcgagaaagtacttccagcacaatgctttcttctgatgattcattttctacagttattggaagtgggaagaaatccacagaggttacagaatttgtaaacttgtagagacatgtgccattatatcatgctgtttcatagatgtgtatgtctgttagttacttttcgggcattcattgtatatatgtctgttacttacttttggggtgttcagtgtctgagctttgtcaacgattgtgtgctctttttttagcctaaaaaaactaagttagagaaatgtttgctcatccaaatctgtattgttgtagcttattcagtagactgctgttgtatttttaatttctctatacaacaagctgaaagacagtgtggacaacctaattgcatttgaagtagctgctggccaggcctgctgcaacagctgatgggctcctctgaatttccagggctatttctggtagatgagctggtatcaaggctctcgagttcaggccataaaaggcccgtcccatgtgaagttgcttcactgctctgactgcgtcctccccaggctgaagtgtcctcaggtttcatgtggatttgcccagtaatggatggctccaccgaggccaggttggggaagttcagcctcgaggacactaggggacgaaaaacttcaaaaagaagactctttttattaatattttggcgttctttttggagaggaacttttgggatgtagcctttacctgtttcctgaatttgacatccaaaaagccttttggaaaacaccattctaaatttatcctgttctgaatcatcatcgcttct

SEQ ID NO: 60416 - DNA, 1050 bp, Homo sapiens
cagcagggaagggaagagcctcccaggtcctcactccactggtcacatcaccgtcagctcatgtccccatttgagcagcagcctccatggttctgttcgtgcagtgagctgctgcttgacagcagacagaaatcccatatttttagatatctagtggcccaaacggagcatgtcacactttgtacatctctgattactctcaagactctgagcctggtgtccaggaacgcgatgttgctccagccgtgtgagaggctgggtctctggagccaggactcataaaccacggtccaggctcacccctggcaagttcacatctcattttgaccacgaggccagcagttctctttgtgttgagctctgctacacacccattgctctgaagctacagcccgggagagaaaagttggctggctcatcagtggttcaagccagtgacttacagatgaccttggagctcaaagattttcagctaaagccagtaaagttctccaaaagctttgagaaaaagcgagaccagacagacagaaagacagactcaattgattgaattattgattgattcagatttccggcaggggtggggggttgttggttgaaaaatattaactgaaaataatatcccctttttgtctttaaaaagaaatttatgcacaaacaaaatgacttgcccatggtacagaaggccacaagctcgattcatacaggtgtatcggtgtacatatcagtagactacagcatgtctctgtcttctcccatagaggtcaaaatcctaagctttttgggaaaaggaaatgattccaagtctggttccatcgtggcagaaaatagggcaaaatacaggtcctggttgcctagccttttcatctcctggaaatgagctgcttaaaaaatacctccagtgattgatcaagttcattgccctgtggaaagcagaacttttcagaaggcagaagcaaggagacagagagtgttgttgtcttactttcctgcactgacagtcctggccaatgctctgacatcatcttgagtccagaaataggagtgaga

SEQ ID NO: 60417 - DNA, 1120 bp, Homo sapiens
cttggccatcatcagaaaacattaggcagggcctggctgaaaaataatcctgccttcagggcttaccacatcaattagcttaccatacgggccagtaagccgtgtctttgtgaacacatggtccctgggcagcggatttgtgaaagtgatgccaagcccaggagatcagaatgcacggaagattttgcaagggagtcctatattgaaatcagacactgcttaatgaggaaaatctttcccaaagaggtatttgagaaggaggtaaaccaattcaggcatgtggaacagcctgcacaaagccagcagaaattacgatcacagattgcagggcaggggggtgtctgtgagggataaagttgcctttggaaaagaactcattgccttgtcattttccctggagcatacgcattatttgccttattcgttcaagaaatatttatcgagcacttaatatatcctaggcactgaagatgaacagcagttcacaaaccagacaaaagtctctgtcctcacacaagtcacattttagggggcccatgtcactaggggtacaagcgtaagctgaagggagctgtagcaaggagttaggagtacctggaagaactcctgaataactatagttgtttgaaaacgtatttgcttatttattttctctcttccctttgatgcaacttgcacccactatcccactaacgagattaccagccatctttcgataaatccttgggagggaattacttgtacttgctaatgaataatccactttagtagtccaacagataataacttcagggtcttcaaagggttatctgatctgctttggcctgagtctctatgggagggaagttgaggcatgatcaaaggattttatctttgcttgctctcctactgtctaataattttttatttcagaatgctttgctttaacatattttatctcgcttggagcgctttattccttccttatttatttattttttgagacggagtttcactctatcgcccaggctggagttcagtggcacaatcccggctcactgcaaactccacctcccgggttcaagcaaccctcctgcctcagcctcccgagtagtttggactacaagagcccgccaccaca

SEQ ID NO: 60418 - DNA, 1050 bp, Homo sapiens
cctactaccaaaaaatcagaaagtatctagctttctaaattgggaaagcaagcaatgttataaaaacactgaaggaatctctttcttcgtgaccttttgttaaactcggtttaagctgtagaccttatttaaaataaaatttaccacagaacaggaaatagaagctgtggaagactcgaaatacacctttgtacttctctgttcttcacctgctctctcactgtctctacacacacacacacacaaacacacacacacctatatttgcattaaaaatgggtagtaaaagcagtgaagggcaaacagaaggtacaatacaatcaagtaagaggttgaatataaactggaacaagtcttaattttttatttcactttcattcggatacgtttactaattttctttgctagctttaagacttttaaaacattctttggccctgggagggagttgtataaccataaaacttgagaatcctggccctagaataaatgttccttttaaaaccccaaggacagaaaattgaatacagctgtgcaaaaaagaaaaaaaagaaaaagaaagcaagaaaagaaaaaaaagccaagtgatggtttaggcttgcaggcaccctgaccaactttcccagtgcacttgggctgtggtttcctggagatgggagatcgggagctttggtgtacttcttgaaggtttcagaaaaaggccaagacttcttcagaactgtatgttcctgggatatggttaagagcgcattctttttggcatggttatctatcatcttgcttgtcctaagcatgtcctcttgttttcccctgcagaggattggggtttctaggtcattctctgtgatgccgtgattctgcaaaccttatagttcctacctaaaagtaagcttcagagtttaagcagtttccaccagtcagaaggtggaacggatgagtttttaagacgcaatcttgctcttctccctcagtcactgaatttgcctcagtatggccagttttcagacatggtcctgagaatacggcattgctactccctgcttctcctct

SEQ ID NO: 60419 - DNA, 1072 bp, Homo sapiens
attagaaggtagaatatcacccatgaaaaaatttctggcttaaaagaaaccctgcttttatttatttatttagacagggcctcgctctgtcacccagcctggagtgcagtggtgtaatcacagctcactgcagccttgacctcttgggcttaaaggatcctcctacctcagccacccaagtagctgggaccatgggtgtgagtcacaatgcctggctaatttttaatgtgttttttgttttttgttttttttgtgtgtagacgggtgccttagtgtgttgtccaggctggtctcaaactcctgggctgaagcaatcctccccacttggcctcctaaagtgcttggaatataggcatgagcctctatgcccagcccaagaaacaaaccctgcttttagaatctttttttttttttcccagctgtcctgtgtcctaggtttataactttgactaacttctagcaacttccaatcatgggagaattagagtggttatctgggatgaattgtttgaacttcaacctgttatcttggctgcagggctttcttggccacagggccgtgctaaagggcactttgatttcttgattttaaaagagcaagagaaagtgattgccaagaggagaggtttggttggcttttcttagaactaactgcctctccagagaagcctgcattggctgctcatcatgatgagggtcgggcaaggtcagtttccactgtcttctaattgttttcagagaattggacggtacaaagcaggtgccactgacaacatttcccatcattttatggaagagtactgattccgtcttttctgctcagagtggatctgtgcaaataacttttgtttctcaaaaatttctggtttgtcttgggatgcagccaggcctctaatgtggtggtgtgtgctgtgtcacaaacctcggccccaaaagcctgagcttggctttgtcagatctgatgagtgtgcatgagcaggaagccacccttcgggagaattcaggggcaaacgtacaagtaacgtttgtgaacctgtgcagacaaaggctttgggtagatgcctgtgagatg

SEQ ID NO: 60420 - DNA, 1097 bp, Homo sapiens
acaggtctgagcggaagtgtgtggtaagtcacatggaggcagaaggtctgttcctgatcagggttaaggtgcccctttggtctcccttcctagcctgtgtaagaagccctgcatctgttgaaataaacaaatgcgacaaggaagcgcagaagcagcaagccttattgcaatgtgcctagtgtggtttgtagcaaggaggaagtcctgctggtgggagcatccagcccagctctgatgatctgaaaccatctttgagtaactggtgcccagagggaatgttttactttttggctgcttttctgacgtgatcattaggaaagagataggcacacttttgcacaacttctatgctaagcttctttgtctggaaaggaaattttagttgcaaggacttaaaatttccttcttgtgagctgatacttttgagacagtcaagaggatgttaatttaatgaaatcatgaacttatgcttcttatctcctcctcctcctcctcattcttctctctctctcaacacacgtacacacacacacacacacacacacacacacacacaccattccatctttagaggtcatcatgcctttgcatgtcatgctttgtgctgtggtggctggagactctctttccatcaccagctattccctgggctgtcattctgtgtaaaatcctttctgctgacttctcatccttccttgcctgcacgtgccctaaatctcacttttctgcccatcctctttggctcatcctcttctcttcccacacaattcccttctcccagtgccatcctccttcccagttgtaccagtcacagccccattccctaccatgccaattacaaatgcaacccctttatgacagcttcctgccccacctccacagggaactcacctctcttccgccctgcagtgctctgagcttctcccatggactttccgtctcctgcccctgagccagttgtttgtgaggcaagcccagcaggtagtgtccatgcctgctggttgccttctccttccctcccactttctttgctatttttttttttgagatggagtctcactctgtcgcccaggctggagtgcagtggtatgatctca

SEQ ID NO: 60421 - DNA, 1355 bp, Homo sapiens
tctcccacctcagcatcctgagtagctgggattgcaggctcatgccaccacacctggctaatttttgtattttagtagagacgggtttcaccatgttggtcaggctggtctgaaactcctgacctcaggtgatccacccaccttgacctcccaaagtgctgggattacaggcgtgagccaccacgcctgggctattttttaaattttttaaaatttcaacagctttagggatacaaatggtttttggttacatggatgaattgtgtagtggtgaagtcagggcacttagtgtacccctcatttagtgtacctgccccctgaatagtgtacattgtacccaataagtactttttcatccctcactcccactaccccttctcataggagacgtcaaggtgagtcaaccttcaaaattactaattgggaatcaattagtattttaaataagcagctcgtacattccatactttctggagtggctgctgcttccggctgcagaagccctagtgttggtggtgccacatcttcattcctagtttgtcttcattgctttgggacccggaggtctctcttgacctcaagcagaaattgttctccaaggctctggaaccccaattcactagaattgccgaatttctgccctcagaagtaccgtgcattgtgcgaggcatgcagaatggaggagcgctcaaccctgcagagagagataactcaggcccctcccttcctctagctgcctttccttaggaattcacagtttccttataattctgtccctcgggctgtttaggtccaacggcttatagcgtatgaatctctcaccttgagctttcctataaattccaagttcttccttagttttccttttcccctttggttatattaagagaacgttaaattgtattttggggccaggcccagtggctcacgcactttgggaggccgaggtggaaggattacttgaggttaggagtttgggaccaacccggccaacatagcaaaaccttttctctactgaaaatacaaaaattagctggatatgatggcacacacctgtaatcccagctactggggaggctgaggcaggagaatcacttgaacccgggaggtggaggttgcagtgagccgagatcatgccactgaactccagcccaggtgacagagtaaaactcgatctcagaaaaaaaaaattgtattttgggaaatgcttgtaatgtaaccatgctcacaataactgtatcaatttatttttttaagagacaggttgtactctgtcatccaggttggagtgcagtggtgtgatcatagctcactgcagcctccaactcctgggctcaagtgatcctcctgcttca

SEQ ID NO: 60422 - DNA, 1762 bp, Homo sapiens
tctgagaacagtcaggtgagccttgaagcgatgggctaaggtgcagtgcttctcaagcttgtttttgttaatactcaaataaccaagaggactgaaatcgtgattgcaggtgggggtaggggtgccacaggtaactcctggctcacataaagaatggaaatagtggccaggcgcagtgactcacgcctgtaatcccagcactttgggaggccgaggcaggcggatcatgaggtcaggagattgagaccatcctggctaacacagtggtgaaaccccgtctctactaaaaatacaaaaaactagtcgggtgtggtggcgggcgcctgtagtcccagctactcaggaggctgaggcaggagaatggtgtgaacccgggaggcggagcttgcagtgagctgagatcgcactactgcactccaggctgggcgacagagcatatctccatctccaaaaaaaaaaaaaaaaaaaggaaatagtaagaatttcttctctgtgttataagctatgggaggggagtcactgagcagtgtgcccaaaatttttcctgtgtgacattttcaggctgtagtgggtggaaagattttgtaaatgtatcttcttggtgagagggtgtcctctgaatctgctggtaggttggagtgtttgcagggaaatgttcatcaaagggcttgctctgtgaagaatgtgacttaggatgatctttattttacgtgcattccatcatatgtaaacaaagttagggtctcaacattcccactagcaccttcagccaactcccaagcttctgtctcagcaaagcgtttgctgtagaagcctacactttgaacccatccttattttaggtgaaatcatttatttcgtctatgtttttactctctagtgtgtcatatcttactttttcacttcttgaagaaaaaaaccaattctgtcctgagtttggaaacctttccttggtaagccagggcccatttgtgtagagtaagcttttcaaatcactttacagttccttccacatttgttgaaagggagagtttagaatacaaatcactgttcagtagccaactgtgttaccagcccatcaatgccctgaggacactgcatagcagacattctcccgctggtgccttcaggtgcccggaggcctgggcctgaactggccttccacactcttggctggagatgtggctccatctggcttcaccttcagtgcctcctaactcgtcagtaacactcagtaaagaattgagcagaacttactgaaaaagcaaaacgtctttgtgagtttttatggcttcagcgtgtcctgagctatctttaaaaatagagcaacttgggctgggcatggcggctcacacctgtaatcccagcacttttggaggccaaggagggtggatcatctgaggtcaggagttgaagaccagcctggccaacatggcgaaaccccatctctactaaaaaatacaaaaattagcctggtgtggtggtgcacgcctgtaatcccagctactcaggaggctgaggtgagagaattgcttgaacccagggaggcagaggttgcagtgagccaagattgcactgcatttcagcctgggtgacagagcgagactccatctcaaaaaaacaaaacacaagcaaacaaaaagaggtggtcatggtgatgcatgccagtagttccagctacttgagaggctgaggcaagaggattgcttgaacccaggagttggaggcttcagtgagctatgatcacacactgcattctagc

SEQ ID NO: 60423 - DNA, 1034 bp, Homo sapiens
acttactcatcactgatgattcataaaatacaaagtgtgctttagtaacactgaatagtatagtctagaatcctaaaaaagttgagaaaaagactttgttctccttattttctatttttttctattgctccaccttgtattagaaattaggaaagactcgtggtgaatgtgtccaatcagttcacctcacctcatgttgtttctaaataaaataataaaatctgaacccatagtcttcgccttttttgaggtttaagtattggttcatctatgtcgttatgtaatttcaaagtgccttccggaaaatccctcgggatggagatgactcaggatagctttgcactggtttgttatggggccatctaaatgaaggaatggccctctgaaatggcagcaacaaccctaagctgcctgggttccagtcccagttctgacaccgtctaggtgagtagcctcagccaagtaacttcccactctctaaacctcatttttctgtctatacaaggtaggaattagatgatgacattgcttcccaagccttcccacccaacactagtggcccttgagatatcattgattgggtgcttctccagtatatccatggaaattggagaaatgctgtgtgctgaattctattccatatttggcttccaaaagctcataagcacattagagactgcaagaagccttgaagtaaagaaatctgcttaacatttttaaacctagcattttctaaactctttgaactggaaactctccctcttttggaggaaaagcttcaagtatattggagtatcctgtagtacatagtttgggaaatgctggaatagatcagtggtcggcaaatagcagcctgcaggccaaatccctcttgccacctgttgtgtaaataaagttttattggaacacagctacactcattcatttatgaattgtctatttgccccagaatagccaagttgcagagttgtgacagagacctgtatggcccatactgccaaaaatatatttaccatctggttatttacagaaaa

SEQ ID NO: 60424 - DNA, 1033 bp, Homo sapiens
acacacacacacacacctccataaacacagaggcccagcatggctactgtacccactatcctttttcacccagcccagctcctttcagaagatgacttcacctttataccatcaaactttttcctcctgcttaatgtcttgggatgctacaaaattcttgatggatgtcagatataggtgggcggtcaaagttagcctgtttcctctttttccacaggggtactgttggaaaatgatccagttccccttgatagtggtgactatgttgtccccccaacatcatggtccttggggttagaaataagagccatttcccttaggaggaagaaggtgatgagcttagttggggagggggacctcctttgctcaggacttctctagtattccttatgcagccatagtaccactccccacaaacatcctaacaccgcccctcacccccagactttggcagctttctcctccttctaggaccctttgtttgtttccctctttgacattctgcccctcctgttcctggtctgttgctgtcgcccagccacctcccggcaggcctgggtttcaagtgtcttagggacacatttgccttggacgtccttatctccatctgtcattggtgtttaattgctttccctccactccccagcctgctctttgacttggggtaagtttcccccttgcgatcctttctgattacttctttcagctttcctctggccaattcagctgcccgttcagctcctccatgctgctagctcaccttttgtgtctgcagtttcccagggtttccaatacatggctttgtttctatccaaggctgctctactctttttcccttccttcctttccttcctccccctttttgacagtgcttcttgatgcttgcattcctttccctttcatttttttcttcttaacaatttgcaaacccttctccctttgttctgagtcaatctcatttggctgtcacctttgtttagtataataatgatattgaataccctatcaaagtttttatgtacaggaaatttct

SEQ ID NO: 60425 - DNA, 1094 bp, Homo sapiens
aggtcgccagattttatttatccctggaaggtctggagactcaaaggggcctctcagggctccagggtaagcggctgcctccgggcagcagagccggtgagagccagggagccctgagccgctgggcgcgtgcgcgtgggcgcgtccctgggccgggcgcgcgccgagggggtgggtggcgccggccccgccggcctggcgcgcggtccgagccactcagagcgcctggcggccgacacccgggggccctacaattaataccgggcgcctgcccgctggccgggactcgcgcgccggctctcggggacggaggcgcccggtccgccctgacgagctcgccactggctctgctccggcggcgacggcgacagtggccctggccgactttcccggggcccacacctcctcgagagccagcttgggcaggggacggtgccgcaccaccaaggccccgcgctagtgtgcacccccggcccgggcccggcaggtgggcgaggagggcgggcgcagtcgggctctgcaggagcgcgcggaggtgagacgggggggaaggtggggacgcgagtgtgggcgcgtgagtgtgggcgcacccccgggaaggtctcggagatgtcctctctcccttcttcctggtcccctccagagtttcgctcaggtcctcaggggacagcctgagaggccaacctgctggaagagttcactcgggcgacagagcgagttggacagccacacccccggccgggagagcgatagggcggccctggcctccagcccctgggatcctaaagccccgcatctccggggctgcagcgggggctagcccaagcatcttcccagccctgggaccgggggggcgtgactgccaccaccctgagagctactgagacacaggacacaaacttagtttccaaacaaagtaaaatctgcctttccggtgttttaagataggacgtgcttatgccgattcatcgcggtttccttgggccacctccgaggacgcggctggacccgctggccgtggagggggtcggctccgggcgcgagttcgtgtcctggggcgtggggacagctctggtgcttcccccgagagtcgt

SEQ ID NO: 60426 - DNA, 1064 bp, Homo sapiens
tacaggtgacgaccttgcaggctgtagtacaggtaccagcgagtgtcctagaaaggtattgtgtgggatctcctggctggaggctagctggctacagcgtcaggaagagcctaaagattagattgtaagagagaaaatagaggccaggcgtggtggctcatgcctgtaattccagcactttgggaggctaaggtgggtggatcacttgaggtcaggagttcgagaccagcccggccaacatggcgaaaccccatctctactgaaaatacaaaaattagccaggcatggtggtgcatgccagtagtcccagctactctacttgggaggctgaggcaggagaatcccttgaaccaagaggcagaggttgcagtgagctgagatcatgccactgcactccaagcctgggcaacagagaaagactctgtctccaaaaaaaaaaaaaaaagaagaagaagaaaaataaaagaaaatagaagccattttcaaagacctacaggtttggaagacctgggtctgaaacagctagccatttggttctttaaagatccctgaatgatgtgagttacttgggcgagtgggtcaggaccctgttatgaggcaggtgatggaaaaaatccattcacaatattttctctagcaacaagccagatatggtgatcaggggactgtgaagtttaccaaatgggggatgtcagtcaaaagaaaacatggcatagattatcagtattctggccaggcctcagagatgtggcatagcagtatgtgaaaaagggatcttgagtttatgtggaagggcaagtagactatggtgaatatatggataaaaataatgtgaggtggcaagcaatgactatcatagctgataatattatacttctaagagaccaggcaaaagagaaggcgtggaatggatgattcttctttggccatcatttggtacagcctcatttccaaatcatatataatctttatagttcccaatgacaagaattaaaatactcttatacattaaaagaaaaaaggtttgtgtgcattaatccccacatgagaagcacaatccttat

SEQ ID NO: 60427 - DNA, 1047 bp, Homo sapiens
aggcatgtaccaccacacctggctaatttttgtatttttagtagagatggggtttcgccatgtcggccaggctggtctccaactcgacctcaggttattcacctgtctcggcctcctaaagtgttgggatgacaggcatgagccacctcgcccggccaaaagattgtttttctaacttttcagatacttccagatttcctttttttttttttttaagtgaatcaccttttttgaccatgccgagacttgctgttttttttcctttttctttttttcccagctttattgaagcatgattgacaaaaattgcatatatttaaggtatagaacatggtgttttgattcatctatagattgtgaaatgagtaccccagtcaaggcagttaacatagtcatcttctctcatagttaccagtttttttgagtgtgtgctgagaacatttgagatgtactctatcagcaaattccaagtgtacatgatggcattagtaactaaagtcaccatcctatgcactcagtctccagtacttactcatcttatagcttagggtttgtaccctttggccagtatttccccttttccttcaccccagcccctggcaaccacccttctactctctgttactgtgatttcaactttttttttttttttaaatgattccacatataggtgagatcatgcagtatttgtgtttctgtgtctggcttttttgactaccataatgtcctgaagtttaatccatgttgttgtaaaatggcaggatttgcttatcttttagggccgaataatatcccattgtgtgtgtatatacaatttctttttttcttttttttttttttttttttgagacagagtttcgctcttgttgcccaggctggagtgcaatggcgccatctcggctcacagcaacctccgcctcctggattcaagcgattctcttgcctcagcctcccgagtagctgggattacaggcacgtaccaccatgcctggttaattttttgtgtttttagtatagatggggtttttgcatgttggtcaggctggt

SEQ ID NO: 60428 - DNA, 1683 bp, Homo sapiens
atgtgagaggcagccagcacgggcacactggaagacaagtttcctccccttactcacagggcgagagcacctgcgaaactcaaaccaagctcaaaaagttccaaactgggactcggaccaagaaaagttcaaagaaaaaaatgaacgagactatattttgcttggtttctatcccagtgaaatcagaatcacatctgccagatagagatatggacaacaatgacttaaagcccagtgctgatcaaaagaatgggtctgataagagcccggctctgcaagaacagagtctgctgagcatgtcttccaccgacctggagctgcaggccctcacaggaagcatgggtgggagaacggagttccaaaaacaagatctaggggaaccagaagaagacagacaaacaaatgacctcagtttcatccaccttacaaagcacagagaactcaagcattctggctcttggccagggcaccggtacagagatcagcaaacacaaaccagtttctccgaggagccccaaagttcgcagctgctccctggtgcaaagctgggagggccgagtcgtgcagcattgagtccaaaatgttcagaccctgctgcctccgaagctcagacgcacacagcattccctaccggtgatcacaaacagaggccaagtgcccgtaacctgaaaggtcacaggtccctcagcccatccagcaacagtgcgttctcaaggacttccttgtccgtggaccaggcaccgacgccaaaagcaggccgaagtcagccctgcgtggatgtccacgggcttggagcccaccctgggcctaagcgggaggtggtgaagggggagcccacgggcccttgcaacagtaaacaactctttgggcagtttctcctgaaaccggtcagccgtcgtccctgggatttgatcagtcagttagaaagttttaacaaggagctccaggaagaggaagaaagcagcagtagcagcagcagcagcagcagcagcagtgaggagagtgaggcggagccgcagcaggagaaccgtgctcactgcagacaggaggatgtgggcttccgcggaaacagcccggaaatgagggttgagccacagccgaggatgtgggtgccggagagccctgtgtgtaggtcgggaagaggtgagagtaagtctgagagctggagtgaggagctgcagcctggccacccacgtgcctggcctccatccccgggccgctttcgcgtggaagaaggtggcggtgcacctttctgctcagcagatggaagcacgagtgcagagaagagacacctggaggttagcaacggaatggacgagctggcaggtagcccatttcctgtgacgagaatgtcttcaagatcaagtgacgcaaaaccactgcccgcgtcctatccagctgaacctagggagccccaggaaagtccgaaaatcaccagtgctttcagctctgtgaaaccaagtgaagcggtccctcggaagtttgacagtggtggagagaggggggcagggctcccactgtccctgtctaacaagaaccgagggctctcagctccagacttacggtctgtggggctcacccctgggcaagaacagggtgccagtgagctagaggggtctttgggtgaagcaagcacaatagaaatccccccaggtgagtccttgcaagccagggctgcaagga

SEQ ID NO: 60429 - DNA, 1037 bp, Homo sapiens
tccaccagacattttaatgtttataaggaccttgacatcgctggagtacacccaacatccctgtattcttgtgggctgcccactgctgccccttcttggcccttgatgccaaaacacgtggctgtcttccaaccataattaatgggatatgttttctttcaagctggcaagtactgtggctgggaaccaagttttcaaagttgctgacctgagtttgacttcgaatgccagtcacagaagcagatgaagacatgtttcttctgtgcctaacgtctgtgactctttgttttgtaggttttgtaatcaacccccctcagcatggtcctctcatcccccgactggtaacgaccaagcctaccggagaagaggacggcaagaagccaggagccagaagccgagggagcacgaaaacctggaggccagaggaatggcccaagcccacagcctgcctgtccacgtgagggagggtccatgggaagttggaggaaggtcagagcatgtgatgaagaagccagtttgggaagaagaattgcgaatgtcaggtcctgccaagtggcagaacgtcagcctggaaagctggaaccagccaaggaaattagggaggcagatgtctgatggagatggggagagactgtttcaagacctgtacccattcattcaaggagaacatgtgttgaattctcaaaacaaagggaagtctcgctcactgcctagagttctttcccccgagagcctgagttgcacggaaattcccattccattaaatgaaagacattcacctaaaatgccaccgtatcctcccacttgcgcaccaaatttggactccacgaggaattctgagaagagtggctgctcagccccatttccccggcctaagtttgggaggcccctcaagcccccatcttacagctcgcaccagcagtctaggggaggagcggacagcagtgactctcaggacagccagcagatggacgcctatgtccccaggcatgagctctgcctgtcagaccctggattggaacctccagtgtacgtgc

SEQ ID NO: 60430 - DNA, 1011 bp, Homo sapiens
caccgaggggtttgcaggggagctcagagtgttgtatctgctgttcagtgcagttcccaaagtgtcagcaaccccagctgggaacagcagctgcccaggtaggagggaggcagaaggtgagggtcctcaggggtcccttatgggggggctgaacagtgtggggcaccagcattagcagtgtggccaccgcagtggccagccgcaggttagcacttacatattggggttacaaaagtcttacacaggtggaggaatttctctaggagtttccatgaattttttgtgacatccatgggtgccagagggcaagatctgttctttgacatttgctttccaattctcacagggacccaaagtcaaactgggcagctgtcccgtggttccgcggcctcattccatatggctttacgtttttaaagttcgcttactccaaataattaaaatgctttatagactttatgtagcagcttcgccaggaggaggctgtttcaaaggagaagtgacattcatgccgtgacttgggggaaacaggcaaggataggtattgaacggaaccttaggactttgaaatcagatgcaccatgtcttttattgctgctgtttttgtttgtttgcttgtttttgagacagagttttgttcttgttgcccagtcagctcactgcaacttctgcctcccaggttcaggcgattctcctgcctcagcctcccgagtagctggcattacaggcatgtgccaccacacccggctaattttgtatttttagtagagatggggtttctccatgttggtcaggctggtcttgaactcccgacctcaggtgatccacccgtctcggcctcccaaagtgttgggattacaggcgtgagccaccctgcccatcctattgcagctgttttgttttatgttgttgtttttaaagatagggtctcactctgtcacccaggctggagtacagtggtgtgatcatagcttactgcagcttcaagttcctgggcttaagagatcctcc

SEQ ID NO: 60431 - DNA, 1075 bp, Homo sapiens
aggctgaggcaggagaatcatttgaacctgagggttggaggttgcagtaagatgagatcactccactgcactccagcttggatgacagagtgagactctgtctcaaaaataaataaatttaattaattattagtgaaaaataaaattataggttgttacttttgcctgggtttattttgaagtgtggcacattgaaaagttactgtaatggatgctgtcaaataaaatggagcaaactaatgaaaagattccacattaagcctgcatcatgctccgtgtcactaaaattctttaacatgttaaacttgttgggtacaacggaagtcttacgtttctgaagcttttcctcttataaaattaaagcatattgacatttctctctagttctaccctgtcttgaaaactggagtaaaaggggtgggttatgaaactggctgattagcaaggaaagcaagctcactaataattgtatgaaactttactatggagaattttgaacacaggcaaaagtaaattgaaaagcgtaatgaacttggcacacatccgtcacctctttcaacaattaattcatggccaattgcttttaatttataaccccattaacttaccacttctgtattattttaagcaaattccattctgccatttcatctgtaagtatgtaatatttctaaaagataacttttgttctaatataatcacaaaatcattgtcagaccaaaatggaacaaacaaaaacagtaattctctaataatatcatcgtatttgattactgttcaagctccccattgtcttgtggatatcacgatggctttttcctagtgcaattgtttgaatcagtatccaattagagtccacatattgtgattggatggtctgtttcttaactctcttagattccaggtttatacttcatctcttttttcgcttgcaatttattgaagataggggattgtcttagggagttcctacaacatagattatgctgatgatgtcagcacatatgattgttcaacattgttcacataagctgttcaacattacttaatgacttgaaaatattttttattagtt

SEQ ID NO: 60432 - DNA, 1089 bp, Homo sapiens
agccatgattcctttcttttaaaaataacaaatttggccgggcacggtggcttatgcctgtaatcccagcactttgggaggccgaggcgggcagatcatgaggtcagaggttcaagaccagccgggtcaacatggtgaaaccctgtctctactaaaaatacaaaaattagccaggcatggtggcgagtgcctatagtcccagctactcaggaggctgaggcaggagaattgcttgaacccgggagatggaggttgcagtgagccgagatcatgccactgtactccagcctgggcaacagagcaagactccatctcagccaaaaataataataacaacaaatttgagtacttgagtataggttttatcattaagttagataaaatttggctgttaaattttccacaaaaggccagaaggtgactgtctctcatatgcctcagaagagtctttctccttagtgtttaataagaaagtaaagcttaagtagtttaaagctatcagcaggaagtaacagctcatggcttacatatgattgtatgtaaagccttattaatgaaaaattctttacatatatacttggaaaagaatgaaaacacgaccagaagtcccttttcatcttggcaaatttattttaaatacttgaaagacttatttgggtttccacaatgaattcaattacttgtggatacggattccaaagaatataaacattacagtgttcctctggaattcccatgtagcaactatcagaaagtactgtagatagaatctttaatctatagtatttgtgatacaggatatatcaaatcaccacaaattattaaaaaatgtactttatcttttaaatgtgattgctcgtgttttatgttatctgtgtgtgtatccaccccctttcggtactcagtggagtcaaagctagattaaaagcattattcatttttctaagatgaatatgttgcaaaaattttcccccatagcagagtttctaagcttctagaatgtggtgctaaggcatattttaaagagagtattaaaaaggtctaacttggccgggcgcggtggctcacgcctgtcatcctagcactttg

SEQ ID NO: 60433 - DNA, 1321 bp, Homo sapiens
cctttaccaagaagaaaagcaataagtttgcaattgaaacagtcaaaaacttgctagaatctttaaaaggtaacagaacagaaaatttcacaaaaaccagtgggaagagaacaattagtactcagacatgatggctgctacattgtgtaaagaactgggcttagcctatcaaatggtctgtggacttacttggaaaaactgatttgaaactttcacagatctcagctttcatctgatgtcacttttcatgatcttctcattggcccccttaacctggtctgaagttctgggatgttttcagtttgatcagtctgatactcagtggcactttattaaaacatcagctgtggagtgtggcggtgcacacctgtagtcccagctgctcaggaggctgaggcaggaggatctcttgagcccaggattttgaatccatcgtggacaacatagcaagattccatctctaaaaaaaatgaaaataaacataagccacaaggaatgggtgaaagattattgtaatgtgctttaactaaataggtaaatatactaaacaaatgctaaaactcagttttaggatgaaaccattgttgatatccacatcagtccctgtttagaaaacatttaaaatgacttttagttatgtacagtacgttggcaatgaatacattaagcttcaaaatttggtagtgctctcgaatatgtatatttgtatttttcaagcgaagttctcttattcacatataaattaaagtgggttggtactgatatcaaaaaatgtttatgtttttagaacagacatttcagtcactgcattcttaggtattccaaaccaaatatgatgacatcaatagattgcattttaaaaatattgtttgatttttctattttcaaaaataaaattctgtttctaactaaaatgtgatattcccagtattccttcacatctcttttgagaactcccctcttcctgcaggaaagagacatatttgtctctcagtatatgcagaaaattggttccaggaccatccacgtacacccagatctgcacacactgaactccttcagtcctgtggagcccgtgcatgggagaattccaccttgcacataagcagattttgcatcctgtgaaagtactgtattttctttctttcttttttttttttttttttttttgagacagagtctcgctctgtcgcccaggctagagtgcagtggcgcaatctcggctcactgcaagctctgcctcccaggttcacgccattctcctgcctcagcctctctgagtagctgggactataggtgcccgccaccacgcccggacaat

SEQ ID NO: 60434 - DNA, 1058 bp, Homo sapiens
tattataaattgtatagtagagcacgtaaaatgtgctattaaaatgttaaaacctagaataatttttgagaaattatgcaggtaaccaggtcttgacaaaaaaatgacaaaaaacacaaaaaatgggagataaatttataggaggcttatttatctctctggtgattataggcatttaaagtcaaatatcagggccgggcacggtggctcacgcctgtaatcctagcattttgggaggccgaggcgagtggatcacttaaggtcaggagtttgagaccagcctggccaatatagtgaaaccctgtctctaactaaaaatataaaaattagccgggtgtggtggtgttcgcctgtagttccggctactcaggaggctggggcaggagaatcacttgaagccgggacgcggaagttgcagtgagccaaggtcacgccgccactgcacttcagcctgggtgacagagccagattccatctcaaaaaaaaaattaaaatatcagcagtcatccagattattgattatatacctgctatatgctagatgctcattgggggcaggtcggtggtggggagttgggcaataatgaataggacagtggcctttgtaattcctgactggggcagaggagtggacagcatacaaacagtcacaatgcagtcagataagtcaaatggtgaatggaacaaaaaggatggaaaaccagtttggaattatgaaatgctttcagataggaagtagccattgatgagatttctgaagagtgggaatttgctcttgaaaacagcatagtatctgttgcagatagtgtgggccagggatttcatggtggttgtatatttatgaaaatgattacctcttaagatataaatactagtaggaaaggtgaatatctgagtctaacgtgctgttattgagtttgttttgctgaattactgaattccagttagtctagagtgctacattttagaaattacctgaagcttttttagttagcattcagtttgtgtcgtgtatgaagatgataagaatggaattggagatgtaaattaagtattga

SEQ ID NO: 60435 - DNA, 1819 bp, Homo sapiens
ttttgttgaaacggggtctcgccatgtttcccagactggacttgaactgggctcaggggatcctcccatcttgttctcccaaagtgttgggattacaggcgtgagccactgtgctctaccttgtaggcaggctggagtgcagtggtgcaatcttggctcactgcaactctgcctcccaggcttaagtgatcctcccacctcagcctcctcaatagctgggatatacaggcttgtgccaccactcactcagctaattttttaaaaaactttttgtagacatggtgtcttactatattgcccaggctggtctcaaactcctaggctcaagcgatccttctcagcctccccaagtgctgggattttaaatgacctgttgagtttttaattccaaatctacattaaaatacatttaaatatgttcacatcgtatagcatcaaaacaggcaaaactagcttggaattctttaatatttcacttgaaacatcaaatttgattgtttttaaatttttgcagtagtttttaaatacggtaagagaatttttcaggctagtttttgcaattgcttctcggcatatagcacattgtaggtgcgaattgccaataaatgccaagcaaaatacactttttgccttccatcacctatggtttttgaagttgctgtaaaagaacttgtcttagattaatgtatattaagaatttggtgaagatcattttgaggagaatttatcaatattttccttttccttttttttccctccaaaatccatggtttttatactttctaattttgaccagtagttcaactttggtggacattaaacctaaggaagaaaacaattttaaactgtgaaacaatcaaaaccatattgagtacttggtgtttaatcatgtaagtgacctgaatcttgtgtacaatcatttcatttcttctaagctgtacctctcatttgatatacaaataatcaatttgttcttttttaaaagaaaaaatattttatttgcttccttgcttgtttattaatagaaggcaacatgaattcctagaataccttccagaacttctaggattttgtaaactactatttagaacctaagctaagctaaagaccaaactttttcacattgtatgcagggccctttatcaccttcctttttatcctcttcttttacgttgattcctgtataccagttgggagctttagccactcttgaactccttgatgatccctgatgttttgtgctttttttcattgctccatgcttttgcctgaaatggccttctcccagcctccccctcccagccaccccgcttttttttatggagaatctcaagattaagccagagaagacagacaaacctagtacaggatctcatctgttaggtcttttcttgctgtcctctctgcttcccagtgggtagtgctttgttggtttccaagctcttggtacacacctgtattgtaacaactgttagattgttgtagttcttttatgtgcctgcctcagcattgtcaagcttttctagggctagctgtctgcttcacctctgcgtcttctgttctcggaatagtattgggttcatagtaggagttcactatgtagatttcaaaatgattggataacattttaaagttgagggctgtttgtactgggcaagatggaccatgatattaactttcatatttggttcctcttgaattgccctgtttatttgtgttttcttataatctccactgtgttctctcatatgtctcattttcttgtgttttccatgctttctggctttgctacttttgttacatttacttctgtgcttag

SEQ ID NO: 60436 - DNA, 1581 bp, Homo sapiens
gattacaggcatgagccaccgagcccggcttacattttaattatcaattttaagaggatgttttaatgggaatgaatgtatttgatattcagccattcatattaaattttatattgcaaattcataatgcttttgattacctaatgatgttctgaatacattcagatatagtaggatatttagatgtgtttcttggtttgagtttaattttacccttggtttataatttggggatttgaacatttttcttatttttattttttgaaggattgccttgacaagttccgaactcctttatatatatggtgccctagactcaagagtgagagccttggtgttcagtgtacggtgctgggctcgagcacattcactaacaagtagtattcctggtgcatggattacaaatttctcccttacaatgatggtcatcttttttctccagagaagatcaccccctattcttccaacactagattccttaaaaaccctagcaggtaagactagaaagaaacttctccattttctttttccaatgttatgagtaaatataattaccatgtgttaccaaagtcccgtctatttgtttattagtcataaaatttgtcttgacttttttttaaagtctaccggagtcacgagagcagatgatttgggaagctagggcctttagcattttttgagagttctgttttctttgtatcagttggcaaggttgtttacagcagttgtgagatagctggagcttctcccctagttgaccaagtctagaatgacctttttcagatacaacttgttcagatacaacttttgattggatcacagtctcagagatgactttcaaatctgaacttatgtttagacttgtattagagatactaaaactgcttcgtgatgtttcaaagattctaaatgtgtttttaatgaaaagcatataagcagtcttaggtgcattattttaaatttgacatactatattgtttgtattataaatgattttataaatgcctcccagattcaagtgattcttgtgcctcagccttgctgaggcctgctggagaagttatgttataaaatcttgaaactgtaaatgctaaagggaagataattaaggggtacatacacacaaatgcatactgtcttctacccgtcttacataattgctgcctgataattcgattaagtgccttcttgaatcttcctgtttaaaatgaccttaagaggcaaactatttacatagcttggtgtttaaaatctttagctctctagacacggcccagttttccatgctcttccctactcctctttatgtgtcccacattccagccagtgctgtgattacccttggaacatttcatcttagctttttgttcacactgtttttctgcctggaatctgctttctcttctcccagtctaaattatttcttccatgctaccttcctttatccatattagaagtgatctcttcctgttaacactgtaagtgttgatattgtttgaaattgaccttaaaaaaagcttgatttgtgtttacaactaattgatcacaaccagttacaaatttctgtgttccttctccact

SEQ ID NO: 60437 - DNA, 1072 bp, Homo sapiens
tatttatgattcattttatactgtagttcataagttaattacaaaaaccagtgatcgttcaagttagtgctttgtatttctctatattctggagaaacagaaggcaactggggatcttttaagtttgcttttggctgtgatttcttgaagagtttttattttgtgggttgtttttttcttattttgttttgctttccagcagtgatttagagcattcttttacaaaagcttattaaaaaattgttttttttaccaaaagctcctatttagaaatgtgtttatttttcagatctcaggaaattttctgatggaatttcaagtgaaaaatgttccttcagaaagaattgcaactcagaagatcctgtctgtgttaggagagtgccttgaccactttggccctggctgtgtgggtgtgcaaaaaatattaaatgcccggtgtccgctcgtgaggttctcacaccaggcctccggatttcagtgtgatttgactacgaacaataggtatgaccgcttacatttattattttaaatatgaatattctgatatattagcttagtgtttctcacacagaaacagtggctttgtaatcttaaacatgcttgaataataattttttaaaaatttatcacttggattgaaaagtaagtaatcttttctcttacgttatacctgttgataatttggtgttcctaaacagtgttaggatattgtgttaaaatgttcacatatctaacctctgagaagaaatgtatttcattattcttacttgtgcagcctggtagtgtgtagtgtgaaagatgcctattttttaggagaaatttctgatggcaaaaaaagaaaaaagtaaaataagaaagaaagatgcctatttatagtacaagccttctaagaatacttagaaaataaaataccaacttgaagttgacctttgaattgcctccagatatatagtcaactttgtgtactagacaaatgtcccctttacttaggtccaaaagtggttggaagagcttaagaccggatggcttttgttcagcctatgtgcattgtattatcctagtgatttgtttg

SEQ ID NO: 60438 - DNA, 1174 bp, Homo sapiens
atttgctaatgaatgaataaaagttacttacagctaggcgtggtggctcacgcctgtaatcccagcactttgggaggccaaggtgggcggatcacctgaggtcaggagttcaaggccagcctggccaatgtggtgaaaccccgtctctacaaagataacaaaaattagccgggcatgatggcgggtgcctgtaatcccagctcttcaggaggctgaggcaggagaatcgcttgaacccaggaggcggaggttgtagtgagccgagattgcgccactacactccagcctgggcgacagagcaagactaaaaaagaaggaaagttatttactaactgaaatgtagattttaatgttcataaattttttagtgtgtgtaaaagttggttacatgtgaaatatgtcacctgacttatcacaaagatcatgttagcacaaaatcctaaactaaaatctgcctttggtctttccttcagttttgctttttcttacagggttctgtatcttagaggacttaggtaataaaagtaagaattagtgcctaagtcttgagtactgctttctgttatctgaatgattgctgtggacagtgtgcttaacttctgttttttctttattagatgatttgctaataaacagatagtgctataggaatagcacacattaataggaagtatttatggatctaactgtctgtgaacagtttttctagtttttatttatttaatagaggacagtcatttttgagaatatctttcctttgctcataataagtataattttcatctaaattttccctaaaggcagtgttttatttctgtactgagtccattgtgattcttcgtggcttgcatttttggtcagtcaggttaggctagttgatgctttggtaacaaacaactcccatatctcaaagatctcagtggcttaacacatcacctatttatctgttgctgaggttatatgtcacagcaggtcagcatgggcactctagacattgtagtagctcaagcacccaggctgaccagtgtttcatctccacctgcgctaccatcactgaatagtggaaaggcaaagtgaagaattgagcatcggctcttgaagtttctgcctggaagtgacacttaaaacctctgctcacatttcactggccaaagcaaatcacatgagtttgctt

SEQ ID NO: 60439 - DNA, 2032 bp, Homo sapiens
ttgaatgcttagttcagttcagttcagttatgttacgttatgttatgttatgttaatgttatgttgttatgttaatgttatgttgttatgttatgttatgttacgttattttttgaggtggagtcttgctctgttgcccaggctggagtgcagtggtgcaatctcagctcactgtagctgcatactcctggactcaagtgacccacctcagccttctgagtagctgagactacagatgcattccaccatgcccagctagtttttgtatttttttttttggtagagtcagggtttcatcacgttgcccaggctggtctcactcctgagctcaagcgatcctcccgccttggcctcccagtagttcacaggtgtgagccactgtgcccagccagttgatattttcaatgttggtttcaaataagagcatttgaagttacgattttttttcacttcagatactccagtacacaatttcagtatgtgatcattttaatgccagtcttctagtggatagacaggattgttattctgagaaactgagaggtcttgggccttcattacttgagtatttctagtttttcttgccctttaacattggtctttcatccctttgagtttaaaatgtctaacgtggttgttttaacctcttctggagtactttactactttcattttcttaaaacaatactttatactcatcgcttacaaagttttaattctagccaactttcattttgctagtggcattcctcagagctttttaaaaattttaaaatattatataatttatttctttagtgaaatagagacgaggtcctgctgtgttgcttaggctgatctcaaactccttgcctcatatgatccgccttggccttccaaagtattgagattacaggcatgagccaccgcgcctggccttctcagtggtttttaaagagtatttttttttgagacggagtcttgttcttgttgcccaggctggagtgcaatggtgcgatcttggctcaccacaacctctgcctcctgggttcaagcgattctcctgcctcagcctcctgagtagctgggattacaggtatgcgccaccacgcccggcttattttgtatttttagtagagattgggtttctccatgttggtcaggctggtcgcgaaattccggcctcaggtgatccacctgccttggcctcccaaaatgttgggattacaggcgtgagccactgcgccaggctttgcatatttctaaggtaggtcttcaacgccaccaaatctttgaaagtaaaatggtaactttttatgcgacctgtactttttctctattttgttggttttgtttcggctagctagatagacgatcagctgaacactctcttgaaggagttccagctaacagaggagaacactaagctccgatatctcacctgttctcttattgaagacatggccgccgcgtattttccagactgcatagtcagaccctttggctcctcagtcaacacttttgggaagttaggatgtgatttggacatgtttttggatctagatgaaaccagaaacctcagcgctcacaaggtaagtctatttcttttgaccactataatcatgtaaagttaagaaagtataaaaagaaaaatctttgaacttaataaaatagaactgttgatttctaaacttattaaacattgtggttaaagaataaggtgtatttgttattgattctttggtgaagtctttctttgtattgttctactatgtgatcatttttgtgaatattctgtagatatgcaatcaaatagttaattgttttcaagtgttcagaaatttttcagttaagtcaaagttacctattgtgttattcaaattatgtatcttaactaattttttctttttaatcttgtgatctagttactgagatgtttttacatctcatgattcttggttttgttaatttctctttaaaattcttttgatttttgttttatccaaaggctatattagctacatataggtatacgatcatcatatttccttat

SEQ ID NO: 60440 - DNA, 1127 bp, Homo sapiens
taactaacattgttttaaggttccgtttctttttttttgacatggagtctcactctgttgcccaggctggagtgcagtggcatgatcttgggtcattgcaacctccgtctcttgggttcaagcgattctcctgcctcagccttccaagtagctggacttacagacacctgccaccacgcctggctaatttttgtatttttagtagaggcgaggtttcaccatgttggccaggctggtcttgaactcttgacctcaggtgatctgcccacctccatgtcccaaagtgctgggattacaagcgtgagccactgcgcccggcccagtgttccttttcttcatctacttaaattgaataaaattaatgctatgttagaatcatatcatttgtaaattttaaagacttgatattttgtagcattatgataattgttttaatatatgagctaaaatagtatgttagatatatcgtgaaatgtgttctgttttttcttatgtttttggtatagggtctctatgctgtcgtagaattttgccaaaaggaaagcataggttcactgcagaatgggactcatactccaagcacggccatggagactgcaattccattcagatcacgtttcttcaatctgaagttgaaaaaccagacttctgaacggtcacgcgtacggtcaagtaatcagttgccacgttcaaacaagcagctttttgaattactttgttatgcagaaagtgtaagtttttaggtgtacctcaacttttagaactatgtatttttttatgaacaataaagattcctgtaaaatgttcaagctacattattgtttaatgggtatagatcttcagttttacaaggtgaaaagagttacggagatgaatcgtggtggtggatgcataatgagatgaaggaaagtttttttctatttctagctttctaagaatgtcgtcatgctcaacacattgagtagatgttgagttttgacatttgagatggtattgatgactggcatatggtcttgagattgtatatggttcctaatgtctttttctttcccctcctaatgtcttaacgtagtgaattgtagattcactgtagatttcctcatgtcaagtcattcttgcattcacag

SEQ ID NO: 60441 - DNA, 1057 bp, Homo sapiens
taaggaccacttggaggaaggacagttggtagactgagatctaattgaaaagaatagcctctgccctcaatatggaagaaagtattcttccatattgttaaataaatataacactatgaattacattccttcatagttgttaaagtaaggtaatacagaggtggaagagattctgccatggagagtcagaagtcttcacagacctgagcaagatttggagggtgaatgggagtttgccagacagaaaatgagaaggtagacattccaaccagaaggaagaagacatagatagttcatagcatgtgatagtattgtgtgtgtagagtaccatatgtgaaaagtacaacagaaagaaatggtataagtgacatgaaagaggggagatgggacatggtgcaagcactttatacccatgctatggagttgagatgtgatcctaaaggcagtggggaaaccattaaaggatttaagcaggtaagccaaagaataagacttaaaaaaaaaagaccattttataaagaacactttggcagttatgtggaggatagcttgagaaaaacaaaactagggtgaatgagactagtttaggagtcagattattgtgatacaggcctgaaataagagattgatgttaaagaattgtcattgggaatggaggcgaaggcacatagttaaaagctgtattttcaggcttggcgtggtggcgtcatgcctgtaatttcagcactttgggagtccaaggagggaggactgcttgaggtcagcagttcaagaccagcctgaccaacgtagtgaaaccccatctctactaaacatacaaaaattagctgggcgtggtggcgcacgcctgtaataccggctactggggaggttgaggcatgagaatcgcttgaacctgggaggcggagattgcagtgagctggggttgtgccactgcactccagcctgggtgacagagggagaccttgtctctttaaaaaaaaaaagaaaaaagatagtaagatagtgggtttggagtatttccttgatccatcagtttcatagccttttggaagaa

SEQ ID NO: 60442 - DNA, 1035 bp, Homo sapiens
gtggcacataactgtagtcccagctacttaggaggctgaggttggaggattgcttgagcccaggaagtcgaggcggcagtgagccaagatcatgatgccactgcactccagcctgggtgacagagcgagaccctgtctcaaaaaaaaaaaaaaaaaaaaaagtataaagtggaagcatctgtatgcatgattgaagtcatgctttccatatattttttccactttgccttttttctgtctaaaacactgtatcttaagcttttccctatgttattaagtactcataagcattattttaatggttgtatcagaaaccattatctggactcattatcatttatccatctgcagttgctggagatactgccgtttctgccacactcagtcaccttgactgaccttgctctgtgtccagttatctactaatacacatactggtcatttaggagttaaagttaagaataaacagttatcatagttcctaacacttcaaaaagaatgtatcttcctaaaaatagaatgacttggtggttaagataattttaaagtaaaatagataaatcggtattgaaattaacattttgctttcttcttgtatctattcttcatttctctgtcattttgatggataaagtttcatttggagggatttttatttcaaaatagaaatagcatatgacatgagaatgggaactctgaaaggttcaactttctagtcattagtttcctaagattttcacaaaagctaccgatagccaatcatgattggcctgtattgaaagtgagttgacattacatacaacttatgcatatactttctatcagatatagaaaaataggtggtgtgtttggaaaagtattgggctaggagtcaggaagcttgactgttgactgttggtcccaaccctaggcttgttcagctgagcacccctagacagtaattcagcagctatttcttaaatacctaatgagtttcagactttgtagttgggctgggaatatagacagtcatgcattcatgattctccaagcctc

SEQ ID NO: 60443 - DNA, 1462 bp, Homo sapiens
agaacgtaatttgaattggtaaatgctggattagtaaaaactaaaaatcaatccgctatttatgtctctaacataatggcccttaataggcaaccacttttcatgagtcttgtttcagacatcccagactccatttcccagagaagcggagaatgaatgggtgctgtatgttcactgccgggtgtccgagaagctgcacaggaagtgtcttaacgtgaagagagtccacactggacaccggcacaaagggcagagtgaagggacgaagtgtcagatgcgtctctgccaccagcacacgtttcagcggtgctagatttgactaggcacaggactctaaactggtggtttgctgactattaacctccacggtattgctatctcatgctccttgaccccttcctaattttgctgtggttcggcagctccagtccactgttgaaatgctggtagatttcaaaactccgttgggacatattaaattctggtgagccagtgggtgggatgccttctgaatgacaaaggggccccgtggctaaaagctgaaggaaattcatgcaatgatgaatgtgctgcaattaatcaccagagatctgttcttttccttatatgcgtagtatagtgcagggtccagggttggggagagtctctgagtccagatcttcatagaattaaaaataatgaatatttgtaatcaggcatcgcttgaccaacaactccgcctccttagttggaaatacagacgtccacttttcgctagtgtgtaattattttctggaatgctgagaattgttcccctgacctatggctcttttttaagcatctgggatatgcagtcaatttgcaggttgctattttgaagtcagggagcctcagagaatcgaatatatgccacataagttcctgcaagatggactttctgggagtcctctgatgaggttgggagaaggcaaagaggagatgtttccatgtaaaggctgagcaagctccaggccactgcagaagttcagctttcttcagctctgtaagctggaccctgtggctggagtctggccaactgcagggacaagtttctattattatgtaaatggagtcccagtgcggccttggaagagtttttggcacagggtaaccctttgtctgccaaaaggtagcctctccctttgcttcaagcccagagtgtgcattttgcagtggtgacctgtaagccaccggtcaacctgcagattgccttattaggcagactgcggaggctggtggctggggactggctggcagaggcggtggcagtgagcttgtgtcctgtacgaagccggagaaccccagccccggagacgtggcctagtacttactgttctataaatgatagtcctccgtggtgacaggaatatacactctccttggcaggcatactttatgggttggttggagaacaggaggtttgcagggggaggtgactgtccga

SEQ ID NO: 60444 - DNA, 1107 bp, Homo sapiens
tactttaaacagaactgacctatgtctttttttctgacaatcagttctccaccctttcttcctctgaggtacctgcatttttctccccaagaatcattagtcatagatttggaatgaaccagaaactaaaacgattggagataatttcattacaaatgttaacattactcttttgaacatttattttaaagacactaataaagtcttttaggtgattgcaataagccttttctttgaaaaagaattctgaagtatagaaaggctggcaccgttttctttcaacgcatctgataaagaaaaaatagttgtgacttgtaatatttcttattaaatgtacttttgccttttcatctctacctacgtggtctgttttaaattaccttatgcagtgatgtaacgcaacattttatttgcaggcttgtccaaaatattaccactaaccaaaattcacagagcatttcacagtgcacgcaggaggagaattagactaaaatgaggaatctggaaagtctgaccgaccagtgagatgtgatcaaagagaaatgaaagggcctaagtgggctttccatgggggattgcctcaggtcaggcagttctgcctccgattaaggatctacacacataaagaaaattcaacaaagaaaatgagaataccatttatggctgttgctagtgtacaaaattctcctttactgggctatgaaaatatatccttcactttggaatttcagtccagctgtggtctttagtggcgtatagtagatttcattaaactcacttccatggcactttttaattttggaagtgtatcagtaactcacaacagtatgtactcagacaactgcaggtcgtaatatcacactcccctgtactgtccacttaaattccagctcatagccgggcacagtggctcatgtctgtaatcccagcagtttaggactctgagataggaggatcacttgaggccaggagtttgagaccagcctgggcaacatggcaagatcccatacttgtttttttttgtttgtttttgtttttttgttgttttttttttgagacagagtttcactcttgttgcccaggctggagtgcaatggcgcgatctcg

SEQ ID NO: 60445 - DNA, 1035 bp, Homo sapiens
caacactccctcttttctttttgttgctaattatctatgaccttaccatcaagtttctaatttagttatccatggtactgacattgttccttgctgaattttttttaactatcctatttgccatactttttcctgaccttgtgactataatgtaatgaggagtttagagaaaaataccaaatgctatcactgacacctcttgtacccagggttgatgtaccttgtgtttatgtgtctttattaattcagcatataattcttcattttcaccttaagtgtgtttgtattttacaaattagtctaagtccacctggtttgaacacacgatactaactccacacacccattttagaaggagatgtctagtttttagaagagattatcttgtgatttcctgtggtcattcagcaaacatttcctgcagccctactgtgcaccaggtacagtgtccagaactaaagatacaaagacaaactcagagtccctgctcctaggtggggtgtggtgaatcacagtcttgatcccacctccccaagatcccatagctccatcaccaaacagttgtctatccaggagccagttacctttctagccctatttccttagcttgcaaatgagattatttcccttggttttcttgaatgttccatttctctgtaaatatggtcagtctgtaattattgcgaatttttcttggaattgcatgagcattgcttgggcccaccgactacatattgtggttaaaattaaacagggggcagtctaacaggtgaagcttaacttaatggcttctgcctcaaattaaaattttggggccagtcgcggtggctcatgcctgtaatcccagcactttgggaggccaagacaggcagatcacctgaggtcaggagttcaagaccagcctgaccaacatggcaaaaccccgtttctactaaaaatacaaaaaaactagctgggcgtggtggcaggtgcctgtaatcccagctacttgggaggctgaggcaggagaatcacttgaactggggaggctgaggt

SEQ ID NO: 60446 - DNA, 1036 bp, Homo sapiens
ttgagactagcttggtcaacatggtgaaacccggtctgtaccaaaaaatacaaaaatttgccaggtgtggtggtgcatgcctataatcccagctactcgggaggctgaagtgggaggattgcttgaggtcgaggctgcagtgagccatgatcacatcagtgtactccagcctgggcaacaaagcaagaaggaaagaaagaaagaaaggggaagggagggaagggaagggaaggccagagtaactcattttaacagagagagaaaaatgaaatgaagcaaagtctcaaagaagtggtttggcaggattctctgttacaactaactttcggttttgtatttattttcaccaaatagttattttcaattccaaccccatttcggcttagttggcattaagacatacacggtgaccccgcaacttttgtgaagatagttttccagcgaatcagaccttttcgaagaagaaaaaactcttcatagacttggccattaaaaccctgtgtctgtttctgagttccagagggaactggatatcccactgtgcttcagcagctgtgaggtcagtgtccatgacagccccagaacaagtccctgaaattttaagaaaggtgaatctgcacatttatattctcagtgtctgctgccattgaaattccagatcataattcaggagaatgaagtcactttaaagtgcgaggatgggagggagagaaaggctgagggaatgctctctaaactccagatgatcattctgcggtcagggaatgagttggcctgaggttcacatcaccctattgtgtgagcacgtgcatgctgctgtttgaacccaggcacaaaatacttgaaggtgattgcgatgccctgaccaggctcttctcttccagtactctgccatgttccctgtttgttttaacctgcaggaagaaggaggagttgcggatgatagtgccatttctaatctgctttgggtaagcctgactctaacacaggtgtcctctcgatggtggccagaattacacttcgcgtgggtaatcct

SEQ ID NO: 60447 - DNA, 1046 bp, Homo sapiens
tgttaatctggttgtttgttttcctatggttgagttttaagagttatttgcatattttgggtaacagtcctttatcagacatgtcttttgcaaatattttctcccattcgtagtttgtcttctcattcttttaacagtgtcttttacagaagtttttaatttcagtgaagtccagcttgttagttatttctttcaaggatattgcctttgctgttacatctaaaaactaatcatcaaacccaaaataatctaaatattctcctacgttatcttctaggagtgttatagttttgaattttacagttaggtctttgtgatccattttgagttaatttttgtgaatggtggaagatttgtacctggatcttttttttttttttcacatgtgagtgtctagttattccagcacccatttgttgaaagcagtatcttttcttcattctattgcttttgctccttgtcaaagatcagttgactatatttatatgaatctactattgagctctctatttcattgatctatttgtttattcttttactagtaccacacaatcttgattactgaggctttatagtaagtcttgaagttgagtggtgttggtcctccaacttttttcttccccttcagtgttgtgtttgctattctgggtcttttgactctccatgtaaactttatgatcagtttgtcaatatgttcaaaatattttgcagggactttggaactgcattgaatttatagatcgagttgggaaaaactgacatcttgacaaaattgagtcttcttatccatgaacatggaatatctctccatatattgttaagtttaagagaaaataacatttgccaaagacatttatgtttcatcacttcaaaattaaaatttcaaaaaattctatatttttacttctgaccagtttttcccagctgaatgtaaatattttatatactaagtatgtagcactagctcatctgtgttctcagaggtcaagtcactccttttctttcctccagcagtactggtgtcttcatacttaataatacagagg

SEQ ID NO: 60448 - DNA, 1829 bp, Homo sapiens
ccttcttttcatcttaggagctggtagatggtgacaggactggaaaacaattacttcaaggtctgagcctagacccgtgatcttcatctcttgttcaggctatttgaggctgcatgcagtgacaagggactgaaatttctcttaaggaaggggcaaagctaaatttctttcacagtgtgtagaaatcgaaatgatgctagcgtttttgaaaactgaaaagtacaactttattactttgaccttttttctattgcttaatacgtgctcttataatttcttcctttatagtttagtttaactagatgtgaataagataaaaatttaaaagccagatcacagtattttcttcccatgaagctctccggttgtggaggagttttacccttaaatctaccctaatccttataatacgacttagttgtgctctctcttgttggatcacatccctgtgtgagaaacattaagtgagatttgctatgatttctcagtcgatgtataaagacagaagcaaacccatcagcaacatcatgcaacctaaaagcattcatgttaattcattctttgcatagtttccagctgtgacttaccaagtctctgaccatctttaaaagaagaccgtcctttctacctgtttcactaccttctatacacacacacacacacacacacatgtgcatacacatacacaaatactcattttctcctccaccctctccctctgcctctccccaccacattcatgggatctatctttgaaagaataaaggacagatggggtagaggtttctgttcagattcttctccaattctctcttacgattccagtcaacactcaacttgtatcggctaaacctgggaaatgctacagtacttattaatgtacatatgtccttctctaaacaaggaaagaaaaaattaaaaggaaaaaacaagacaataatgaagaagctgagaaaaagcaaacggacaaagatatccatcttctttgttttcacactttgagttcaaaatagaagagcaacttgtgatagatttttgttaaattctttggagtataaacagcctatatattatttacctccttatagagccatgtaaagtcagatagcaggaattggggagccataagccaaccctactaagtagcaatgttaagtagaaatttttagagaagcaaaaacgtttatgtttaatattatcatttagcagagattacaaattatttgttcttgacctagatctggcaaagaaatggaagctttaaattctaagaaggtcatattgtcccagggttcatatccatcatgtgcatgaagggctctgggggaatcccagtgctttgaaaaacaaaattgttgactcaaggccaccatctttctgagtcaccatccacacccactaccccaccccggactgtcgagatgcctgagataattcaccgcagagttgactaagtgaatagtgagtcaccatagtgatggctggacctttggagacgccaactttcttggcacttgatgtgtttcttggaaatatttgaacccaagtgccatcttggtttgattaaaattcactcctgaaacttcattttcaaagaaaacatattctctttgttgaattttgatgaggtcttttgggcaagtgaacctcatcgtttatttaaaaaggatacgtgattcagagagttacttggaattaggagcttctcgccaatcataagcagaaaagttagggttttaaaaaaatcagtaaatcttaattttgataaaatgttaaacttatagaaaaatttccattataggcagagcactttcgtaccctttaccaga

SEQ ID NO: 60449 - DNA, 1026 bp, Homo sapiens
cctgtctctaactgggcaagttcctcgtgtgctcacatggataaagttttctagatcaatcatgttctttgtgagtatatagggataaaaatctcccagttaactgagtttaactagatgggttaagacagagaaactttaaaaccctgtagagtccagggcatgaaaacaatctatttttaattgtttgtgtttacaaagaattgttctggtgctccagtgccccaaaccggtaagtcacaggacagaggcgttcatctaaagttacagcatcgccaatggtgatctcccacccaacctgcacgtaaggaagctgagcccatttcagatagaacatttttgaacatctttggacaatatacttactcctctttgtctacctgcttttttcacgcatgaaatgctgcaggctgagatccacaccgctgtcatttctctctcctgttttctcttctgtacatttatgaacagcgggtcacagaaagtcgagagagccaaatgatgattgaggagaggaagcagctcatcactgtgagagaggaggcctggaagacgagaggcagaggagcggccaacgactcgacccagttcactgtggctggcaggatggtgaagaaaggtcagttgtgtgtgtgtgcctgtgtatgtgtgtggtgtgtgcacaatgcacacatgtgagcacactcacccatggagggcatggtggtacacgatagctcaatttaaaagaagaaaccatggtctctttaattttttttttttttttaagatacaaggtcttgccctgttgcctaggctggagtgcagtggctcagtcatggctcactgcagccccaaactcatgggctgaagcaatcttcccacctcagcttctctagttgctgggactacaggtgtgcaacaccatgcctggctttttaaaacttttatgtagaaatggggtgtcactgtgtttcccaggctggtctcaaactcctgggcttaagtgatccttccgcctcagtctcccaagtagctaggactaca

SEQ ID NO: 60450 - DNA, 1039 bp, Homo sapiens
gaagtttgtctcctcttccttttatattaattcctgggtccttctccatcaaacctgatttctctgactgaccaaagtcaatcctggatatgctttaatagatgtctaaaatatgtcctcagttccaaggcagtgggatgtctctggggcagtccattctttgctgctgagctcttggaactgatttgttgtctgtattcaaacatttatgaaattgacttacatatgaaatacttagtaaagtcatctgagagctttaagtcttcataggagtgtttggggctttgtttcatgtcctgcaggaaatcgttaaaatttggggtccctttgtcacctatatgcacataccatcattttctaagctattatttaaaagcagatttcccaacttagtggtaaacattttcacattcactttgtcttaacatcttgtcatcaactttataggcttagctttcctttttctcagaacctttaggggtccatgctttcatgaatagtacctaattcattataggtacataataaatgtttgcagaaggaaaggaggggaaatccctgaattgtaaataactcaaatcttagtggggaatcccttccaatacatctcttcagcctcatcttggaattgtgaaaagatgagagaagataatttactcttacagtaaattatttgccaattttctgcatcagatcacagaactggacactcatgtttaaactcctttaacgtgagccccaacccttctttaacagaagcacgtcgttaggtgcagggtgactaagtagaactggaactgagaacctgaaccagacctcaggttttccaacttctagcccagactttcatcttgatgactttctgctttggtttcttttttcctcttccatcttaaaaatctgaatttatttgtaagtgggttcttactaccaaatgccactgcccttgtccacattgacatcagaggatatagatttgctcttattcaggtttgtggaagcaacagttcccatttctcggtggatgagttcgctttca

SEQ ID NO: 60451 - DNA, 1035 bp, Homo sapiens
acctgccctgctctgtggtttcttctgaaaggttgaccctccttgggttactgtctgtgtcatgtccccaaggccactgtccctccctcccctcagcctggaggagagctccagtgtggggggccacttgctggcaagtgtgacacagttcattctgcagatggcaccaatgcactctcagctgcccccaccatctccaaagggcctcagaactcacagctgcatttgctcaagtctacgtgtcatggacatgttttcccacatctccaccgttcattttggattatcagctcgtcagccactacagtccttggaaataataaaatcctgtctacatctgcagttggttgtcccacagtcgtggtacgtgtgaaatgtgtgtgtgtgtgcctgcatgtgtgtaaattcttatatgttgtgccgtctaccctgggactcctggagatcggtcagggtcccggagatttccagaagtgaccctgagatgctcagtagctcgtctgtgtgttccacaggtttggcgtcacctactgccataaccccagtagcctcagccatttgcggtaaaacaagaggcaccacacccgtttccaaacccctggaaggtaagtcgccaaggcctcggccacgccaagcctgatcagaagaggccttagtgatgctgtctcactgacggtttctgcttgcctagatatcgaagccagaccagatacgcagttagaatgggacctgaagctggacaggctggaaacctttctaagaagactgaataacaaaaacatacctaccggaagccagaaggctttgctctcagaatctctaaatcctaattctgattgcttttcttcctcagctaaattgttttctttctattatggctttcctaattcatactgtaatcaccgcctttgttgttatcttcaaaaaatgaagttttggtcaagaccgattagactatcaagccctaattcatttgataacatactaaattggggactcccaatatcacatttgttcttgaatctaagcccttgg

SEQ ID NO: 60452 - DNA, 1047 bp, Homo sapiens
gtgggaagcaaccgcaggaccttgtatatcacaaccgtatttcttccactcctggaacttaggaggaaatagaatttttaaactattggtgaagcataattggagtccttgtttttataaaactcttacgtcatttgcttgtttgttgatagttggcgggatgcacgaaacggtgctcactgtcaccggcaaatctgtgaaggagctgatgaagccggatgatgacgaaacctttgcccaattttaccgcaacgtggattgtaatatgctgagaagtcctgtggagctggacgaggacttcgatgtcattttcgatccttatgcacccaagtgagttatttgggtctccgtctttcctccactgagaagggcttccttcgcctgcagagggcacatccatgaggctcttcccccagtgtggcctccttctctttctaactccatcacagccgcgttagtattctagagccagggcaccgtgttgcaggagccaggggcacggagcctcgcagcagataaaacatgcagacggcagaccagatgtgcatgcaggcagaccgcgtgggccacagatgcttgtcctgtgccataaagagtcaatgaatttttcacataatttgaataccgttttgcagtttttatgtttatatcacttagcagagagttcaacacctgtctttcatttgacatatttcttactcataactttgcaaaatatttggatgagatgggctcaaattagtacagctcactagaaaatcagtaaggcatgttacttagcttccaatcatttacaaaatcaatagatctgcgggttttctcagtgatgactaagggtttctcttcccacgggatcatgactaaaccaactaggaaaagcgataatggtattaggatcccgtcaatttcaagtgccagaaaaccatcccagttcaaaccgacttcagccaaaaagaaaaatgagaggggtttactggctcacttgccgaacagtgcgggggcaggtttccgggctcattcgctggaaagtgctggggggcaggtttc

SEQ ID NO: 60453 - DNA, 1046 bp, Homo sapiens
attccgctccagtgcccttcctgtccgtagcaagggagattccaaagacaaaccaggggtctctgggccatgaggaggagactcggctgcctcctggtggccactgtatagatgaatccttgagatgagaatgaaggaaatatcctctccctccaggagggtttcccacatgtttctgtgtaaccactatcctattgtgtgtatttaaaaagactagtgagaagctcacataaccaatctctgtcctgagtcctaacccagagactacatgatcagtgtaattgtggaaagctcaaaatcaacaaatatttaggaaaaggtgttgaaagccacagaaggtggcgcctccatccttcctgttgagaggcccctagggttcatagtggaaactccccaggggaagatcggacccttcctgaaggcatggcttcccttgcctgggccacagatgtaattgggtgcaggaggtggccaggggagagaaaggccccgggagaagagtgaaggagggaaaaggagcctgtgtgctcatctccctggaagagggagccttcattaacccacgcacatgacactgataatggtcctgataagtgggtgacatttgggaaagcacaaaccaggaaagcagccgctagtgccatcatcatgccctttctaaatccccctgctgccaccctgggccatgggcactcttattagcagacaagactctagaagtgaaagcgtccgcagcagggatgcttccgatatggggtgcgtcctatccccgttctgtctggaaagacggtgagtgtctgcctcgtgttcaggaagaagacacgtgcagaccaggctggtggaacctcgagcttcggcgctcaatagtggggactgcttcctcctgctctctccccactgctgcttcctgtgggtaggagagttcgcaaacgccatagaaaaggcgaaggttggtacctgaaaaataaaaacgctttagctaacatctcctttacacaccggtggagtgttcttcctggcgtcagtcacaaagcttctcaaaagcc

SEQ ID NO: 60454 - DNA, 1634 bp, Homo sapiens
agaagacaccattggaccatgagtgcctggggtatatgaagtggcctctgtgtatatattaagtgaatgaacgagcacatgagagggggaggaataggggagagaggcaggaagtcgacaggaagatgtacctaaagaactcttgtgaatcgcaagttgtaagcaggttgagagttcagaggagggaacattatcctggccacttaggacactgggaggaggaatcgtgcccacagggcagaggctggctcggtggggcagtgccagctgagatctcctggcctttttgtgtctgtgctggtcaccccattaggatttctgtcttcctccgtttgactcactgtcaacagagaccctgttgcacctgattcaactgttgcatgttcttgaagttaacaaattcttttgtgccatttctcccaggtactggtgtttgattttggtagtgaagtttacgtatggcatgggaaagaagtcacgttagcacaacgaaaaatagaatttcagctggcaaagcacttatggaatggaacctttgactatgagaactgtgacattaatcccctggatcctggagaatgcaatccgcttatccgcaggtactactgcccccaccttgggacggctccctgagcgagctgattcccttcgatccctctgttctcaccacagtcctctactctcgctctttatagggttcagttttcataaacgattatatgcagtggactgtgaatattcacaaaaggaacagttctttaacttttatctaactattatagaaatatggatgctgtcgtcttccagaagaggtttgttatagttgatttcttgaagtgagcaagaaatgctgcaagttcctccctgcggcattccaagtgctgctgtggcagatgaacagcaattgtttaaacaaattacatgcggatctgaaaggcttccccgggtctggaattcagccattgatctgaaagtgcaaaagcaacatgcctccctctaatttcataccttcccagcatcgccctcgaattccaggatttatttggcagcagatgatgtttatgtctttataccttttgggaagggaagagggagaggagatggtattaaaacaatgattgcaattgtaatattccctgcaggtactagactctttaaagttatttttgaaattgaatagaatatgtgcaaactctaaaattgtgattatgagaaaaaaattcttacatgcaaaggattgttgttgtctttttaactatcagaccaaaaaaagtagtgctttttaactatgggtgctgttacaatagatgagaaaccaatgaaccaacaaacagcatagaatattgggcatcacacaactacattttaatgttttccattgaactggtatatgaatttcaactttcctgcctagtttcctgctttaaaatccaattattgattttcttattaattattatagaaatcattaaaattatgtcagtgtggtaagaagttttaatgtccttgttaagcaaatgcactaatgtttaacctcagtatggtaacaactgttgttttaaggactggaactacaacagctcaaaagattttatttggtatagcagagaaaaaaaaacaagctaaagcataaa

SEQ ID NO: 60455 - DNA, 1066 bp, Homo sapiens
tttatttatttatttatttatttatttatttatttatttattttgagacagagtctcgctctgttgcccaggctggagtgcagtggcatgatctcggctcactgcaagctccacctactgggttcacatcattctcctgcctcagcctcctgagtagctgagactacaggtgcccaccaccatgcccggctaattttttgtatttttagagaagtgaggtttcaccgtgttagccaggatggtctcaatctcctgacctggtgatccgcctgcctcggcctcccaaagtgctgggattacaggcataagccaccgcgcccggccctatttattttttttgagacaggttctcactctgttgcccaggctggagtgcagtggcgcaacctcggctcactgcaacctctgtctcctgggttcaagcaattctccctgccttggcctcccaaatagctgggattacaggcccccgccaccacaccccattaatttttgtattacactttaaattaggcaactgatcaaggctgtgaaaagaatgaccccataagttcttcacactgaaaattgaatatttacattgataaaattaaaaataaatacacataagaaaaattaatttgtatataggactacatttcaatacatgcaggaaaactgtaaggaaaattagtgaaatgcccattttgtaaaatatctttaaagaaataaaagtctaggcttacatctgtaatccctgagttttgggaagctgaggtgggaggatcacttaaggccaggtgttcaagactaccctgggcagcacagtaaaaccccatctgtacaaaaaattaaaaaatcagcccagtatagtggcatctgcctgtagtcccagcgctttgggaggctgagccaggaggatcacttgagcccaggagttcaaggctgcagtgagctatggttataccactacactccagcctgagcagtagagcaagaccctgtctctaaaataaaaatacttttaaaaagagatacagttgtattttgggtatatacggtcaagtctgtttagaatgttaggacg

SEQ ID NO: 60456 - DNA, 1052 bp, Homo sapiens
gggactacaggagcgcaccaccacacgtggctaatttttgtatttttagtagagaggggattttaccatgttggccagactgatcttgaatttaaccccctggcttaaattccacttgcttgacttgtaccttgtaatccgcccacctcagcctcccaaggtgctgggattacaggcctgagccaccgtgcctggccgagtctctcaattcttagtcacttgtcagccttacagttaagtttgccatttcctagacaagtcttctgcaagtagaaaagttttcttatacagttcttctaccacttttctcaactctgtcataacatttgtgttatttaaaggtagttttcaaattgtgagtgttatttctatttcataaaagtaagaagtcggggtggagagagcaaatggtttgacgcagacacacaggcggccccctctggacccactgcagttagctggacatgtgctgtacagctactactaatttcccaaatctttacatgatttgactgcacaaccacagccattactgtctatcatgtgaattcatatttgaatcttttttaaaaacccctagattttctgattcaataaaaaatggttatgatactgtctaaaaaatgtattctatgtcttgcagacataaaagtgtatacttacagcttacagacctaacattttggtatttgtgaataagaatattagaactcaagtaaggcatacttagggaggagctagttaatactcatatcattcttaaagtttgaggaaaagaccttacttattttggacttagtatcaattaggtcttttataaagttcttgatgaattttctatctttagtaggatttaaagcgtcctggcatgtagtaggctctcaaaatgcatattaaattatgtataaaatgctttaaactctcaaacagtttttataaatcaatcacacctgttgctgtgaaaatattgtcatctttttttttaatgaaacaccaaagtggatggaattctaaggccaatgaaagcaaatgttcatttaacaagtatttat

SEQ ID NO: 60457 - DNA, 1122 bp, Homo sapiens
tattcactggcagttaactggcactaacagatatcagtaaaattaaaaagtgttggctttattgaagcaaaataacacaagtattttagtgagtagaagaatatatgcatatatattcacacacacatctgtagacatacacttagaggatatagaatttgtgtatacatttctttgcctgtttcccctgatatccatttaaaaagaaatagaaaaactattttactttttgcaatgtataaaaaataaaataatgattttttaacaggcacttctggaccttccagaagaacctgtacctccagatggaggtagagtcctttcttcatcaagagtaattaaattaccctcaccataaagggtacactctaaccccggggagaaataccagtctttccctgccccatctagtctcttccacacagaagagaagttctgacatgtatgagaaaaaagacatatctttaatgaggcaaaattaggttgccttagtggaacatgtagcttttagtgaaaggagggaatttgttatgaaggacccttaaatagagcaaacaccctttgatctctctaccagtgagaaaggtagtatcataactcttgagcacatggaatctggatttgaaactcagtcctaccacttaactgtaaaactttaggtgtatcacttgacctcagcttccacatctgtaaatctataaaatgaagataataagttccactctataggatatgtggagactaaaggaaatagcatatgtaaatcacctagcatattgttgtttgcatagtaggcacttatatgatgataaaactaccattctcaatggctattattaatatctgggacatcctcatctttgagactggtcagtgagatggccatgaggccgcctcttgcctgggatgcctaatggccttggaaggccaaacatgctccaaggggacccatggggagtaagcaggaattagaccgcttggtttgattcttacccaggagttgatccgaagagagagtgagagtccttgagactcacacaaaatccagccgggaacactagggcaagaaaggagatgggcaaaccccaactagaaataaagagcatgtgtttttcttgagtg

SEQ ID NO: 60458 - DNA, 1036 bp, Homo sapiens
ctgcctcagtcatgcaagaaagtacctagaactacagatgtgtgctaccgtgcccagctaatttttaattttttttttctggagcagggtcttgctttgttgcccaggctgatctaaaactcctggcctcaagctgtcctcccttctcagtctcccaaagtgttagaaacacaggcatgagccattgtgtctagccaacaaatttttttaatgaccctaattaaacatgttcaattttttatgccaaaagaaaatagatgtactatagtttagaatgtaacatttgtgtacaatttttaaggaaaaaaataagatcaagaaatttaaagtttccatgggccacttagggttatgtctttagtcttcccaggattatttggtccctcagctctgaattaggactactttgatggaaaaggttagaactacctatttaagttgtcagatttgtaattctgtattttggttttgttcagtggagctattataacatttttattcagcatggaataggaactggccatgggttggtctctgaatcatcaggcttttctggttaaaggtaaacatataagtattttttcttttagccatgtttaattttgaaaaatgtcattaaagtaagcattgctgcattataaaaatgattgacaagtccgggcactgtggctcatttctgtaataccagcactttgggaggccaaggcaggtggatcacgaggtcaggagttcaagaccagcctggccgatatggtgaaaccccatctctactaaaaatacaaaaattagccggttgtcatggcaggcacctgtaatcccagctactcaggaggctgaggcaggagaatcgcttgaacttgggaggtggaggttgcagtgagccgagattgagccactgcactccagcctgctgggtgacagagtgagactccatctcaaaaaaaaaaaaaaaaaaaaagaattgataagaaccaggtgatggcctagctgttggagcagtactcaaaaacaaggttgtcctaggccacaaagtaag

SEQ ID NO: 60459 - DNA, 1048 bp, Homo sapiens
gaaatagagttattactctcattttatagaaaaagaagttggtttagagatattaaataacctattcagtgccacccaactcataatgtagtttggctgtttccactgagctattctgtgtcttcagatattctccaataaataaatctgacaatttctggataaattcacagaatctttgcctaacttaattaggtttcttgaaactcatgttgccacttgaatcattggtaattcagtgtttgtaagcctattctaatttgacttaagtagaaacttacctgagttttggtaaaccatacttgctgggtaggggagaaccgtgcttgcagaagacagtcctttaaacaggcagagacgtttttatgtagggttttgaggaagcacagagtttgagattggctgattttgaaaagtgcaaaaatttaaggattagccagctttaaacttagagtttagagactgaccggctttgaggagcaaaggtactgaagcggggcagttgctgattggcttactttgttggcaaagtgcttaagtggaaaggttgagtagactttaaggatggattgactggggtagatttaaaactggttttgtggttacttgtttccagcttaggactagagccaaagaacaatcttttcctttcttgaagttgaagaatacgtactttttatgtcaaacatgttgatgttagctatggcgctaatataacatacttttgattttgcttttcttctgaaacttaaaagaaaaatggatgtacaaatatcacttgttttctgtctatcaatttcaggacaatatatttggaacccaggctgcctcaaggattatttttatatgtagttcaagaggtaatatattatttgtggaaatatattaatgctttaaaaattatggtgaaggctgtgctgtctatggtgaaggttatgtctattttttttctcttttgggagtgtgttatattatgtgcctgccacaattagtcttgatagatgccgaattatagatctagaagtctgttgtttttgctgttattaga

SEQ ID NO: 60460 - DNA, 1112 bp, Homo sapiens
ttgtgtccatgggtagaaaaaaagacatggaaagaaagacagcaatgccttttgtattagtctgttttcatgctgctgataaagacatacctgagacagggtaatttacaaagaaaaataggtttagtggactcacagttccacctagctggggaggcctcactatcatggtggaaggtgaaaggcacatcttacatggtggcaggcaagagacaatgaaagccaagtgaaagggaaacctcttataaaaccatcaaatctcgttagacttactcactaccatgagaacagtatcggggaaacccatgattttattaactcccattgggtccctcccacaacacatgggaataatgggagctactattcaagatgagacttgggtgaggacacagccaaaccatatcaccttctctggcagtgtggcagaacagaaagaccatggactgaaagccaggcaaagcaggttccagccctgccccttacttgctggctgtgtcaccttgtctaagtaatgtaacctctttgacctcagtttcctcatctgtaaaatgaggataatactagcctgtttaattggatcatgaatagtgatacaactagctattatttattgagcacttactatgtagagtatttggccccagcgctttatgtgttataactcacttaatattctcaaacacactaagagataggttctattgtgatcctgaagaacctgcggcacagtaatagccataaagggagccattatgatcaattatcatgatggtgctaatattgttgtgacagcactgacagctaacaatgaaaggaagtaaaacaggaatttcttcacttaaaaatatcataaaagcaagatttatatgaaaaaatactgagtaggggaaagacacatcattctttagatttacacttgaattttaaccccatgtgtctttctccagattgaaagggactagcacaccaaacaagaaaagacccatcccaagtcacagcatcaaggaaatttaggtacaccaaaaagcagacaagatcccagagtcttcccaaaatggataaacaaaccaagaaaagctgcttacatacaaagagatgtcaaatagcat

SEQ ID NO: 60461 - DNA, 1040 bp, Homo sapiens
gcgtgggactgatggtagccctgcctccaggaagcaggcaggcggggacctctgggcgctcggaggggcagctccgagggcacagggtacagggagaatcagccagatccctccctgccccgggcagccgcggcgggtgtggccagcgcggaggcaggacgccgccgagcctccaactttacctttccaactccgacagcccgtcgcctttctgaccgcgtccctacggtttcccggcatccgcctccctctccccaccacacctgaggaaaacttttccctcgcccctcaattcaaattcagcagtgcccacggttgccgcaaaccgcccggtccctagcaacaaggttccggccgtagagcgagagcctctaggtgtaaggaaggtgatgtcgtaaagccgggagtgtcgtaaaccaggtgcggtggggaggggggaggggtggaggcggaggggtgggggggaagggggagggagggggaggaggtgactcgagcatttagacacaagcgagaggatcatggcggatggccccaggtgtaagcgcagaaagcaggcgaacccgcggcgcaataacggtgagtggcggaggggaccggggagcggcggagtcagggggagctgggcagccggggcgcccccgggggtgaggggggcgagccgggctgggggcagccggggcagggacggcaaagtggagtgggaaagtagaaagtagtgctctctgcccccctccgctgccgccgctgccggagccgcgccgcggccgctcgctctccctgaaccgttatgtctcttacctggtctctctccgcctagcggctcccgccgcccctgccgcctccctggaccgttagccggcgccgacgccgccgcatccccggcgcagggcgggcggccgggacgcactggccacttttctggtcccgggtggagcggctgttgcttctttccgcacttttccccactcttgtgcccttcggcgcctccctctccccctcctcctggccccctcagcgcgattctccctcagcgccca

SEQ ID NO: 60462 - DNA, 1022 bp, Homo sapiens
gcgcgcgtgtgcgcgggcgccggctgtgcgcgccgcgggcggacagggttcggccggcggcggtaaagttgggacccgcgggccgggcgcgctcgcgtaacggggattagaggcgcgggggcgcgggtccctaagcgcccctcctccctggcgcctcccgctgcccggcccagagccccggcctggggactccgcggcgagccccgcgagtggggtccacgtttggcggggcgcggcggggcggcgcggggaacaaggcaggaaaggtacccacttaacgccgccgggagccgcgcggatgggggcgagctgggcggcgggtgtgtttgcggagttgttacctgggcttagagaccgggaagcaccacagacagatccccctcccggggcagacgaggtctctgcgccgggatgggccggtgtgcgtgcgcctcgcgcttttctctttcggtttttggggaagttgttacctgggccggacgcacggagcgctgaagccggataatggggcttggatggcgctctgggtctcgggtggaaggagggtgggggagggggcggacggaccgacggacgcgcggggctgctacttgcaccgcagctgcagtgtttattgatttgtgctgctgtgccaagggaaacacacacccctctgcctggcgtgagagttaaaaaaaaagagagacagcccgagggatcgagacctgaacatgtggtggtggttgcacagtcgccttttccagtttggagagacgttgtaagttgattgtatttctggttatctcggggcgatgctatgctttctctccctctcgtgcagcagcgaaatgtctgctgattgttattgtctggacagttcctgtggcgagaggggcgagacttgtccgcccgggggcggcgggagcgcagggagagcagcccccgcctgcgccgccccggtacctgtttgtataataatgggcggcaacggccctgccgccggccgcagcccaggctatataaggaattacacgtacatttcg

SEQ ID NO: 60463 - DNA, 1149 bp, Homo sapiens
ttctccttgagatcctgtgatatgaatattacactcgtaaggcatatcaacagatgacttaaggggggaaaagcgatcctgaaagatacttgaaatcaacaggaaagagaggttcttgatcgctgcagcaaatggcaacttgtgcaggtagaaaaaaagatggtgtttagttttctcctgcatgtatgtcagccccctcctgtctgctgctttcattctcaagggagggatttatttaccacgcttgctgtcagtgtttttcctttgtgtttaatattagaaaaacagatttgcgtctgtttagcacaaaacgtcttgtctgcagtatgcattactctcagaaaacaaaaggtgtttaagatagcactgtactactacaggtatcttccattttcatcacttttggctctgtccttgtatttctttttgttctcaaatgcatttcatccattgctggtgattatagccatgctatttgatttagccttatattttgcaaattaaaaatgaagttatattccattgtgttgtgaaacctcagtatatgtgctggttaatatttcttagcagtgcagtcatatttaagttgcagatgtttattggagaaaattgcctggcaaaacgttaactctcaaatctttttaatgaagaaatatgtgatatatacagtggaagattgtcgtagagatagtttatgttgttatatatgtaaataatgttttattcattttgaaataagatacgtggattttgctgctaagccttctgtaaaatattttaatttcctttctggaatatgtctgaaggtaggatattaaaaggagtatcaggtaatgtaactgacaggggtaaaccaattgagtaaggtttggccaaagcatcaaaccttgtgtggtaacttaatgatgttagtcatccgtaaaggagtgacattagaattgcttgaattagtttttaccatttataatttcatgctttgttgcattttaaaaaatctgtctttttctttttctgctttcttctatgtggttttcttcttgttctaccttttttttttttgagagagagatgtactctactaatgaccacatgctgattaattctctttagatggaatagaaggtacatatccttctgtcatcagcacca

SEQ ID NO: 60464 - DNA, 1090 bp, Homo sapiens
tggtcaaagtttaagagtagcaaggaaaattacaattgattgataatactgtgtaattatttttatataacttatgtagacttagactatggatgggttggcagagagctactaacggaggtggtaactagcagtcacttagatgttagtgatttttagattttatcttttccttccccttcaggtcttttcctactggtagccctcccccacctttttagttaagaatcagtgagtgcatacgttttaaatttgtcagttgtaattaaggaatataagtttgctttgagatcttatatgcagtaaaactctgtagttcgtacgttgctgtatgcttgtatttaaataattcctttcaagaaactatataaattgcatataaataattgcatgagactgtatttagttatgtcttttcattttgtgttcttataggtatattaatataactgtaaattttaagcctctcattaggtagaacattagaagtatttatttccttaattatttttagtggtgtttttataaatgcatcaatatcagtaccgtaatggaatagccatactgtttatcttgaactaagtaggtattgaattgccaggtaagcctgtgttaatttcttattttaggatgtcatggttcttcgtgtgtgtgtgtgtgtgtgtgtgtgtgtgtgtaaatagtttttcatttcctgacaggtatttcttgaatttagtattctaattcctgagggctcagtagtgaataggtgtgattcacttaaatgtttatgaactcagaaactttgccacaaagtcacgagatacattgtagcatggagcaaaacttaaagtatcttataaattgaaaatattaatcgtttatgaagatgaccctgatataaaaagcatgtgaaatatttgtttaatactgttttcttcctttctctagtctctagtatgtttgaaatggcatacctcctatgtagtagcttttgaagcatgtgctgagaaacttctgttaaattgagaatgatatttttaaaataagagcataatgatttctcatagttgtgtttttcttttgctttatcctcttgtggatttac

SEQ ID NO: 60465 - DNA, 1049 bp, Homo sapiens
ccgaagtgttaaattctaatattgaatctgccattatttggcctctgaaattgagaaaataattccatttatctgggcctatgtttgttcatctgtgggatgaatatgatggattattgtatgcaaggtaatgagaccctgaagatgagagatgtagtaccttgccctaaggagattatagtgtggtagggaagaaaaatgaggaaagaaacctttagaatacagtttggtaactgatgtgatattctgtcttatatgcatagaggggatggtgcttaaaccaagtcttaaagtatgtgtgtgggttatcctagtaaaatatcctagtggaaaataatattccatacagggggaatattatgtgcaaaggcataacacacatgcacacacatattgtgggactcaagtcacgtttggtaaaactgtagggtgagcggaagaatggctagagatgaggctggagaattggatagtaagcaaatgaagaaaaaatgctttatattgctttcctgaatttagattttatcttggacatgatgggaaattaccacaggtcttgaagcaaagagtgacatgattacatttatatacagtaatttataatattatgtttctttatatactcagtgttaatatgattaaaaatttaagaatatatatgcttgctttactaaaagtgaaaaaagttgtaaaacctgatgtatcctgctttcctgagtttttgcttatctattctgataatactaatagatttgcatagtaattgcttcgaaatggtgctgccactaccacttctaccaccaccataaattagtagaagacttacgctactagaagcataagcagccttacgttatagtggctggtatctgtgcaccaagtttggctgtgcatttctagtccctgcactgttagggggaattgtatatttttttttccttttctcaaatcagtaaatcagtgcaaacaaatgtgttgtggatttacaaacctatggaataaaatgtttttacttctatcaattatggctctccaaagacataaaatac

SEQ ID NO: 60466 - DNA, 1092 bp, Homo sapiens
tgtttcatagctgttgggtacacattccaaggacggtaaaaacaaaatgcacttgctcttctaaatctttagccactggctagtggattgcatttattctcagtttccttgccgatccttttacccttcccctcccccatttttctttttgaatggttttgtttcatgaagctcttgagagctttctatgttatattgtggcacaggaaaaagtttattcattttagcactaaactgtagttaacattttaagttaatcatttttagaatgttttgatgagcaatcctgtttcatttttagagatgattcaatctgatatttcatttgcttttaaagtctctaatttcttttcatctatttccatagcattgtaatttgtatcctgaacgtttctcttcagagaaatataaaaatccagcaatccattatagtattgtattaagcctaagatttcattatttatcatacacatttatttatttatttttattttttatcatacacatttaaagtacggcctttgatttatagaatttttcattttgtggttgtgcctgcttatctttgtttttgtgtgtgtatgtctttcacagaaattagtatcattctgtcatagctcttaggaaattcagagttaatcaaatatgttataaaatgtgtttgtataatgaaaaggttggaggagatgattctgaaggtgccatttagagcaggtgtgctatggtttggtggctctctattctctgcccgctttaaatcttagtaggcagcagatgaaatactactaagtgacctttgacacagaacccatgaatgctccaagtatgatttcattttaccgtgttctttgtaaactcaaatgcctgtcaaatcagatgtgtgtttcgatgtttttactgaatgcgccttgaggaggagactaaagcttggggtcaatttggcataatccccacgtttttctttttctattatagaggtttcttggggaaggggtgacatttctttctgaggaaaaggtgcaggctaagtgtaggtggactttctgtcttctccatactttttctgacagcctcactggatcctggtgatat

SEQ ID NO: 60467 - DNA, 1127 bp, Homo sapiens
gtagatgctaagtgttatgagttgtccacctgtataaaactacttcccagaagccttgatgttcccataaagagctaaagacaaaaccaaatcaactgctaacaccttttatgggagatcaacttgtgtgggttatgaggcccaccttgactaagcaggatatgtaggtaaacctgcccagttggaattagtagctgatactctaaaaggagaatggtgaacaggaggccattagcagaaacagcctcattcatttatagagatcatcttgttaaaagggaaatcagcttccctagatcccaagggggtattgaaaatgctaggagagagcctagaaaacttttctgtgcagattgtcagaaaaaggtgaaaatattttcttttactgtaaaaagaaagaaattcttttccttcttccaaagatgccttaccacctttgaaaaagatttttaaaagtctcagagaaaatgaaatatagattcttaaagtggaaagggaccttaaaaatccatctggtctggttcattttatagatagaactgagaacctcaaaaagttatgtaatttggcttacatcacaagagctagtttgaagcagaagctacgattttcttactgtgtccagttgtttggaagtatgaatagtcatcattaaaatgtagggagtttatagggaagcttatgacaactattagttaatttacaatttgttcactgtagctcatctgctttgtttcagaagaaaaattctatgtcttgtgtggaaaaactcttacctccctatgaacagaactataggaaatttcttgctaacttggatgtttcagctacttcagggttattttaagtaactggatagttggttttcagaattctagttacagaaactagtaaaagaatatgagttgttgatacgtggaaactttagacccaaaataaaggtaggatgatgtgagtttagtgcttacaaatttgaatgaaatagtacctttttgaggtgttttagtagttgcccttaatgatttattttaaattagatggctttgggagtaaaaatactgcttttagcaaaaaataaatataaaattgaaacttttgcacgtagagttttttttttctttttgaga

SEQ ID NO: 60468 - DNA, 1139 bp, Homo sapiens
tctgtcagtcttaatgtgatagactctcactcagtgaagatctatggatttattttattgaaaacatttgtttagcatatatctgtgttattttaattttaatgtttttagagatgaggtctagctattttgcccaggctggccttgaactcctgggttcaagtgatcctcctgtttggcctcctaggtagctgggactacaggcatgagccaccatgcctgggtaagatctaatgatttatttgattgaaaacacttatttagcatacattcatgtatttttgtaacttgttgcctcctgacaggtcactagacataggaaagtgcctcttttaacactttcataaacctttaacataaacattttaaatttcttcattatagtggaaatagcgtctccccttattattggacattttgaaaaattaaaaaaattttaaaacaatttttatcataaatactagatgggaataattatatatgaagcttgtctgacaagttggatttttatgataggatagaatcccaggagtagaattattgggcatacccttttaagcctcacagtaaattattactaaagtgtgttgcaaagattttatcagttgtatagactcccagatatgaattccagggcccttcaggggaattagtggggacattttgcaaagagcaacagatggtgtctggaaacatgttctttaatctttgctgtgccacatactagttgtagatatctgggttagtaacataggttgtgtgggccttactttcctcaccataactcaggtgaattttaactattctactggccttaattctcattctgtaaaatatgagtataatcaaggagaatcagtgcctatatattaccaagtgatttgtctgggaaaaaagcagaagcagggaatgtcagatgtacctagaaaaaggagcaagttaggggaaatgcacaaaacatgatttgctcttctggtttttttaagaatagagtctaggctgggtgcagtggctcacacctgtaatcccagcactttgggaggctgaggtgggtggatcacttgaggtcaggagtctgagaccagccttgccaacatagcgaaaccccatctctactaaaaatacaaaaattagccggg

SEQ ID NO: 60469 - DNA, 1053 bp, Homo sapiens
acttgctattttagaattctttattttctaagaattatgaagactgtattaggtatttatgtggacttcctttttttcctaccttttattatagcaccaaaattggaattacgctagattattttctctctgctgtttaaatcataagagactcttttattgggtcagggcaattgtctttctagcacaataatcttctttgataatgtcactactggaaattatgtttatccttcataaattaactaatccttatttttgtaataaattatctgatatccttcagaggttatctaaaaatattcctttaagtctgcatgtattcagcatatttcatggtataacaagacttttacagttgtataacagaaatttaaaataaggcaacggactgtaatccagacttctgtcaactggaaatttttatgaagtagtattttgctggtatactgatacttcaccaaatacaatgtttatctttaaagaagtttctaaataagacaaaacattatgtttagtaaaattcaatgtagtatgttttactgtatactaattctttatatagcccataatcataatacataggctatataatacatgtaaagcatataattcataatacataggatacaaatcaaatatatgagctttattttgatataatcagactttattctgttacctatttgcctttctttttcaaacttttaagcgttgcccttattttcataagacttagtgtttcactcagtattaaatttatccaaagtcattgtgattttatgaaacattgtgattttaagtgctgaaccatgttgtttttcaatgtaaaatgagtgtaacttttagtaattattgaaatttaagcgttactgtgattttccataattctatttcggtagtcacaaaaaaacaaaaatttggcttcttattggcccttctagtgccaacactggcattgttgaaatacatttctaaggaagatggtgagtgtttcacttcattagtagctgcatgacaagccaccccaaagtttaatggcttaaaacaaca

SEQ ID NO: 60470 - DNA, 1072 bp, Homo sapiens
gaatagatttgaaatttgggatgtgaacaaagccttgtatttgacagaaatgtaaaactattaatagtattgttattgttccacctatagaatctgattataagattatctctaaaatactttcaggtaacttgtacttaatgttaggaggaagtgactatattataaatataatttagaaaacatcgttccttaaaaaataatttttgaattgtgctaattcttgttattgtttgacttcattaactaatatagggagtatagggagaacttagttttaaaagataatttgacttcctgatttatacataaaacacataagtaattttggacatatatgatgtgtatatatatatatatatagtgcaggtcatcttgtttacaccacttattaatgaatatcagatttggaaggtgactctttaggattttcctattggttgattgattgaaacttacatgaagaatttaacccttttgtttcaaatagctttctattaagaaacacttttttcatgattattcagagaatttattgctggatcattggctctagagatagactgctggttaaattaaaagatgccggaggaaacattttggaaacagacttcacagaattccttatgaacttctgtactttcttaaccaatcttatttctttcatgtacctatggctgttactagcctgttgtatcagggataccatagtcaactacctatacgggccttaactataaagaattaggccatttagggaaataataatgagactggggctttagagaatttgtgctcatctaactgagtagagggacagctaatattctgctccatctgatggtgatcatgggagtattcaggctgattgttacccaatatttcagtttttccaaaggatcctaaaatacagatttttatgtaaattagttggtaattaatttaggtgtttttaagatactctgtgacaataactctacagggcaaaatcgacctgttaaatatatttggcccataggctgttgttttatagccttgaccatatagaaatcttcaatatctatttaaaagt

SEQ ID NO: 60471 - DNA, 1818 bp, Homo sapiens
gactgggtgttgctttgttgccaaggctggtctgaactcctggtttcaagcagtcttccccaccttgacctcacaaactgctgggattacaggcgtgagcctccatgcctggccaaattgtaagactcttataatggatgagtagaatatatttaagattatataaaaacacaagtcacttcatgatcatcgtctgctggaacatgaaaccagctttcttgtgtagatgtgttatcagtaatgttattcacaccgagaggatcattctgtggtttttaattcatgattttgtaatctgatagtgacttttcattatgtctcctgatttataattacatcacagccattatgattggaatcattgggaagagttgaaatgagcaatttagaattgtttctgaaatacagaaagccttattttttggtgggggttgttggaggagatatctctgtgttctgtaatttcatttgactaaggaatttatctttggtcttctcccagagtgaggacatgaatacttccatagctatattccgtattaatcacagtttgctttgtgggtttcattaggctaaataagaaaaacgtcgttatgtattttctgctttaaaaaatgcttcttgatataaagtcttctcagatcagtcccacatgtgataaatctattcaaactattaaactgcctcaatgtgcttgtttctctcttggaaatctatccatttctgtgtctttatgtaccactcactctcccccatcatattttaggttataagctcctttcctttatatctcatagcacccaggaaagaactttgttagtctctgaatagtttataagtgttattgctattgagaattttggatttaaattattggaatgaatagaataatgctatttctagtatatctaactgagggtcagtgttattaactcaaagacatagcagttttattaagctctaggctttgtttctgaagtcagtttctcttaatcataagtggattattcactttatattctcttatataatgccttggtatcaggttattgataggtaaacatcagaaataggctggatagatatgcatgcatgtgtacacatgcacatgtatgtgagagagagagagaaggattgcacatagaatatatgagaatttgaggtgtgtgtaatgtttataactcatctgagtcttacatagctatctagttatgtacacttaattttgcaccttttatagttgaaattcagaaacattttttaaggaaaataaggacgtgtttttctttccttcatgttttcagtttagctttatttgattgtatttttgctaaagacttaaattgtcaataactattgaaatgggccaacttatagctgagcacaaagtatgttaggacactgagatatatcttaacatttgggaataatttaatgtgtctaatacttgagaaggatcaaaacagactgtacaacccaataatcataaagcctatggtcaaaaatcgtatataaatgacaggccctatgaagagtagccgtaagaatcaagagaaaaagaacctaaattggtacagaaaaggagctgagtcatttttatattataattagaagttggtaacgataaattttgtcttcccagtacaaaaagtatcatgatcaggcaggattacgctaaagtgtaacctctaacttcttgtggtatgtactattacaagtagttgatgatttaataaatataaatatagatgatactgtcagagtgtttccagacattacagttagcttttaggtgaaggcagtgcttgacagaaccta

SEQ ID NO: 60472 - DNA, 1802 bp, Homo sapiens
aaaatagacatgcattttgtggtagtctgttgaatgctgtttggttttttactttcattataaaataggaaagaaaaaagtataatatcatatgacaaaatccatttagtttaacattagttctttaaaaatgtataattgctactatactttggcggaaactattaaatttgtaagataagacgtttatactctatacccaaaacaaagtgaagtagctgttcataatatggcgcagaatcaaattttggtgataaaatcagacatctctctcctgccttacacatactcccactgagaaaataatttctaaatttggttacattttcatatacttcagatgaccttaaatttatatttttctcctgaatatatttgattcctgcatatccctttttttgggcatctgtgtccaatcagatccatgattagtcatgttagctttggacaagagtggaggtaggatcttagcaagtttgaaatctttaagattgatgtttatctgagattattccagcatgtccacggacatagtagttttgtgataacaaggtaatggctgatgaagattagcatattaataatagattataattctgttaaccattctattgtcaaatacgtgatttttgcgattcacatagtttaagtaatttttcatgcccaattagagatgtcaaaattatgttaattgaatctggccatgttcttagctgttttctagagcttaataacaaacatatcaggaagagctcttgtgacaagcacccagcacagcatctgtcattatgtaatcattccaatgtttacagtgaactaagtacttgagatggcaacattcatactttagtccctctgtctagtaattcatacttgtatagtctgtctactatgtgtcacccatttaggtaggtgctgagaataaaatggtggggttaaaaacagatattccctgttattgaacttccagtgccaatggtaattacagtgtagataataattacacactgcaactggaaccaatactataaaatggcataagttcctataagggtaggaacaataaagttagtgtataaataaagcacagaacctacacatttatttattagattgaattgataacttgcttttgaacttttaaagttaattctattaatatctgctaagctaggcatcagaaagactaaattctaaccatagagaaatacattttttatgctgctattctattttcttagatttcttaagaatttacaacaaaaccctgtcaaagcagcattcttacgtgagaatttcacttacgggagagttcttacaggatttcaagaaggaaagccctgaagagggacactgatttcctcaactgaatttaaaattgttacatgcagacatttttaaaggtagtatgattttccttaatcaagtcaactttatatctttttatctttttaaagaagggaatgtgacatttatgtttttcatacacacacacacacacacacacacacacacacacacacacacacagagaagcatacatgttgattacgttttggaaaataaaatccaaagagcatttggatgtctgaatgtttatgcttcatctccgcagtgacttctaaatttagtttttttctggatatactcaaagtcaccaacctgagttcaagtattctgatttgaagatctcaacttagagatccaggcagtcccccttgtcagtgctaggagaaagatgtccttcccataccttccagaaagagtgtcttgaagaaatatattccttcctgggtaacgtg

SEQ ID NO: 60473 - DNA, 1059 bp, Homo sapiens
ccaaatttactgagtaaaagaattctattctaaaaattattttgtataatgcccttcaaattgagttttacatgtactatttcaaggcttctcagatattcccacataaattatctagtgtttctgcatcactttgcgatcttttcattaatgtcaagtgtaatgttttttaacttcacaagggaaacatgaaattcctttagtgtgcctcattttcagacattttcttgttgattaaaattcctttttaaataaagtttcaacatgtactaaataatttgtttacctttgaattaactttttataaatgaattttaaataatgacagcagtcattacaaactctgctgttggcaacactagagggcatttctagttcttcagacagtgtcatgagttctcagaataatttaccaattcattaaacagcagattagcattttaagggaaaggaactaaaacaagcacaatacatatatcatacatatatatagtatgtatatattatgcatagacagataatataaatatccatatataatatatacattatataatatatggataatacatatatattggatgtatgtatactcacgtctgctttaccaaatgttctcactgaatcactactcctaaaaaggcgggagagtatttgtgatctgctcactgaagcaccactatattatccagttgtttattagtgtcgtggaggtctatgctctgataggtttagcatcaagtgaacattgagtaaaaaagtatatgtatatactcatacatacatactcatcagaagttagttgctgtgcttattgaactactagatgctaacatagtcataattagaataatttttcagataaaaaatgagagttaaaatagatgccctttataggcttagtagaagatttaagactacctatattttgaattactgtattttagatgttaaaatattttcaagggttttgaatgcaaacatttttagggaaaagatacaattatgtaatattaaatatataatattaaatattaacatgcaatgatatgaaagaag

SEQ ID NO: 60474 - DNA, 1020 bp, Homo sapiens
caccaagaaagatctgcagatctttttcagtgttcttggaggtgtggggtgtgagaacttgatcagtttgtgtcagccaccttgttctctaaaggtaagcactgtgtagtgagtgcacactcgtgggcccaggctcctaacctaagactggttttggaatgctccattgagggtgtgagaccttcagacgttcgcacagaagggaggccctacctgtgggtaggacatcacacattcatcaagaggtgcttttcgttatttagaagtgaagcatgtcctggggatgtatggatatttttgttttgttttactttaaaaaaaatcccagtcatagtaaaaccttccagtttagtctgcatttattcagttaataactgctggagttaatcaaaaatttttcttgtatgtcttgagatatggattaagaattttgaaacaatgacaccatttaggcaatctagtgacataatagcttcagttgatagagccagctgtgaagaattacttttcatgatctttttgaagctgtatcttatctttacttcagggaaagcccctcaaaccattttgtattctgtattacacttcagaaagtgtggaagcaaaggtcatctaatctttaaaaggtatgtaatcataaaattttttatgtcagatcttaattgaaaaatattacttaaaacttgaaaaaattacttaaaattggcaatttctttttcgtcttacaacttcttcctgtcttcaggaaatgaagaataaatatgttggttctatcagggaaaccttatgaaggataagcaaattaatgtctgtgctttacttccaaattctgacatcagaaaaccttattgttaactaatataatctatagatgtctctcaaaatgaccagtcttaaattcaaatgtcatttggatatcattaattgactatggagaagagcagaagcatgctgatttcgaaaatgtcattaatattaggattaggtcagtcttaggcaagaatactttgaataacaaga

SEQ ID NO: 60475 - DNA, 1026 bp, Homo sapiens
tgaaaccccgtctctactaaaaatacaaaaaaattagccgggcgcggtggcgggcgcctgtagtcccagctactcgggaggctgatgcaggagaatggcgtgaacctgggaagcggagcttgcagtgagccgagattgcgccactgcagtccgcagtccggcctgggcgacagagcgagactccgtctcaaaaaaaaaaaaaaaaaagcagcattaggagagaaatttatagcactaaatgctataaatttctctcccacaagagaaagcaggaaagaactaaaatcgacaccctaacctaggctctttttctgggtctctttctttctaaagttttgcttattttgtttactgcacaatccaactaaaaccaaattttttacatcatttcatttgagagttaccttttattctaataaactgtggaataactggggttggggagggaattgcttaagttcataaggattcttgcaaacttgaatgtgtcgatacaagattttttttgaaaatttgtaattccatttcacgatctcaaccagaattcattatgtttaaaccacctgatatagactaaaacattttttcaggagcacaattgtaaaaaggatgcagagaaatatttacaacattacttatttctttgcagatttagtgaaagtatgtcctacttttacaaaatatcttattttcctctcttttttacacatataatagagaactaacttttataaactaaatgagaagggaatactaatttttaaattatgatgtcacttgtagaatttgttttaaaattgataaaatacacctctttttttattattatactttaagttctaggctacgtgtgcacaacatgcaggtttgttacatatgtataaatggccatgttggtgtgctgcacccattaactcatcatttacattaggtatatctcctgatgctatccctccccactccctctaccccatgacaggccctggtgtgtgatgttccccttcctgtgtccaagtgttctcattg

SEQ ID NO: 60476 - DNA, 1024 bp, Homo sapiens
ttcaataagttaatgtgtaaaagcacacaacatagtgcatggcacataatagttgagctttaattgtacatgttacttgttttttctatcttctcaactggtaataataactctactgaataggtagtaatttaatgaaaaaaattaaatgcattgtggtgtttgccaaaatttttggtttgtatgtatacactggattacagttttataaatttgtcctcatgaaattgattgtcaggtgttttctctttagttgttttgttaaaaggttaattggagcataacaaatgcatcactatcttatgtagctcctataaaaacataaatactttaaaataaatttgaaaattagaggggctactacatgcaactgattatagttctaattttagttatgaaatttacttctcaactaaggcacaatctctaattctgtatctgcattgatgactcagtgattttagaggttgtgagttgatattttcacatttctacctatggtaactcattacagaatgtctgatcatgatatcctgttctgtgtagcatcatagtggacacttcatgatatttctgctaaaccctttacctgtcataactgtctcctttctgttttgcaaattccctcagcaaagtcaaattcagtcctcacttggttataaatagcattataaaccatatttttgatttaaataaagcacacaaatctcaaagaatgataaaagcattgttcatactttgtaaaacttaatcattgattatagattaaaactgaaacaacatgaagggatcagactcactcacagaaggttattgagaaccaggaatcatagatttcattcaattcaaattatcagttgtacattgttgcttgttcaaaatcattttacaatccactttgcccacctccatcttcttacgttacaaagaactttcatctgctaggcactgctgatggtagaatgccatgcctttaaggtttccctttggaatataaagtctatgttttcaatagaattaactg

SEQ ID NO: 60477 - DNA, 1097 bp, Homo sapiens
ggaataaattcagttgcacattttgtatttaatccaatgactcaaaaacatgggcacatatttaccaaattaaacgctttcatcaaacatcttcttgatcataccataaaagcccccaaagtttttattggtagcattgctctgattaatgaaatgagcttcagtgcaaaaacttgggctgttagaatacttacaaaaccattattgtccagttctatagctgctaccctagtccctggctctcatctttttatacctggtttaccacatcagcatccatgctgagaaccatgcctcagtcttgcactgctcaaatacatttagtcatgaacttatttattcagcagacctttgaggacctacaatgtgccaacaatttatttaaacaatatttgtatattttccatccccaggctaggacttatagtccccagttggttatcaaatctaaactaaactcagcctaaaaatttagagttctccaaatctcacttattcttgttctttcatgccagtctccttatggtaacattcattcttagcacaatgtgtgtctgttcccacttcttgtcctagtgcatcatctttcctcttcaaggatgtactccttctcctccttaaaattttaaaaatcatagctaaaactaccctgtgaggtgtgaggtttaggttggtgtagtcatctgacttggatcattctttttattctggatcctgagagtatctagaggaaattgcgtattctggttaatgagtggcttatcacatactgtcttaacaacactaagcactctttattcagtaaaagttcacaccataagaaaatatattgtaatgtatttagtgcttcttcggtgatatataaggtgttctacttagaaatttagatttgtaggaatgctggttaatagaagtttctaatatttactgtcttccatatttcctgatgttttgtttattttaagctattttaaatattttgcatttcatatttttaaccaggcagtatctctgttcctcattctgaacacccaatatggtactttgaacataatagggtttcataaagtgcttgattcagtaaaaaaaaaaattga

SEQ ID NO: 60478 - DNA, 1716 bp, Homo sapiens
gcttgtctcagtctcattatatctttgatgacttcttcaccattctttctcttccttcattccgtagatatcgagatttctcaaaacatctcatcaacagtccagcctgtttcttgaccctgtacctcttatttttcattggctgaggaccaattttcttgttctaaaaataaagctaagagcaggcacttttttctccagtcatttgctgaaaaacataaactcatcagataataaaacaaatgctgtttcttgcctgccttgtaccaatttagggagaagcctaggggagagtgactgattttagctccagccactccaggtagggaaaactgtgcatggatgattgggagaaccttacttagatgggggacaggcagttgtgttagtgagttctagcagatgcaccctccatggcatggaggagtattgtccttttatgccagggtaccttagaagagtatcggtgtgggttgtgacttatgagaggggctacacatgcatgggttgggacaaccatgtggtattaatctaccagtggtttcaagttatattgataaaacaaatacattcttacaatttaagtgtagcctttacacctgaattcaaccatctgctatctagcaaaattcagtatcttgcaaacttaaggctgtcaggcgtctgctgctaatttaaggatagcttggtggaatttgcatggagggagcagttctcttttctctttctgaaatgaccttcatctctctttttatctgattggtttatctgttaaaacccagcttaggaaaaaaaaagcttagacattgcctccctgctaaagcctttccatttctagaaacctatctccagtgtccatccttgagaaagtcaatccttcttttctctttgttctctacctggattgaagttgtttctgtcaattaaaactaccatattttattataatttatttacatgcctgtctcctctactagtgagatccttggggatagaaactgatttattaattttcttaactataaagtgcctgacctgtgacaaaagctcaatacatgttttgagtaaatcaatcactgcaccaactcaaatcacagtattccccccctccccgctgatttcaagtgaccacctctgatccccttagacacaaacattgaccctgattaaacctgtgtttgctttgatccatagatacacatttgaactacaggccatcctttctggacggggttttgttactctggcctacagttctttattctttttctccccactgaccagcatgtattaaagtcacaagaccagtctttcaaatagatgttttgaatggggcaaagccttttcatcttgaagccctgtaagtcactccagagagtgtgggaaaagcaaagtgcttggcatagggtacggtagtagcagaggatcttaattatagttcttcacatttgagtgaagttctgaagctatgaagtagaaagtaggaattatcatctcagttaccttagttttgatgtgtggaccaaagaaaatgttcaggaatcttcatattgtgaaatgtgcagtacatgtttaaggttgtagaatattggctctaaggagaattttatattcattcttaaaagagaactaagttagagacagtatcttcagattattgtttccccaaagacccttacctggttttactgttgaattaaacagtaaaattaaact

SEQ ID NO: 60479 - DNA, 1066 bp, Homo sapiens
gtgcagcataccaacatggcacatgtatacatatgtaacaaagttgcacgttgtgcacatgtaccctagaacttaaaagtataataataataataaaaaaaaaagaaatccaagtggagctatcaagtagataatttgggattcataggagaagtcacctgggatataaaactgggagtcaacaaatggcatttagagccatgaaacagattgaggaagtggaggaaagaaacgaaaaagaagcagttggtgagttaagaggaaactgatagagtcaagagaagagattgttttgaaaaggagagagtaatgaattatgtcaaatgctgctaaaagatcaagtcaaatgaggactgataattgtcattgcatttagcagtgctcacagtcatgacaagaacagtgttggtggagtgttgtaattggagtaatttaagataaaataggaagaaacaaattagagacacatgtaggcaacttttccaaaaagctttgaagtatagagggactgagatatagaattaggagtgctggagtttaatcaaggtaagagattagccagcatagagattttgaagccagagagagcaagaaagttgagagtgtacgtgagaagtgattataaaaatataagattaaaatggatatttcttctgttactgaggttgagcatctttttacatgtttattgggcattcatttttgtgtgtgcgaattgcttgtgcatattcttactgggtggttcatcttatgagtgtttaagaattctctgtaaaataaagatgtcagcctttagtcatatgtgttgcacatatttttcacaatttgtcgtttgtcttttgacttgatttttttctgtgtatagttatgggtttcatttcatgcttataatggccttcttattccaggtttgtaaaaggatttgcctatattttcttcttttttttttttattatactttaagttttagggtacatgtgcacattgtgcaggttagttacatacgtatacatgtgccatgctggtgcgctgcacccactaactcgtcatctagcattaggtatat

SEQ ID NO: 60480 - DNA, 1046 bp, Homo sapiens
tttcactgtttcatctatctgtgagttgtacgaacactggctgaaattagctcattgagtggatgggagtttagataaaaggggaaaaggggaaggtaatttgggaggatggctcttgttgggggcagatagatacaggatctgtggaggaagagagaaaggccagaacaagaactgagagagtaacaaagaaatcctacgaatccttagtaactttcatgtaatgagagacaggagaaaataagaactagcattctgtgagcaatgacaaccctttccctgcgtttgcctatcagttttcattctattaatagcatgtatctgaagatattaaaaaccaccaccccttttgcaggggtaaaatttagaatgattgacttttattggagttatgttttaaaatatattttgaaaatataaaaagagtttatgaagattttacctagagaaggatttaaaaatttcacccaaaatttactgaatcattagaattactaaaatctaacatgttcatggtacttggggtactctaaaaccattatgatacctatttttagattatttaaattaaaattagataatatacacattgttcattattatataacattacatttgtatattacattatatccttcattatacagtaaaatatatatagacagtaagctaacattatcagttcggtcaaaagtcagattaacaaaaatttacagtaaatgcttagtatttatagacaagctcctctttcctggagtaatattatatgcagaagttttctctgatcctatgaattaccacatgacctctccattccattttgtgtacctgtttgcctggtctggttatgactgcagttttgttttcattttcctgaattgttgctaacacttaagtatattgacttgtttcttcactgagaaaagaaaaaagtgtggtcccatattcagttcagcaaataattctatacctactatgtagaaggcagtatgccagtgactgtatttaggataaaatgtgtgtgtgtgtgtgtgtgtgtgtgtgtg

SEQ ID NO: 60481 - DNA, 1194 bp, Homo sapiens
tttcttagcaaataagaatcaccctgaaagtagtttaaaagagatattctagtgaccatacccaatgaagtactaaatattcatcctgttagagtgattattgcaaggactctaaaggaaaacattgattatactagattatttattttatagaattttattctcagcttatactcctggttctatgaactatagaaatcactcagaataataaaatgctgatgttatattttattgaaattcattaaaaattatagaaaaaggtgctcatttgaaaacttccaaatgtcagttattcagaatgacaaacttaattatatagaaattgactaatttggttgattctttctaaagtcagtgttggattaataatgtaatgcatggatcattaacagcttaaaaatacttgtggtaaacttgatgatgtaatgctattttgttaggaaagatggcctcttttcttaagttgcaatcctttaaggattcaaagccctaattgtacataagcaatatcgtatgctgtaggctcgttatcattggaggggaggtttaatatagagtttaagagcacaaaatatggaatcagactgttgctgttaaaatcctggctctgccacttcctagctgtgatcttagacaagttactctctctctgccttgattttcttacatataaaacaaggatataagtagtaagtggtagaactcttatttcataaggctgttataagattgttgtaagaatttaatgggttagtatttataaagcaggtctatatatagtaagtattcaataagggtagctactatttgtcattttggtcatgtaatatctagtgttacatatgtgtgttgtcaaataaattagttgttaacattatttaaaagaaaacattgaattacaatctgttttaagcatcttttttatttttctgagatgtaaaaactgattgttttactagttggttttgattatttgtttcttgtttgtattacagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggagga

SEQ ID NO: 60482 - DNA, 1067 bp, Homo sapiens
tataagaatatgtcactgtttgttatataagttccttcagaacaacttagagaaaaaatatggtaattaggttatcatgtaatccaatgacatacatctctgttgcagcacttttgcaatgatgttgtaattctctgtctctctctcccccaacctttgttctttgatgttagtggtctttccaattttgtatttcaacatctatagagtttctggctgatggatcctcaaatagtgaattggatgaatggattagttaattaattaaatcattcctataattgtcaatccatttataccctgctcttaaaatttaatgaattaatttgaggtgaaaatgtttcagacaagatgatcttcaaattctacatgtaataaagataattttaagagtctcaaaacaatttgtatatttatagaatccctaataatggccatttgcagtgtgctaagcattgggctaaacgagagctcagtattcacaacaatcctgtgatgtaatgctctagtcgtatacatgtggaaactaaggactaactgagttgtatcactccccaaagtctactcacggacccagtagagccaatgtcttcacctaggaataattgactctaaagcgtttgcccttatccactgcctcatttctttttattcctaaagtaaaactactcataagatttctggatctgatttctgtactacttgtggattgattaaatacaaaaacattattgtgtattattatcagttggtctttcaaataactgagaccaaaacattaaaatagttttaaaaatctgtaaacactcctattcttctggatttctacttacagaattagcacctagaactagaaaagtaagtttcttttttttttctgagtgttaagacctcaggaaatatttttttaattaacatactataaaattgacttgatattcatttatttgagctttaatacacacacacacaaacagacacacacataagtgtattcatgtagcaaccatgacgatcagggcacagaacagttccatcatcagagcactatcgtgctacccgttttt

SEQ ID NO: 60483 - DNA, 1045 bp, Homo sapiens
ttcatagatttgataccctttgatgcttattagaaatccttcttactatagataattattaaaaactattttctaagaaatcatataactgaactgaacgtcagagtggtttatatgagaattattcagatttaaagtagagctcccccccccattatctgtgggagataaattccaagagtcccccattgagtgtcttaaataaatacttatatatactatactgtttcctatacatacatacatatgataaagtttaatttataaattttatacagagttgcaacaagaactataataaaatacggttataacaatatgctttaataaatttatgtgaatgtggtctccctcgctcgctctcaaattattcttcttgtactgtattcacctgatttcatattgcagttgaccacaggtaactgaaaccatggaaaatgaagccacagataaggggctgtctattgtccaactttaaataagtattatgatatgataggttgctaagaaggtgacctttgagaactaaagtttttttcttgctttatcattaattgagaaagaattcagtcaactatattgccttctctgtgttttattagtaaaatgcaatagaagtatgactttaacatttgaaagggatactgtgagaatttcacacattcatagcattttaaacttataaagcaaagatatatcttaatacattacaacaaaatgagtggaattcatttttaattttcaagaaatattttctgcagattcaagaacaatcatatgttctctcaagataaataatttcttatttagaaaacctttgtaataacttagtggtgagattgctgtcttaaaagtatgcattttttttagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggtaaatggatctt

SEQ ID NO: 60484 - DNA, 1183 bp, Homo sapiens
agagtaagcatttagcatttattataccaagactttgtgacattttactatattttataaaatattggtccacagtagattggaaacttaaaaaagaaccaaacaaagccaactggtcattcaccacaaatagtttgaaaagctctgcctagggtatctaataatggaagagctgaatatcttttaggaaacctccataactttcttttcacatgacttttgaaaagatgttgagaatcaggatccaaaattatactctctaaaattacctatattgttgctaaatactggtacccaaaaaattttgatcatgaccctatgcagaaccgtgtgtgttaataattagttgattctacctgtaggaattgagctatcatgaggaaaaggctaccagacctccactcagattagagacaaaagaacacctgcatatggctgtggtccacccccaaaaataattttccatggtcttagtaatttttgcctggaaaatttttgtatcagatgcagccaaacacccaccttagccattaaaaaaaaaaaaaagtcagtatacatagtataccgaactttgagtagtgaaacttcctgatgtaaccttcaggctaaaatacttgtaaaccctaacctccatagataaattagtgatatgcctaactaataaactgtaaagctatgaagctagaaacaaggagttttaaattaacaaatatagtgactttggctttagaataattgttgtgtaaactttctttctggcaatgataaaatatcaagataatttttaacaataataatgataactagcacttattggatccttagctatgtatagccacatgttagttatttgtatgcattaattcatatagtcctcaggataaccctatggagtaggttttattattttctactttttactgatgagaaaattgaggctcagagggcttaattaacttgtccaaggtcactcaggtagtacatggcaaagctagggctgtgatgtagtcatcctgacccaaagtcattcccttacgtaccatttctgtccccctgttttaaaaaatagtctgtatttatagatgtttatctttctagcgtctctagaaggaaaataagcatgtagttcatgtaaaaatgttatcaagtaattaaaagtgttaaaatagagatgtactagagt

SEQ ID NO: 60485 - DNA, 1050 bp, Homo sapiens
gaccaggttttaaaaatagaatgttagcttttgcttagtgaaacccagaatgagaaaaatgaaggcaaaagatgcagttagtaatgagcgattaattagcaaactaataagttaaaaccttctgcaaatttctcgtaaagtaatgattcacatgaaactaggtaaactctgttactatatattttacatgctttcttttcggtgtccttgctttctttccagtaccagttgagtatatgtctttgctatggttttgactgtgttatccccaacctcactcttgtctttgtcatctccacctgtgatctggccccacccttggggcacatgtgcagtgaagatcagtgtgcttgctttggtcaagtccttgaaagtataaaagtataagttaaagtagttctttatctcatgcttttatgtatatctcttgtttatcttttaatgttaaattacattttctcacacctttctccctctaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtatgtcagtgaacacaaacataaagtgtccatgatatgatatactggaagatgcaaaattaaaaactaaagttttagaattttctttctttttttttttttttattttgttttgagacaaggtctggctctagtcacccaggctggagtgcagtggcacgcaatctcaatctcggctcactgcaacctccgcctcccgggctcaagccatcctttcatctcagcctcctgagtagctgggactataggcacataccaccacacctggccaattttgatatagacgggttttgccatgttgcccaggctggtcttgaactaatgagctcgagccatctacccacctcggcctcccaaagtgctggtattacaggcatgagccaccacgct

SEQ ID NO: 60486 - DNA, 1294 bp, Homo sapiens
ccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaag

SEQ ID NO: 60487 - DNA, 1030 bp, Homo sapiens
ctccctccaggctgcagggacggtgggggctgatctgctctgtggctggggctgcctgctccaggctgggcagcactgggctcaagtcaggcagccctaagggttcagagcttctggatttttccaggggctctggaggaagagatgagggattcctgagattcctgccccaccgctgatgctcagagctttgctgtcagtgttgtcttgcaggataaccacacacccctttcttcctcctttttcttcctttatacccagactgtgggcctgctcgggccctcaggcttggagaagccttcccaaagatgtgggcctgttgttgatttacaggggcctggctcctctgtgcgcgcctggctgcataacttaacgggatctgtcaccttcaataggccgctgcgcagctgcgtgcaggagcagctgccttcactgcctttgtttggtctcagttctcatcttatccagcacagccaaggggccctcttgcctcccggcactgtgattagtgctgactgtcctctgcccaccaagtgctttgggtggcccacgaatatacagggtctcacacacagtttatgatagtgatggcgaccaaaggctgttcataaacagtgagtcgtgggtggcggcattagctcttaaaaatcataatcagctctccaggtggcctcttaaatgtgcttggggcttttcttctcatccataaaataggctaccttagccagaggccccagagctggcaggaggacagagcacatgtttggcctttgtggcctcaaacgaatgcgcgatccccagctcagactgatgagaatctgtgcttctttaaaacatacatgcacgtgcacgcacacacacactcattcacacatgcatgcacactcacacactcacatatgcactcacgtgagtatacacacactcacacgtgcacactcaaacatgcatactcacaggcatctgaggccccacaaccaccgtgggctgagcctggggattgaggaagcaggtgcagcgggcacaactg

SEQ ID NO: 60488 - DNA, 1060 bp, Homo sapiens
atagataaaatctgcataaacacaacttttgaaacccttcataatttttaagagggcaaagtgttcctgagaccaaaaagtttgagtactattggtccatgatgtaagttgttgatttttttgccagtttgtcatttttctctcgattttttctttttgtcatatagtcattttttatttttatatagttgaatttattattcttttctttaaaaaaagtgtctggatcttgacctgtggttagatcttccctcactccatggataaaaaggaatttacctgtgttttcttatgattccatgtttcactttctatgtttctaaatatataaaatatctgtcctacccagttatcccaacttaaaagtcatctttgccccaccggcttgtgatgacacctttatcacatattgaatttccatatgttggttcatcttagtacttcctgtttatactattggtctataattcatatgctcatgttataccatttattgagacttcatggaatattttgctagcttgtagaacttgtctttctccctcccccattacttatcctttcaataactttcttgacttatttgttcattttttcatgtgaattttggatcacctacagatcagtttctcctacaggttttagttctcatccagggtcattggtgccttagcccaggctttgctgctggcaatacaaccaatagataaggcttgttacttatgctcagggctacgggaagctgtggcatatacagggacatgccctgttggctcctgcccaagtgctatgagaagcaggatagtgaacattctgcttgtgtttgatttgtttatattcggcagcagagggtcaactgagtggaatacagcattgattattatctgaattcaatgcaactaaatgtaaaaattccacaagcctgaattcacagcaatggaacacttatcaatttcaacttttattttagattcagggtgtacacgtgcagttttgttacctgcgtatattgtgtaatgctcaggtttggggtatggatgatcccatcactcaggtagtg

SEQ ID NO: 60489 - DNA, 1070 bp, Homo sapiens
acatttcgaatggtcagtggggacttggagttaatggccgccatcctgaacaatgcaaatatggaacaatttcatcctcaaaagaaatttctactggatggtgctattctagaaggttgggatgtggggaataagcagttgcaaaatgcgcattctgcaaaatcacttaaaaaattaaaatatgtaatattttatccatctccctcatgcttatctcttaagtccatgacactaggaaagtttaaggagagaaatatatttttattataggtgtgctaaacttgaatatttgtcccattatatgctctcatattggggctggaagggaggtaaatgtgatttaacttccaatacaacaccatcaaaatgcttgcaatttgggcaaaagcggtctgagaccatggcttaatagaagcctcagttcacattgttctctttggaaaatctaggaatgctgtactgtgagataattaatgtttcagaagtttgtgtcacaatagtcttacatttaaattttagaagtttttacattggtgagaaaggtcttctaaaattttattttagaaactaaacaatgaaagaaatggttctaattggaactttcccttgggatctaagctacttcacattatatttacttctgatttttaataataccctgtatgaagtagtgaaaaacttgaaaaacatacataacacaactttttaaatggaagctgacgtctaaccatggatacaaggaaattattggtaatctcaaagcaactcagtaggtctgcacgtgatttctccagatgcattctaaagtatggaagatggcagggtatgtaggtctcatagagtagatgataatcagcattttttgtttttatttaaatgactatcagatttacttcaagggtcccaggccacattcttccagagctggtactcatgcatagttggctctagttgaacgatgctctagttgaagaagctgctactgatatgttttcaatcctgttataaaaggacttctattaataagcactttaaaatttctaggtagggagtataataagttgttagtt

SEQ ID NO: 60490 - DNA, 3009 bp, Homo sapiens
attacataaaatgagtaaaatggaaagtttaatctccacaccctaatgagatttttttcccatcaacttaatggagcagtcactgttacctgaattgtaactcatacttaaatgttctattttaaaaactaagctaaaatatcacacattttaagtttgttagagtatgcttaattgtatctttcagctgtgtttatcaaaaagaaagcttcacatggcatttagacagaattctacttggttaaatagtttatgcatcaccttaggaaaataagtattacttctctttttaaaatgcaaactgttaggtttataataccatttgaagaattttccctctctcttattttctcttttaacaacttctttttttcccttcagagttatagaaaatggagagaaaaatcgaatgacctatcagagtatagcaattgtttttggtcccactctattaaaaccagaaaaagagactggtaatatagcagttcatactgtgtaccagaatcagattgtagaattaattcttctggaactgagttccatcttcggacgttgattcttactgaagacaacctgtggaatagaagctggattccatcagatttcaaatgtttatacacaatgtattttattttttggaccaagcagtgactctttgattttgcactttttttttgagggatcagaagggaaggggagagtcgagatgtgtgttaggccctcatatttgctgctttgttgcaagttgatataactgcgtgtaattatgaattcattttatcctgaatgtttgcatttcatactctgaatttcagtaaaaatcaaaacttaaaattctaaccagtcatatacactggataatttggtaagaaaactgtattttttttccctgaaattggataatgtactttcttctcaagattcatgacttgatagaacaatactttcagttatgttgcaaaggctcttgggcattttaaacaaaatgaagtatatccattttgaaacctgtgtatttctttttcggggtttctgcatgcagtggcagtcttaagtgccaaaattcattataaccccaaaataaccccttgatgaaggcttgctgtcttttactgtgttacacagcatccttactggatatcttagttgcttgtttgggcagcacactaatattacttaaaacactgtgatatactggagttttagttagcggaagtcagttcagggcattttagggctgtcttgctatactgaattgtagctaacaatcctaattatatctagtaccatactgagttattggtatgaccctgtggaaacacacattattttatgtaaatataggctaaagacttaatgtcctttagcttgtgtatataattgtgttgtatagtctcagagtacattctaaccctacatttctaatcattgttattggtaatcttttctgtgaatattaggtttcctccagaaatagtccgttatttgggaaagttaactgtgtgcacttttagatattaactacatttacaggcaaatcactgtaatgagaatggtactggaaaaatactgaatagacttgctaaatggcacatgcactacaagaggaaccttttgggttatttaatatgtacagaaaacattagaaaaaatttattacagaattctaattccagtatgaatagtggaaacccatctgtaaattagatggatgttggatggaaaatgacattgctaaatttgagaatttctttttacctactaatgtagattgctttgtataataaaacacagggtttggaaggttttgttacagggagcatggtctgttgaagatttttaaaatgtatttttctagattaacttctgtacatgaaatgtctaataaaactataagaggtttagagatttttccattggaaatgtgcattttggtttctaatttttttgttttttcatttactggcatactgttatacctcatttttaaaaatcaactgaatccaatatttcctgtggcaaataacactttcctcatttcataccttttctcctctcttccatgccaacatttctccacccacaacgtacactttttatttctccatcaatatttgaaagcgagtgatttgtgaccaggatttttttttcttagggttgcatttataatttacagattgccttccttgggaacaagtatttttttgtatgatctgtctaaaaacctctcacctgaattttgtggtagaaagtctgtatttgttgttgtgagcgtgttaaattgataacaaaccaaactacttgatagctaaagcagattgtttcgggtggggagaaaaagccctaaatcagaatgtttatatttgcctaaagatgtccttaataatacaatatgctttagatcttgcttatttagtgattgtataccaggaaaacaattagactcaaatcagtgatgttcttgttcttggtgttcatgaacatatatcaaagattaaaattgtcctgtgtttcttgtttcaaggtacgtgtgtgtgtgtgtgtgtgtgtgtgtgtgtgtgtgtgaagtcttaaatgttttattagtctacagctaatcagtttattgtaatattgtatgtacagtgagattaatgtcttgcgttttcatcctttgtgaattaaaaattctcacttgttttgtaataacaaagctagtaatattttcctgtcttgacagcttggttttatagtagaaaatatattaaaagctgaaataaattatcagtggaattttatttgttagtaagtcttccttcataatgtcattgaaaaaggtagttgcagatttagaaaagaaagtatatttaaatacattgtcacattccaattagaagaaaaacacttatttaaattttatagaaataagaaattttaccctttactctggagaaagtacgttaattattaaataatctccaaaaaatgatgtttatattttagatagagacaaatctataaattgttttt

SEQ ID NO: 60491 - DNA, 2588 bp, Homo sapiens
gggccatgttaaacaatatttggttacgctggatgtttctgttgcactctgaatggttagccatttcatgaactgaatttcagcaaggtgattgactttttaaaaataaatctttttcagatcaggtatttggatccaatctcgctaatctgtgtcagagagagaatggcacagtaccaaagtttgtgaagttatgtattgaacatgttgaagaacatggtaagagaaggattttgatttttttttttaacattaagcaaaccagcttcttgttttgccatcaaaattcctagaatttttatgattttgagtgatgcaaacagaagttccttatagtcctaagatgttaagaaaataattttgtttacaaatacttacatgtttacacctgtttcaaattaagatctctccaggcatctgctgaatgtttggtactcacagttaattaagtatatgctattctttgatgccatttcatttaagcatttgcttaaaatgaagaaggtagtgattgtgaaattgagcttgtttttaagaaataatttgacaatgtataagatccgaggagattgtgtttacttactaagtttcttctgtcctaaaaatcagatgacattttaaatggttaagtcaaccacaaatgtctcacgagataaaaatttttatgtcattttctgtaaaataggacaaactaatttctattgtgattaatttaaacatagctataatatttatactagttttatatacattagtatattgtaatcacattaacttatctctgtatatcatgaaagagattttgtacaattaaaacacataattcaatttgtaatttctgccagttacagatctcttgtcccactgactcttcttgtcaacatggcaatagggatactacactattgtcttaatttgaagctaaatgaatagtacattcaataatgtgctttagtaaatttgtacattattatcatttaatgaatacctgaaatttcggggcttaattgtatgaatttcagatgattctgtttcacatataaaagaaaataataaattatagcaaattatgtattgtttttatagaaccattaatttagtggttatattaagtttacttattacaaacacttaatatgacagatgccttcaataaagtttttacaatatgtgcatttacattataaaatggtatgcaaaatatgcatgggctgattttacctgctgacttcctttaattttgaattatccccagatgttttcagaaatttgaaattgttagtgttttaagattaatgaaaccatttccttgagctgattcacagtctatatgatgagcagagtagaattactgctgtttattaaacagaattcagagcgaatctccatctctctcccctgccaagcatctaccagaagccatttagagaaaaagaatatttgcccatttgattttaggctaatgcaaatgagtgggaattctgacacatgcaaacgtgttcagaagaggcaaagaagtactttaaacacacacacacacaaattattattgtctcttaggtttggatattgatgggatatacagagtaagtggcaacctcgcagtgatccagaaactaaggtttgcagtcaatcatggtaagattatatttactgttgttattcagatgcatcactcataactttttgaactggcttaaagtaattttttaaaatgtccaattcctgctgtttttcagatgagaaattggacttgaatgacagtaaatgggaagatattcatgtcattactggagccctcaaaatgttttttcgagaattaccagaacctctttttacatttaatcattttaatgattttgttaatgcaattagtaagtatgtaattctactcagttttttctagatattgaaaattctttgcacagattaagccacccaattttttttatcttactttaagcaagtattttcaacagattgttttactccaaacattttaaatgtgaccaccagatgtcactgtgtattaccaaatatcagcttccaaactgtgacattgctttcagtttcataagaatttgctgtaaaatatctggttattatcttttttcagagcaagaaccaagacagcgagtcgctgctgttaaggacctaatcagacagttgccaaagccaaaccaagacacaatgcagattcttttccgacatctcagaaggtaggaggactgcccagtcatgggatgtggtatagcacaaggggaagcgggaaggcctgtggggccagggtcactcagactcagatttggatcccagctatgctacttgctgtctttgtaacttgaaaaagttactcaactccttttagtatcagtctgtcatgggtaaatgatttgctatgaagaatacagtaaagtaggtattatatgtgaagtatttatgtaatgcttagcacatagtaggtgttcagaaattgttgctaaggttaatatgaagatgagattggatattaattgaggtgtattaagttaccgtcatggttctaggttactacatagccactttaataaccaagttctttcatctga

SEQ ID NO: 60492 - DNA, 1712 bp, Homo sapiens
ggtctcgaattcctcacctcaagtgatctgccagccttggcctcccaaagtgctgggattacaggtgtggagccactgcacctggcctatatttttgattaagaaattttaaaatacatactgtttccaaagtgtcagaagataaccaaggactaaatgtagcaagaggtgcaagaactttgcagggaaaattacaactctttattgagagacactgaataaaacctaattaaatgagaagtatattctgttaatgcatttaaagattcaataatgtaaagatataattttcttccaatgacttacagattcgagatttttgaatctcatttaaaatcccagtagtttttctggtagaacttgacaagcttattctaaaatttatatagaaatgcaaaaaactaagaatacctaagacactcttgaagaagaaagtaaaaggacttgcaccatcatatgtcaagtctttaaaaagtcatattcattaataaagtatggtatctgtgcagggataagcatacatacctgtgaaacagaataaagaacctagaaacagactcacgtacctgtggacactttgtgccagatagagcactgtagaggaagcagatggtgctggtgcagctgggaatccaagaaaaaactggaacccttccttaaaccatccacaaaaataaattccaggtggagtaaagatctccatgtgaaggcagagcaaaggtttttagctttgagaactcagtcattctttaatctgtacaagcgaccttagttatagatgagctctaggatttcttttcttttttttctttctttcttttttttttttttttgagacagagtcttactttctcacccaggctagactgcaatggcgcgatcttggctcactgcaacctctgcctcccaggttcacgccgattctcctgcctcagcctcccaagtagctgggactacaggcgtgtgccaccatgcccggctaatttttgtatttttagtagaggcagggggtttcatgatgttggccaggctggtctcaatctcataacctcaggtgattcgcctgccttggcctcccaaagtctttgctgggattacaggtgtgagccaccacgcctggccgctctaggatttctttccgttgacaaccgtgaatctgaagtatgagtcttgtcctgttgttacagggtaatactcttgtcaggtccatgtgtagaagtcttatactgttgtcagagaatgtagctctattgtgtttttcaccatagattatagccttaaccttttaactgttagtgtcactaatatacagttgattaaaatgaggcaagatagcctcatcatcagtgtaaactaacccattatcctgtgaattttcagcaacaatttcttttttaaaaaaatcaaaattgatgccatctagggagaaaaaaagtatttatcaaatatctaagtcatacatactgtatactaattggtttcctaaaattgtttggaagagtcatttacaatagtcattgtgagaattatgccattccaactatagtaatactagaagtgtaatatgtgtttgggaaatatctaaccaataggcagtagaaactgatgaaggaattgaagaggagataccggattcaccaggaatagaaaagcatgataaagaaaaggaacaaaaggatcccaaaaagcttcgttgtaagttgtcctttccc

SEQ ID NO: 60493 - DNA, 1036 bp, Homo sapiens
ctagtatatttcttcttctttatatacaacaaccaaaaataatcctgggtttatattctgcaggtatgttagtaagaacgttagtaagcagctgggagctgtactttttttttttgaaacagagtctcgccatcacccaggctggagcagtggcacagtcatagctcactgcagccttgaactcctgggctccagcaatcctcccattcagcctcccaagtagctgggactacaagtgtgctccactgtgcctggcttgcacttttttatactctgtattctccttttcacctttcaccatatggggacatggctcttcattgaggatcatattatattaatgacagaaatgaaagatactactgataggaaataaaagagaactttgcctcttctagcaaattagttatgaagctatatataaattcttcctttgtagtttgtaatattgcatgatatttctgaatcttgtcctttcttttccgtttattcctgaaaccatgagggcaggcctttatatcttaataccaaaataagagtaacctcctaaacagttttttccttatttaatcttacctatcactgattcatccttaatgccattgccatatgaaacttcctaatgtcaattttctaatcccctactgctcagaaacttgctgtgattcattaaaattcagcggtgtaggcccaatctgtcttttcaaaatgcaccttctattttacccaatatggactttcagctctagtcacagtagtctgttcactgtctcttgaaagcaagtatgcatgcattcatttaacaaatatgtgaatgccttatgcattggggacatagcagcacacagtcagatactgcactttcctagactgagattatagccacagacagatgattattcaagacagataacagttaataaaatgaaatgtgatgagtgttacgatggtaggggggtacagcattctgtaaaaacaccaattaagtaggggcaaacctagtgtattagttagggaaggccttgcagaaaaagtg

SEQ ID NO: 60494 - DNA, 3080 bp, Homo sapiens
tacagaactgccaagccaaagtatacatgcatttgtaaatttgcaaatatagcattaccaatttttcttttctaggagtagttccagtttatatcccacttgcatatgaggcctttttagtctatagcctcaccaacatagttttgaaaaaattttttcccactctggtgggtaaaaaaaatttcagtttggctttatatatatatatatatatatatataatatgatggaagttgagtcattttgttttctgtgaattgtgtattcatatattctagatatttttcaattttaaagtagaaattgttactttataatagagaaaaagaagaatttgagaaaatctatttgatttattgttaatataaaattgttcttaattatttttgaatacacatatatgtgagtatcacatgaaggttttttttctttttcaaaaatgaagtttggcagtaatcagtccaaaccagagttcacagtggacctcaagggggcaacaattgagatggcttcaaaggataaatccagcaaaaagaatgtatttgaggtaatacatttttttctaagtataacacattctaaactgtagtaattggatgttctgttttttgagctattttgggaaatagtctttcattgtgactagttaaggcaaagttggtgattaagttagatggtattgtaatttaagaaaaaactggtgtaaaaactggctttatttgcataagttgtttgaactcagactgtatattacaagcctttgtttcacaaatcctatcttttgccagcaataataaaaaggatgtggttccctttacttaccaaatctaatattaaaaagtaaattaaggggaatgttgataatggggaggctgtgtgtgggggtgggcagggggtgtatgggatatctctatatcttcttctcaattttgctggaaccaaaaactggtctaaaaaataaaggccttttttttttttaaacctttccattttatcttttaaaaccctccccagtaatatatgatctgtattagttacttattgctgcataagagaccacctcaaaacttagtggtttaacaaaagaaccattttgtttgctcagcctggcctgggctgagctgggtgatttttcttctaatctcacttaggactattcatgaggcttcagtcgtctagtggcttgattggaactggatggtctcaagtgacctcatggctagtattggtgccagctgttggctaggcctccttgtccgcaagatctttcattctcaagggagctaccccaggctgcatcaagtgacggcctcaggattccaagagggtgagggtggaacctgcagggcttctcagggcctagatttggaagtcacacattactttcagagtattcattggttaagactgttcaggagactagccaagtattcagagttgtgggaagagaggcagcctattgacagaagagcagcattatctgtcccattccagaagggtgtggttacagagatccaagactgattttgtggacagccttccagatcccaacctctttttgtagtctcatgtctcagggctttcctgttgtgttgtgtagacagattggtttaattgctgttttccaagtggagcccaggttttctggtttgtctgatttttactctttattgttctgcctcgagcaccaacccatgccaatctctccgtgccaaatgctccctttcttccaagactcatgacaagcatcaccataacaatgaggctacttctttatttataataataaatatttatttaaaaataatatttagtgtacttgggttatcatttgtcaattatttctctcattagataattacaatttttttgtttttcccttaagtaaagagactatgtttttcctttaaataagaacctataacagagcagagtatcttatgtgcagtaaacattcaatattggtaaactggcttgaccaacactagaaaagtgcatgaaagaagtcactgtttcctgaattagccttgtagtttcaaaaggtaaatcaagaataaaaatggtttcatggtcaaataaatttgggaagcagtgtatattttattcctatcttagaaaatcacagtgcaccctagaatatcaaaagcctgtgacatcttgaaggagagaatctagttatattttcttcaatccagtattttccaagttaatattatatacctttttcaaaaatttattttttgagggtacctttttaaaacattatttgtgaaactatgtttgaggactatgtttttcagaatgtttgggaagcattgccatatcttcctctaggaaaaaaaatcagtttttaatcggaaaatgggaggagtgctttccacaaatgtgtcaaaattcttcctcacttaagtttaagaaactgcaaaacagagattgtacataaattagttattgccttcatatagaataaacatagtattcttacttcagctcatgatctgacacttaatttagtaatacttccgcccaaaaggggtgtgacatttatgcctgctctttgtactaagccattatatttacctacaaagtaggaaatattgaaagtctttatgtattctttcttctgtattttttagccagagagacagaaaaaaatttctcaggttgtgtaaaaatgtcatagattttatttctttatcctaatttagaatgcaccactttgatacttgaacagatttttaagtgataaacgtactagtttcagcaggttttatggcatttgtgtgatggtgtttgggatcctaaattattagatttttgtgagaatttattatgagaaacaactttatgtttttttattcaactgatattattgtaaaccaaaaaggtattccatagccgtgtagtcctttaaccttgcatcattgttacataatatatggcagctactcttggtggttttgttaactttgaattaaaggtattcatgtattttgctgaaagcacaaactgaccatactcttttttctccctgcttttctctaaagctgaaaactcgtcaaggaacagaactgctaatt

SEQ ID NO: 60495 - DNA, 1040 bp, Homo sapiens
aaagtgggactagattttggaaaataataactaacgaaatgttgccagctatactgattgcattttttttttttagcattccatgtcatgtcattgtatttatatttaattgctatatcttatttggttgcttatttgtatcttagcttagagctacccatctacagcgtgtatgatgacaataaattaaataattgatttttgtcattttgttaaatgtatgttcaagtttggtaacatttgcaatacatcatttctgctcagaaagttatgcccaacatatagctttatgtttaatttgtctttcgattgacaatggtacttcaggcaaagactttgtagaatacagttacaatttctattgtgatttttattatgattccacaaataaattccatgtaatatctcaaaattttcattgactccactaataaattttatgtaatcctaacttttgtttaagttcacactgatagctaaaaagatgtaaacgggaacaggttgaggcaaactgtattttaaatgtgaagctcctgaatagagttactgagattacaaatagtgaataagttatcacaaagttgggtaagataatttctaatgacaaattaatttgatttgaaaatatttttagcaaatgaaattctctgtaggaaatatttataacagatttttatgatctttagattacaattcagtagactttagggttttaaaacctttaaacttttcaataccataggaatgttactttttatacttaacagactaaacaaatttaaagatgtcaaggtacagagtaagtgtatatttaacataaattttctactacttttgctaatcttttccttatctagttaacaaaatataatagctagctaagtacttctgaacccacccgtaacaactgtcttcccattcttttcatagttcctcattaaattgctgatgctttatagcatctgtctctagttacagtttctgacaaagataaaagaacatgggacttagtgttttctgtttccacaagttgttgttaa

SEQ ID NO: 60496 - DNA, 1024 bp, Homo sapiens
agtaaaatttaaaatgaaattattctaaatgtatttggtctacctcatattctaccgtaaccaatattttattacaattaatgagtttctttaaaattaatacaaaacctatggatcttatgtttgatgaaagaaaagtccatttataaaatttaagcaaattttagtcatccacatttataatgcagccatgcaacatggttctgaaccccaaatgccacagaacacattattcctcagcttctctgatgaggaaacctaaaaatccacatgaattgagcacggatgtgaacattctagatcgtttcttctgttttgttttactaatcttttaatttgctccctgttcagccattccagtggaaatgacctgtgaaagggttgaaattttggtttgatatatcttaaagtaaatggataattatgtctttctccttttcctcgaggtgaaacatgtggggctcttttgtgttaatgcatttctagaggactgtgtaattgtttctttcttcctatttacggctcaacttttatttcaaattgagtgaagaaaatggatgaaagaaaaggaatggagaagcaataagagattaataagtcacttttaaaagtatctgaagaaagctggatagtggtcacttatttgataattactgatacttaaagattgaaggttgtagcaggaacagatgaagccattagacagagcatcctgtaggtaggcaggtttgtatgtgatttagatgaaatgaaaacttattttgaatttaaagatgttaaatgagtaccttccagtacataatcattagtacaggatggttacattttttaaaatttatttaaagttttcactgtagaagatcttacacacgattcagaactcatgattaaaactaatactgacaaaggaggtgaggtatttctgtttatcagccaaggttgtattactttgttaccatgtggcaatagccgaaacatagtttaaaatttactgagcaagccaatttgaaattttagaattctc

SEQ ID NO: 60497 - DNA, 1044 bp, Homo sapiens
catagttatttctgataacttctctgattaacttcatttgttttggggccttcatgatcaggtttgaaccataaaatgactgtaaattgcattagtatctatccccaataaaaacaattaaaatgtcaacaaggctgtaaattgtagataacattgataagagctaagtaggtcttaattttttgaatttggctgaaagaactcgagattggagctttaatcggtcatctttataattacagaaagaactggttgtcttcttgggcggtgttgcagggttcatctttactttttaccaaaactcaaggaagtagcacaagttgggtaagtatttcttctctttggagattttatacatttaaattatgtgaatagtatcgtacctgaatttcaggaggtaatttccagagtccttatagttatagctagtgtgcaaataaaaatgaataaaatcttcttaaagattcattttaacttatgagagaaaaagaggactaagtaggacagtctaattagtggtgttattaaaatcaacagattctgttttatccattcaactgaaaagtgggcttattacttgggcattatagagaaaatacatttcttgattcattttcaggatgttaaagctttgctgtgtttgtgactctgctatttcagatatttagtcagaaaataagcagtaatgtggcaagctgtatcttgaattgtgatctgaccattggttacaaatcagtgattgaggtgtcagtgtctggattgtcagccagctttcaaaagaaaaagaaatgtcacattacttgtgggattttgaagctttttatatatttgagtgcttactatcattactctactcttcagttatttgtaatgcaaacattaaaaattataatttgtgacatataatagctacattttttgaatgctcattctgtatcccacatatgttgtcagtgcagaggattgtgtatatattgtctccttaacgctgggatagctattgctctgatttcgcccttcccccgtcatagatgagaaaatgag

SEQ ID NO: 60498 - DNA, 1050 bp, Homo sapiens
attttttgttgtctataaataatattatttgttttctttgaaaacttcatttatttttaagataatgtttgtgtgccacatatccaggtctgaataactatagtatgtacatcagttgttttttcaggagaaaaaatggggttccaggaaaaaaaaatgtgactaattcaccttgcaactaagtcacgcaagtgcttagtccttgaggcaataatcgttattttactatttatgtattcaatatttgttctcagatatatatctactagttctacagtttttctcattttgaaaattgaactaaaaaagcttacttaaagtggaaataggctaatttaagtatttttcatagtagggagtcagtagatgatatctaaagaaatagaagactgagaatataaaatgaatttacaaaaaattaaaatacttccaaaatatcttcagatccagaaaatgaaataatgatgacagaaaaagcaccatctataatatcaatatcagtaaatgtaaatggactactcatctattgaaagaaaaaggtgctcagactgaagcataaaaaagcaaaacttaactaaattctatatgtaaaagaaacacctaaagatgattcagaaaagttgaaaaaaaaaagcaataaggtgtgtcaaaggtatagaaagtaaagcaagactagggatatcagtagcaaagttcatcctagggagagagcataaagcattatgaaagtagtatttaaaatggtaaagcatgtgcagaagtccacagtgaagatgtaattattaggaatcaccatttaccaaataaagtagcattaacaaacataagcaaaaaaatacaggaaataaatggaaacatagaaacttagtagtaattaactttatttcactagtagtaattaactttatttcacttatcttaatccataaagttcaactagacataaaaagtaatttaaaaaaaggtaagtcttattgatagatattaaattctacattctgaaaacagaaaataaacctcctttagaggtggttttttttttgtttttgt

SEQ ID NO: 60499 - DNA, 1013 bp, Homo sapiens
tatgctacattaaggcaagttctgtacatgataccagttaactttttagtaatttattaaatacagacacagtatttggtctccctatttttacattttgacaaagtgagttagtatattgaataattttcagattatatagttgtaaaataacagcaaagtaaatcattccttttttgtagaatttatccttatagcattgtattcctttctttgaatagaaagacataaattatttttcagtgctgctttgttcatatggaaatctaatttgatagcaaagtatctaatagctgctgtgacttaaggagaaaaagaagtgtttaattataaaattaagaaaaaactacaaaagtattaggaaagttatattcttaatgtattctagaactacgcatgttacacattgactaatcttttcttttaagctaatttttagagaacgagaccatgttggttcagtcatgtgtaagaacttggacctcattgtctatgtgattgtataaacagtattactctgttccataggatcaagagaaatatggattattaaatgtaacaaaaattgctgaaaatgggaaaaaggttcggtaagtacacaagtctttaatgttcttacatgattcatctgaaataaattaaaaattctcaatataattattttagtataaacaataggtgctgaagaatctctcaccatttgttttctatgtaatcatatatgtaagattgtcatgagatttatgaaaattttcctttgtcttgacatatttcctaagtaatattaagttaagaggtaatgaggcagagggttctgaggatgcatttgctttaatattttttttttcagtaagcagtaaatgcacatggtaaaaaacaaaggtagactaagtattgagtgaaaagtcaatcccccagccggcattacttcccctccccagaggcaatcagtgttaagtctcctgaattctagtgctttcctccagagataggatatatatgtatatgtttgt

SEQ ID NO: 60500 - DNA, 1750 bp, Homo sapiens
ggtatagcaaaaatataaactgagtggcttataaacaacagaaatttatttctcacagttctggtggctgaggagtccaagatcaaggcattgataaattcactgtctggtgagggcaccttcctggttcatagatggttcctttttgctgtgtcctcacatggcagaaataacaagggttcccttttataagggcactaattagattcatgtgggcttcaccttcatgacctgatcatctcccaaaggccccacctccaggtatcattacatttgagattagatttcaacgtacaaattttgagggacacaaacatttagtctgtagtaagtacaataaggcaaacaaactgaggcagtcataaatagtgggaagtttacttaaaagtggtcaggaaaagccctaaagtaacattgaagtggagatattaccagctacccagttgctcaagcttgacagtttccccaagatctttgctctcaccctagcaaaagtccctgtcaattttgtcttctgaatctgtcaaattgggccccttttctctgtcactgccaccacattcaggtctttatcatctcttatagtaatgattaaaatagtattctagttggttcctggtcatgctaccctttcttagtgcattctttctgctacctcatttcttgccacttctccacctcacccaatacttgggggaatttaaaatccttcaaatatgaaatgctgtctttagcccctgtgcctttcactgttggttgtttttatctcctgctgtttcagtctagctgactcctgttccttagttcaagtgtcaagttccccaggaggctgtctgatgtctttctctcccaggttgagttaggcatagctttctcatagcatgtatcacattgcatgggaattgttctttgtatttgtacgttttgggtgtagcaaattttgttctttatgttcaagttagagtgattaatagagcattagtacttgggtcttgatccctgtgaccatttggtgaaagttctggaccttttctttgagtgatgcatatatacatgctcagttatgttccagtttcagtctatccgttgatttgggtgagaatccctgatctagactctccctctcatccttaggcttaggctgtctatcactactgctatgccatccatttttcttcctgttttgatgcctgtgtttccttcctgcctctgcttttttttttttttaatacaaattcagctgtggcatttttaaaatgggcttaattcccacctctctgcctttccaattgctgagttccctagcttaagtaatcagtgcccatccactcagattaatgttgttacttagttcccatatgatggaaagattgttttctccctgcttttgaggggtgcaggcggcaaattaaaaatgttcttctttaacatcttatgcagctgccttgctgtgatctgttgaaagtcagccctcaacatgaaggtttatgagaaaaagaaaaaaaaaaaatctcacacatacttacaattgtgttattaatgtttttgttgaggagcaacatagttcttacgaaaaatatcaaacttgcgtatctaaggagatttaagctgtgctttatgaaaaaattacaataaaacttcatatgggctatttcccaagtccccagtataccaaaaatgtaaattgacatagcagtttgtcagctttgtctacagatgtcagtttttatcagaccagacgaaactttca

SEQ ID NO: 60501 - DNA, 1119 bp, Homo sapiens
gctctggctcctgagtgcctccaccacctcatctcatatttccttttcccttcttgcttgttgtcctaccacaccacccttctctcagttcctcaaaggagcctgcctttcagatcagggtccttgtgtgtgtcatttcttctgcatgctgaaacattctccccgacatctttgcctggttagcttctattcattcatcagggcttagtttgaacttttatttcctcagagaattttattctaattctctaggttaggcaaagttttcctataatactcttcatagtatttgattatatattattcgattacataaaataacttgtcattatttatttcttataggaacctccaactctctattaatgtctgtcttccccaccagacagagtaaagcttcattagagcaggaacagagttaccccattacctcccacagtgccatataatagctgctcagtaaatatttgttgaataaataaatgaaaccttaaagctttttaaaagacaaaattttattatggcttctctagtttatgaaattatgatacactgttatttattaggatacttcagatttcccagaggtaaagattttcacagatactgtttcatttttctaactctttctccattccctagtgcaatctggtctttttggcactaatcaggggttgtacacatttccttctgatgttggcttaggcagtacccctgcctagagtgggccttgctttttctatacatagttaaatcctatacctccatcaagatggacccttccagaaagctttgtcagactaacgtagcagaataatgttctcttctttatctgaactctcaagtcactaattgcattgaataagtgcaagttattatatgtacttctagtctccctaccaggttttaaattcctaaaagaagtttaaatagaggacagatagagactacatgcatctacttatcttttgcattatttgcacagtactgggtacataaacattacataacgataaaagtgaacattattttggtggttttggcaagaattgccatacgaatctaaggcactgttactacagtactcttaatctgtccatctagaaaagtaggaaaccc

SEQ ID NO: 60502 - DNA, 2508 bp, Homo sapiens
tgtaaaattatttcttgtttataatagttataattgtacatatgttattactgtatttgtggtttttatttctgtgggactgaatgtgctatgaaaaatataattatcattttattcagttacttattttctactttatgaatcatcagatcttccatctttctcatactgttttactatcagacagtcttaggaatcaaaaattgatctgaagttgtcagaaaaaaatacttaagtgagatttggatcttaagttaaatttttttgaagttttttattcaatgtgattttaatattttctccattaatagtaccttgtttgatttataaacttgtcccttcaagggcttccatgtaaactttcactgctactagtttctgtatttacaaattgtgtgggatataaacccgaagacatttttccaaatcagtaaatgttgagttaatagtttttttgcaagtgttacttaaaacaaattcccaggttggttgacagcaccttctccaggtttatagacatagaaaactagaatgatacctacgtggagatgaatgttcaaaggaactttttggtttgatagaaacaaattaataataggtaatggtgtatgatttaaaaaattctctttttctgaaattattcaaaacatctaaggaaatggagaaaatttaagtggaggtgggctactgctaccaaaaaaaagtttttcagtcttaccctccatgaatagtcctatcaacatctgtaatagaaatcatattctgtgttttaatattgacaaagcagactgcttaaaaaaaaaacacgttattggtttggtcttatgatactcttgtaggcttagacattaaaatttttttttctggggagttattaatatttaaatcgtaggtttctttcttgaatttaaaatatcttatttctaatttttggaaagttttctataaattaccttaaatactaatagcaatttaatttcttatatagcttttgactaaaattaaattctcattctggcatttgctaaggtatttctgtgaccttgcctaatcctgggtatttatacttaccataccaagagcaagttagtatcatgattataacttatttatccagaagtgtttaggttttacttattttaatatggttaattcaaactgatataacatcatgattttaaggcagcttgtatcatttcttttgagtaattccatatgcattatttaaatttaactgtaattgctataaaaagcaccatattttataaacttttaataacgtttgtagttttaaaatcattaccttattagcttggagctgaatatagaacgaaaataacgaggaaaaaatttgttattctctcttactaagctctcccactgtgagtagaggcagaaatataattatataaaatagagtaacttttttcattacttatttcttgtaggaatctccaactgcctcaaaaccctgctttcctgaaaatgagtcttctccctcctcaccaaagcaccaagatacagttagtatgatagaagcatatcttataatgtagtccagttatttcaatcaattttagcaagttaatttactcttaatgtaatgtttaaatgagcttctattaaatttcattggtttttctaaaaaatcacaatcaaaataagtttaacaatcagattttattgatttaaaagtcccccttttgtttaaaatatggtatcttacatgattaaattatataccatatttttaagtgatgaacttatatttgtttttaaaaataaatataaaattcccagacaatactatgacattatactttactctttttttcctcaggccagcagtccaaaggtaagaagcaatcctctccttcttaataggcatagacaccttcattttctatgctgtaaaatatattgccaagtctgtgccagatgaatattggaaataatatagcttaactgtaagttctcctaaactggaaaacctccatgtgacttctgttaagatacctgtcttaactctgatgaaattttacttaatttctgtatttatactcattcccagtcttttctgttgctgatcatgctattccccttcaatggcttctgggttttttttcgttaccgttttttaaatagagacatggttgcgctctgttgtccaggctggagtgtagtagaaccatcatagctcactgcagcctcaaccacctgcccctcccccaccaggcttaggtgattctcccgtctcagcctccctagtagctgggaccacaggcatgcaccagcacgctctgctaaatttttttttttttttttttttgagatggagcctcactctgttgcccaggctggagtgcaatggcatgatctcggctaactgcagcctccacctcccaggttcaagtgattcttctgtctcagcctgccgagtagctgggatcacaggcatgcgccacaacacctggctaattttttgtatttttagtagagacggggttt

SEQ ID NO: 60503 - DNA, 1693 bp, Homo sapiens
gacataaatataacaagtaaaactttaaagactgtggaaagatatatcaaagaatatctttgtctgcagagtaggaaagatttcttgaacaagactcagaagcctactataaaaggaaagattgacagatatgactgaattaaaattaaacaaaacaccttctctttgtagaagatgtaatcaaaggggagaagatgggctacaaactaggaaaagatatcttcaactcacatagcctagaaaggtttagaatccagaacatgtaaagaacttactagttcattttgaatttaatttttggtttaggtttttaaaataatgcttatttttgattttagtagaagagatagaagtagaaaaaataatttgtctgattttactttataaattatgatagttaatatttattgataatatactactcttttaatactttcttctttaatactttgatctttatagcaactccgtgaatgagatatttctgttatatccactttacagttgacaaaacttagactgagggagattaaatattttaccaaagataacactaccttggtctgtgtaacaccagagtctgtgatcttctcaattgtgccacagttctggttaaagatgagaaaactgaggctggaaaatttgtggagatgtcatataatgaacttcgcctaacagtctttgtcatttggagccaagatgtttagattccactttcatttctattgtttatgaactgttttttgtgttttttgctttgttttgttttagtataatgcttcatcccagcagcaaagagaaataattaaaagtaggagcctggacaggcggctgcaagaaccaatagtattaacaaagtggagacatagcaccattgtattggacactaatgataaggtaggactgttgagatttttggcaagttctttgcattatattgtacagtgaattgtaactattcgtactaatattttatgtatttagtaaatattctttgctaaaacatttgatttcttttgaactaatttaagcttttgatctgcatgtatgttgaaatgttactacattattgtttcttttaccaaattgcatactttagtgactacatttttatgtatttagcatcagtttgtcatgaagtaggttttggttttgagggttttggtttttgcacaatagactgacttatctgtagcttactgatgtgtgtaccttgatacatttgatcccagtaggtgacagatttttcttgcttaccttattttaaagtcacattctgttatcctttgtcttcagtctctaggaggtttcatagggaagacatttaattaattttcctcatcccaggtaatattggaattctattccctttgtttctctaaatgctctctgcagaaagcacttcttttatcagtctgaggagtaatgtcctctgtttcaaaaacgggtaaattttaatgcaaacattagaatggatgttttaaacacttctttagaggttacttattcacagtgtagcttcattttggggataagttgggaacttagtatgaatttgcagaatattaggtatattgattttgaaatgtaaaggttttttaaatcatcaggcttcttgtagcatgactaacagtttttctgtaatttttaggtgtgttcatgaaaacagaattaactatccctatggcatatt

SEQ ID NO: 60504 - DNA, 1004 bp, Homo sapiens
gttagaaatttttgttgccggccgggcgccgtggctgacgcctataatcccagcactttgggaggccgaggcaggcggatcaccggaggtcaggatttcgataccagcctgaccaacatggagaaaccccatctctactaaaaaaacacaaaattagccaggcgtggtggcacatgcctgtaatcccagctactcgggaggctgatgcgggagaattgcttgaactgcttgaacctgggaggtggaggttgtggtgagccgagatggtgccattgcactccagcctgggctctcaaaaaaaaaaaaaaaaaaaaaaagaattttttgttgcaatgttcttgatcaagtagaataaaattcataagaattaaatctagtatctctgatagtagtagcttaaactcacttttatttaaatttaataaaaaacacctgttctgtttttatagtggctcaagcatgttgatgatcaaggtagacaatattactacagtgcagacggatctcggtcagaatgggaattgccaaaggtaataaaccttgacaccgaatttctatttaaaaatagtagatgaagtaatatctggagatggtttcagcagatttattttaagatctttattctacttttacaaagtagaataattttttcagaattcactgtgaatactgtgagtagtgtaagttttctaagatgtacaggtgtcttcactatgtgatactgattgttgctattcagaatatcttttgggttaacttgaaattggcctttccttattcttggaaataagaattctcttcaataccaataatgccatcttatatctagttgtgttgagtatattgatttttctacataaagttggtcttatatttaatcattttttgagagaaagaaaagtaactcagtattcaagtttatcctcttatgtaaatggtgtgtatgattgagccattcattgactgagatataggcaacatgtgataagatgtcctaggattta

SEQ ID NO: 60505 - DNA, 1043 bp, Homo sapiens
ttctttcatcggaagaaaactactacagcacttcttacagccagtcagatagtcagtgtggttctcctccaaggggttggtcagaagagttggatgaacgtgggcataccttatataccagtgactatactaatgaaaaggtacattctttttttctcatctagtgttttttggcagaattctctcataaaatagttgtgtactgcagttttagtatttaaaaaagaaaaaactcatgaaaatattcttcattgtaactttataatcatgccaattgacaatacgaaaactcagtgtaactactgattgttttaaactgctaaggatgatagtaatttttatgctcttgtactcatggaagactttttaagagtacacctgttgaatgtcatttgtttagatttcttcagtaggcatatttctttatatttttctgagggaatagttttttggaaatggttttctctctgtgccattatcatacatcgcctcactgcctattctcctttttctattacaatcaaatttatgtaaaacaaaaaccatcaatctagtattttatgattagtctgtaatgaatattgacattttatgtgtgtattgcatctggtatcatttgagaaagcaactgtgggttgtacatgttcagagaagatatgcttgggaataagtggggctaggcttttatccctctttcctgcctcaattatttgacattagaacatacggaagcagttttttcatttatgtcatactcaagatcatgtgtttgtattagcaatatgtagtcttttttcccctcatattccctgtgttttattgcatgatgttctgttgttgctgttatttaaattttattgtgtttggccataggaagtaattcctaaaggtttgcatgaaatgagcctttaaatagtttagttgtacatttaattgaaaaacatttctcttttgtcaatttctcaaacctgttttgagaatgtgagtgtacctgtgttccagtgcatatgtacatcgtatgttatatgttgcttgttgttaag

SEQ ID NO: 60506 - DNA, 1666 bp, Homo sapiens
tctagaaaaatcagggaacacatcttgtatttagcagactcccaaaagctttttgtagttaataactcccttcttgtcccatttttcagttggtttatttatagctttagtttggtaataatttgtgtttttagtgttcaagtgagagcaaaaatagaaaaattgttcatgtttaactataacaagaaaggaaaatttggctggacgcagtggctcatgcctgtaattctagcactttgggaggcagatcacttgaggtcaggagttcgaaaccagcctggacaacatggtgaaaccctgtctctaaattagccgggcgtggtggcgggcacctgtaatcccagctacttggaaggcagaggcaggagaatcgcttgaacccgggaggtggagactgcagtgagccgagattgcaccactgcactccagtctgggcaacagagtgagactctatctcaaaaaaaaaaaaaggaaaattttatttgaattgtacattagaaagatttgaaaataagctatccagtgtatcaataataaagtaaaatttaacaattttagagaattaggaaaaagactaaattatagactaaaagaatttgaagtatacataggaacttttaacatgtttcttagctattttagtaaatagatgggagtgactatgtatacagggtctcaattactggtctctatacaaattatatgaagattaatatttccaaagtggctggagcacatcttccagcgacttcttgagaaaagttgtgtatgggaggtaaaatggaaactatgtgtgtatgaaaatatctgtcttctcctctcatatttaattgatagtattcctgggtatagaattctaggatggaaattattttctctcacaattgtgaggcattttgaactttaatggatatctgggtcagcccctctttggggaatccccagtgttagacccattaggtctttccttttggactaattagaatgtccacagatgtctttaggtctcttgcctatacacggtaagggctgtctgtgtcttggtgttggcattcattttgcatgtggtccctcagtctcccttctttctcttggtacccatgttcctattgtgtctattgtcccccaactcagaatcttagtatttttcccttctcagagggaataactctccatatgtctgctggggtagggatgggctgcacacctagcagccaggtatgtagaaggagattctggcatttttaatccttattttagtaccactgctttcactccccagtttcacagatacctgataccgtcagttgctgagccagttgcagattctgttccgtaagcttgtcgggtttattttcccctactctcctttgtctgcaccatactggtttagattctactttcttccgtgtaggtaattcaggttttttgttcatctgcttgactgttgtcctccctgttgttgtgggtttacatcattttaagcacatttcgctgttgtgattttagtggggtttgagagggagcaactgttggctcttctgtcttaacacagaagcttattattttagtggttaccctagaacaatcattcgtagtagggctgatttcgcctttcagggacatttggtaaagtccgaagacttgttttggttgtcacaatggg

SEQ ID NO: 60507 - DNA, 1098 bp, Homo sapiens
atgttctcattttaattcataaagcaacagcttagtattttccagggttctcatttcatcttgcacttactctgtatgctttcatatgttattgaccccacgtgtatattaatgacttctatatttttagccctgatttttttttttttttgagacggagtcttgctcagtcgcccaggctggagtgcagcgtcgcggtcttggctcactgcaagctctgcctcctgggttcacgccattctcctgcctcagcctcccgagtagctgggactacaggcgcccgccaccacgccgggctaatttttttttgtatttttagtagagatggggtttcggcatgttagccaggatgatctcgatttcctgacctcgtgatccaccggcttcagcctcccaaagtgctgggattacaggcgtgagtcgccgcgcctggccagccctgatttttgtaaattgggaactgagttcccaatttatataaccaacaatctattaccatttccacttgggttttgaaaagacttatcaacctaatgcaatctaaatgtaactcctgtttgcccttctctttccattcttttcttcatcttgacattaactgtagtaaaactacacacacggtaaaacaaactgtacttcacataagcaaacatacaacctgtatgttaatttaaccttctgattgtttcttgaatctgtccctgcttctgcattcctactgtcttgtcctattgcagctctcttcatcttctgtctgtactactgtaccaacctcctagttgcgtctctctaaaatctgtaatattttaaaaatttaaatcagaatgcacttcctggcttaatcttcagtagtttcctaaatgcttctggatgtttgctttgcaacatgaccttcaaactctctgtgctgttacttgcttttccttaggcctttcacttgctgctccttttacatactcagtatgtcagcatcattccctgaaagtaccatgctgtttttcctagcttttgttcttcctccctgctgtttccccaacttttaccgggctaactcctgtttatttatttctaaggcttagtcacttgtttccgggtctc

SEQ ID NO: 60508 - DNA, 1026 bp, Homo sapiens
tgaagatgaagagacaaacaagacaaatgtttctgccttaaagagaatgaagttctagaaggaaaggcagacaagtaaatctgggattagagtttagtgtcgtaagtactatgatgagctgtagagaagtaaggctgaggaaaggatgagcgtgagggcatgaaagaaaaggagactggagagatgtgggctctatcttgaaggggaaatttgtcatttgttccctttttggcaaatcttttgcctgtaataaacttcctaattgtgcactcccatgactctctatgtgctggttcctattagttccttcattccttttcactgtggtgtctgtcacctcttctctgtcaaccgtctagatacagatagatagtctttaccagtggttgtagtttatagcatggcacgattgctgcaataatctgcttgcagctgttattgagggttagtagcagagagatgacttcatcagtatgtttgtgtatggctttttagaaacaagcatttgtcagacattacagcttttctacctggtacctgctttattattgtctttgtcaggggaggcgggagaaatggtgacagatctgtgacagggtgaagagactgttcaggctgttggccaaggtgataaaaggagagggggaggacagaagcaagccgtaaggtgacagctaagtcttagcatatgaatacaaggtaaggtaaccaaccctgtagtaatagagcacctctgagtttcaataactagaaaatcacctgaaaaaaaatcagtaaggcaaattatgtgtttaccatgaaaactgatgtctattaaagataccatgataacgaattcacttagttatcagtagtgtttccttattcaaaggttgttttccttatttgtgtgttatatccgaagaacaataaagtgttgcttgtgcttgaagtgcccttcactactctcttgacttgcgcctattttcctttaaagatcatgttaaacatctgttgtgaaactttttctgcatgctgtgtctcacc

SEQ ID NO: 60509 - DNA, 1028 bp, Homo sapiens
aatctgtttctacatagatggtactgaatctaaaaacaagtgtaaactggctttgaatagccagttaatagtgtcccctttcatccaaatcctagcttgctgctgataaatctttttgataagtcctctcttgccacactcctggaaccatggagtcgttacttagctttcttaaaattttctgaaatgctgctttgtcaccagcccagtcttaccgtagacttcctacttaattattgcttagagcatgtctaaagttaggaatcttaggcgatttaggggctcagtcttcttttagtacttatgatttctgctatataatggcttaaataagttttggtgaattagaaaacctaatcctcagtatttataacgtaatattttttggtaaaatatgcttgaagttccaatcatcttagaaagcaacctatttgtaggttggaattatttgtctctttgagcactagtataattgttgcttattttacttttttaaaatttaggacaatgtggggactgaacttgggttgaaactgatttagattttcagattttggatctgcctctgctttgctgatccttgggtgaaccatttaatctctgagcctcagttttctcccctctagaaatggagctcagaattgtcattaggtttaaatgaaattctgttgtgaaatgacttatgtacccagacacaaaaagaggtacttggtacaatattagttctattcactgcacagtaatgtatatacaggcagtgttggagattagaatgactaagtacaagtatgtatgagaatttcatggccctccaagatcccatggttttttctgcttgttttagtttatatatattaaaatatacaaaaatctggccaggcatggtggctcatgcctgtaatcccaccactttgggaggctgaggtgggcagatcacttgaggccaggagttcaagaccagtctggtcagtgtggtgaagggcatgcctgtagtcccagctactcgtgaggctgaggtgggagaattg

SEQ ID NO: 60510 - DNA, 1690 bp, Homo sapiens
tttaaacccgtaatgccgtgttctaggaggtgatcatttaaacccgtaatgccgtgttctaggaggtactaaaatattttggaattgttatagaaatgaaagtaaatgcatattagttattagtgagcctttctaagaaggtgaaggaggtttgagggagtaatgaaaggaaggaaagttcttctcaactcttgtgtctacctggttagtgtatatttactgttccagttatcggcttttgttttggtcataagtgactgaaaaatgtagattacaattagaatgaaagtgtttttaatgtggcagtgcatatgatagtagacacatgtttgctttttggggtttgagatttgaagtaatgttctttaaatggcctatactatatgatgcttgtgagtaaatacgaaatccagattgcattaacttttttcttcattctctttctccatttaaataaaacagctatattcatccaacaagccataaagccataatgtggtataacatcctttttgagaggtgaatattattgaatgaaaatggctgacagaagtgggaagattattccaggacaagtgtatattgaggtggaatatgattatgaatatgaagcaaaggacagaaagattgtgataaaacaaggggagaggtacatcttggtgaaaaagaccaatgatgactggtggcaagtcaagccagatgaaaactccaaagcgttttatgtgccagcccagtatgtgaaggaggtcacgcgcaaagctctcatgccacctgttaagcaggtagctggtctgccaaataactccacgaaaataatgcagagtttgcatcttcagagatcaacagaaaatgtgaacaaattgcctgagctttcaagtttcggaaagccatcgtcatctgttcaaggaacaggtcttattcgtgatgccaatcagaattttggacccagttataatcaaggtcagactgtcaacctaagcctggacctgacccataataacggaaagtttaacaatgactcacattctcctaaagtttccagccagaataggacacgctcatttggtcattttcccggtccagagttcttggatgtagagaaaactagcttctcccaggaacaatcttgtgattccgcaggagaaggctctgaaagaatacatcaagattctgaatctggtgatgaacttagcagcagctccactgaacagataagggtaagattaaaaatagaatgaggaaacactgtaccaccctagtgaaaatattagttatagttttaattgaaatatttgtaagagttaagacttgttttgctttgtattttcagagtacatgggttctatcctgatttagagatctagaaaatatgtgaaataacttgtggagttcataaagggtcactttggttttcataattattcttataccatgacaggactagatctactttaagtgaggaaactttttttcccttttctctattgattatgtataaggcagaggggatttacttaatttactcagtgatgatatttcttctaatagaaaaaatttttactcttttttacctgtacccattttgacttggttccaagaagtcttcaggtaataatggttatttgaggaaagatgtccttggaatattaactgctaacttttgtcttaagtgtctaagtatccacacttg

SEQ ID NO: 60511 - DNA, 1009 bp, Homo sapiens
ctcagtgtacggccgacacatggcattatatcaaactgagacgcttctgcgtggcaagggaaacagtcaacagaatgaagagatgacctatataatgggagaaaatatttgtaaactatatgtctaacaaggggttaatattttcattgtttctgaatgaataatttataataagtttttttctttcatttttatgtggctcttcctagaccttggattgtaacatgtagttcctgctatgtggctttctgcatgtttataattttaatagtttctcttggagcttcccaacctgtttccccacccttcaccccggtattgactagaaatctatctcagctcttactttctatcccattgtctccactcttgctcattttacctgccttggtatctaaccaccttttctatagagataccttttgaccacttatccatctcctttgccctcctacttctcattgcctttaactaaaactctagattggatgtctcatgttgaacatagtaaaaccgacttgctttatctttctccctaactcctccttcatacttatctttgtagtcactgtggggaaggtgtagtcctaaagcctggcagtgaaagagattgaatgtggactggcctttaactcattgttgtccccagccccacaattcctctcccactagtgtgaaaccgtacagctcacttgttattcttcatccttcttttctccattcttagggataaatgtctaactaactatagtatgtctgagctgctgtaaccttttgaaaagtagctgcatattccctcgctcatctctgtatcttcaaagatatttcttaagttattttattactttcctggaaaaaaaatcacctaaggataagcatttcagggtaaaattttgaaaagttgtgaaaaatttgtataggtaaatgatcaaagcacatagtgactagcgttctggtaatgcatgaaagtaacgactgagcgtctgaaaggtcagaattcctgtttact

SEQ ID NO: 60512 - DNA, 1090 bp, Homo sapiens
tttctttaacgttttgtttacctgtttactttttttgatatacctcttaaacagattggttggttaaaacggatgtcctgggggagaaagacaacatttgctgaactgtttaagttttggtaggcttcttggtagtttaaatgggaagaaaattttaaaaattggcagatagaaaggaggaggcttttagattaaaaaatagcgtgataggaaatttgaatctgacttgggggcagagaagtaaaatatataagcaggcgtgtgtgtcgggggtggtggttgttgaaacgtggaaaaagggaggaggaagaagactggtaagaggcatgaaaagcttgtatgggcgtttttgagactgctaagagcagcatcggggtgtagcaggcagtaggtatgcagaccttgtatatactgggagttgggtacttagtagttgtaagtgtttgggatgaatatggatggaggcgtgtggtgatgggtatagtatagaatacatttcagttccaggagtattgtgcttggacagcgttgtatttgattgagcaaacttttaaccaaaatactttatagaaacaggataaacagcgttcaactttctcttaagaacagaatctacaggtctggggaacagaggaagaaacaacccaaaattaaaactgtaaacgtttgttttaatacagcttatgtttttaagtaaaaatagcattaattattcacacatttgtagatactgttacctagatctaaagttttagtgctaccccataatcattttaattatttttttcagagaatttatctgatttttgtcctttctgtgaagtttgtttcatttttttaaacgtaaattatttcatgattccatttccacattctcagcacatttttaaaaaattgataacactgtatgttttttattatgtacaatatagtttttgaagtatatatacgtagtggaatggctaaatttagctaatttacaaatgcattacctcacatagttatcattttagtggtgagagcacacatccactctctttacagttttcaagaatacagtatattgtcatttactgtagtcaccttgctg

SEQ ID NO: 60513 - DNA, 1001 bp, Homo sapiens
gctcagtggttttttagtaggctgatagaaagtgaactttacaaatttttaagtactctacgtaagtgatattactgaaaataatacgggtgattaaaatttttaaatggagtaaaaactaaatagtggtgatctgtttaaccattaaacagtagtactaatattttacttacctgagaaaatgggcatcacagttttacaataaatcatgggagagaaaagtgaaattaaacttttgtcctgtatttaacaattttggctagaattgcaaatatgcactattttgtagtatgaatcagatgtgaaaggtgtcgtagtacgacatagcatcactgtacttcaaatcgggcttttcagattacctcttttgaggaacctattgggccactatccttgtggttttttttttttttcttcagttagctggccccggctcattggtatatggctttgctgtgattcagccatttccctattactttcattgacttcatggacttaatgaatattctgcagtttcgttttgtaattgattagctctttaattgaactgaactgccaaatggtgtagtctctaagcctccttcccctgttgataatctagtgcttctcaaattttaacgtgcataggaatcacctgcacttctaatatccacttggtcatatggatgctgttctgccagaccacagaccactgctgtccaatagaaatgtaatgcctatataaattacttgtgcttaaagtttctagtattcacattataaaaagtaagcacgtggaaaaaaagtgaaataaatgaatatattttacttagtatattcacaatatcattttaacatgtaataggaaaattattaatgagatattttatgttctttacattggaccaggttttttgaaatatcaagtgtgttttacacttagagcatttctcaatttgcattaggcacatttgactagtgactgctgtatcgaacaacagttttggagtctaaaagtg

SEQ ID NO: 60514 - DNA, 1032 bp, Homo sapiens
ttgttcagtataaggagtatttcctgtatgctttggcaactattttccatagactctgcttgtgttctccttataaaaccagaacaagagcagtgcaaaaaagaaaacgaccctgataggaatgcgctgataaccttactttccctactctccaaacctgaattgggcacccttggttttagcaagagatagaactcaacagtttgcatacacttgcggatctgcctgtaaccccacttcctatttcacagcctaatctcggatgataccacaatgcccacagtatgctgatcaccaccaacagcagatggaggcggataaaaagagctttctcgctagtgtgttgttttaaaagaacctgatggagagctatgatcatatgtaacactgcctctagttagtttttaaataacacttgtagcatatgtctggcgcctgtgctcaggatttcaacagatcattttcaggattttgacatttaactggcttcttatgaagtagcagagagttccaaaatgtagaactgaaatataagctccacacacaggcagagatttgagtctgatttgtttgtgtgtatatcccaagtgcctaaaagcacttggcatacggtagatgcacaatagattcctgttaaatgtatttttaggtgaaaatgtagtctgtactttgcataaacttgtcctactttcttcctagttctttaataagtaacctacttttcattatatatttttaaatgaaaaaacaaaattatatctggcatcactactttggctgggctataaagaaacaggaatttggcagtatgtattaaaattacaaatgcatatatactcggagccttgaatttcatttccagggatttatgccacagatgtttccacacataagaaataacaaggtgtttcttattgttgagaatagcaaaagattggaaacaagctaagtatctatcaacaggatactagttaaattatgatagagccatatgtttgaacattgtgcagctgttaatcaaaaaaacagaaa

SEQ ID NO: 60515 - DNA, 1038 bp, Homo sapiens
ccagaggctgaagtaggaggatcacttcaacccaggaggtggaggttgcagttagtcaagattgtgacactgcactccagcctgagtaacagagtgagaccatgtctcaaataaataaataaataaataaataaataaaatcaggtaagctagtgctcataggcaaacttttgaaaacctcagagtttttgttcagattgaatgatgtctgtttcttaccgtaataatttaaaatccaggtacatttattttgaggcttagtatacattttatcaaatgtatataaattttcagaagtactctatttttcttcaagtttagtagagccttccttgaacaagttttaacaaattggatcctccattttaaacaataaaattagaatttcatggatcatttgtctgttaattaaggtcaacaaaatatattttgggaaaaacgctaaaggcatatgtttctcgtgtatctgttcactcacccattttgtaatatcaactgcttcttgtttccatgggttacacagatgccctgtaaatgattttgtctgatatgtttcagtatttgattatatttatttgtgggcttaatttccagaaatctcaaagagaataatgagtacaatagcagtcagatttgcataacacatctttaagggttttaggagatttattaatattttcttgtgaaatctcactgctttcactatataaattcatatgatcagttttaactattattaaagacaaatattagtacttgtggtcaggtgtggtgactcacacctgcaatcccagcactttgggaggcttaggcaagtgggtcacctgaggtcaggagttcaagaccagtctggccaacatggtgaaaccccatctgtactaaaaatacaaaaaattagctggacatagtggtgcacgcctgtagtcccagctactcaggaggctgaggcaggaggattgcttgaacccgagaggcagaggttgcagtgagccaagatggtgccattgcactccagcctgggtaacagagggagaccct

SEQ ID NO: 60516 - DNA, 1068 bp, Homo sapiens
tttctgtttgattaactttctattttgtgtgcgtgtgtgtgtgtagaataagagagaatttaactaaatatatatgaaatcctatttcatatgggggaaaatatatgaaagaaagcaaaagttgtataatagttaaagaaattgggggaaaaaggtaaaacaaaaaccatctcccttgggtttgacagacaaattgtgttggctctgcatccgagcatgtggcttctctaacactacttttaattatgtttttcagctcttaaccaatggaaagtatctactaatacagtttctagccaggcacaatagctcatgcctgtaatcccagcattttgggaagccaaggcaatgagagatctcttgaggccaggagttcaagatcagcctgggcaacatagtgagaccccatctctacacaaataaaaataaaaaatagtttcccatagcttcacacaaataaaccaagttgctgcctgctttcccagtcttgtatgaataagattcttcaaagtgttgatattgaatttccttgttgcaaatccacattatttctgtaaagtttcccatgccttcacttcaatggttaattgaaaacaggagtagattcccctttgtgatgtgcttctcttaaatcacaaagcttccggagccctccttcttagtggctaacaaatttatttattctcatattaatcagtctgttgaaacaagattgcatattctctgtcaaactggttccacttcatctcgctgaccttcgttctcctgtatgtttgcagtaccccactggctgatacagaatgggactgcattgcaagtatgactcaaaagaggcttcagtttgattaaaatctgctctttgatatttactttttaaacttttagacatatgatgtttttagtttacacaaattcacattctgttgtcagaaaactttattttaccctatttaaaatggtagttattttcacgataggtataaaataaaagaggagttctgaaaacagtttttttttttttttgagatgaagtttggctcttgttgctcaggctggagtgtagtggca

SEQ ID NO: 60517 - DNA, 3326 bp, Homo sapiens
cctcttgtttatccctattcctctcccccttttttttttaaagcttctatgtatataactagtagttgctggttagtgttccttggtttaagaaggtcactgaccactgtctgctggttaaaagattagccgtctttttcttttttaaacaaatacaattcataaatcagcttacccatagctttatttgggagaataaaaacaaagggagggctgacctccctttaaacattactgcttctaaacagttctacttaggtagtatataaaaggaaaccaaatcatttaatattgccatccttctaattttggggaaagtagccacagatgttggctaaaatgtttataataaactgttggcatattttattttgttttattcttcatgattatctcaaacaccaattttgtaaaactaaacatatttactctatgctttctcccatttttaggtgttaaaaagtaatcgaagtacgaagaggacatggtatcaagcagtcattcaatgactataacctctactcccttgggattgtagaattataacttttaaaaaaaatgtataaattatacctggcctgtacagctgtttcctacctactcttcttgtaaactctgctgcttcccaacacaactagagtgcaattttggcatcttaggagggaaaaaggacagtttacaactgtggccctatttattacacagtttgtctatcgtgtcttaaatttagtctttactgtgccaagctaactgtaccttataggactgtactttttgtattttttgtgtatgtttattttttaatctcagtttaaattacctagctgctactgcttcttgtttttcttttcctattaaaacgtcttcctttttttttcttaagagaaaatggaacatttaggttaaatgtctttaaattttaccacttaacaacactacatgcccataaaatatatccagtcagtactgtattttaaaatcccttgaaatgatgatatcagggttaaaattacttgtattgtttctgaagtttgctcctgaaaactactgtttgagcactgaaacgttacaaatgcctaataggcatttgagactgagcaaggctacttgttatctcatgaaatgcctgttgccgagttattttgaatagaaatattttaaagtatcaaaagcagatcttagtttaagggagtttggaaaaggaattatatttctctttttcctgattctgtactcaacaagtcttgatggaattaaaatactctgctttattctggtgagcctgctagctaatataagtattggacaggtaataatttgtcatctttaatattagtaaaatgaattaagatattataggattaaacataattttatacggttagtactttattggccgacctaaatttatagcgtgtggaaattgagaaaaatgaagaaacaggacagatatatgatgaattaaaaatatatataggtcaattttggtctgaaatccctgaggtgtttttaacctgctacactaatttgtacactaatttatttctttagtctagaaatagtaaattgtttgcaagtcactaataatcattagataaattattttcttggccatagccgataattttgtaatcagtactaagtgtatacgtatttttgccactttttcctcagatgattaaagtaagtcaacagcttattttaggaaactgtaaaagtaatagggaaagagatttcactatttgcttcatcagtggtaggggggcggtgactgcaactgtgttagcagaaattcacagagaatggggatttaaggttagcagagaaacttggaaagttctgtgttaggatcttgctggcagaattaactttttgcaaaagttttatacacagatatttgtattaaatttggagccatagtcagaagactcagatcataattggcttatttttctatttccgtaactattgtaatttccacttttgtaataattttgatttaaaatataaatttatttatttatttttttaatagtcaaaaatctttgctgttgtagtctgcaacctctaaaatgattgtgttgcttttaggattgatcagaagaaacactccaaaaattgagatgaaatgttggtgcagccagttataagtaatatagttaacaagcaaaaaaagtgctgccaccttttatgatgattttctaaatggagaaacatttggctgcatccacatagacctttatgttttgttttcagttgaaaacttgcctcctttggcaacattcgtaaatgaagcagaatttttttttctcttttttccaaatatgttagttttgttcttgtaagatgtatcatgggtattggtgctgtgtaatgaacaacgaattttaattagcatgtggttcagaatatacaatgttaggtttttaaaaagtatcttgatggttcttttctatttataatttcagactttcataaagtgtaccaagaatttcataaatttgttttcagtgaactgctttttgctatggtaggtcattaaacacagcacttactcttaaaaatgaaaatttctgatcatctaggatattgacacatttcaatttgcagtgtctttttgactggatatattaacgttcctctgaatggcattgatagatggttcagaagagaaactcaatgaaataaagagaatatttattcatggcgattaattaaattatttgcctaacttaagaaaactactgtgcgtaactctcagtttgtgcttaactccatttgacatgaggtgacagaagagagtctgagtctacctgtggaatatgttggtttattttcagtgcttgaagatacattcacaaatacttggtttgggaagacaccgtttaattttaagttaacttgcatgttgtaaatgcgttttatgtttaaataaagaggaaaattttttgaaatgtaatgactttcttaaaacttaagtgttaggttgattttacatggctgagttcaggccttctgtcttgacagaatagtgactgatatgtcattatatttatgtatattttgtttcctaatgtcttgcagccttttggaccgcagatattaaatgtataggctaaagagctagaaatgaatgaccagtctcacatataaaactttttttttttttttttttttttttgagatagagtcttgctctgtcgcccaggctggagtgcagtggtgtgatctcggctcaccgcaactcttatcacctggattctagtgattctcctgccttagcctcccaagtaactgggattacaggcatatgccaccacgcccaa

SEQ ID NO: 60518 - DNA, 1053 bp, Homo sapiens
agataattatgaaatgatcagctgtttctgacaaatactaaagctagtttattttaatgttgcttgtttatacttcgacattttgcataatactggctctaagttgagtagagaattaagaaatattctgaaggattcacatttctagcaattttaaacgttttgttcacacaatgtaggatttaaaacagtggtagagtgaaaagaacagggactatggagttccatccaagttggaatcctgactacttttatgaacttgagcagataaactttttaatagtttttttctcattctgacttgttttacagtacttcataaaaattatggatttattgcttaactatttaatgaatctctaaaataacatttttctacatagccacaatattatcacacccagtaagattatatttttaatattatttaataccattccatattcagatttttccaatttctttttcactatcctgtacagctggtttgtctaaaccagagtacaattcaggactgctgtttgcgtttagttttatcccttaaatctcttctgatcttgaatgagcaccctctttagtgatattgacttactgagtaggcccagttatcttgagggtataacacctgtgtctgattgtttttatgtgtagtcaccttgttctccctctatttctatgcaaaagcattgattagactcagcataaacatttttgacaaagttatgtcatagataatatgtacttaatatcagtagacatacaatagctggttttcatgataattagagataactcctgtgtttttcccctttggactcatagcagttttattagtaaaatggaagtcattcttaagaattacatgagttggccgggagcagtggctcacacctgtaatcccagcacttgggaggctgaggtgggtgggtcacctcaggtcaggagttcgagaccagcctgaccaacacggagaaaccctgcctctactaaaaatacaaaatcagcagggcgtggtggcacatgcctgtaatcccagctactcgggaggctggg

SEQ ID NO: 60519 - DNA, 3737 bp, Homo sapiens
tctatggattttcaaaggtttttttttttttaagttgtcatcttagtttatctagaagcaatttccctgcctccataaccatgtgcacatacatagagtttatggaagtcagagtttgcaacaatttgagtaggaaccaagaagagaataacataacaaaataatgatgaggtttggggcgtaggtcttactatgaatacctgatggaagtaggcataaggattcaggaagatgaaagacagaggagaacagaatcatgatttcaaaccaaaatacgaaaaattttgtatgtccacaagtagccaggtccctttcctcttttcctccatagggtataggataacagaaaagtccttgatgagattatagaatttaaaagtttggaaattttaatgatgacattgagaaaactgtgatattgatactgtgttaattatttttttctttcgtcagccaaaaccagaaaatgatgttagagcaggaacgtctaagagtagaacatgagaagttgaaagccacagatcaggaaaagagcagaaaactacatgaacttacgtgagtaattgtttttaattaaagtttaaaaataaaagctaaattagaggattataggcattacctttggatatagccagtggatacatattttactttgtatgggctaaaggattttttcttaaatccactgagttggtttgatttatatctaaatacttggaatatatacttgcatttgagtgaaagcaaggtcttatatttcattgtggttaagattaaggtttctctttattaatctgcttgctgtttctttatctccatattacttcaggatccagcataaaaatgaacctaaaacaatatattaagtaacttcgaagattttaagatctaacacaaaaactgagtttttgttaaattttctcttgcataaaagagcattgtggtgtttagccttgccattttgaacagaggttttcatggtttaccttttctcattttctcaaaactcagttttctagaatcttagcaggtagaaagtgcatgattataatttttcacataccttgagtttgtgagacaatttgcaaatcaactgatattgttaggatagttagaacatcaggaccagttcagagtggattatatgaagattctgctaacttgcagctgtaattttgtttagaatacttgtaatgtaaaatattttagtctttgacagtttataatctataattaatcagtatcattttggataaatagcagtataatacatgtggcatattttaaaatataaattatagaactattccttattctttgaattctgccacattttatttcatctcttccattgctatatatggaatgtataacaatagactgttgtttagaaggcatatgaaaattttttgaaattgcaaagctgcagtggctcacacccataatctcagcactttgggaggccagggcaggagaatcagttgagcccagtgtttgagaatcagcctaggcaatatagtgagaccccgtctctacaaaaatttttttagacagggctgattgtacatgcctgtagtcccagctatttgggagacgaggtgaggaggatcacttgagcccaggaggttgaggttgcagtgagcagtgtttgggacagaaactctgtgtcaaaaaaaaaaaaattttttttttgaaagacagcacaggtaaattgtttaaaataggcatcttgtatttatttaaatttaagaatttatcctttcagacacaaaatattttattcaactctcatgctaagtacaatatacagaataaaatttgaaaatatatgtttgttcttctactgttagggttatgcaagatagacgagaacaagcaagacaagacttgaagggtttggaagagacagtggtaagaaaaacatgaaaataaacaggattgggaaatattttgtgggttttttctaccatgattattctaaatttaaagtctgagctccaaaaatatcgctgttcttaatccaaggcaaaagaacttcagactttacacaacctgcgcaaactctttgttcaggacctggctacaagagttaaaaaggtaatgtaactatgccgaggtaggcgtttgcataaatggtgcttacttctaggtaattatttgtattcaaagtgaaataactttacagtcacgtcaatttttgtatagttaagcttagttttttttaatttttttgtaatacttaccttcttttctcagagtgctgagattgattctgatgacaccggaggcagcgctgctcagaagcaaaaaatctcctttcttgaaaataatcttgaacagctcactaaagtgcacaaacaggtactaaagagtatattttctggtagctgcaagatagtaaaaatcaaaaattgaggattggcaagtgagtatttcaatctttcagagtcctcaggaatttttataccctgagccattttatcagaaattatataaagaaaccataagtaacttttagaggagttaatatttttaacaacgttattatcaaaagaggcagtgaaaacatgtattctcattttccctttaggattttaagactgtgcattttcataatttattcatggtaattttgaaatctctactacacaagactgcagttaaagtactgcaaagtcttttggggagagtggtctttttatacctaataccccagtgtgtcagacataatgacgcagttttcatttaaccagattagttgtcttactgaagaaacatagcactatcttgtaatgtattgtctttgcctagtagagggaaagaacaattctccccctaaaaaattaaaggaaattatacctttgtgaataaactagatgtgtgcacgctatgtatagatggatgtattccttgcgtgtttctgcctaaattagataaatgggaaacaatataaaatgcagttttacttttctaaagagcaattatgaaatgctcatactttttcaagtcatcctgttaaatctggaatccttgttttctttgtgtacgtttagttggtacgtgataatgcagatctccgctgtgaacttcctaagttggaaaagcgacttcgagctacagctgagagagtgaaagctttggaatcagcactgaaagaagctaaagaaaatgcatctcgtgatcgcaaacgctatcagcaagaagtagatcgcataaaggaagcagtcaggtcaaagaatatggccagaagagggcattctgcacagattggttagtagaacacattaaaacctttaaaccttgctcaatttgaatgctttcatttagtggaaaacgtaatccgaattttatgtgttgtcatggtgcatctgtctctattttctaacttagcagagtggcactgttgggaaagaggaataatcacattagcagaaaaagaagataaatgagaactagagaagcaagcaagaatggtcatggaatggagaaactatatagagcaatattattaaagccaagagaattgcaagaaaataagccatcagcaatgatttaacgtttaagaataatcattggtggctgggcgcagcggctcacgcctgtaatcccaacactttgggaggtcgaggcgggtggatcacctgaggtcagaagttcgagaccagcctaacatggtgaaaccctgtctctactaaataaaaaaaattagccaggcatggtggtgaacgcctgtaacc

SEQ ID NO: 60520 - DNA, 1868 bp, Homo sapiens
atgtcatctgcacagttttatttcttcctgaaggtgaaggaatatacagtgaccacaattccttctggttgagcttaaagttcatcctttccctgccacctaaacatcctcttgttaaattttaagctgaacgtgcacatgattaacaatgaatttactgaagaggtcctgtaaagaggaagtgaaaaaattgaaagaggcagaatttattagtttggttgtatttttgtgttttctttaggtttacatttatttatttttcttgttggcatgtattaacattattctcagtttttaaaaaaaggaaggcaaaaagtaagctgtatttatttacctttcgttgaaaacagtaataaaagaaaaaaataagatccagactttgtatgaatattgagtaatactaaaatatattttataaaaagattttatagcctaattgggaaaacacacattgaacatttttggctttaattttttattttactttttccttacagcagcctgagggaactggcatgatagatgaagagttcactgttgcaagactctacattagcaaaatgaagtcagaagtaaaaaccatggtgaaacgttgcaagcagttagaaagcacacaaactgagagcaacaaaaaaatggaagaaaatgaaaaggagttagcagcatgtcagcttcgtatctctcaagtatgttatagaacaaagtttattcatttttttgaaacagccacatagaaattttatttattatacaagttttcagaaaaatgtgtgtctataggtgaaatttagttgtttttttcctagtctagctgcagtaaatttgaatgatttaactgagttatatttgcctaacataaatatgggttatgtatagaaatttaccagaatgatgtgactggtggtaacttgttaaagacttcagaattccagggtgggcaaaactgcagggaaccagtttcctggcttggcaactgaatgaatggggccattcaccactatcagaatttcacaaggagggaagatggtaacgttagatggtggtatctgtaaaattagtatttcatatttgagtcttcagtgccttagtttgcaagttatgatcaccaatgaattaattgattacattctttaacatttcaaaattggctcctgaatattttagttttaaatattcccaaatttatcatatatagataatgaaatgtttactgtcaaatattcttaaagtgtatgcatatgttttccacttcatatcagtatattttttccaaaagcatgaagccaaaatcaagtcattgactgaataccttcaaaatgtggaacaaaagaaaagacagttggaggaatctgtcgatgccctcagtgaagaactagtccagcttcgagcacaaggtatagcttccaactgtttatgagttacatctgtgttcttattttagtataattgtagtaaacttaatattcacactgaaagaaatagtaggaatatggctgatttcgaatggtaaacaaatcatacatattaatgttgctttgaaacatttttttgttgttgttttgagacggcgtcttcactctgttgcccaggctggagtgcagtggcactatcttgactcactgcaacctccacctcctgggttccagtgattctcctgctgcagcctccctagtagctaggaccacaggcacatgcccccacgcctggctaattttttaccttttttgtagagacagggcttcaccgtgttacgcaggatggtcttgatctcctgacctcgtgatctgcctgccttggcctcccaaagtgctgggattacaggcatgagccactgtgcctgtcaaaacatatatatatatatttttaag

SEQ ID NO: 60521 - DNA, 1122 bp, Homo sapiens
atcacatggattctttccagtgagtaagtatatagaaagtagatgaagaaagcatactaaccatctagaaaagagtgtcattgtaacgttaatttgctgactcactttctaaagataagacataatatagtaataagtgataatcaaatctagttaaatttgaggcttcccatttttagacagaaaatattattcaatcccaggaatttagtgaaataacagaaactgcctgctcttaattgaaaacaatgtggctacttttaccatagcctattaggtctaaaatatattttaagtttgagctgggagcccagaacctggtagatagttcaagaaaaatgaaagcagaaaagacatggtttcgtaagggcttggtgtaaaacttgaaacaccgatgagtatttgatttgaattttcatgtagtagatttaactatactttttgttttgggttctcttaggcaactttagcgagtatagatgctgagcttcagaaacttaaggaaatgaccaaccaccagaaaaaacgagcagctgagatgatggcatctttactaaaagaccttgcagaaataggaattgctgtgggaaataatgatgtaaaggtaaatataataactaagtattaaggacaattatctgtatacactggcacttttgtttactactaatagtttgtaaagttcttttcgtattcatgatctcatcctcacaaacagtcgtgtagtagatgttattaaccgcattttaaatagatcaggagagagcaagagaataagggcacccaaataggtaaattcagtaggcggcatttattggacctcatgtttgattctttactataacattttccccaacctgggcaatgtggcgaaaccctgtctctacaaaaaatacaaaaatgagcctggcatggtggcgtgtgcctgtagtcccagctactggggtgggaggattgcttgagcctgggaggtcaaggctgcagtgagctgcaatcgtgcaactgcactccagcctgcacaacagatcaagatgctgtctccagaaaaaaaaaaaattcgtgcttaaaaattacgttaataaatttccataagtgaaatgattggaacaacaattaagatta

SEQ ID NO: 60522 - DNA, 1157 bp, Homo sapiens
ggcctcccaaaatgctgggattacaggcgtgagccaccccgcctggcccaaatctaaatttttaagcaactcttgtagaatgccattttcctttattacattaatttgcatgtgactgcagtcgatctctcctagccaacttctccatgaatgaatactctttcctgtattactaagcactttatctgtcctgtccctctcttatggttctgaccttctatcttgtactgcacttattcatgtgcctatcttctcttctactgtgttccttaaacacagtctttgattttctttctgccttgcagcatccagcacagtgcctgcacatagttgacatttagtaaatctgtttaatgaataaatgttgccacactgaataccatccatatttcactccatttgttcttgacaaatggtgaagcttcatgggtgttttttaaaacctgtatacttttggggaaaataaattattttctgtcctatagcttttggcatctaccagaagggatcaagacaatatgcaagctgagctgaatcgccttcaagcagaaaatgatgcctctaaagaagaagtgaaagaagttttacaggccctagaagaacttgctgtcaattatgatcagaagtctcaggaagttgaagacaaaactaaggaatatgaattgcttagtgatgaattgaatcagaaatcggtaggatatagttttattttcttttttaatgctttagtacaagtattcttaacctaaaaactacttaaataacttacttttctatgtaagtcaaatatcgataacatcaattttcaaggactcgggtttcaacttcatttctttctgtatatgaagccttagaggtggaggaagacagttattttagttcctaaaggtctgttaatatctaatttaaatgctgttttagaggatgtttgctactcctaattttaatttttttaatttagtatatagcatgtagaatctaatgttactactaatgttaaaggaaaaataatttaaagctgctagttgcccaataaagctattagatgattgttcaaacaataaattaaatatgcagtacaaattaaaatgctatttaatcaactgtgaattatttggaatagatgtaaggatatgtaacttaacataatttatgtt

SEQ ID NO: 60523 - DNA, 1059 bp, Homo sapiens
cccctgttctaatgaaaatttggcattgggtcattgggagcctcaatgataccaattgttagaatcagggctctgaagactccaataaaagatgatgtgagagattaagggaaacacaatagagtggaaataatatcttcctgctttgcatatagaagtaatgtcaatagtatgaataatagcaaactaagaacgtaatagaatggaaggcaagaacaagagtagtaaagagattagaagaaaatattttcttaagttgatatttttaatatattttaagcagagatggcaggttcgaagtacatgaccattataagtattgataattgaaagaaattccttttgttttgccattttcttaaaagagattaaaataagcaatgttgaatttagagaaatggttttgaaatatttctggggagtagtaatcttataacctgtattgggaaacaactagaaccaggttgttagctactggttaaccggatacttcacaattctaggatgaagaaattaaccagcaaagtcaactggtagagaaactgaagacgcaaatgttggatcaggaggaggtgagttgaataccttttacattgcttccagaaaagctttatagttttgttttctgaatcccattgactttgtctttaatagttgtataattttgggtatgactgtctttgtgggaataagaatgtcacatggataaagtgaatttttacttattcatcgtatctacccagatacaatctgttgttcatttccgccatcttttttttcaccctggttcttgacatttctcttcttgtcacttactttggatcctcattttatcttctcacccagcagagcagggggataattgaaaagcagtcctttaaatttttttgtgggggtggtgggcagggtgaagacaaagactgcttcggtaagaaagagatactctccatcagtgaacttaatcctggtcagatcatctttcaactatagcatttcatatttcaactatagcattattcctcaaaggggcactattgatattttgcattggataattta

SEQ ID NO: 60524 - DNA, 3133 bp, Homo sapiens
actgcactccagcctgggtgacagagtgagactcagtctccaaaaaaaaaacaccacaacatagatatttagatattttatatatttttaaaagaagcagatttgcttatataatgtgtttaaaactcagtctctgttttctaacagttacaacatcaacattatgcattagccaattttagaaggttcctgttttctaatgtagcaaaggggactaacagattaatgaactacaaatttacatttaaattggttattttcaagagtacctacaaactacagataaaatttgatgtctctctaatcaaactcttaagagtagtactcaagaaatggtggtatgcttggcaaataagatcatgaagcttttcatgttcttttttcttttttactggttattgatgacatatgaacattttagaaaatgtaaagaaaattataaacttgtaattttgtttcattcttttgaaatcttatgtataggttagtaaaactggagctgaaggtgctgtgctggatgaagctaaaaacatcaacaagtcactttctgctcttggaaatgttatttctgctttggctgagggtagtgtgagtatacatgtcttctatctccctgttaccttatggggcattatttaaatataggtgtatatgtgtgcctgggtgtgtatgagagagagagagagaaagagagattgagattcaatgtgtttgaatcagtatgtgtaagttagttgtcttttgggagtttattttataataacattttattatactggtcttgttttctttctttgtttttgtatgcagacatatgttccatatcgagatagtaaaatgacaagaatccttcaagattcattaggtggcaactgtagaaccactattgtaatttgctgctctccatcatcatacaatgagtctgaaacaaaatctacactcttatttggccaaaggtttgttgttaagaaagtacaaaacctaaatttagatagaccttttgtttataaaatgtaggaaaatgtgagctgttattccaacctgtacatactgttttgtgctagacacactcagtttgaattgatgacagataatacaaggtgggtctgatttttagactgcttggtttaagttttagtacacattaaagtcagatgtaattttagtcaaatttgtgtgacaagctgtaatttggtattaaagaaaataagcatttgaatcaaataatgaggtcaaagcctggcaaacataatcctctgttaagcctgtagacatgcatgacaggttaatataatctgtatgagatgattaggaaaatcagtaatgatgattccgtctttgactttcaacagtaatttcttaattcagccttgcaaacaaattggaaaaatataggcctttgtcttttatttttagtggtttgttgatttttttttttttaaagctattcacagattttggagcagactcaaatttagttgagttgtaaataacgtcatatgttgcggcttttagtatttagtctaagagattactggacaagcataagtttcttagccatatatacatatattccatatagataaaattaaaaataatttcagtctcatcctttttttcctccaattacatctcttagggccaaaacaattaagaacacagtttgtgtcaatgtggagttaactgcagaacagtggaaaaagaagtatgaaaaagaaaaagaaaaaaataagatcctgcggaacactattcagtggcttgaaaatgagctcaacagatggcgtaatggtaataacttaagaatttgtcatcttcagtttgttaaatacagatttagagcatagaaacgtagaaatagttcagcaaaatcagtaagtgactagatcaagaaatttaatagacatcgaaataatttttaaaaaaattaatagaaatcctggagctgaaaaataaaatgagcaaaatgcaagagaccatcagtagtagaattaattaagcagaagaatctgaacttgaagacagattatttgaaaataacacagagaagaaaaagtttgaaagaacgaggctgggtgcactggctcatgcctgtaatcctagcactttgggaggccaaggtgggcagatcacttgaggtcaggagttagagaccagcctggccaacatgttgaaaccccatctctactgaaaacaccaaaattagcctggcatggtgctgagcgcctgtaatcccagctaatcaggagtcttgaggcagtagaattgcttgaaccctggaggcagaggttgcagtgagcctagattgcaccactgcactccagccagggtgacagattgagactctgtctcaaaaaaaaaaaaaaaaatttttaaaggaatgaaattgaaattagctttagacgtcgtttttttattaaccactttattttcttattttaggggagacggtgcctattgatgaacagtttgacaaagagaaagccaacttggaagctttcacagtggataaagatattactcttaccaatgataaaccagcaaccgcaattggagttataggaaattttactgatgctgaaagaagaaagtgtgaagaagaaattgctaaattatacaaacagcttgatgacaaggtaggtattgcttgatttaggtctgctttatattaggatactattgacatgggtgtttttattttctaacttttctcatttcagtgctgtgggcacttaggatctttatgcatcttccttgatttctgttaatcttgtaaaaattattgtattaacaaaataaaaagtcataatttcaatttctgtgtggaaactgtatgagcatgtatcttttcttccccctctttttaagctaaaagaactttataaggcagcagtccccaacctttttggcaccagggactggtttcagggaagacagtttttccgtggatcaggtcggggagatggttttgggatgaaacttccaccttggattatcaggcattagattctcataaggatcctctaacctagatctcttgcatgcacagctgataatagagttcgcgctcttaatgatattctaatgctgctgatctggcagaaggcggagctcaagtggtaatgcttgctgctca

SEQ ID NO: 60525 - DNA, 2517 bp, Homo sapiens
gattatattttattttacagcaagaataatgttctaaaaaaatagtaaatgctggtttctttaattttaaaaattgtttttctggaaaggtacagttgaaagatcattcaggttagtaaacttggatttttgttcatctgccattagatgaacaggaatgttaactaacgtaaatgattaagtctttagcctccttcaaaaaataaaggaggttgctttactgcagaacttgaaggtttctactacataaaactattctaattcattttagatgaagataatgtaatttatgtccaatgggaagactgcttaaataactaagctaatttggctaatttatgtcttcccattagaatgtgagctatggctggtatgttgataactgtctctctagtctaaacaatgcctagcactcagacctcaatatgcgaataagttatataactttagttgatcggtgtttttttaaatttgccctttaggtttcatattttgaaatatatttggataagataagggacctgttagatggtaagttaaattcttgctaatcagttttaaataacatctgttaattcctttttaataatagatgtgagactatttctttgtaacctatatgaaattgtcttaagttattggaaatagacaaaattttttttcttctaaagttttagttgaatacctttaaatagaataactagtttaaagcgatgtttatgggtacttcttagtagtaattagagcattggactgggagttacataatctgagccctgagttctagtcttctgtcaactgtcaattagatacattgtccttaggcaaatcattgaaccattcagggttaatgttcttgtttataaaatgtgggtggtaggttggagtggtcctaaaattctatattgttgcattggtttctatttacatctcctgctgtgtctgtaaggtctgctttagagcaatgttttaatatgtttttagagttcaactattgctgttaggctgctcaggaaagcctatcagttatttcatatccagtgttaagagttttaggagaatgttgctaacatttgtttttctttctcagtttcaaagaccaacctttcagttcatgaagacaaaaaccgagttccctatgtaaaggtatttatagtacagttgtctagaaaaccctgtaatactttttttttttttttaagacagagtctcactctgtcgcccaggctggagtgcagtggtgcaatctcggctcactgcaacctctgcctccagggttcaagcagttctcctgcctcagcctcttgagtagctgggattacaggcatgcgccaccacgcccagctaatttttgtatttttagtagagacgaagtttcaccatgttggccaggctggtcttgaactcctgacctcgtgatccgcccgcctctgcctcccaaagtgctgggattacaggcgtgagccaattcatttaatatatggaggctcgctctgttgctcaggctggagtgcatggcatggtctcggctcactgcaacctttgcctcccaggctcaagcgattctcctgcctcagcctcccaagtagctaggattacaggcacccgccaccgcgcccggctaatttttgtgtttttattagagaaagggtttcatcatgttggccagacattaacatatttttaaaaattatttcacaggggtgcacagagcgttttgtatgtagtccagatgaagttatggataccatagatgaaggaaaatccaacagacatgtagcagttacaagtaagtagaaaataacactggttaggatttaaaaccagcttaaaatatccttatccaggtgattaattataagattgcttcagggaaattgttaaggggaaatcatgtttgtttatatttgtttgtgtaatttccttgcagatatgaatgaacatagctctaggagtcacagtatatttcttattaatgtcaaacaagagaacacacaaacggaacaaaagctgagtggaaaactttatctggttgatttagctggtagtgaaaaggtaaagtcttcatgtattttgacaaatatttaagcatctttgtaaactttagtttgagttgggagttacgcagggttcattgttgcatcttacttaccaaactggatttggtaacctgagatttgtaaccgctgatgccagtgccttatgatgatatcagctgaataatcagttccaagttactgttgtttgaccatactctagttcaacccataagtggtttctatgacttaagatatgttcatagtgagaactggttcagcatatgttgttataaactttattagatatcccttttctaatttttgatacgtattttatccatattggcagtggggtccctattaaaactggtaactctcgattagtcttttctggtttggttggacttatttctttcctttggattattgtttcattattacaattctatacagtctgattctagtctatatcaaatta

SEQ ID NO: 60526 - DNA, 1089 bp, Homo sapiens
gcgccactgcactccagcctgggtgacagagcaagactctgtctcaaaaacaaaaaactaatagtaccgtgcacggggttttgtgatgattaaatacaataatatataaaaaatggttagaacctgactcattgtaagctctcagatgttaatagtaactttatatgatgacttctaattctcagagcttttgcctaagtagtcattttgctggggaggctgaagttcagggagatacaaagtgactttctacaacgtgatgtgctgttatctcactacctaaatatgttttttctgttgatacagtatgaaagaagtaatacttgttcagagttgtccacctctgtttctcataggaatggcaaaagtatatttaaaagggtgagggaggctttagaaagatgctgtacattgatgatggtaataaatattcagcaagcatttgagttcctctggagtgccaggcactgtgttaggagttaaacacggtcctgactttgagttgacaggctagtgagtaaagcagacaggtaaattgatcgaatactcattggtaagtgttatgattaaatgcagatactgtaagaacacataggatgagacttttacccagatattttgggggtgcgttgtggaattgggttagaggaagaggtaaatgtgatacatgaaataattttgctttccttctcaaaaataaaaagattttgaaggaaagtttcaaatgtttggagtctcttaaaatcttcccagggaagttagtaatgatgtctttttttctcattaataaatgtttctgtaggaaatctgttatccacttagttgtgcccatgttggggtttttttttctttttaaaataatgaataaaaacaaggattggcttgcttattagtttacttttcactgttatatgctgtttccaacagaggcttctctttttgttttggcttcctctagaatagaatgtaatttcatagtacctttcttgtcaccaaaaacaaacaacaaacaaaatcctcgaaagccagaaatcaaaggattgcctttttcccccctttgacctaataaaagaatatatttaaatgtta

SEQ ID NO: 60527 - DNA, 2156 bp, Homo sapiens
cagtaagcagtgattgtgccactgcactccagcctgggtgacagaaccgagaccctgtctcaaaaataaataaataggtatttaaaaaaataaaaatcactcagcaatatttggctgccatagtagtgctaattataattactgggaattataattgtaattactgggccctgggaatgcagcaaagactaaagaccattcttgttttcctggagtttattctaatggatttgtgcatggtgatcccttctacttcaaagattcaatgataccaaattatgcatactaggtatactattttgaggattaaatatattatatgatggcatctgtaaaggttagaaatgttcatttacctttaatttgtatagttgaaacacttttttgtttttcagtccaagccttatgcatttgatcgggtgttccagtcaagcacatctcaagagcaagtgtataatgactgtgcaaagaagattgttaaaggtaaatatattcaacctgctgagttgtctcagcaataagtaaataagtttgtgatcttttctacttactcagcttccttttttcattttaatgcccctttcttctaagttaattgcagaagaaagttgtttaaataataaaaaggtcaaacacaattagtaaatattctattgctcaaattccatgatctaattatatacagtacctaattaaggttattatgagaactatgttacacacttattcttaagagatgcatttctgttagatattcccaggagagtttccaaggtggcagttctagaaagagaacagtatgagaatgaaaacaaaagggctagacacatttctaaaaagtagtggaaaatggcagtctatcattcttccattccattgttattccttccccaaagacttacctatcccttgaggaatttaacaagggttgccaagggtgagaaaagtatgtacattccagttaatactataacttatacaagaatatttataactttatatattctaaaaccattgaattttaaagctgagagagtgctcattgtttatctggagttacttccagttactgtagaaatctgtttaatcaaaggaatggctgttactttgtgatatgatttatttcattttttgacagctgtagttgttacaaagtgcttcttagattgaggcaaaatctgtgttgtggcattcaccacattaaaagaattgggattcagtataaaaataggtggattaggatagcataggagcacagatgctcatcctagtaacaggagataaagtggagttatagaaggtttatagatgaggtgagggagggaaaatgtgtatgtactcattatatcaatttcatattgtctaatacagggagcaaagtcatcatggagatgaggaagggggaagaggttctaggaaaaggcatgaaatggatggattcaggcagtgtgagagtattgccaggcagtattaagggcccactcaaggttagctgctgaaagagttgaatttttgcccatttggagttttgctaggtgagtacaaaagagggaagtgggggacaagagaattgaggatatagtcaaaggagtgattataatggtggaccatgggatctaaggtggttaagttacaggaagaaggatatgagggaggctgaagggcagtgaaaaaaggtggtaacattagtgggttgtagatctcagtggggtcaaagatttgttggaatcagggtactggacggagtaatagaaggtgaatacagacagtccctgacttagaacaacttaaaattgttcgactttacgatggtgcaaaagcaatacacattcaatagaaatattcaatagaaatatttctagtacctgtacaaccattctgtttttcactttcagtatagtattcaataaatcatatgaaatatttaacactttattataaaataggctttgtgttagatggttttgctgaactgtagatcagtgtacgtgttctgagcacatttaaagtaggctaggctaagccatggtgtttggtaggttagatgtgtttgatgcattttcagcttagggtattttcaacttacagaacatttatcaggaagtaaccccatcgtaagttgattagtatctctacttgaaattgagattatggaa

SEQ ID NO: 60528 - DNA, 1020 bp, Homo sapiens
tttttggatacctactctttctcctagattattaaaattgttcctgcaagcatttaaactacctcaggtcttacaagtcttaaaaaaaaaataactttcttagacatacagcagattttctgcaccacttggttacctcccattctttttcaatccattccaatctgacctttgtcattgagtactttttagttttgtcttggcctcacaactgtatttgacataatcactccctccttgaaaattattattttttgacttgcatggacaccactgattttttttttttgttcaatacccctggctccttctcagactatattagtggttctctgagagtggtccatggagtccccagtatcatttctggggtccagaagatcaaagctgttttcagaataagatgatgtctttttaaccgttttgatatttgcatttgatccttgctccttgtacttcaacttaacaacttccattggtttcttgaatgctacactgttctttctgccttaggatctttaagtatcctcccagtgcctagactactttcctacacgaaacctttttcacccttcatgactaatactggggagagtgatgatgagttagttgctgcgtatttttcagttcttaaatattctttctccaagggtgtttccgtgatattctgctttcccgtagacttaggttctcctcctatattctctcattgcactttcatagcactcaattgcatgagtcagaattctggtcacttaattttttaatgtctgccccactattatttatgctccactaaagcagagagggaatctcttggttatcattctagcatgtcatctcacattccataagtatttgttaaatgaaagaatggttgaaaagctgttgcaggacaggcatggtggttcacacctgtaatccgagcacttggggaggctgaggcaggaggatctcttgagcccagaagttcaagacaagcctgggcaacatagcatggtggcacatgcctctagtccc

SEQ ID NO: 60529 - DNA, 1047 bp, Homo sapiens
ttagcccactatagtgtttaactaaggaaaatctaatataatacactcccaagtgatctgaaatgatccgctattcagaattccagagaaagacatatccctgccagaagggtgtccttcataaccaaatttggtcttcagtctggtcggtgcatactcaaacaggaatcacttcccttaaggaacctaaggtatgcagttgagatcaacttattcctttttgatttgtccccttaaagcatcaatcagacgtgaatgcatcttgtgacttggagttactagtaatattgaaatctgaaacttgggggatctttgaagacacatgggattaaaagctgcataatgtacatttcgaggctaaaaaccaggtttgaaaaatacagatgtccagatgagtttttctttaatttatttgaaaaatagagatatgccttaattatagaccattagaaataatttttgtgtttcacagagtcttgattttcattccaggaagccagagtcagtaatttatggctagatctttaattaaaacatttgccttacttagtattacaaaatcatcatttggttttgcaatcaagataagactgttttgtcaacttaatgctaagcacttaatttttatttaacaataacttctagaaagataatcactccagtctcaattatttttatgtttgtgtgttaccttttaatagttgccatttatattattttagtaaggttgtagtggtagtttatatatttgcttggagttgataactagagtaagcagcttcataaagtacttctgaaggcaggctttactattaaaactgtttactattatgaagctgtttacattatttctggcatatctcttggtaaatggtttaggggcactattttctattgatgtaaaaattgaggccaggcatggtggatcacgcctgtaatcccagcactttgggaggctgaggcaggtggatcactggaggtcaggagtttgagaccagcctggccaacatggcaaaacctcatctctactaaaaatacaaaaattag

SEQ ID NO: 60530 - DNA, 1024 bp, Homo sapiens
tcgccgggccgcctggcccactgcgcctgcgcagtcctcctcccgcaccgccctgtcgcccaacggcggcctcaggagtgatcgggcagcagtcggccggccagcggacggcagagcgggcggacgggtaggcccggcctgctcttcgcgaggaggaagaaggtggccactctcccggtccccagaacctccccagcccccgcagtccgcccagaccgtaaagggggacgctgaggagccgcggacgctctccccggtgccgccgccgctgccgccgccatggctgccatgatggatcggaagtgagcattagggttaacggctgccggcgccggctcttcaagtcccggctccccggccgcctccacccggggaagcgcagcgcggcgcagctgactgctgcctctcacggccctcgcgaccacaagccctcaggtccggcgcgttccctgcaagactgagcggcggggagtggctcccggccgccggccccggctgcgagaaagatggcggacctggccgagtgcaacatcaaagtgatgtgtcgcttcagacctctcaacgagtctgaagtgaaccgcggcgacaagtacatcgccaagtttcagggagaagacacggtcgtgatcgcggtgagtgacccccgccggcatccctcctcccgcttcttcgggccggcctgtgcggggagtttagggaagtggcagggtgcagaattgaaagggagcggcggtgtccccagccctccccggcggggtttgccggttcagataacccagtggagggagactgcgcagcctcgcgtgcgttcctggatcgcccccaccccagtcttcggcgccgggagacgggaagcgcccagcctcagccctggacactcccccacctggggcaatggaggaacgtccgggcagcaagttcagtgcacgtttgtctgcgtgtgtgtgtgtgtgtgtgtgtgcaattacggatactgttggtgttttggattaaccccaaatttgccattcagaaaatatgtaat

SEQ ID NO: 60531 - DNA, 1003 bp, Homo sapiens
agcactgaacaacatagcagacaacacagtagcgatggaggtgacgtagcttcctccgagtggaactgcagcctggggacttgattaggtgctatgcatcagtagcattttgaatgcaagggatgatggaaagcagcacatgcgtttctgtggcagctgtggggacttgacagcaatgctcatctctcatgcttcaatttttcttttcttactgttaataggaaaaaaatcaacatctgtaaattaagaatacagcaattatctgtacagtactgcatatttgtaatacccttgtatatatgttacttgaatacagaaatgttcatttgtgatgctttgcacttgggggtggggggtgggagggaaatcaattgcaacaaagagtgtgagatgtgagattgtatagagatgaagtgtcatcacatcatgtgcatggtgcggaacctgctgttttatctatttattgtgccgtgtttacagttttttgtacactgtaccttcattggttcctgtgctgtagtaaatgtgttaggtagctgtggactccttggtattttgtaaatggtataacataacttggttcccctctgggtccttgagttttctgtgtatcatgtgaaaaaaaatggtgacatacatacagaattttacaaaaaaaaaaaaaaaaaaaaaggcatcagtttttttaaaaatggggaatgtactattaaatggggatcttcctggtctactatcattaggacaagtaacaagctaaaaatgaagtctcttgaatctttccatccccaacttgcccacaaagctgtgggtggtttctggtacttaaagcactaatattatgttgctgctctgcgaacagcccagtagtcccatttccttccacaccaaaaagtgttaaatcaagtatgcaaatggagtccttacaactggagtttatgttgtcttgccctttttttagcacaaaaaaaattgtacttttttattgtcgaattgtttaaaagac

SEQ ID NO: 60532 - DNA, 1009 bp, Homo sapiens
attgtatagatgatggctgtaattcagtataaggagaaatctttttttgcacagggaattctgggactcttctaacaaaataagatcagatccaatctgtgttagtcttcgggcaaagaggagaaagaaaaagcatttctggcaggtggagtgaaatacaaatttgaggctgagtgaaaatacaaagttgaggaaatacaagtgtttagaagttaacaagtaaactggtttttgtataggctcaggaaggttagtagtttaaattggaatggcaggagaagccattccagattcctggagcactttaaatgccagactggtagactgtctcagccaggagtggcccagaagaaagcagggtttgtagcaatgaactgtggcctgtagtttccaaaccatgcatctgcatctgcttctgaatttaagtaacagtcattgtctgcttaatgccaatccattcttaatagtattctgggtctaattatatagctcatctgtcagctatagttctgactcatatcatgattttactgctctagaattgtttaaccatggaatatttgccatgtatagaattttcatatcacatgtccttttgtttttaaagatgaagaaactgagacgcagagaagttaatgtatttctctaaggacactcaaaagtctagactgtagaaccactagggccctcgagctctgtggctgtgccactcagctccatgtattagactgatttaaagcctgacacaaatctcagttatgtttgtttcctttttaaaaactcttttgaaaggtttaatagagaaggaacttgaaacaacaattactaaaacatgggaattctttgtttttaacatctaggttgcttgagtactactataattttgatggtaatgtagttgactgtggaatttatttatagtcaacattagcctgatttctgataataaactataaagattcgtattcctctacttgctagcttgttcccaaagagtccaatttcttcc

SEQ ID NO: 60533 - DNA, 1077 bp, Homo sapiens
aggtaagaataaagacatttaaattgtttgggttatatttataacatatatctataatataaacagcaaagttgtacattgtttagatgtttctttctttttctctctaggagtatacaagggcttacacctcagtagtactacaccaacagcacttgtacatacaagtccatcaacggcaggttcagctttgttacagccttcaaatattacacagacttcaagttcccacagtgcactgagtcatcaagtaactgctgccaattctgcaacaactcaggttctgattgggaacaacattcgattaactgtaccttcatcagttgccactgtaaactctattgccccaataaatgcacgacatatacctaggactttaagtgctgttccatcatctgccttaaagctggccgctgcagcaaactgtcaagtttccaaggtcccatcttcatcctctgtagattcagttccaaggtgagtagttatttttgcctaacatacctggaataagagatctaacttcagtcctccagcatcgttctttacctatttctttgtgtttcttgttcttttccttttatacattgaaaatgtatagttgagaattgatcacttatttattcaagaactaaacagttcttgaacacttaattcaatattaagaatttgaactaactggtatagtgaatgttgcatatatgatttggaacatccctttcttactataacaatagttataccaggtgcagtggctcacgcctgtaatcctagcactttgggaggcagaggcaggcagatcacctaaggtcaggagttcgagaacagccgatccaacatggtgaaaggccacctctactaaaaatacaaaatcacccgggcatggtggcgcatgcctgtaatctcagctactcaggaggctgaggcaggagaatcgcttgaacctgggaggtggaggttgcaaccaagatcgcaccattgcactctggccagggcaacaagagctaaactctgtctcaaaaaaaaaaaaaagcgtataatgctctcagttttcttccgtctttggatggaaggagttct

SEQ ID NO: 60534 - DNA, 1600 bp, Homo sapiens
ttaatacatagacattcagtgaatgctaaattattgtttttctatatatgtgatgacctgaccttccaaaaatggtttgtttgcttttaaatttactgagcattccctactagaaaagccaaggcttaggcaaaacactcaaacttaggaaattaaactgtaaatctcacaaatatattggcaaaagtatctagtgagtcaaggattcttacatttaaataattttcgtggattttttttaaacatgagaaatattaactatgaaattatttgagggcagcattgacttttttagattttcttcaagttttggtataacacatttctgtttatatggaaatgatcatgttgacagttatttttatgtcaatatttagggagcattctattatcaataaaaatcttttctacagattgcagatttgtgaattacgaacatagtaggaaaaggagctcatcaaagggaagatatcaactaaacagattttaacacacacagaaaataagaaaaccaatttccaacattttttgcccttatagcccaagaacttagttcaactcaagtataagaacctgtgtagatactaataacttattaggttttcttgaatattatttcacaattttctgatccattcaaaacatggcagaatttgtacctaacctaattttctagttgtaccaggcagaaagtatatcctggaggataaagaaagattcttcatgagttatataagtgaaaagtataaaacttgaagtgatattctaactaaattatcaaactgaagttaaacaacaaattaggtgacagtattttgaaaacattaaactttagattgaggaaatgtgcatgatttatagattccctggtagccagggatgcatgataaatctttttttgttttaaaataattcttactcaaacatcacaggcttcttaaagacgcctttaaaatcagaggtattgtgattgtatgtgctttttttttttttaattggcaaaaaagagaaaaaggtttcctttttaaaaactgcacacacttttttgggggggtaataaatgaacatttttttgtttgttttttttagaactgagctctccatagacaaacataagtagcataacacagtgtctttcctcagacatcattctgtacagtaaatcaacataaacaactccgttcttattgactggattttttccaggtgggttaattgggtggggaaaattaattaaccttaacattagagcctcttttcttcctgttaaacttaaaggatgagttctttaaaaaaaagcaataaaccaaccaacaactgtaatctttcatatagagcaaatttttttaatgactacaattagaaaatatgtagaactattagtatatatacacagagccattagggatcatctgaatgccttgggaagatatggattaaatagaaaccaaatgtaattatcagatattctctcaagctcagtgcaaagctgaattccaaatctatggattttaaaagctgatattatctttctacactgtgtagaacaagtgtcacagcttaaaaaaaaaatagtggtgttgaaatttgggaagtgagc

SEQ ID NO: 60535 - DNA, 1401 bp, Homo sapiens
ggcatagtgatgctcgcctgtagtccgagctagagctacttgggaggctgaggtgggaggatcagttgagcccaaggaggtcaaggctgcagtgagcccagatcacaccactgcactccagcttaggcaacagagtgagaccctgtctcaaaaaaaaaatttctgcccaagaaaattggttacttagaagctaccaaaacaaaggtagtttctacttctgcctaagtatttctagtgaagctaaattcaacaactttctagattgagttgtttgaggatcttggttagaaagtttgtctatgtattgaaccaaaaactgccttcttaaattaaaacctgcaggtccctggtttgctcatggaagcataccgagtgagtttgctcccccttcagcatcataatggccttcacccagttgaagtcctatcatgcttcctttcctaatcccgttcctggttaaatatttggagcttttaatcctgtcccacacataggattctccttgcgtagacccttgtttgtcaggtgctctatgtgtgtgggctttttaagcacttgattcatattgttggtacctcagaagatagatttcttgtaaatattaaatccaagaatttttgtctatttttcaatttaaaatctcattgctttggggttctcttttccttccactgttacatatgtgtgacctcagaagtttcttcatctctagatgaggttgtaggaagaaatcctacaatctctaagagtccttcctgacctcaaaattttttggttttgtgaaaggattctgactgtaggtttggtcatctgtcaacaacaaccatcttgtccacctttgtgggaattacaaacttgattctcataccatatcaggaggtagacatacaacctaaaaatgttctaccttgatatctcaatccattcatagacatttagagagggtgagcatggtcatttttgtcttatttccatttagcatttggttagactttcaggttataatggtatcatgacctgaggttcagatttcttttgcccatatttactaccttggtacaggtttttctactcattcacactgggaccttctttaggaattgaactttatttctcagaagaatataaaaccttagcatctcatagctgaagaggaccttaatgatcacctaatttaatctcattctcattttatttatttatgtatttatttttaagatgaagtcttgctctgtggcccaggccagagtgcagtggtgcggtctcggctcactgcaacctctgcctcctggattcgagcgattctcgtgcctcagcctcccgagtagctgggattacaggcatgtgccaccacgcctggctaagtttttgtatttttggtagagacggggtttcaccatg

SEQ ID NO: 60536 - DNA, 1039 bp, Homo sapiens
tcaccaaatctttcaccaaaattgctacattaaaattccagcttttgattttttcccaacaatcctctatttatatgccatgataaagctataagccaaaaaagtaaaaggaagaaacaaaaggaattatgtaatctttgagagaaattgaatagtcaaagtttaactacaatcttgccttaaatgtaattggtgtttataattatatctcagtcagctagttattaatggttataaagataaatacttataaaactaactttccaaaattttcttctttttcctgctttatttaggtataattgacaaataaaaattatatattttatatgttggtcaaagggtacagacttacagttatgaaatgaatacattctggagacctaatgtacagcatggttaataacaatgtattatatacttgaaatttgctaagagtagatcttaagtaatctcaccacatatacacacaaggtaattatgtgaggtgatggatatgttaattagcttgattgtggtaattatttcacagtataaatgtatatcaaaacatcacattgtattccttaaatatatataattttaaactttcatttgtataattttaggtataatttgggcgactacaatggagagatcatgtctgaggttatggcacagagacagccaatgaaacctacttatgccatccccatcatccctattactaatagcagtcaatttaaacaccaggaagcaatggatgtgaaggagttcaaagttaataaggtgattaatgtttttgtgataatagtatctaataatgggatggtattttatcattagaatgaaagttaaaaagaaaaacacacataggccgggcacagtggctcacgcctgtaatcccagcacttcgggacacggaggtgggtagatcacctgaggtcaggagttcgggaccagcctgaccaacatggtgaaaccccgtctctactaaaaatacaaaaaaattagccaggtatggtggcatgcgcctgcaatcccagctactagggaggct

SEQ ID NO: 60537 - DNA, 1079 bp, Homo sapiens
tttaaagaccactcccttagcttttggtaaagtagttgaataatctacaaaataggacttaaatattatagaaaaaaatcttaaaggccttctccttttatattataaaaattgcctatgtgatgatttttgagctataaaaatggcacttcacatggttcaaccaaataagttttaatgatcgctttatgttcttaataggcttctagtgtatttgcttttaggagtggttggagggtgtcgcatccattgtcttttattacttatatgtatattcatagtaaagataatctcctttctttaactttaaatgtgtaagacaaatctaagcttagattgtttgcgactctgaaaacaaaatccaagaattctttcttatttctttagaaagtctaggtcttgtttttatgcagacatctgtggagtttttgtcggtgaattcacacagtaaatgattgcatatggttccttctgtcagcttttagtttggatgctgaacagcctgattatgatttggattctgaagatgaagtatttgtgaataaactgaaaaagaaaatggacatctgcccattgcaatttgaggagatgattgaccgcctagaaaaaggcagtggtcagcaggtacaacttcatttgtatataacaagtatatacatattctatgtaaagaactgtattgtatggaaagagtgtgagattgcaggttgggggtaatcagtcaggctttagagttaaaaagtatgaattcaaatctcatctctgcttatcagtaacctgtgtaatcttgagcaatatgtttaaatttttctgtgccttggttgccctgggattgtcgtaaagatgaaataatgtatataaagcaccctagttcagtgactgacaggcataatgtactcctcaagtttcccatttgttaataatgttgtaatattgattattgtcctttaaatttagaagtaaatacttatgaaccttgtatgtgtattgtatgaaaatgacataatggttttacatttagccagtcagtctgcaggaagccaaactactgctaaaagaagatgatgaactaattagag

SEQ ID NO: 60538 - DNA, 1035 bp, Homo sapiens
ttacttccccaggccagacactgtgttaagctttaagcagagatggcagtatttggcagctaaatagtgccctttgtacccatcacagactttaatgtctgactgggtttggaggttatttccccccactttaatagacgtaacattacagaggtggcatacaaggtgaaacctgttaccctccacttagcggtacagaagtaaagaaggcatgcctctccctaaagagatcacacacattctaatagggaggcatgcttaacaagcagattataaagtatgtgaagtgggttcttagccactaaaaaagatgaaagtggttaggaaccacttcttgggtggggaaaaatcaaaaaaggattctagatgagtgataccaggctgggtgctaaaaagaataaataggcatttgcctccttggtgggcaagcagaaaaacagggatttttgtaaaggcctgcagtcatgaaatagcatactgcatgaaatcaatgaaatctgatgttactagatcataaagaactgataacactggagagaataggaaaaaagggccttataccattctaaagatgtggactgtaatgttagtagaaggaattaagtaagggaaagatgtgagacaaatttttatattaaagctatttaatattttgcttatattcatatcaacctagcttaattttggtaagtaattaaacaacatttgatagtagcagcggttcttgcagatctaagatcctcccatttccatcagcatgacagtgttcgcgtagagaaacaaacttcctaggcaggaacatactcaccgagtgacagctgctgaaaactcaaaatctgaaatgctccgcagttcgaaatttttgagcaccaatgtgattccacgtgtggaaaattatacacctgccctcatgtgatgatgggtcacagtcaaaacttcacgcacaaaattatttaaaatattacataaaatcaccatcaggctatgcatataaagtatatgtgaaaaaaatgaattttgtgtttagacttgggt

SEQ ID NO: 60539 - DNA, 1184 bp, Homo sapiens
tgggctataaacataacaatcccaaaatcttagtggctttgcaacaaagttctgtttttagcattgcactatccattgggttgatttgggggttctgtactatgtggcctcactccaggatgcagacaggcagagcagcctttatcctgaacattgtgtacactgcagtggaggaaagagagcgctggaaatgtctgtctttgcatcagctgttaagatgctctggccagaagttacatgccacttttgctcacagctcattggccagaacaagaaacatagctgcatctaatcataaaggagccaggaggtacaatcttgtcatatgaccaaaaggcagaaacaaccacattaacaagtaggccaaggtttggcttacccttcttctcacagagaaaatacactcctctcccccggcgaagccagctcagaagtcccaagtaatgattgcatcaaacttaagagtttccaggtgatacgcataattctgtatatcagacctgtatgtgtttccttgacctggagaactgtgaacaaaaatgttacctgcaaccaccttcctgccacacccaatatacgttgaaataacagggacaggataaccccaataagcacttccatgtgtataacagaacattagaggagcactgcagtccccatcccaccgccattcagaaatccccccacagccccgtgtgacaagggctggcttaccctagatatggagagtgtgctggtttcagcactaggtctgctccctggtggggaactccccaggccattgttttttgtggctgttggcactgatatctaggagattgattcctccttttccatcatcttccttagcctcatctgaagtagtcattggaaaatatgccctcattgggagctaaaacccttgacaacctgcttcctatagaaagttggagacttaagcatacttttaaatcaggtttttaattcaggctctgggttgtttgttggtagcacaactgtgcaagcttgtaatgtgtctaaaaacacgtttccattcagctcatatgccagtgttctttaccagatgtatgtcttataaacgctgctaccggtaacctgttgggctctgtgtgtgtgtatttatgtgtctttttcttttcctcagagcattttattcaactgagagcattaattgggtgtcacaa

SEQ ID NO: 60540 - DNA, 1570 bp, Homo sapiens
tatgtccactgagaagatgaaagtatgggaaagtaatttaattagatatgtgccattggcatgttttggtggagtggtgagaaggaaagcccagctggagtagaagaaataatagaagatgaaaaaggggacatagcaagtatagtcaactctttggaatagctctgctatgaaagagagaaaaaaacagggctggagtagctggaggaggctcccagatcagcaaatgatttcttttaaaaattagttacaaagttccatcaggcacaaatgaaggaaacaaatgaagctgagccctagattgacccacttcactgccttgagagttttcagattgcagcacagggatgggaaattccaaacagatgtggcagctccttcagttgaagaaacagaattcagagtgtggggaggcctaagtgactttggagcagagtaccagggctgcacagaaaaagagctccagatattcacagggtgtcccttcgagtgtctagctgaaaactgatctgatcctgtccatgaggaacttccaagtctagggaaaagcaagaggaaagaaagaacagtttgggaagctcatagggctgagactgtgctacacattcccactaaccagaatggaaaggcctcaatacacagcgtatcaagtagaaccctcagaagggttattgtctcagtagtgaggccgaggccagattagttctaaagactgttctggacttgccctaacaaagattgagtactagcctcaaaagaatcaaactaaatttcaagtaacttgattgtgtcccagaacaaaggccaaaaatgtttaaaggaatatttagagatcctgcaacataaagctcagtgtttagcatccaataaaaaattatcaggcatttaaagaagctggaaaatatggcccataattagggaaaaaattaacagagacatagaaataacccaggtaatcaaattagattaaaatgttaaagctacaaataaaagcaagaattactagaacttgtagaattatttcatttgaaaagtatgaaataatcccatcctctctcctactcaaggacttcactcctaataactattttatgtctctcctggatccatttaatggagatattggttactaattccaacaggaacttttttttttcctttgtgaaaggaaggcagataaatgagaaaagatgcatgtcagtcgttaagagttgattatgacaggatgaggtagtttatcctatggttgtattttctctatgaggtatgagtgaggtcatcacctcaagagtgagggagaaccttcagagatgaggtaggtataggagagctaacttagaaaaatgtaaaaggattgatagacttgctgagggctcaatatttgtgatcatttaaagtgagaccagtcagctcacttgggcagtagcattcacttgagttccagcacaaagtaggtagatagggtttgtcaagggtcaatgtttggccagcaagtagaaaggaggaagacagggatgaaggcattaaaaattaggtagtaggccgggcacggtggctcacacctgtaatc

SEQ ID NO: 60541 - DNA, 1045 bp, Homo sapiens
tgcctacagtgtagcttaaattttgtaaacgagagaaaaaattctgcataaaggttcatgaatgtgtgggcaggattaaatataccaaccaatcctgttaaaaatggctgggttttagttttatattttgcattctactgtgtcatggtatgtactggtagtaatggtagaaacatagaatctatacacacacacagacacacacacacagacatgtgtccatgttttaaagcacttagtaatggcaagagtcctttttatgtatgtaaagatgtgatttctgattacatttattactcaattttcttgaaaagttaaggatgcttaattgttaacagcagttagttaaaagcagaagatagcattttaagggagcaataataccatggaattgtatcatttgtgattgtacttcttagaagaagagatgcacaaggaaatgagaattttatattgtaattcaggaataaaaagaattgagcgtgtctaagggcaaaagtgatatgaaagtatgacatactttcagagacaactagagtatgtatttacttttaaagtagacttttggaacactgaagtgtgacttgcattgataacaataactttttggtaagaataaaccaaattctgagaaatcaatgagaagacaagggattcaaatgttttaaacaacttgctagaattgcgggtttttttttgagtcaaagtcttgctctgtcacccaggctggagagcagtgacacgatcatagctcactgcagctgcagcctcaacctccctagctcaagcagtcctctcacctcagccttacaagtagctgagactacaggtacacaccaccacgcctaattttttctatttttatttttaaatattcaccatgttgcctgggctgttctcaaactcttgggctcaagtgatccacccaccttggtctcccaaagtgctgagattataggcgagaaccactgcacctggccctagaattgcttttaatttattgatgctaactgttgccttcaacacatttataaactgtagaaaa

SEQ ID NO: 60542 - DNA, 1396 bp, Homo sapiens
tctgcaaggaaatgtcgagggtgcagcgtgtttgcccggacgacttacttttctagaagataagacttactttcagtgtcctctttctgggacgtttgtatccatccctctccagagctagttggtcggaggataataaaccactatccctgactttttctgtgatccttgcgaatatcttgcagatttgtttggagtacctctctcttctgaagcctgtaaccttacctatttgtaaaataaatttaagttctcctgctctctggtatctcaacatagggggagaaaagacccaatttaagtaacttttatagatctaaatttcgaaggaggatcctttcttattcaaaaccgaactaaaactaagtgacttgattcacagaaatcttaatattgagatgtctaaattgggtgggtttcagcacgtaaatgttgacaactaatagacattttaccatcgctgtggctttaccttgttgtggaagttgggttcggacaccaggataatagaatcttcctctcatttcccccagatccttgacagtataacttgatgacttctaatcctaaggaattgcataccttggttttcaggtacagccatttaaacagggtgcagtgtattgacagttcaaggaagtccaggagtcgcgtggatttgtgtgctacaattttgttgtggaaaattgtactgtaatacttctcttggtactgtaagaatttttaatgtagaaattatgctctgtaatgttgtttttggaaataaaactgtttaaactctttgggttgtttaaccttttaaagtgaaatagctgtgacagtgaaatgttacttttgagagtagtgtcttaaatctaactttacagataagccaagtgtatgtagtagctcagattgtctagttgggcactgactttcagcacattgtctcatgagacactacctcttaatttattttacttgtatcaactttagagtagcatggccatttgtttattttttaataagtgatttgtttttaaaaattaaagtacttgtgactgcagaatcttgtcttttggttttatttttatttctaagttttacagataatactttcaagtattggggtgttggttttaccctgccctggaaattaatttgtaattcttgttcagcagccaaggaaggggaaagccttgattaaagcaagacagcacaacagtacactttagactttagttaagtcttgcttctgtgaatactttggacagtcccaagagttacaacctgaagtcagagctgagctcaatgaagtatcagtgcttgttaaattttacgggtaatttttattcgctgaaataatttagatttttcttcttttcttttctgagatggagtctcactctgttgccca

SEQ ID NO: 60543 - DNA, 1051 bp, Homo sapiens
actgtaatattttctttccaacatttcctagatgaaaaaaacaacatactataaagggcttccagtgtttgtttacctaaatgttatggtggaagaattgtttgcagtcatttctttatgtagcttattatgaaagtaaaaagcaggaagttaagagaaatgattagaaatgattacttcaagtgataatgtattcagtattcatacttttgcagaatgctttaaattattgcactacatcactttttaatgtagagatcattgtgcatttacatggtttaaagatattaatttcacattttcccaattaaatacaaatacagtacctcactttattattagtcccgtgaggatgtagagaccatatcttgtttattattgtttctccaacacaaactgtcttgccttagctcttagtaaacatttgataaatatttgttgaatgcttgaagaaatgaggaatccggactcctgctaccaaaaccagtattatgatttttaatcttgttgtcccatcaaagagagtttaactctttgcatcactgtccattctggctgtcattctttcctgcctggctcagaaaaagacagccctaaaattaacccatttaaatgattctttgcttttagtatacaaacatgcccacatctctcctactttcaaaaacaatgaaacccttgacttcaaatagctacccctttctctctctctttgcccttcattaccaaccctcttaaacatctctttcttcgattctagttcgcacttcacttcaatctgggactgcactctggaatcagataccagggatttctttttttgctttttttttttttttttgaaatggagttgtgctcttgttgcccaggttggagtgcaatggcgcgatcttggctcattgcaacctccgcctccttggttcaaggtatttttctgcctcagcctcctgagtagctgggattacaggcatgtgccaccacgcccagctaattttatatttttagtagagacagggtttctccgtgttggtcaggctagtcttgtactccc

SEQ ID NO: 60544 - DNA, 2041 bp, Homo sapiens
ctgtaacattttagctattcataaaatgtaaatgccccatcaaggctagtttttgacattatagattatttatagaatgaaatactgcaggtgtaaatatattatctaaccctctggttatgctggagagtttagttctctgaagttgatctaccaaataaaatatactttccaacacatgtattgctaaaatagtctgctattcagaatggcgataatttttattttatttaatctctgaaaactaaacatgtgtatataaggtagcccccttttaaaaacaaactgatgctctgaagtccatatggagctatgcaatgctctttgttctcctacatcattgactattacatcattgattatgaagtaactattatagttaaatcttcacttttaaaaatccttcatatatatttatatgactgataacattttatatatgactcttacatcactaagtatttaaggaggttgaaatctatgaggcaaaaacagttcactattttatattattctccattttaaaatccaccttgagcttcattttagctcttgattccttgaacattattttttttaattgataacatttttatagaaatgtagttcatgagcttggtgtgattgtgattagaattataacaaatttttggattaaaaacctttatttattaaatttagcagatagagaactaactcagtctttcatggtaacagttgctagatcatggacaataaaaaattattttaaaaaattcccaaaatgtcattttagtcaacagttacacacttatttctttcttgaacaccattttatcagataatagcaagtagcaaaatttactatattgtcatatcatttttctcatcctgcccatccctctgatggagggaggggctaatgagtagtgaaattaccaaaaaacaggttgcagaaagcagaaagaaataatgccaaagacatggagaatctgtaaatcaaattagaaacaataaacctcagaaaaatgaacttgaaattaaggagctcaatcaataacaaataaactgaaaattatattaagacaatgtaatgaaccaacacaatttcctaatttattaacttgcattcattagtattgttaaagactgaggaagtttcaggttagccaaactcattagatgataggtaatggtagggtaaggtaacaaagggaagaaagatttagagatgttaaggtgaccaaacataaaatgctaaaaatattagccagggctaatctaatctaccttggaatgaacttttttaaaagaagaaaatataaaataaaattctatcctgtgaaatcacgcacaatatagacctgaaattgtctgtttccaattctacccacttctcatgcatatttacctctgttatttgctagatgtgttactactttccataagacgatacagatacaccactgtcctcctcagcatggttttgcaaaagaaaacaagaggaaaatgatacacaaaatgtgtgtttgtgttatgactttgtttttgatctttccaaaatgattatcaaatggagaatctaaagggaaagtaaagcagatgtataattttataaatatttttatgaaaaagataaaagcagattttataattgatttgttcaacatttgtttctatttttattcgggggtttgtttattctagatcttcccccatctattatgtatcattctgataagatgctatgatgcaatattaagcaaaagaggcaaggattcctgctgtaatggagtctacactccaatgtggttagagttctaaagatactttaaatctaaggtcttagatgtgtgagattcccaaatgaaggccaaataatatttttagaaaaaaaatatttttttaatttagatctgtttaaataggatttgacaagtgttcttccattgaaggaccatgattcgggcatcaagtactcacatattggggttgggagaggatgtagcccttaagctttagatataacccaaatagatgctacagatggttgcctaataca

SEQ ID NO: 60545 - DNA, 1339 bp, Homo sapiens
ttacttggatacaaactacagaaaagctgcccttggtataatgaaggtggaggttgacataaccgggtttatattaagttatggctgttactaaatagtggatcttttatttgctgatcagatctcaacttgtagtctatgatattatttctttgaagctcttcattagataatctttgcaggtctatcttgtttttctcctatacggtacatttgggagacattttgtaatttttggcatttttctaattttttttctttttgcacacggtgggagatcttttttgttttgcattgatctgtgttggtggcgctgtagtgctcctcaacaatttatgtcagtttcactaaaagaaaaaaggaagaaaaaaaaagaggtggggcaagatttgatctattctcttctccctttattttcttaaagaaagttcattttagtcagtggaagtattcagttgtgttatttaaatgttttctgtgaactgtgaactatggtgagagcagacatgtcgtcacaaccagccgagggaacatcagggacaggcatgcagtttgcagttgttttatctgatctgatttatcatctctatatcagaattattcagtaataagctgtcgatttatccttttagtaacattttgcattttccttatattacaaaattatatgtgttagtgtattttcaatttaaccaaatgtctgagttttagttccttcaacattgtaaaagttgaatttcattttgaacctagggatttcttaaataactattctaagtttctcctgaggtttttctaataagtagtcatataataattcccacattattgtttgtttcattttgaaatgatacttcaactgaattacagatagtcttgttttaaaaataacaaatattttggaataagataattttttaagaatatgtgcacaattgcttttggctttaaaaattttgatgttcacatatctaaatgcaggattatatcttttccatctttgttcttattgagttatctgattagagaatgtgggatttaggcccaaagcctcccaagaacaaaaatgtgttacgatctgacataggttttactggtctctgtaaacattttagctgtttatggagatagtaagtgtgcccttagttcaaaaagaaagtgggacgaatcagtaattgaaccctaaagcgtattttttttggtcacataaaataaaaacaactgaaatagtacactagaccacttttccataagattgaagagattattttttgaaagagtgaacatttcaagaattattatttagcgtgtttacccactttgaaatacgtaaatgctc

SEQ ID NO: 60546 - DNA, 1034 bp, Homo sapiens
tttgggaggccgaggtgggtggatcacttgaggtcaggagtttgagaccagtctggccaacatggtgaaaccctgtctctactaaaaatacaaaaattagctgggcatggtggtaggtgcctgtaatcccagctactcaggaggtgaggcaggagaatcacctgaacccaggaagtggaagttccagtaagccaagagcataccacttcactccagcctgggcgacagagtgagactccgtctcaaaaaacaaacagtacagtgttagagaataacagggagggaaataaataaacaaggtggtaaggaagttgtctctagaggagtggggcttaacctaggcttgaaggatgacaaggagacacatttgaaaaatatcggagaagtcacagtctaggaagaggctacagcatgtgcgaaggccctgaggcagaatgaagcttggcacattctaggaagggaaatgaggccagtgtggtttcagcacatcaagaagtgcatcagatgaaatcagaaatgtagactggagagagatcctgcagaggtttgtaggccacagaaaggaattccgtgtttaagacagagaacgttgaacttccagattttagaggttttgataatgataaggtccagagaaggtagaggggaaaaaaaacccctcaatgctaattttgaatttacatagctacattacagggttttggtattatatttttaaaaatccatatttcactcacatagttacagccattgattatgactcagttcataaataaatatgaataagacacaaatatctgagatcattcatagtacaaacaaaatgaaaaggaggaattcaggcaacaatttgcctcagttttctctaatggtgctgattttgatatttttgattaaaaaaatactacattttatatcagttgaacagtgctcaccttttttttttttttttttttttttaaaacaaatgaggccaggagcagtggctcacacctgtaatcccagcactttgggaggctgaggtgggcggatca

SEQ ID NO: 60547 - DNA, 1036 bp, Homo sapiens
ctcaatattactcactgtaatgcggcatggctaattttttaaacctttggtttcattctcagaatggaggtgctaatagctagcttatggtcttgtgtaaatgactagcccgtatacacagatataaaataactagcagattttataataatggcagatataaaatgactagcagattttaagttgtgctgcttcttttgttctttgtcttaaagcagctgacagacaatcctatatttctttagatatttgtttttatattcaattcggtgtaccttacttcgtttatatacatgatctaacaactttaataatttttattgccctcggagaaactatttttattatttatctttccaggaagaagttgaggtagttcacaataaaaattatacacaaaaagagaaggtaaaaataaaggactcaaatctcagatgcttatgtggtcattcaaaatcagtatatatttaagtcatagtttggtattcaagataataatgagttgacatatacagaaggtaaagggcaaaagtaaaaacaaatccaaaggccgggcgcggtggctcatgcctgtaatcccagcactttgggaggccgaggcaggcagatcacgaggtcaggagatcaagaccatcctggccaacacagtgaaactccatctctactaaaaatacaaaaattagccgggcatggtggcgcatgcctgtaatcccagctactcaggaggcggaggcaggagaatcccttgaaccagggagttggaggttgcagtgagccaagatcgcaccatagcactctagcctggcgacagagcaagactccatctcaaaaaaaaaaaaaaaaaaacccaaaaacagaggcatgaatttttaaataacatatacaaatgaagtaaataataatataaaagacaaatttctcacaacatatactactgtctccattttggttatttcctcacctgtggatattcttggattttatcacttgtcctttgtccacctgaatctgaaaccagtgattttcttgtttcttt

SEQ ID NO: 60548 - DNA, 1033 bp, Homo sapiens
tacaggcgcccgccaccatgcccagctaatttttgtatgtttagtagagagggggtttcaccatgttggccatggtagtcttgaactcctgacctcaggtgatctgcctgcctcggcctcccaaagtgctgggattacaggtgtgagccaccttgcccggctggcctaaccttttggttacatacttctgtaaacatatttgaacatgtattctcagtatacttattttaaaattgataaattacaaaaagtacctccacagtttattatatatagtattagcattataaacacttcaacaagaatatttaaaaggattagataattatgtaatagataagtttaaaataaattttgagctactctgcctgtggagcaggcctgctctgtctatggatcagctattttcttgtactctgttgctctaataaacatgcttttctttaactcaaaaaattttttttttgtttactaaaagtataaaaccttatttgctcttaatttagaaatataagtgtaattttagggcctactctccttctataatgtctcttccaatgctaaaatatgataatttctttgcttttttgataccttaatcttacgaaattgtcatattaaaaaactaccttaaatgatatttttctaaatgactgtaaacatttcatatgcatacttgatatttttaaatgtagtattatctttatcacagatcactgcccaaagcggaagactgattgaaaagaggtaaaacactttttaaaaatttgttccctcattttctaatctttatcagttcacatacctaagcaatgaaaataaccattctaaatttaatgtcacaaaactctttgaaactaattttaagtagaaaatgttagaaactttagatatcaaagttagaagagttgatgcagtcaaaatcaaaattaaatgaaaaatttaaatttaaatttaaattaaggacaatgtagaaacaaacttttttttcctgacaacagcaattaaaatttccagatagtgaggaactaac

SEQ ID NO: 60549 - DNA, 1040 bp, Homo sapiens
tctttgtacattggtaaatctcagaaaatagaaacactggcttacaaaaagcattttaaagagagtttctggtctctatgaagacatggtaaggcagtttcagttactttccatgggtgtttggaaaaatcttaaagaggggttatgataatgttacctagtgagttattacccctggcagccctcattctacttttctgataagtcacattttagaattttaatgggaagtgatagaatggaagaagggttcaatggagaacaacagaatgaggatgatggggaatatagtacatcaagattaaaaaaatcatagaatggatatatcaaataattcctcttaaatgcctttttccccctagaaatgttgattgatgtaataacttcaggaggaagattattttaattcatttcaattcagtttagctctaatgaggaaacactgactgagcatctatgctgtgcaaggcactgtgctgggtattatgggatataaagggcttcaaatatatggtcattgccctcaatgcattaacagtctagtagggccgactagacatgtacaaaaataagtgaagtataatgcagacgttgcattctataaaacattaccaagaagctacatcaaagaagaggaaaagctatttctgactggattaagaattacataccatttaattttagaaagatggttgggttggattttaacagggaaatgtgaggaaagggtgtgccaagtggacagaactttgctttgaggcaaagatgaagatgtttagaatctatacagtgtgctcaggaagaggccaaaaattcattttgtttgcatcctagactaaggacaataatgggaaatatgagatgaaataggttgtttcagcttgataggttttatagaattgcacttaatagctttaggttaattattatatattatataataatataatatattacatattatattatgttgctaaatataataaaaattcaaactattaagcacatggcacaatattattcatcaaccttcattttgg

SEQ ID NO: 60550 - DNA, 1039 bp, Homo sapiens
gaataaatgaatgagtaaatttaacagctaatcatctaatctatggagaaaaaaaatggacatgttccaacactcttctcttgtatgttttcgtgcttgatagcaaacccaagtaataatgaaagtcctaatgaaagtatttagaaagaactaggttgactgtgtaactcttcaaaataaaacaccatgaattagttcacattttcatttctaaaaagtgtgaatttcaatgccacaaaacatttaagaaaagctaacaacgcacatgatgtgaaacaataaattattaaaatctattgtttgattaactatttaccactaactcattccctaagccaaaataaactgataaatgttgtaaagagcaaaaatgtactttattgtaagcaataccatgtatctgctcaggtggggtctccttacttcgctcccatccactctctgaaggtttgggagacttttccaaagtatttcagaaactctattagcatctaagaagtaacccaaaatgaaggttgatgaataatattgtgccatgtgcttaatagtttgaatttttattatatttagcaacataatataatatgtaatatattatattattatataatatataataattaacctaaagctattaagtgcaattctataaaacctatcaagctgaaacaacctatttcatctcatatttcccattattgtccttagtctaggatgcaaacaaaatgaatttttggcctcttcctgagcacactgtatagattctaaacatcttcatctttgcctcaaagcaaagttctgtccacttggcacaccctttcctcacatttccctgttaaaatccaacccaaccatctttctaaaattaaatggtatgtaattcttaatccagtcagaaatagcttttcctcttctttgatgtagcttcttggtaatgttttatagaatgcaacgtctgcattatacttcacttatttttgtacatgtctagtcggccctactagactgttaatgcattgagggcaatgaccatatattt

SEQ ID NO: 60551 - DNA, 1103 bp, Homo sapiens
ctgtagagggctttcccaatccagggaggcagggtgctgtgcgtgttcagtccagagggcagggtgatcagatcagattagtgtttctctaggaggctggcctatgcccattttaaaattgagttctgttgttgtggttgagttgtaggaggtctctatatattctggattattaataccttatcagatatgtgatttaaaaatattttctcccattctgtggtttgcctttttactcttgatattttccattgatgactgaaagtttttaattttgataaattctaacatgtctatttttttggacagtgtgtttggtatcatccaagaagtcattgccaaatccaatatatggttttctcctatgttttcttctaagagttttaaagtacagctcttagttttaggttttcggtctactttgagttaatttttgtctgtgtaagataaagggcacaacgtcattattttgcatgtggatatctagttttctcagcatcatatgttgtaaagactattttttccataccgattagtcttagcactcttgtaaaaaatcatttgaccatatatgtgagggtttatttctcagctctctatcctattccatcagactatgtgtttgtctttaggccagtaccatactgttttggttattgtagttttgcagtaagcttcgaaattatgaagtgtaagtctttcaattttgttctttgtcaagattattttgactatcgggtcccttataggggcagggtctccaactcctggtctgtggcctattaggaactgggccacacagcaggaggtgagcagtgggtgagcaagggaagcttcatctgtgtttacagctgttcctcattgctggcattaccacttgagctctgcctcctgtcagatcagtggcagcattagattctcataggagcacaaaccctattgtgaactgcgcatgagagggatctaggttgtgtgctccttatgagaatctaatgcctgataatctatcactgtctcccatcacccccagatgggaccacctagtttcaggaaaacaagcttagggctaccactgatcctacattatggtgaattgtataatt

SEQ ID NO: 60552 - DNA, 1474 bp, Homo sapiens
gttggttatgcattgttcaaaaaattaatattttgaatagggtgaatatttttattatttgtgatttaaaagataattgcataacttctttaaaattgaaaagaaaagtaataaagtaatttgaaactttcaaactcaccactgcctggtcaggccttctgtgatctgggcctaccctgttgatccactgtatttccagctgtttttcaataagcaccatccacacgagtcagtattattttcaaaaggcttctatacttgcaatttcctttcctgcatttctgaatttgtcatgttgcttatcttgctcagaatttccttcattctcaaaagtatgggtgtggtacagattttcgggcagcagcatgtaacactttaaagaaaagttatgtgttaattgaaaaaaagtttaattttactccagttgatataatttttattgtatatgatatcatggaaaacagaatgtatgaataatataaacaatgaaaatggaaaatagtatataaatctacctacctattgtttttatagaatgatgctgtgacattctcaacttagaggagtataaatatagataatggttctccaactttagctagcaacagaatcgctcagacaacttactaaaacagatttctggacctgaacccagagcttctgattcagtagttctggggttgcggcctaagaaactgcatttcttagaagttcccaggcgatgcccatgctgctagcccagagaccacactttaagaagtcttaatggagacattcaaaaagttccagttcactggaattttgtattttggcatacaaaaaaaatgtatatacttaatatgcctatggttcttcaaaaaatcagtcagttttaaatgagaggccaatttgtaaaccacaacaaaattaacttagtatcatggaggaaataacagcaagtccattttaggcagaagactcatctttaagctaatggaaactaagatggagtcataaaatatctcttgatttcaataatctttgttgcaacattgtttgttacatagaaaaaacgggaaacaaccaaagggcctatttaacagaggctcataagctatgatagatctaaatataaaggacttaaaaataatttgattgatttggatgtgctgatacggaaagactttcaagatatgatacaaggctacagtaaccaaaacagcatggtactggtacaaaaacagacacaccgaccaatgaaacagaacagagggcccagaaataaggctgcacatctacaaccatctgatctttgacaaacctgacaaaaacaagcaatagggaaaagactccctgttcaataaatggtgctgggataactggctagccatatgcagaagattgaaactggaccccttccttaaaccttatacaaaaattaactcaagatggattaaagacttaaatgtaaaatcccaaagtataaaaaccctgg

SEQ ID NO: 60553 - DNA, 1870 bp, Homo sapiens
gatggcagccaaagtctttcaaagaccctagaccctattcacatttgccctgattctggcctaatttgagctaattagagtcattggttaaaactggcatcccctgctcaatattaagggttatcctgctatcctgaaaaagtattacattttaccccaaagctcagttgaaagactattcctggtcctacttctccaaggagctatttttagttgaaccagtctaatgactggttcatattcaagcagaaatattttctgtatatccctctgaatagctcactgccttcccaggtcctggtggctattggatcattggtaattctggagttgcacagttcaatatgggagccacaagccacataggattattcatgtttaaactaatcaaatgtatgtaaaattaaaaatctagattcccagtcacactacccacatataaagagcccaagagccacatatgagtcatacctcccatactgtagggcacaggtgtggaatatttttatatcacaaaacattctactgaaaagtgctgaggagtcataattgccatgaaaaagatggtctaggaggaggaccatttaaatgaagccaagatagcttgaatctattaactgggtctcctctgccagtagctacaggacctggattaaaaaaaaaaaaatcaactgcaaccatttgcatatgggcttgggcattagtttatttcccttgtatcctcttcaaacaataagctccatggttctcaactctggctgcgtattagaatcacacagagaatctggtttaattggtctggggatgcaaggcagaaaactggtaggctttaaaagccccaggtgagttctattttgtatttaggcttgaaaagtactgatttagaaaatgcattacctcatttaatcaaataagtattctataaaggcagagcttcagtgaaaataaaacttcctccatgttttatagaaaagcctgctgaatcccagacttaactaatgggaattaagatagagctggcattgttatccaggtagttcataggggcaaactgagaagctggattggatctagtttagataaccctaacaatcaccacccattgcaggtagtcttccatactacactaaaactataaaaataattatagaaagaaacataaaatccactttattcacaacccaattatcggcaacttgcaataacaattctgctattcatttctgcatatattctctccaaaaccctcaccagagttattaatatagttcacatttatgttacctttgggatctttcacagttttagagaataattgatcactagggaataatttctccatttattttctcttgacagtttcattatgctgaattcatgagtttttctaaccatataaattgttcatttttcattactatataaaatgtaaataatatctttacaatgggagattataaaggatggaaactatttcagtcattttatttcactttattttgtttgagtagaaatccaattttctttattattttttggcagaaacataactccagaatatttagattaatattactgctcattcctctgattcttgctggggaaaaataggaaaatttaaggcataaaagaatattctgcaagtctaaatatttatgtcagtgataacccagattgggtttaggacaattttatagccaataatatttatgctcttcaggggacagtaaaaacgcagttacaaatactatttcagtgttataaaacatttgattggtaagaatcacatctttaaaattattagcagttgtattttgtgccattacaaattctacagagtatgcttaacacatatcaggttattgtcata

SEQ ID NO: 60554 - DNA, 1991 bp, Homo sapiens
ttactctctaaattagtaacttccgtaggagaccccagaagcacacctccctcccagcagtgaaagccgaggattcccgttttgattagcaggcgccttctgttcacgataaagggataagaatcaggcagtgatggcagcggagttcatgcttcattaaggcaggcattgcaaactagttcagaggagagaatccacgatgacagcacattctgtgccatggagaacattcttaaatcaagcctccagtggaggaaggactcaagaatgaaatagcaccagataacggggcatcattagacttgtaaagcaaagcttccattttctatttttatataaaccattattaatgcctttaaaacaactgtgatatctggacaaataaaatagaaatgacttcttaagatgattgcaacttttagtcttgatttataaaaattattctacataattttagtagggtaactgataatttttctcactttttttttgttgtagggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttactcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctgtcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcatttctggttggtgggtagttcacttatgaagctaaaacataattctttaaaaaaatgtactagggacataaggagagtggtatggtgaaatacagacttgaagactgtccttgggctctctgaatcatggtggatagatccttacttatcctgctacgctgggagagaggtttca

SEQ ID NO: 60555 - DNA, 1244 bp, Homo sapiens
gagaaaaaatttctgtcctactgaggtgaaattttcacccttgctgtacctttcattgtattttgaaggaaattatcagtaaatgttatttaaacttaatgtttataatgtatatatggctaaaatgttgctaaaataagcattttatgtaattcaggaagcagaagtttggtaaaaatttctctatgcattattgaagtccaggcaatttgatggctacagattattttaagagatgtttttctcaagaaaaagtagaaattaacaattgaaataaatgaatgagcatcaagaaattacatcatggattgtaagaaacttttctgatatggaccaaggtttgccagtcaattatgtcattgaaatttttgaaataatgggcaggcgctaattactttggcagaagactaccatgtaggaacattaagaagaacatgtcacattatcagcttctaactgttggagtgggttaaaaaaatggtctgtcctcatctgctgctatgcgggtttaaatgtggctcccaaatctcccacacttctgcattatgtatttaatacattgtagagatggttctgcagctaccactgtcagccattccagagtgagcacaaagatgacattttactgagcttgagggcttcctttcataatataaccctgttctcttgctgcgggtttttttggggtggggtggtgttgcactctgaatgatggaaactaatttgaattattttagtttaccttcatttaaaatgatgcctaatacagatagtgagcttaattttacctctaaccttgcatgttaaacttttgtttgagtggactttgaaataataaatacaaatgtttgtgtatacgacaagacagatttttctccaaaggtaagttcttccatataaattacactttggactcatctatatagggctttttttctttattttttgttttcttttttttttttgtccttcccttataattcttgagtattaaatactagatttagcaaatatattgtattaaagaaatttaattagatgctaatttattttcccaacatatttgaaggaatgtgtagcacttagcctcaaatcagataggatataaatgtggagtgtaatttatttgcactctggctttttaagatagtagttgccaaaatccagtttcctgacccccattttgaaatgtctgctctcacagctgtataatgtattagcttcagttgggactagagctgaga

SEQ ID NO: 60556 - DNA, 2045 bp, Homo sapiens
aatatctctccatttattcagtctgaaagatttctttttatcagtatttagtaattcttaacatgcaaatcttgcatatattttgttagacttatatgtaagtttttcatgctttttcattctgtagtaaatattactgtttaaaaacttatattttcaatatgtagaaataaattatatatatagaaaaatacatgatttttgttcattgatcatgtatcctgcaaccttgtaaactcacttgttagttctaagagctattttatagattctttgggatagtgtgcgttcactctcttgggtgtttattcctgtatgttttttataagacactgcacagctctttgtggtgctcattattaccttcttattttccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacggtaagttacaaaacatccaaaaagcaaagtggcttataaagtaaatgtaatactcctaagacttatgtattagctgtcaggctgattattaaagtcctttctaagtattttattcccccaaaagtttcttactcaaggaatttgcatttagtgaaaaacagaaagcatcctaaatatatcccattgaaacaaaacattgattataagcatgtatattctggttactgtggccagtatttttatttctttaatagttttgatcctaaatctgccttttcatctaatgtgaagtagaatcctaaataatgttatctgtgtagcaagctattcaatggaaagctgcttctttctttaaaacaaacaaacaaaaaaaaccttcagtgaaagccagattcaaaaggttatataccaagcttgtccaactcgcagctcgtcggccaggacatgcagcccagaatagctttgaatgtggccccaacacaaatttgtaaactttcttagaaattgtaattattattattatttttttttggtaacttttttttaaagctcatcagctatcgttagtgtattttatgtgtggcccaagacaattcttcttcttccagtgtggcccagggaagccaaaagattggacacccctgctatatactatatgattccatttagaggacattctggaaaagcaaaactgtaggggcaaaaatcagtggttgctaggggctggaatgggggaaagtgttgaccacagaggggcgtaagggatcttccttgggatgatcttgattgtgggtggatttatgtatttgaaaactcacagaactatgtactttaaaaagatgtatgttcctctatgaaaattatatctcagtaaactttggcttataaaaatcttaaaagccctaagtgaccgaaaggttatgttagcattgagtgctttgaaatatggagtcagagggtggggtaaccaaatgttggcctttgtgtattcatcttttgatacaagaaagcaatgccaatcttcagtatttttaaattgtaaatgaattttgtagttagttgcactttactacaatttgcttgggtttttaaaaattatcaattttttaaattacaaatttcagaagggtagaaataaaaaaaaagacatttatagtgttcaaacactataaagggattttttttttctgatgaaatcattagaaactatttcttttactttagcaagaaaatccgatttacaagagtcctattaataatttcaagaatccaaactacggacgtaaagctggtctctaaattgccgttcgtattttgtttcactttctgcctttgcatgtgaacttctatcttttttactgcactgtgtgtcctttatcactattgctgttctttttttaagtctggctttaaatatcgctattgtggcttttctttttgtatgttaacttcgcgtttagaaagaccgtaaaataagtaatgtgatatagaaacagcagc

SEQ ID NO: 60557 - DNA, 1136 bp, Homo sapiens
accagtctggccaatgtggtgaaaccccatctctactaaaaatacaaaaattagccagatatggtggtgtgtgcctgtaatctcaactacttgggaggttgaggcttgcttgaacccgagaggcagaggttacagtgagccaaggtcacaccactgcactgcctggatgacagaacaagactccatcgcaaaaaaaaaattattatgattttatgttacatatttaatatgtgatagggctaatttattttactatcttttatttcttaatagggttttaatttgaactgtaataaatctttaattttattatggaaattagcatctttttacataatttttctatccacaaatgtaatgttcctcttcatttattgaaatcttccttcatagctgtttgttcaatttggtcacaagagtttagcatgggaaatatgtttaagcaaatatttactgaaataataaaatgtaaatatcataatttgtgttttttgtaacagagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccaggtagaaatgcgatgattgcagacattcttttcatatcttgtatgtcttgtttctgcttatttaggcctaacatccagaaacagcctccagctggaatattttaggtcaagttgggaaatttttcatctctcaaagcttaaaatattatctaattaactgtataagaaataaggaaaagagagttccacttttaagttttctgagtggagagtttgaagattaaatacagtgatttatataagacgcttagtgatttatataagacacttagaacgatgcctgacaccaagtgcatattaagagttttttgatgattgatgattttaaaattagagcttgatttaagcttgaatactgggaaagataatttgttaaaggatattaatataaagtgttgaatttg

SEQ ID NO: 60558 - DNA, 1518 bp, Homo sapiens
tctcagactgctgtgctagcagtgagcgaggctccatgggtgtgggaccctctgagctgggcatgggaccctctgagccaggcgcgggatataatcttctggtgttccgttttctaagagcattggaaaagcgcagtattagtgtgggagtgtcctgattttccaggtaccgtctgtcacagcttcccttggctaggaaagggaattccttgaccccttgtgcttcccgggtgaggcgatgccccgccctgcttcggctcacactccatgggctgcacctactgtccagcaagccccagtgagatgaacccagtacctcagttggaaatgcagaaaccacctgtcttctgtgtcgctcacgctgggagctgtagactagagctgttcctgtttggccatcttggaacctcttaaattatttttgttttgtgtgattgcaattttggcatgtttcttcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggtaagtaaagggcctgaagtggttgtaagatgtgatcccatctaatgccacgaaaaatcttgagtttagttggtgcataagtagaaaaggggtagcttgagggtcagtctcgcccctaggtatactttctcacatgttgttgcttattttacttttcagtcaatactgtgattgtatatttttaccattttgagaaatgatatgcttaattgcaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataagtaagtatttcctaattgcttgaaatagttgatacttcctcttggctctcctaagcctgtattgtttctagaaccagaacagtgccaatattaaaatatactgtaaataaaatgcctgccatgtggaagcctactctttaattcttaaaagttctttctcaacagctagtatatattacatggtatgaagtgtgtcatgtgagagttgtactattattttgatctgaatgtgctagataattgaatttacatggtaacctttattttggcaattaagatttaatttaatttaatttgtcattaccaatttcttaattactgtcttttgacaaaactaagccaaattaaagatttttcctcttgaaggattattatactagta

SEQ ID NO: 60559 - DNA, 1058 bp, Homo sapiens
catgcaggtccatttttagtaaaatgtcatttaaccaaaaagattatcttgaaaatactttgcctttctttcctttatatttttaccagatacagaatcagtgcagtcagtgtccatgagcattatgtgttctaaaaatacacagggaacctgaaaagtctgcacatgtaggatatatttatttttaaatagtatactagttatattttaagtggtatacacagtatgttttttttcaacttccatacacttttttgcatgtgtttattgtatttttttaggttaacagaccattgctttaaatttagacagttcacctggaatagtaaatgtaatagcataccatttgaaaatgtaactaacgtgctctttaaaattaagtttattctgcctttccacatgtgtcattcactattcattgctagattacatttttgtcttgaccaaaatggttactttcctgaagaaatttttttcctagactcttgcatatattccatatgaacttgagtggctggaatgtacatgtgcgcctgtgtatgtttgtccctgcttgcacatgtgtgtacactttactacacgactgtgacttgtggcatggacactcccacctaacagattaggagcttgaagagattttttatagttttattttctttcccagtttttcccttttaaattattattattattattccctccaagatgattcttcttcttttttattatactttaatttctagggtacatgtgcaaaacgtgcaggtttgttccatatgtatacatgtgacatgttggtgtgctgcacccattaactcgtcatttacattaggtatatctcctaatgctatccctgccccctacccccaccttatgacaggccccagtgtgtgatgttccccaccctgtgtccaagtgttctcattgttcagttcccacctatgagtgagaaggtgcagtgtttggttttctgtccttgcgatagttttctcagaatgatggtttccagcttcatccatgtccctacaaaggacgtgaactcatcattttttatggct

SEQ ID NO: 60560 - DNA, 1404 bp, Homo sapiens
tgtgttggccaggctggtctccaactcctgagctcaggcagtccacctaccttggcctcccaaagtgctgggattacaggtgtgagctaccacacccggcctattccacatttttaagactcctcctaattagtaacagccctctgcactgtgtgatcctgagtattttaactcagtgattaaaacaggaatactcttttcaattgtgtattttattttaaagatttgatccttattaattaaaacctgtttctctggcctctgtgttttctagttactcaattggatttggcttgtagatactttattgaaatatatttttttctgagcagtttatccattggttttatgcattcaagtagcattttgtttgacttttcctgtgtataattaggcattcttttagtccctttcctcagaagtcattttggaaaacggcaaattgtcagaaggcgtaacaataagttacaaatcttactgcaagaacggggtgaatggaacaggggaaaatggaagaaaatgttccaatatttccattggagatgaggtatgttgtataaagcattttctgtagaaaacattggttatttataagcaaatttagtttatagtttgagaaacattaaaataagtgagcaactttttgaaatattttttagtagatttaaattgtttagttggttgttaatcttttttttcccttcaaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtaagctgggtgttgtcagacagtgacagagctacattggtttagagagtataggcaggtcatattttgggacatccagagaatatctctctatttggagcaaattattttttccaaccacggttgctcaccacaagatcagtttgatgatcttgtgtgtgatatttatagaaagttccttcctgcctttttttcttaaagtgattactctttaaaataaaagattttatagccatgaaagaagtatattcaacaaattgttaaggtagcgtttctctcatgtgagagcaatcaattttctagaacaaaataagcttgtgtaaaataacgtttataggaaaatgttttggaaaaacatcaaaccgatgatggcgatttcgtctgggaaatggaattatgaagcagtagaagatgtttgtcttgtactacatgtacttctgcattgttggaataatttttaaaaaataaatatgtgttgtaaaatacaaaagagaaaa

SEQ ID NO: 60561 - DNA, 1010 bp, Homo sapiens
ttaatcacatattataaaactggtttctaggtttgactcctaaagttagttaggaggaaacatgggaactggcatttaaagataaaagttgctcagtggatcctaattggttgaatgaatagcagttgtattttacgtgttttatcttttaattgcaggagctgaaaaacttgatccctaagtcagcagtaggaacattatctgcaaattctagcaatgtaattcagttgatcattgatgcatacaatgtgagtacatcttaaataagatcagttttggacaataccctgttgagaatactttgtacaaagaaagtaaaacttccttcatacacactttagcgagcccaaagtactacagaaaaacttaaattctgtatgtatctagaggaaaaactttatacatattgtcttacaaaagcaagattcatggcctaaacaaagtgaaaatgtgataaaggcatgtggggagtatttccaaataactgtttgtttatcattaaggaatagatctccttgttagaaagcaattgtaaaacataacttacatttaaacttacaggatttctccaatctttttcctccccaaaatatcctttatagagtcatctattctgatgaattgtgctagaaaagtttttttttttgccaattcttctcttcccatatattcagaggatatgggtttctatttcaggaggtacacactcatatatacgtataccataaaatatataaaaatgtaaatatacatgtgatttgcctatttcaaaaagatttatagtgttgttttcccctcacagatgggaggaagttgaattgaaattaaagaggaattggcttatcctttttgagcataattcagtgtactttaatcacaccgagttagccttcattaataatcatttaaataatctgaaggcggttgtaatttggtaggtaacccttgtgtgtctcgtgcaccactttcagcccccatccccctaaccctttggcagcttgaattttaga

SEQ ID NO: 60562 - DNA, 3186 bp, Homo sapiens
attttaacatgagacttgggcggggacagatacccaaactgtatcagttactaatcccattcatgagggctctgccctcatgatctaatcaccttccaaaggaaccacttcctaataccatcatgttgggaattaggttttcaatgtaggaattttggggtaacacagacattcagtccatagtaacctacatttggtaacatagatgaattttttaaacaatgcaaatctctgtctttccatctatccatccattcattcatttatgtaccatttttttcttggcaggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggagtaagcgcattcatttcctatcaggggatattgtttctattatgtgtgtgaattttaagtgtgattttactatgataatagaaaaattgaccttaattttcatagatttgattatcttagagaagtaattttaagtaaacccttaaattgcctgtatacataaagtgcctttataaaagcatatttaatctttatgcaaaccacacagttagtttattcatgcgggcttttaaaagacagaatgctaaccatttgaaacagcggggcaacctctctgtactgtagctggtggtctggattttagaaaagcccatgtgtcctaactttctggctttgtactagagatagaattgatgttattatctgaggcatcaccaggaaccttgaaattgctcaaagggagagtgtcttgtatcattttcctttggtcagttttcttctcactgtctttgaaagacacatctttctcctgtgtcttagtaattcaaaaagagagaactttttaagctctagtttttaacctatatgaatagatgtattttgagaagtgatacaatatttgtaattttaattgtaagattttcagtagcaagcccatccctattggttcaataatttgtattttatgatccatgtagcagctatgtattttgagatgacactttaatgatgtggctgaggctgaaactagaagacattgtcatgtcaagtttgtcctgcgtacctactcttgtctcatttttgttccctccagtgcccccattctctagatgaccttctttgattttagaggcctcttagtggttatttttcagtcaatttttgctaaggtgctaattgatgcccaaaataataagtgaaggaatatggatagtaattaagaatttttctatcaccactgatgctgggcaatttactcagcctctccagggctgttttcttctctttaagaagggatcatgatagtatctacctcatagggctcttgtgaagttaaaatgcatcaatctctataaagtaccaatgagcattcagcaaatactaattcctatattgttattactttcgacttttcactagagtgtttgcaatttaaggttagtccctgctgttatagccgaagcaagtagcattccaggtagtacctagccttacacctcttttcttactagccattgatgtgtgagcctgttagcagctcgttgtggggagggcattctctgggctgcctctaactaggccttaacctgtggtattaaacaagccataacacccttgattgtggctgtttttctgtgttggtcatgctgatccactcctctagatgcaaaagaatcagacattccacttttgaaagattgccagtattaataaatgtgattcccaccttaaagtattttactgtcttatgaagatctaaacagacgtattaaataaattaacgaaagcaggtaaattcctatagtcctatgattttataattataaattaccatagtgacaagaagattttacagttactttagattctttattggaaagggcaaggataaagtaaatgagtgcataaacagtactgattgaggagttagaatgggtgaaattatccttaaacaagatacttatttctgttataaaaaaaggaagcctcatatggtgggctgataaagaaggtgcatggcatagaacatagagcagagatgggtggatggggacaagacagcagcagtggggtaaagtaaggataggctcagacactttcatttattcagcaaatgctcatcaagggcttactgcttgccaagcagtgtgctggcttgctagctgctggagatatgatgataagcagaactaaaccaaaccaaacaaaacaaaaaaacagtttttaaaaagaactgagagattgagagatacggatggtcaggcaagatatcgttgtacatgggatggaagagcttcattcagtgggctttgtgtgtttctcagcaagataattaccattgtataaagagaagacacagaaaatacagaattaggttaaaaatacaatggtggcctatatgaaaattaaaggatttttgttgaattactgtgaatagtgttttaaaattgaaatccttttcttttcaagtcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgtaagtgcctggttccttacatagtgaatgtgtttatgttggattttaatgtttaatactaagagcttgtgggtgactggcttggggtttctcagggtttgaggttttgctgttttggtaagtaggggtcctgattgaaagtgcaggaaagctagtgttgctgtttgtgaagatgcagctttgtatttgcttccttctgctcagacaagggcctcactggggtgggaaagggatgcccagatgccactttcactctttgcctcaactccccgcccacagcatttggtagcacagtcagtactctttctaaataaataatttatctagtctcatactctttgttttatacgatttttaaaagcagtcactctgc

SEQ ID NO: 60563 - DNA, 1165 bp, Homo sapiens
ataaataataaataataataaataaataattatttttaaagctgtctgccaggctttctaaagtaaagatcggatcatgttattcacttgcagggagtggcatcccactacacacagaacagagttcacaacttcagtgtctaaaaagtcagttgtaccctatcacgtgttctgccttgccctctccagactaatttatggtgttctatttgttttcttctcttataaactgactttttgtctgttttgtccactgtggattgggaatatcttttttatctttgcatcctgaaggcctggtgtttaaagtatttgttgaatgaaactgaatacatacccattgagttacttatggaattcccaggtttttgtaaaaattatgacaacatgttttattttattgtgtttaccgtgtaaaccacatttatttggtttttctcgtttgcgtttgattgccaacaggcaagtttcattttctaatctcttgtctaattaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggtaggaatgttgggaacattgaccattttcattataaagtcttggcaattctcaaatgttgttttatattttattcctttgttactcacaacatacttgtgagataaacaagccagttttttagccttttctgagtggaagttgatattccagtcacacgtttaataatcttttctgccaccttgttcctctgtcactggatgctactgtttgacacagattgtacctcatagataatgacttgcatgcttattttcatactaacttgatcatttatcttatgacttactttattttatttttaagagtttcactcttgtcgcccagactggagtgcagtggtgtgatctcggctcactgcaacctccgcttcccgggttcaagtgattttcctgccacagcctcccgagtagctgggattacaggcatctgccaccacccccaactaattttttgtatttttagtagagatgggggtttcaccatgttggccaggct

SEQ ID NO: 60564 - DNA, 1016 bp, Homo sapiens
ctaaacaattttaaaatacatatatttgtagctcatctttgtggcacatattagatttttatgggagaaccttcaaaaaaatcctagtcatttagtttgactgtttcagatttccccttttttgatggggaggtataaattaaccttcttaattatatttgagttaaactactggaattgatttgcatcccaatataagcttattgaggttaattagggtttggattttattcacttttgtcatctctatacttttgctaatatggtaccttccacaaagcctactaaatgttcagtgagtcaatgaatgaatgaatgaatatatcaaaagagaaggtaaggagaagtcattttgaggttgtatagtttattcacagaatgaataactaatatcagaagatcaaggggttactgattttgttttcatgcaggcatttgggcccaagtttcaagtgcctatttttgtatgcctaagtggtcaagtgtcagatatgtcgtatggtttgaccacatgaaagaaaaaatgagaggttttgttgtttttcaaaaattttctaatggtgttttctaaaagtggtgtgttgggattacattggcaacagtggaggaaatatggagtgttgtgagtttgtctcaggcaaggcttatgtaactgaagctcttggttttcatatctgaaaatgaggatgataatatccgctttatctattgttacaataattagaattgatgaacttaaagcagtttcacttaaaaacttctaaataagtggtagctgctattattgttaacatatccattttatggggactacagtttatctgtagttaaggattatcttagcctttgagctttggagcataatccttaaaattttaaaggctttctgaatatattcagtgaaattgtatttgggtgtcatgattgtaaatttcgtggattgattagtatttagaaatgtgtaattcactaggatcttgtgctttggtaggtagtagtttaggtttaataaatag

SEQ ID NO: 60565 - DNA, 1303 bp, Homo sapiens
taaaactgagtattttacttattgcatgcatagaagttgattttcttttcttttctttctttttttttgagatggagtcctgctctgttgcccaggctggagtgcagtggcataatcttggctcagtgaaacctttgcctcccaggttcaagcagttctcctgcctcagcctccggagtagctgggactacaggcacccacgacgatgcctggctaatttttagtagagctggggtttctccatgttggctgggttggtctcaaactcctgacctcaggtgatctgcctgcctcagcctcccaaagtgctgagattccaggcgtgagccagcgctcctggcagaagttgattttcttaaaaaagagagataataggaaaacaagctcaaaaatctatttggggccttatgcaggatgttggccttagcctgaagaaataaaaactgatgaagcgcattgttagcagagggatgacttgatcaggtttttgaaaacgaatgttcagcattgaggtaactgaggcatctggatatgctggtctgggcccctgggagccgcaggagataatggagatagagattctatgggctgagaccattggtaggttttatggtgttgaggaatacttaacactgattttttttttgagcgctgttaattaaatgttaaaatataatcggtttgctttagagaaaggcacgaatggattctggggctctggtatggaagttattttcgcagtgtaggtgcaaggtgagggaaccagatagggaggggagatgggcgagggtctgtggagaggggctggagtgaaatggtttgagagccatcatgtttataaaagcaatagaaggtacggtggggtaatactttctatttaatgcatttttcattttatttctttataactaatataaggcacattttacatttcagatgaatttacaaccaattttctggattggactgatcagttcagtttgctgtgtgtttgctcaaacaggtaaaaacaaaaaattttcttagttgtcttttcatttccgtatcttgtattgcgctttgaccagttaggttcatatgagaacctaagtcataatcatgctgctccttctggaagccctgcaattgttcctcttactcagagaaaggtcaagttccttcatggtcaggctcccctcacccctgccacctgggatgatgggaggcaagttggctggtgaagtactaaaatgctagggattgaacacactgcaagaagatcttttgagaacatgagagtgtgtaagtgaacagaaggcaaaag

SEQ ID NO: 60566 - DNA, 1049 bp, Homo sapiens
cttgaactctttgcctcaggcagtcctcttacctcagcccctcaaagtgctaagattgcaggcatgagcctaacagcaaagagttttgagcatggactttgtgccaagtatttctaggtgcaatagctataaataagatacacccaggccctattttcttggagcctagaatccatcagggaagacatgttaacaaatagttagaagtgaaatgagtgttacaaatatgcctgtataaattagggtgtccaatacctggtgggctctcaccattgcaggctctcactgtaatcccattgcatcttcctaattttctgcaacccctaagccgtacctcttttcctaggagttcttcctatttcagaaaaaaacagtcatgcatgaatgaactctctttgctttctcacctcctgctctgccttagaagaaaggcaccatgtctctgtttagggtgatccacccccttgggctgcacatgccatccctctttgctccaaggaggcctggcttcatcactttccttttctcttttcctgtgtcttcacctcttcaagtttgcccccagttctcctttcttcctaagtattcttttcatcccaatcacatccattttcataagttcggttagcacctagattatgacaactctcatgtctgtgtctctaactcttgacttatctcctgagatccatactcatgtcctagcttcccaataggcatcttccctagattttgcaataaaacaaacctcattttttcccctaaccccattctccctcgtacatcttctttattttaaagtgatgattattctaaattcctttctttctcccatccttccttctccaagtaagcagcagatccctcatagctaccttctaatcattgtttgttcgtcttcttgtttgttgctgttatctgaatttagacatttgtcacctctcacttgaacctttgcagtaaattctgtatttgtcttccagctcctgtcttgccccctgtccttttctccactgagtttctgccatgtatatgtagaggtattacta

SEQ ID NO: 60567 - DNA, 2990 bp, Homo sapiens
atgctgctagtgtgataagctgaaacatcttgtaactggtaaaagtttcagagaacttaactttctgaatatgtaacaagctgcatgtatctgaaagggttcatttagacttctgttagatattagcagattttctcactctgccagagagttaggatctgttaggttgtgggtggaatcctggagattatgccgggtaaatatgtaagtacctgtattgtattagcagtgtttactctgacttggttttaggttctgagagtttggctggttattttttcagaggtgggaggtatggagtagagacgttaagatacagaaaggtacattcgtcttctgaatcctgaagtgttatgctagaggtatctatagctgtggaaaactgaaaagatattatggtatgtacccagcttaaagggggtacagtccgtaaaagtcagaatattagcagccttccaatatgtctgtcggtaggtgaaaaaaaaagtttctctctttcaggagctgtgtacaaaaggatccaaactatactttgtacatttgttattgttttaaaagtggctgtgagtttttagaggtcagctaactttaaacttgccgtttggtttgtgactttagaaggtagagttaactatatttagcaatatgcttaagcgtgtgcatatcacctcatgaaacgtgtgtgtgcatgagaaaagctgcctccagtacacatacatatgtatatacacacatacacacaagcacatatatgtatgtatttcttataggaccaatctcattgtacataatttcaaagcacaggttcctatctccagggatgcataaaaagactcactgaagtatagggagaaaattttaggtctactattatgtttgttgatctcatcactttaaaatttaaaattttgattatgattgataatcttactatattgctgtagaagtacatgtatctgaatttataaattgcatttattttgggtacaggtatgcctagaatttttttgctgataaaggtgagtggtcagaaagctttgcagatccctatatggaggatgatttgagtggggttcaagaactactgtatttgggagggagaactgataagacttgataagagaaataaaagaaacccagtgtgacactggtttctggctaggaggtgctgttcactgaggtgagagggtgaccacaagctgggggtgctggttggctggagcagaggggaaatgatgaccttatgaggccaagtttttttttttaaggtgaccatgggacataggtggagatgtctaaattgcagttgaatacacagattgagagcttaaaaaaagaaaaaactctgagagatttcaatttgacaattcttagtctattgctggttgaagctataggctgtgcatgcaaacaccaaaggagggtgtggagtgaaaaacgggctgaaggaggacctgggaacacttttaatagtcaagggggggtggaggaagaggaatctagaaaagcatttaccttccccagtttcttctctgaacttctaattcctttgagtggcatttttgtgagtgacataggtatttctgggtttttccagtgattggcatgtttgagttaaagacagaaagacttcattggtcacatttctttgtggtaatttattttcagatacctgatcagagaagcagtttgatgtactaaaggcttctcgattgggagacaggaaacctgggtgtcagtgccgggtctgccactgaatttctgtgtgacctttgtcagagtactgtacttccagagcgttggtttccacatctaccctataaagcagcctgcatgtttctctcattctctcgttcgaggagttggaggatagctgctgcctgatgtaagtagagtgcagttctctctccatgagcaactttttttttttttgtatcaccagagagtgtaggcactgtgccacttactctgttaaggatacctgccagcgctgaccagcaacatctgtccctgtcagctctgcatcaggatgtagcttggctgtacattacattttattctatcagtacattgagtaccagttacctgaaaaatgctttactcagtggacatgaatcaagaagttggcatgctctttgatgttgagtctgttgtctaattggaacaagttgtgttcagttcaggaaaacataaataccaaagagtgttttatacaatgtactgtaccataaaatactgtaccatgtaatattccctaacaatgttagaaaaatctcagcattggcttgtgtggttttggaacacgttgtgtaggagatgaggcctgagcttggaatggtatgagcgaaggttggatgacagatggttgtcacattcaaggacagcatgggaagaatccaatctaatttcacagatagtacctggccactttgttacctattaggagttatgtataatatcatatatatcagaaggatatgtgaaggctatataaaatgaaggcctgggttcttgccctccaatactagcctgatgagagacacagacatgaatacaattagttacaatagaagtttgaatagaaataacactatattattaagcatcactgaagatttgtcattcactctgctgggcactatcaaagctgttttggaaccacagagaaggagtagttaattaagttgattgtggttggtgaggagatgaagaggcaataaagacagaaaggaagaagaaaaatcagcattctattttgtgtagggagtatagtttcagtggagtgatgaggaaaatatttacatacgaaattaggtatgtaccatttggagtatggaagtcacatttttctgtataaatgtttattgaatgaatatgtaaataacttaagctttcgtaatctatgaaattagcaatagattattcttctccatgtacaatattttatggtttatgtatgattttcttcatattatgatttcagtgcttct

SEQ ID NO: 60568 - DNA, 2025 bp, Homo sapiens
ccgggctgggcaagcgcaggtgggagccagcgaggccacccggggctcggcgtttgggactcggcgctcccctggacgggtccggtgcctttgtctctcgctccctcgcgagctgctgtccttggagcagcgtcgagccagccgtcggcgcccgcgacggggactggtctcctccggctgccaggaggcggccctggggccagcgccgcgggcgggggcggcgggagccgggtagaagttggcttagtggagccgctggggaccgggggtgcggtggcggcagtgcagtccacttccccgtgtttataaacgtcaagagtcgccggtccctgccgggcaccccgggaccaggacgcatggccatggccagcttgtgctcagacccggtccgcgagcctgagagcccggcctgtgtctagtatcattttaccgcgtgtcatttcttaggcttcataaattggatttatgagactcctactctctaagtaacttttatttaatcaaattcgtgcttttgagtccaaaactttgcactcattggtatgatcattagtaagttgcattctctaagcttccgtttcctcatctgtgaaataggaacagtaatatctacattaataattcatttttataataatgacagtgagggccaagtttagctctaggcattttacatgtattatttaattctggaaccgctctaatgagattggtactgtttcgattcccattttccgagtgaagaaactgaggcacagggagcaaaagtaagttgcctgtggtcatcaggagctcctggagaaggcatggggtctagttccagagtccgcgtttaaaccacaagtaaccttcctaactatagttctgaaaatcaaatgcaaaatgtaaaaaacttagcttgagagtagatgctcaatgagtattgactccttttcagcccttcttttatagtaaaaagatgttaaaaatatctcggaagataattggtaacatcattggtaaggtttctttgggccaacatgccacatggttaacttaggtgggtagaattactaggttatttcgttttgttttgagacagggtctctgttgcccaggctggagtgcagaagagccatcacagctcactgcagcctcaacctccgaggcttaagttacttttccacctcagcctcttgagtagctgggactacaggcgcctgccaccgtgcccggctaatttttttattttttgtagagacaggatttcactatgctgcccaggctggcctcaaactcctgggctcaagctgtcctctctcaccgagctcccaaagtgctgggattacaggcgtgagcccctgaacctggcccttaggtttttttatttttttttttttaattgtagttttaatgctacaaaaataacatgctagaggaatttagattagacacctttcttaaaccacatacgtcctttacgataggttatacagtagaccaattttagaaatgattaaggaacttcagttggcagttacctgttcatttgtggacatcaaggcccagaggggttaggacttagagtctcactataattctcatatttttaaataatgttgactcattgatcaatattatataagtgactgaagatggtgaagtgttaaataaaaaacattggtattttcattacaggcatttggggagaaagtcattttacttatcccaaaattgagtatgaaggtggaagatgttattagaatgctagttaaaaggacaaagaatgtggttaatactttaattctgtaaacaggaagcaaatagattgtttaactcgtctgtgttgacttcagacctaaacctacaattttaagtgtttgtgattttcttaatgtaaagttctatattaaagttattttttaataccctcaacattctgcacatgagaagcatggaatcagcaattctgaaagtcactggatttagtaattttaacaattaggcagctttctggtcagtataatttaatttaaatcagccccg

SEQ ID NO: 60569 - DNA, 1025 bp, Homo sapiens
catttagttgatataatcctaccagaaggaaagcactaagaaacactcgtttgttgtttttaaaggcaacagacttaaagttgtcctcagccaaggaaaaatgatactgcaactttaaaatttaaagtatcttgcactgataaatatatttaaaaattatatgtttataaagttattaatttgtaaaggcagtgttacaaaatgttcagtttatattgttttagattgttttgtaatttttaaaggtgtaaaataacatattttttctttatggaaatctataaaactttctgtagtaaaatgttttcattttactggtatattattgcttcatgttttgtaccatcataagattttgtgcagattttttttacagaaattattattttctatgacaatatgacacttgtaaattgttgtttcaaaatgaacagcgaagccttaactttaaatgacatttgtattctcagacactgagtagcataaaaaccacatagaactgaactgtaacttaaattccaaactatgactactacattccaaagaaacagttgaattaaacattttcataaaatatcccacacctgatggcttttattatattagcactgttctagttaaagaagttggtgacatgccactatccaataacttccaagatttttaaaaattctcttttttaaaatatcctgataaggagagaagattaagaagacattttctgaaagtagaatctcaactcacattggaccctgtcatgataaggaatacggaatttgacgttaggaatgggaatgatcctaaattgtgtgtcaaatgttctatatttcatttggtaaagtttcttttatcatattcactcataacttggtaagttttgttcttgcagaaaatagtaatgaacctgacagtatttattcatgcacccacgctgcatttaggtaatgggaaaagttgggtatgacattacaactggctgtttggtaattcttaggagagttttattccatctaggaccagaataa

SEQ ID NO: 60570 - DNA, 1517 bp, Homo sapiens
ctaattagtgccactcagccttcccctaatcaaatgtccattttgcaagagctgagagcagggccttaggtgcccatgaggtccccaagtgtgcacacttatccctttccactacgtatttgggttcttggtgctcagcgcaggaagcttttgattagtgagacttgaaagaagagagataaaagtgtggtaatcctggccactctccctaacacagttctttgtcacagcaggagatggcaacttcatctattcccaagctgacgaaaatcagaagggcaaagtggctcgcctggtgagccctgtggtttattcccagaactctgcccactgcatgaccttctggtatcacatgtctgggtcccacgtcggcacactcagggtcaaactgcgctaccagaagccagaggagtacgatcagctggtctggatggccattggacaccaaggtgaccactggaaggaagggcgtgtcttgctccacaagtctctgaaactttatcaggtatgacctcttcccaaggctggggagggcagtggctgcaggaatgctgagatgatatgttggaggctgtgcaaatgagacatgggaattattccgaaattatttccagtgtttcccaaccctgagatattgctgcaatgataaccaccttaatagcagatttcacagtctcctagattgcaggaatagaaccaatttgctgagaaggaacacaaagggcttccgtgtcatctatttctgggctttcacaatgtatcattccttttgtttgctgctttctcccgttttaaagtttgtattataagaagagagtgtaaggagaaggtgcataccatcaccaggcagctaatgtggattgatgagtgaagtctgtgttacgctgaatctgatgaatttaatttatgtgccgtagctggagctgaacaagcatttgtaaacactgccatgtgagatgagcatttcaatactgtgaaaatgatcttattttgttaggtgattttcgagggcgaaatcggaaaaggaaaccttggtgggattgctgtggatgacattagtattaataaccacatttcacaagaagattgtgcaagtaagtatgagctgctgtagaaaccaatggagtgcttgcccagggcaagactcttgccaatatgatggtctttgttttgctcatttctacctagaatttcggtgtggcctctcggcacatcataggaaatgcgtattctggtgcaacagggcatacaatcagcccaatttacctgtgtctgccccgtcacctaccctaggtccttcataatggctgcttgatacctataaaactccacaaataatgcagaatccaaagatgatagctaagaagacccagcttacaagctatagatgccataccgaaacattttgatgaacagtggaaagtcagacatctggataattccaaatatctgggtgtataaacaaaacagcaggcctctgaaaactttgatcagaataagtttaattaagaatgcat

SEQ ID NO: 60571 - DNA, 1048 bp, Homo sapiens
tttttgagacagggtcttcctctgttgcccaggctggagtgcagtggcacgattgcagctcactgcagcatcgacctcctgggctcaagtgatcctctcctcagcctcccaagtagctggactacaggagcatgccactacacctggctaattttcttatattttgtagagacagggtctcaccaggttgcccaggctgatcttgaactcctgagctcaagtgatccacctgtttcagcctcccaaagtgctgggattataggcatgagccaccgtgcctggcctaaagtgaaggagactctctctctccttcaaaggaattataatctaggtactactggcaaaactatgcgcacacatacacacacacacacacacacacacacagaggcacccactccaattacccaaaagactaagtaaaaaaatattaggtcacattctcatggttaatatgtgtacatatgcatcatcgtgatcttcatagtagccatgcagaatgactaaatgaggtaagcattggcatttctgtttgagagtagaggaaactaagacttgaatggactaagtaacttgcttaacattatccaggtcactcctgcaggtcaaagctacaaagctacttctggggtctgtgcttttttccaccatatgctgcctgcatcaccccagttttctctctgttgtaccagaatgcattgattcattttaatgcaatctgttcactctgtattgtgatttactatttacttgactctttccctcactgtctagagggcaggaatcttatcaccttcactccctttcacccaagcacctagcacttatttgtgttatgaatgaataatagccacccatgaagttctctccacactggactggatattagaaacacaactgctcatcattagaagatcatgctctgaactcatgaacttctccttaaatgtttgaggcgagaacagtgtgatttcaacagaagcgtgaatctttaaagaaagcatccacagtttctgtgccatttcattgacaggttttattttaaatg

SEQ ID NO: 60572 - DNA, 1019 bp, Homo sapiens
catatgaatgactagtgctcagtgttgaagggtgcatttgagattctacaaatgtggcaaaatacttacctccttttgtgaaggctttgagaagaatccacagatttaaattttacaggggattggaatgccctagggggaaaaaaaaaacctgggaacaccagaaattatttgaagaacaaattcatagacttcaaagtttagattagattcctacaaacatagttttgttattagggtttttttgtactttatatcaggctatttacaaaaatggattggaggtggcacaaaactaggcacagttaaaaccacattctgaaagctggtgagcttttagttatcactcttgttaagaacaaactattcatcttatttaagacatttaatatttttccttgttccagcttcattatatgtctgttggcagtaaaaaacatttgctatgctgatgtcatagggttactagtaggatcaagtagtagataggaaagcctttttaaaaggtaaaagtgaccctcaaaataagttatcattattatgatatctttaacaagttggtgatttttagaacatttggaaatatgaaactaaacatacgtcaaaactaaatctattgacccagtaatgagatgatttgcacatgatacaccctgcattttctcttgaaatggtcagtatttgtatagtcaacttccaccctgagaaagcttaagaaatcgatgccttagcacatttgcttattgtgaaacatctttgaaacccaagtaaacagttttcttttgtagagtatagggatggttaagtcattagaccagctacatagtcctggtagaaaaaaaaaaattttttatttagatttttattgttttatgtataattaggtaaaaaacatcatttcataatcttaacaatacagtatacagtcacaacttctcatgtgaatagcaccaagactgacccagttcatgagttaattctggatcatactttgcaaaatggtgaagtttttgcagtgg

SEQ ID NO: 60573 - DNA, 1047 bp, Homo sapiens
gcagccatgttttttttttatttaaaaggtcattgcttgtaaccaatttcatcacagggttatttgtaatttgcactgttagaacagagcttcgccttgttctctggtgaatctccagagttattacagttatgcctgcgcaggtatttccctatgtgggtgttactttgtcgctgcagttgttgatgatattttatttgaaaacatacacttctctgtgaggttacaaattacctcttttcttcactttatttttgtgcttggactcagatacattattttgttcatgccatagggattgaagccacagtgtgtaaaattccagattgccattgtaatactgttcatccagtttttgtttttaagaggtcttcatttaaattgtgaattagaggggtgatttttattcaggtcaagtgtcaaacttgccgggatgaacttatttagttgttgctctgggctggtcatgtatgcaatcttccttgaaatatgtgacctgttagagggttttatcttaaaggtaagagtgattctgtttagtaacccacccttttgcaagttctaaaaagagaaatggagtaaactattaatggtgaagccaatgtttatgtttcttcctggtgagcatgatagtatgaaatatgtcagtttgctgatcccaaactcattcactccttttaagttttcagaccccatatgctgataatgtcatcattggaatgtatccagatccaactagatacttgtagctgataaagtttgaggcgaacagtgtcagaaaacacacagcagagaaaacaagtccttcaacttcttttttctctgtcagaagcaaattttcaggcctatgggagaaacaacttaaaaatacacctgaaatttctacaagaccttgcaatttcccttcacatctccacaagcagcttgtcacagaacagcacgagcttaaaaagctggttactaaatcctgctgcagaatgccagatctttcaagactgtttgacacatgcatatagtttacactgagtgaaaaggaaaggaaaatgt

SEQ ID NO: 60574 - DNA, 1111 bp, Homo sapiens
ggtatattttcaccaggctccaggaaagcactcacattcttgccttggtctctcaggaggctgactttcagagatcacagagccctagtgaggtgttttgggtgcagtagcggggaggtcgacaaaaggtatcaccctaagcaattgaatagatttccatgggacattcttgactatagactggtattcactggaaagcacatttgattggtttcatgtattaagatctggcagtgagcatttttcagttacatcttctgcaatagtatttactttgtgcaatttttcccagagaccagaactttgcagtgactaattctatgaatgatcatggtaaaactcgctcgtaaaatgtgatgcctgtctttgattccactcttctaacaacatgcttttgcaacaagcaccatttgtttggttccacttgtgggcagggcctatgtgtttctaggacattagggccaccttaaatccatccatactttatttccttgaatttaacaagaatgtacagcccccataatgctgtttaaagtgatggggtggtagtattggtgtgggggcggtctgaggagggaggtctagaacgtttattgctgcagtgctgtcacatagcaaattgcctaacctagtggcctctaataacaagcattgattttttgctcagacatctacagagaggctaggggttggctgatctaggccaggctccactgggcttgacttataagctgcaggttggattcatattcactccatgtgtctcttagactgtgggcatgttcttgttatggtagaagtcaggagcacaaagaatacacccagcatacaatcagtttcaaactccttttgtgtcacatccacaaacatcctgttggccaaaacaagtcacatggccaaggccaacaacaatggagtgttcgttttcttttgctacaaaacaaagtaacacaaactttgcagcttaaaacaacacatattgattatatcaccgtgtctgtgggcctggagttccagcatgactgagctggatcctctgctcagggtctccctcggggtgcaatcaaggagtcagccagactgggttctcacacagaggcttctactaggg

SEQ ID NO: 60575 - DNA, 1057 bp, Homo sapiens
cagcatcaatgtcttcaaattctgacttgtcccaaagcctttcaacctcacttctcttacccatctttgataggttcaagggctatgtctgtccacaatggaagtcacagccacatttggctctttagctttcaattaattaaaattaaatacatctaagaattcattcctttgttgaattagtcacacatcaagtgcttaatagccacttgtagctagtggtaaccacagtaactagtgatatggaacacttccatcatggcagacagttgtgttggacagcgttctaggagaatcatcacagagatagttgccatatacacactctttctcactagccagggcttgggacccggtttcttatagatgggctggaagtcttcctcttgcctttctgaatgaagctgtactgacccagtcaggcctgggcagcagtcgcttctttagatctccatgggttccaccctgcgtcttgcttagctttcaccctagccttagccacatgggtaacatgaaatggaaaagaatcgtgaatcaaacacacagaagctatccaagaaaaccacaggagtggagatgccaaagagagaagaaatggaaagagatgacttcagaagattctaggttctttaatgcctcccattaaagttgtctcctacctcatgggtcttggtgactctaatttgtcttttctctctctctcttttgtggtttttgtttgtttgttttttatttggagaaacgaagtcttgcttcattgtccaggctggtttcaaactctgggcttcaagagatcctcctgcctcaacctcctaaagtgctgggattacaggcatgagttaccttgcattgtcaggctttgaaattgtctgagtaggctgacatcagcaatgtttaaagagaatgaggtaaaaggaatagaaaatgtttgagtatgttggaaatagaaatggttttatttcataatctgttgcagttttatatttatgtacatttgtgctggttgctacatgaaatatagcgcttttattgtaggttgtggtcaaagtttgaaaaa

SEQ ID NO: 60576 - DNA, 1040 bp, Homo sapiens
tttcgctcatccccaaaatgactatggaaataattgtatatgtgtgtatgtgtgtgcgtccagctaggagggaaactacaagtagtactttctgatttttgaaaaaagaacaactttacatacaattcagttttacattgtttctgcacaggaaaactgcatgtcgtcttctgctgtaactataaaacacatccacaaaagttgtcactggaatttgcttaaatgtttctcaaagcagaaaaagaaatgactggtctctggttcattcagacgcctgcttatgatcacaattctgttgtcttacgttgtcatattctgctgagaatagttcaacaaatactactcttagttgaaagctttagaattttcctttctggaatatttacagatgtgacaaaatatatttgttataaatgtattcttatcatatcaaatgacctgaaatttgccatttttgattaattcctggagattacaagaatgatgagggcagttgcattcagaagttgcatacagttgccctttgcagaagtacatggtgcacatgcttcagtgtatttaatgatgttaacagttcattgattaaagttcaccttggaaataaacaaactttcctattcatctttcaaagttgttacaaaaacagaagcaggttttttttatggccaattcttccttttcttccttagttggtggctctttgttttgaattcccatagtagctgtttatttttccgctttgcacaatgtctgtattagtgatttactactcgctgtctttcacaagacctatgagcgtggtggtttaattaaccatattttgtgcatgtttactcttgacattaagaaaataataataattgcttaaactaacaaatggaatatgaatccagttgagttactttgctccttgttacctcattccctcaggtgtttattgctcttgtagccatttgatgtgaataacaagaattcattatttcagagtattaatgttactcattggactccttccttcttccagtagatccttgctgtaa

SEQ ID NO: 60577 - DNA, 1049 bp, Homo sapiens
gaaataaagttttagagaaacatatttgctaaactaattacctactaatttatctatttgtgaattgttctcagtgtgtgaagaatgctgagtgactgaagtcaccatttgaaaattgtctcaattcagtaagaagggaagagattgttatgagtatgatgcaggtagcttaggaacgtaaacacctgttctgtttagcaatataagggggtttgaataaactgacatatggggatttaacacttaaattgttcatataattttactttaaaattctcagtcatcccataaaactgattgttttaaactccctttcctatatcctataatattcactttgtatttccttctaatacaagggaaagtacttgctttattagcctctttaaaatccagaacattcatttattataaattgtctgatacttgaatgtctaaataaaatatcccattgcttgcctaaggaatatttttccccaggtgaaaatatattttactttatgtgactgtgatgataaaattgcttagtatactttttgagtcaaaaattcatgtagacaatttaaatgtgcaagtttatgatccagtctctggggcccctgcattggcatatggaagcatatttaagtttatttttaatttcctttatggctggcatggtttctttgggttctgacacaggcataagcacacacatgtacacacacactagcagaaagcataaacagggctttcccaagttatccaggcaattttctgaatgagttgcaaaactgaaattaatatctatctttagagtcttcaaggacaaaagcacatcatctgccagccctgctcgatgcttagctctccatgaagttaatgtgggttttgtgtatataaaggcaaatgattcttttttaccatgtgcagttaaatcccataatggtacatgctccgatttaattagttctcatcatataatgggatgcagccagattgatacaattaataatgatgttagtaaaaacttccccattctagatacgaggaactccaggtgtcaaaat

SEQ ID NO: 60578 - DNA, 1068 bp, Homo sapiens
tagcatctctgtgatgagtttaatggaggcaggaccagtctgttctccgttgtgattgcagattttgaggagctattttgaggaggatccaggaggtttactttcttatccctgtttttccttgggatcaattcttacgctaaaggtcaatgtttgtgaaacatgctgtccctcctgcatttcttttttgcccagggacatttaaagtcattatcttgccttgaaaagattaaaaaatgttggcacctccgtctttgtggtgcaaagtgatcttgggctgttgaccaagctgacttgatccctggaatgtcttgatctaaattcatcttttcttttgttgctgaaagtttagggtttccgcttgctgaaattggatttatgaataaaagaagccaactttgctgtaggtaattatgtcagaggcaagttcatcggtgtcagtgttcattttattagagaaggcttagcttattcacaatgcatcttttatccccttgtctctaataaatgcatgattttcagagatttgcagccaaaagtgtgttattccaattaggttacttatgtcaaacataaacctttcctgtatatatgttatttttttacagctaagttcagtagaaaatccttatgcagacattgatatgtatattttaggttatgttttcctgcaatagtatgtctctggaccagtgatagtaatttgtgtcaataactttataaagcgagaagcagttgaagaaattagaacggctgagggccagaagtcctcagcagggaaaagaaacacacgtgcagcagattaaggggaaagggccaaggaaagcgaggacccccactttctggtgtctctctggtaactggaagggcggatatgagcggttcgcaggcaccagtctttaaagcgcctgtgatgttctcctgactggcgtgggcttcctgccctttcaagagaactccttgatcatgcattctactaaaacgaggcagccctgggaggcgagtcttgcgttctaattgcccagtgggttgaggtttggggacaataagtggatatcaaggaaaggt

SEQ ID NO: 60579 - DNA, 1054 bp, Homo sapiens
tgcttacttaggactgtgttcaagagcctccttgcctctttgttgatctctttaaataccaaacaaaagacaatgaatcttccaactcaggcgattccattgtgattgatctgagccaattttttgaggtaattgatgatattgccttagttgagtctgttagtgcaaataattattaatcaatatgctctcagctcttagttcagaagataattctaacacatgatttatgctgaacatttcaattgagctacctttacaagaggaaaatcaattggcgagtgttctaaagcactttaattatctgcagctccacgttcctccgcagccatatttacccagacagctagttgtcccatcctagaaagggtcacaggaagtttttcatcgccacggtagagagatagtatatcgttcatcttagattgactatgttggtttaaagtaatttagtggaataccttaaaatcaaagcattgctgctttcctttggagagcataattaacattgcccaggaaaaagaaggaacgtgttactgatctccattcagttggaaaacagtttgccaatgtggatagtgaatgtcatgtaagtcaatttagccgtaaaacgtgaggagatctgaatcacagaaaggaggttaaggtgtaaaacattttaggggctaaatttacatcactcccctaaactgttgtttagattctttgtgacttccttgtgctaaggctttctagcatggaatttgttgtttttcccttttagacaatgtcttgatgaatattgtggtttgatttttcccccctgtgagaggagatgcagaagaaattaatcaccactaggaatgggcctgcctttgttcaaagtggagcttccaagcatctgtttttgttgtacttgtggtgggtacaggaatgtgtgggctctggcctgggacttttggacatgtttataacagatggaaattttaaatgacagttccctgcattgtcatggtggagccacttcaatagcactgagatgctctgttatacttcttgcccagtactctgtctc

SEQ ID NO: 60580 - DNA, 1056 bp, Homo sapiens
gtgctttgtttcataattaagaggggggtgcatacccccgctaaagtggaagagctaatggcatcttttgtggggtttcttcctcatctttaattaaaaaatatgtaccataataaatggaaccattttttttcctggagttattttctttctgctaatggagtttgtcagtattttgtttctcagtgtttcaggcattctctgcaacatttcctactgccaggcccctctgccacagttgggatatcagcctcctaagaccgccttctatgattgcccttgaaaaaagagggaggctgagattattgagaactccagaaaatgggttactagattttttcattttgattttgacataaagtgggcaggcccagctgaaaaagtgaactaataattcctatacctttaaaggattttgactttttagcgtgaacatttgaagtgagttcttcttcctgctctaggcctttaaatactatggctacttttggcccatcctgaaatcctgtgatgatttgaactatttattcggttttggttgatggacttggaatgcggatctgatcttaaaataggaatcttgatgggctattattttcaggtgccactgattatagaacagttaggttttcaccctttttcttcctctttctggttttgcatcccccaccccacacgacatccctcctcccccatgccatgtcccatcccccatttcccatgccctcctcatctcctgtcctccatgacctctccaatccatctttccactcatggctgattcttctttttttcttcctcttccaacttcttcattgctgtcacgaccttctttaaaataaatttgaaaacttcaaaaaaaaatttgtttttctcttggagaagtgccccaaatggcaaagtatttcccgcccttcccagttttaccagtgatttgctaagtagtccgtctgttacttgggcacatctcagaattgagtaggtttgtggagggttgggtggggacggagtggttagaagctagtctgctttaaatggggcttagagatactctct

SEQ ID NO: 60581 - DNA, 2432 bp, Homo sapiens
gcttttaggtcaatctcttaaagtttgttgttttgagacaggaatataagggcgttgatgattataggatctggctcaggctgtcagaatgagacgacttctccctcctgaggctgacctgcttaggagtttgaaccatatcaaactgtaaggatcaagtacaccctcaaggtttaagaacaagcttttaaaatatccacctctattgtctcgcctctgatgtagtttaaaacatgtcatttagaaaagtgattaggctgggattagagccatgaagacctgggttagaatccaggggctgccacctgctggctgtgtgtccttgagtgtgtgacatggtctctgagccccagtttcccattcaatacaagcagtgttcacacctgtctcacagagatgttacaaaggttaatgaggaaatatatagaggctgggtggacctaccttgtgcataagaagttattaatagatggctgtcattattactgttttcagctatttctgtgctgacatgaacttgattatgctaagcccatacaatttctctgtagcagtctgtagctcatatggtatctcttgattgttttttatcctttagagttcttgttaagtaaaccacacattatggatatggtcaaatttatctctcaccctgttcgccttcccccacgtaaagagctaagcagtctcctgagatgggtctgtgtcccttggttatttttagaaactctcccaacaataaagaaacacactgattcaatagtatctaatatataacctgttttcaagttcccttaattgggatagtttgttttcgatctgggatcctgttaaatgtatgcattgcttttggccatcatgtctttttcagtttcttctcacctggaacgttcattctcccacccttcccctttttatgtccctcttgttggtggcattttggcggaatctgggccagttgtcttgtgtaacatcctgtcctccaaccctgcctggtggcttcctcctgccctgcgagccccatgaggtgatgggacagtgtggtctacaggccccgtgtgtttcctgctctgcctctgctctccgaccccacacgtccagcttcatctctcagaacctgcttctcttccaactgtgggacttaccgaacacagagggttactatgagttcccaatgagatgactaaagggaaggcctgaacaattccgggcccacggtacacctgcgaaaaggttttcggcagctgaataggcgcaggagtgctgcccagagaggtgagaggagagccgggtgggccaggcgaggatgggagcagagagtgtcctgagtgtggtcaaagctagcaaatgcttaagagagcggttttgtttttggtttcctttcttggacttatcgtgctgtgatttggaatacagaggagcaatgtgactctgtaaactgaggtagcagattcagcagggctgatagagcaggaaagctccctttgaaggtagaaattaagtaaagtgctgatccagttctgagcatctggcaagtgctttctggaccttggggacgctcacagacctggggtaccttcacataggtgagaaccacactctcccttcaccaccagatggatctctctctctctccatttattactatcctggttatgccagaaagcttctgctgttgctgctgtttgtgttttcacatttactgcaagagcagcgaggtacgtacatagaaggttcctagatcttgaaggggtctcccatttggggcctcatgctgtcagtccctagtaggagggaccgctttctgcagggcaaggggaaagtcctaatccttcctgggcaggccttagttgtccttaagccactccagggacaaagactgactcaaataactggctgctggtcggtgctagctgttaatacatactttgtgagggcttgtgcaaaatgaaaatgctgggccccttattcagagcgcaagaaaaaatccctttaaaggtattaaaataaaaggcatgtttctttcttctgtggtctccttcccaacttgtcatgatgtttttaatttgctattgaatgttactctaagaaaaataaaataaacttttaaatcattagcatgaattttacctttcatctttatatagtgcaatgctagaggtttttaataaaatttaccatcttaaccatttttaagggtacagttcagtaacattaagtgtattcacactgttgtgatgaacgtcagttttaaagcaaatgtaagagcctttagctggtatgtagaatcactgaaatgacataactcgtatttcatagcttatacatgcatgtgtattgcattgtcaatagaatggtgaaacacaacacaaaactaactcagcggtttgtatctcatttctttacacatggacattgtccccacacccttg

SEQ ID NO: 60582 - DNA, 1014 bp, Homo sapiens
aactgaaacagtatgtcagttgatttttaaaagtgcaggtggttttctgatcgttcactatgatttcctttacagcaagggcatgagagcaccatttccccacttttatatctagtccgttcttgaaaatgtgtaacaaatgactatgcatatatatatatatagacatacatacacacatacacatatatataaagttatatatatacacacacataaacatatatattcacagaagttgtgttctcagaataatagtaaaataaacaatgatgcttcatgcaggcactggtgataaactccactgtgtcgggatgatccagggctgagacacagatcagcaagggccgctgccatttccctttcagatcactgtagagacaggtgtgtgcagacaggaagcacccttttccattaactgtctctcctgacccctctctggactctgccagcgcttgcccatggccatcagggttaagtttgcctgtgtggcttccaaggagagcaacggggaagggagaggaaggacgaggagataacaagttggttggcagcccaggcaaattctgggacgtcacaggagcctcagtccttaggagggagtgagtcagaggtgcttctgcatggaatgtcacactctcaggagcacacacctgtagggacctcagctgcctctgaggggcctggctctgtccccaaagcacagcagctgggggcaggcaggcagcaccaccacgcagtgactggtgttagttgacgtgaccacacgcaggtaatttaaaagtgcagctctcccctccccctccccagcacaccctgactcccttccctgccttctttttcttgctagtccttatggcattatgatgcggcataaatgcactttaaaaatgttatcatccgtctcctccaactagaatgaagttgcattttggagcggggcagggggtgttgtctgttgtctgtttcattcactgctgtattccaagttctaccacacagacattcaaatat

SEQ ID NO: 60583 - DNA, 1064 bp, Homo sapiens
tgaagccataaataaggtcatggctaattttaaagacttcttgtttaattctttttgttgattaacattgcccgaaaccacaatttgtttgtagaagtaatgtgtaatgggggttgtttatttatgtatttattttagccttagaggaagtttaaatattctgcagaaatgtggggataaatgaaagctgttttagactttggtcgttagcaggcaaataatcctccagcagagtatctgcatttttgttttaatgtctttcccttcatagaccactgaacttttaggtctttaaagagattttaggccattccatgatcaaaatctcctggagctgcctgggatttctttcaattttagccttctaacaaaagctccaagatcctgcttcatgtgcaatttggcacgataactcatctttttattttgacctaatcacttggttctcctgtcctttagacagtacaaacccatggcttcaagtaccaatcttgttggtattttgtgatcttaagtttgtgttattttcttccttgctcctgcataaggatggaatatcaatcaactattaataaaaattcatgaggatttatgtggagtcccattgtgagatgcattttcaacttcttgggagactttatcgagccctaaatccgcaatccagttttaaattaacttcccagatgttctagagcttttccttgggtaccctaagtccttggtgtaaataactatttgattactttctttctcttgttgtttcatgtcttcttccattttttccccaattggttgattttgtgtaactaaaggagatgcagtagttgattttaaaagatacctgttttcttttccaatcaagcaagttgagatatccttagtatttttcattaaaacaggtgtgtacatagaaatgtgaaaattataaactttctgtatcgttacagaacagaaagtaactagataattcatttgttctatggctatgtaataactattttgaatatgcatttcacattgcataaaatggactccaatgttagagtgaattaatgtagattgtt

SEQ ID NO: 60584 - DNA, 1308 bp, Homo sapiens
gtgacaatgacattttctttaaaagctcttacttggtttctgccatacttgtgaatgctgcttatagaaggtcaaacagcatttgaaggccatgaatgtcccattggaattgttttcctgggagaaaggacaccagaatgctggcgttgtcagttagtaacttttggaggaagtaaaaaaaaaaaaattagttgacatattattgatcgttgataaaagcactcatcattttcagcaccttccacatccactttgaaaacctgaaaaatagtagactaccacgtagcagtttttcacacagctcagaagtcccacatgacatcaaagccaggagtcagatgggttctgtcttcccagctcctgaggcccagaagtggttgctttaaaccccagtttaaatcatagtgccctacaagagtctaaatcttgcatgtaaatgtctgcaaattttcagtagcacttacatgctcagaacagcctctgtttctggactccagcatccccacttggagtctgtaccctgcactgtgctaaccccaaactgaaactcagcctcctaatttctgccaaaatgcactcagagaaacattctggaggagactttagtcatgaggatgagttacaccaagcagtaagtaactcagaatcacatcttagacattgctgtattcaaaagcccctctcatcctaactcaagcacagcctcagcagctgtcagacttacgatacttttatgcatttgtgccccagaagggtgattagactagataatttgtgagatgcttccaactcaggagagacataatttatatttttaagaaaaaggactatggaaactttagttttttgtaattattatttttgcagagaataagatgtccattaaacaaagattgatgttactaatccaaaaagttgggaattatcatacctgtaaagcacttcttcatctgcctttaacaggatgtgaatttggctgtgatgtcatggtatcacctccattgtctgttcttgtcaaagagaaagctacatagaaaagtgtttctcagacttgaggagtataggaattttttttttttatagaaagacaatctcttggtactgcagtattgaactaaattgttttgattataatgttacttaaatatgtgtaaaaataaaataggactaaactccttctgttgacaaccattatacaaccataaagccaaacatctttacaaattaaatacaaaaatggcaaagccattaccttcaaatgaacaacattaacttaatgtggccaataatgtttcttaaatctaaact

SEQ ID NO: 60585 - DNA, 1115 bp, Homo sapiens
actttgggaggctgaggcaggaggatcactggagctcaggagtctgagaccagtctggccaacatggtgaaaccccatctctactgaaaatacaaaaattagccaggcgtggtggtgcacacgtgtaatccctgctacttggcaggctagggcacaagaatcacttgaacctgggaggcggaggttgcagtgagccaagatctcatgccactgccctccagcctgggggacagagtgagactctgtctcaaaaaaaaaaaaaaaaaagatttaaattatgactgcaatcttgtagacatgaacaaagggcatctcaaattattctttttgagcatccatagcattacttaacaatctagaatgtgtatgacctgtcatttataccactgatcttctatagctgcaagaaatcaaatatattttacaacatattttgatgaatgtttctatatgcagttcctaaaaaaggaaaggtttctcttatttcaactttgttctgatttcataggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacaggtaggcgccaggggcaatcgtggtattgcttccaaatcagcttttatacagcttctgacaggggagtagaccattcatcaatcctcaaaccagaattgccttttattaatggcctttaaaaagctgttgtgtctaaaagtattgagtttacacaaattgaaacctaatggaaggatcagcagaggttttgatggcttttctaatgattccaacatatttcattttgttctgaagatggttttatacctgagaaccaacctctactttataactcaaataaaaagcaaacttaaaattatgactcttctacttaagtgatatgtccttttattgctaggagagcctctaggtgtggcaattaaat

SEQ ID NO: 60586 - DNA, 1039 bp, Homo sapiens
caattagtgctaaaagccatttattgtaaaagcaaaaatactaatgaatagaaatgttacaaaaacagaagtcttgtgtgttttatcttcatcgagcgtcatccattttaattagagaaaaggtggtgaacactgtgacaagagcctggaattaaaatcattaattgatgtcaagctgaagagagactgttagcatgaatttagtgacagcaggaaagaaattaaccttattactttatttagtatattacattattttgtgtattattttctatgcaggttcaaggcaatttcattatcataatggaacactttatttttttttttacaaaaaggaaagatgtatttatgcttgaacataacaagttgaaatgataagttctttattaagttaaaaatgacttgataaaaggttttaattgtttgaatttgttttttcaagtttcaaggataggaaacagtataaatgttgtccatcaatgtcgggtggtacaactgcctgtgataatctgaacttcagaatagttctttttagaaccaggaaggacttactgaaatgtttaaagcaatagacatttatgtcttttgctgggttttggactaatcagttacttctgtcattgttgaggtttggcccgagataaatgggatagagaatgctgaacaacaatctgactgttcagaaaaatgagtgactcttacatcttggagataatttgtgacctcagggtcacaataaaagagtaaagggggtatgcttttatagccctggccatctggatccattaagggctcaactgcaagatactcaccatcttttcaaagtttccttaagaagtcatgttatttttatgaggacaccaaacatgttttcttcctgagccaaatattttcttactgaaatatgtatctccacagagtggaaatacataacatgcaaatataaccttttggtcgtgttagaaagttcatattctcactttgtaacaagacattcaaatatcaaagaatataataaattcatttgtgtcttttgtta

SEQ ID NO: 60587 - DNA, 1097 bp, Homo sapiens
tcagtttttaaactatgatgaatgtttccaataagcctggctgtgaaaataaagaatagttgtttatggaaagattattaactagatgattgtggattatcattctttagtcctaagaaaaacccactccaatgcagatctttcttcctctagcatctaaagtattcagcacttagtcctacagatgtattaattgtttaataaggataaaccacaactcttgttgtttgtttttgttttgctaaaggaaaaactgctattgagatcatttccctcaagagttttctctgggaagttctaattaaaaatgaataaaataatctgattcaaaatactagtcctgacccaaactactgactgcagaagacacctgatccctgttttgaagaagctaacattcatttcattgggtatatgtcattaccacaaacaaaagaaagctcattttgtatatattgacaagttagaattttttgttattaacaggtttggcaaacatcgaaaagatgacaagattgagaaaacgggtaaaataaaaatacaggaatcctttacatcagaagaggagaggatacgaatgaagcaggagcaggagaggtagacttcagttacttgattaaacctccttagaaagaggttctttttttttttctttctactttcttcttttttaatgtaaagattttacatttaattactcttcatatttcctgtatcaacccaaatattgatggttgtgggtgaatatattgtaaagagagatttaaaaaaaaaaaccttatatgtatttgtgacatcaaagtggattttaattgctttagttaagatcttttgcataggaaatagaacagcatattagatgaataaataaacattaatactgaatttatgattttttaaaataacacaaaaagtacttaaaatcctgcctgatatatggatatttagtatattataataattttaaagaaatactcttctgaaaataaaactccgaagttttatatcacattttaaatataataagaattcaggaggctgttattcattatgttgtttttctttcaaacctgacacttatttcttgattctccttc

SEQ ID NO: 60588 - DNA, 1115 bp, Homo sapiens
gaactgaacagatactttaaagtgatggaaaccaactacaaaatttttctaacttgctatattaaggtttctcaatttccactctcctggctaatttagaggatgatctattatcagtttttattccatttctgattttgtcaggtggtatgttggtcattctgactttttaaggcaaacaataagctatttctcatgtagccaatactgtggctagcagtcagcattcattcattgcatgttgatactggtggacactgcagagaacattgttttcaataacccctttacacctcataataaccctataaggtactaattttagccctgttttatgaatgaagaaactaaaacataaaggtgtggagaagaacttaccaaggtcacaaggtaattggtggtagagtcacaccgaatttgaacaatggtcaacctcaaaggccgtgttcctaacactctcctgcaccatctgagccgtcttacccttccgggtaggttttgccacccctaaaacctatgtgggagccaagattgctatgcgacatggcattgctattgtgagtgctatggaaaaaagcactcacatgttactagcttggaaatgcagaagttagtattttttgaacctgactttcacgttttattcctacttgatttctatagctttctctgtctatggtctcttctcttcccaaaataattcttttttttttttttaattttgtagagatggggactcactttgttgccctggctggtctcaaactcctggcttcgagtgattctcccacctcggcctcccaaagtgctgggattacaggcatggaacacaatgcctggcaccaaaataattcttaaggatttttactgctaatgaaaaacttaccagctgtctcattcctctccctcttcacagactctcagacctgtctgtgtaggtgcgatggcagccatccctgctccagaacacaaacgaggacgattttaaaacaatgccctctttcctccggctctcttccttctaggtggctctgtgctgcgcattccctgcctcttcctgttcccaccctcattttcccctttccttactgcatgccaccttgtacctctatctt

SEQ ID NO: 60589 - DNA, 1026 bp, Homo sapiens
aacatacaggagtgtgagcttagcaaaaagtactaaaaactggacacggtagtgcacacctgtaatcccagctacttgggaggctgaactgggaggaatgctggagcccaggattccaaatccagcctgggcaacagatcattccattctctctctaaaataaataaataaataaataaaagcactgaaagcacagatttgaaaacattatctttgagatcaaccaaaattcttgtataatcttttcctacctcatttttactttgttatggatttcatgttagctattttcagactattttagcagcctaaatgattatatcttgccaaccatgtaaataattgttgagaggtaggagggacatgtctgtatcttagttatgcataagagtgaaagccccattgagacaaagggctattaaagcagtgtttgttcttttttgtgtgtgaacaatggttcattatttaaatttaaacatagagctcaagttagtggtagcatttaaaggttcattaataacaagtctaataaaaaaagttacaaatagagcttcaattaagctgcgttcattaatttagtacttattacttcggtctgtaaagatttcattaaatgtggtctctggctgtttcttgacagttgtttttgtgcccataaattatactctaggattacttagcatatcattttttacaaatcattgccatacaataaaagtgacaagttgttcagaagttgcactgaaactctcccataaaagttcatctaagatgatttataatattcaggcacttaatgttaaatataaagattgcttgattgttccataaattaaacccctaaacatatcaaggtgatggtttaaaattgaaaacatacagcacagccatttgacttttcaaaaagtagttatcctgcattatggatcccctctttttaaaaacttttttttaaattgcaaaatgtgaacaacagttttcattttcatagaattagttgatttacaatcctgaaattgacctcca

SEQ ID NO: 60590 - DNA, 1013 bp, Homo sapiens
aaataaaattctcagtggcaattccaactgtagggttaggaatgctgtcatttcgattgtgtagccagccctttcggtcagaattggtttttaaaaagccttcagcttcattttaaattgtccccatggacagaaaacagcatccactgtgggccgtcatttgaatgttaaaatcagttggacactaaaagcgaatttgcgaaggttcagaaaattgagggtgtgaccctcattgtgcctgctctgcaacattgtctagggaagggagggataatggaggtgacattctaccattatctgtgggagcattttacctgcttcatttgagggggatgggttaaagagaagtttagaatgtcaagtaaaagtgaagaaaggtttttggtaataactctttaaaagagtgatcctattgtttttcttccttcacccacatatattgaaaggttttttaaaaatgaaatagagctatttttagagtagagtgtctgaggagtcatctatttgaactttctcccagttgctgaaaccactctacaataccactaataaatgtcacctgattccttcatagcttttttacctcctcacagtcttcatcatatcagttattattctcaccccatgtattagtctaaaagctctaaagtcttcctgtttcatgccagctttgtgtgtgtgtggtttcctttttttggttttcaggaaaagctaagtttttctgttgccaagagctcatcattctaatgttaaaagtcagagtccagaagagcagatcatgttattcgacaccatctgtgtatcactagctgttcatttcctacatctttctttctcttccaaagtcaaagtgttccaccaaaataagaaataaaaacaatatttatgtccccagcgttcttgattcctatgcaggagtttgcagcgactgaaagtccagtcctcatttagttgtattatctttttacctaacactaacagaaattggtagtggtcagtggatttactaaatc

SEQ ID NO: 60591 - DNA, 1008 bp, Homo sapiens
gagtacctgtaataatctgtgatcttaaaaacattttttttttctttttttgctttcaggaattactcattctttcctataactaaactagcaagctatatttatgtgtgtttattttgaaattgcaaaatatttaaagccaagattattaaaagtcaaaggttaatatgaatgttttccatggtttattgaataaaaaataatttatagataggtacaaatatatccttccagagagttaaacatttcttatattaaagtaaacattctattaaaaagtaatggaaaaactctaccgatatatttactaagaagcaaaagggcttaggagtcctaatagtgaaaattgttgattatcttatattgctcataactactaatttaccttttagtgttttaacctcaaatgtgactcaaccatcaaactattgtacgaatagttggagggaccacagaataaaactaaggcagagaccagagataatttgtgtagattgtaaattacttgcaattcaacatttgagtggaccacttctatcacatatacctaagaaagactttcgtgggaagaagagttttaagtaataaagatcacattttgagaatatatacatatacatataatgtatatgtatatatacgttaatatacattgcttatacgtataatgcttatacatataatgcgtttgggaagatgaatatttctgtcataatgtaatatgcgaagcataacttagaggattgctacacttctctccacctccacctgattctccatctaaatccaggcagttttgtcactatgatcagattcctcacaactgggcctttccaggcccagtttttcccttttggcggcctctccaggcccagaacttccttaggtcagcctctccagacccagttgcagcctcctggtgtcctctccaggcccacctcttcctcccggctgtgaatatatgcagcccattcttgcaggatgaggagcatatttactatttttgct

SEQ ID NO: 60592 - DNA, 1101 bp, Homo sapiens
gtctgcagtttagcaaggaagagacttgacaatgcacattgatgtgcatgtctagcttctgttctaaagaattttaaattgccaaaaaaaaaaaggttttaattaagtgcaaagcttattcttggttgttgaccttagccttctcctcatcttcccttgcttttcaaatgagcttccaggttattctggttcttttagattattcctattaccggagcaaaacgatttgacaacaatttcatctgttgaaattttttttaaaaagtaatgacttagagtttttcctaatgcaaagagagaaaatagaccaaatctaatataagtttgggaaaaataaaaattagcaactattacttcatttattctttgtcttttccatctgcattccagaactcatcattgagcaaataattgttatgtacctgaagttttcgacagtgcatattcaggtacataattttcactaattcacactaacattttttttcttgtaaacctcccaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagacctgtaagtttataatggctgaaagaataataattaaaattagactctatttcttaaagtgagctccagggagccctggagttttctaagattcttcagggtaatctctgagatctctgaggtctaataatctcttatttcataataagacgatattatttgccctttactcacattctcttataagtatacactggggttttttggaggccacatgtcctgtgatactgcattagattgaatgcagaagcagatatgagaatctgtcttacaggccaatattaaactaaaaattctgaaaaaatatttaacagtgccattgttctcacttcttttggaatatatatattttttggtaaaaaatgtaatttct

SEQ ID NO: 60593 - DNA, 1317 bp, Homo sapiens
cacaattatagagctgccaatcatatgccatgtaaacatacatattccagtcttacgcagatgttttcattgtgagaaattgaattacataagaaaagaaatattttctgttagtagaaatttatcagtggtgtacttactaaatagtaatatgatttactgcttcaaaaaggctagaaacaacctagattttcttaattatattcatgtaaggatgttttatcccaatttttaaaaaatcaaaatcctgcaaacgtgatctgttatggtagagtcctaggtttttaagtcagctatgtgatgtctaggttaacatccaaaaagtgattctcagagtggtgattttgatttgaaagataatagtgccaatataaatgtttttcattgtaggacaacgtccggtattgctatcattagtcattcagaaaggcatattctttttttgatgctggaattagcttataattaacctgacgttggattagactatataatgcatatggcttcatatcttaactttgtgagcttgttctaaattcgttacttctaaaatactgccaaatcattccatagaaacaatggattatattgaactgggattgcattatagtcatcgattttgctttttatgttattgtatgacagtaatcacaggaaggtcttttaagtgtagttaacgtgctttgtataattgaccatttatgacttattataagtttggaatagtgttttaatctgtatccagtatgatgtagttacactacttagcactaattagcttcaatttgcctttttaacttgcagtagtaaattagttttagctgcttaaaaaatgtgtatcccacatatatatatgtaaaaattattgtaaacatggttggagttatattctttggagtataagatagattgtaaaaacgacatctaataaatcataagattaactgtattgcacggcagttaaccgtagccttatcccttactgagttgtttgttgttcttatgaaacctaaagtttattgaagcagagctaaagagaaatgttatgtgatagttcacatatgtaaaatagtagttagtttttacagttagcagtataagcaataaccccgatccaagtaaacagtcataaaaaccaaattgagctgctcaggtaaaggacctgacttcatatacaatgtcagttaggtaaaataagaaaaatacttaatttaaccaactcacagctactataaggaaaaggacagtttattgtgatctacaacataatgatatccaagttataactcagtgcgttagataactttcatggaaagt

SEQ ID NO: 60594 - DNA, 1053 bp, Homo sapiens
atccagttcttgcttttcaacgagaaggatttggacgtcagagtatgtcagaaaaacgcacaaagcaattttcagatgccagtcaattggatttcgttaaaacacgaaaatcaaaaagcatggatttaggtagtgagtacaatctccatgaatctttatctaaataagttttaaatgctttcaggataaaattgatggtcccaagcagatgtctgtttactttgagcaatagagaaaataaatgtgaaatgtggcaatttggcaaaaattagtttttctcccagtttgagataacgatattactcataagtggcatgtttacataatatgcaatatgttaatatatatgttttcttaagagaatggaaacaaacacatatgcatatcatgctatgtccatgtatctttattttacaaaatgaaatgttttaacactttggctatttaaaaccaatttcattgaaattgtatttggttggttgtgggatttttgaactagaagagaaaattttggagagaaaccattatctcaatccatgtctagaatttggttacttcatgatgtcttcctttcattgctgttctttaaggtttatttattggaagctttcatattttgataattaaggcatttaatcaaagtaataatttgagagtatttattatagaaagtatttaggagcaaatgagaggaggaaaataatcatagttgttcaaacaccaatcaggtagtgtctctttaaatccaaatccaccaaaaaaaaagtaaaataattaattatatttatacactgaatgatttaaaacctttgttaatcaactgtaacttatgctgttctctggtggctgtttgtattccaagactaaaagcattaatttatcatacgcataaagaaaaatttggtgatgcattgccttggctaattatgatatgctaacatataacacacatgtctgtgaaatgaaatgactggcatattgcatggagacactgcttttttttcctccttttttgattatgaatgtttgcttgatgtttcatagtatttgcat

SEQ ID NO: 60595 - DNA, 1986 bp, Homo sapiens
gttccaaagacattaggactttggatttccattcgcctaaaccaataacaacagtgtttattgatttgcacagtatctaggcgcatagatattcctcagactgtttggttaatgattgtcttctatatgtttggaatcactcctttgtagacattagtggaggttgaggtatttacttcatgatctgctatgatacaaaaggaactttgtattgaaattctggctgattaccttagggagttattaattttatgttaacaggttgaattttcatatggagtaatcccctatgtaggactctaggctaaacggagctttgaggctttgtgatgcattcctatgtgaacacatccctggcgaaaggcttttaaaagatacaccccaaaaggaagagcctttagagttgaaaggatgtcagatgtcatcagtcacactttcccatttaacagatgaggaactaagtcctgatatcccatgatgttttttgttttactttgtttttggctatttcctttttctaaaaatagccctctctggggaatgctgagatcttcattctttattagtatcaatttataattatctacatctgtaagcagttattcgaaagtctccagatcttattctatcctggcacccatggtgactaaaaaaatcaaagacgttaaatctttgaaagcagccttcaaaccacatactccagccaacttaccttatatgtcggggagttatggagcaaatacattaattaacttgacagaagttgcacactttctgtacttctgaaccaaaatttggatgcatgtttttctttatcatgagtcacacctgattaggatttccttagcttttgttggggtcagacaggattgtgaccaaaggcaagatttctctgtcatctcttttgacagaatttccacaatcatggattttgtaatagtcctggacattcatcagaaagtaacctgtagtggggctgcctacataggattcttcctttgaaaagccttaaacatttttctaatggttggtctctcttaactaacaataaaaaacagcaacaatgcagctgggcacagtggcttatgcctgtaatcccagcactttgggaggcccaggcaggtggatcaactgaggtcaggagtttaagaccagcctggccaacatgtgaaaccctgtctctacgaaaaatacaaaaattagccggatgttgtgttgcacacccgtagtcccacctactggggaggctgaggcaggagaattgcttaaacccaggaggcagagcttgcattgagctgaaatcgtaccacagcactccagcctgggcaacagagtgagactccatatccaaaaaaaaaaaaaaaaaaacaaaaacaaacaaacaaacaaaaaaaccagcaacagggatagtcagcataactaatttaaccagcacatccatttcgtaaaagacatcacacattgtcatttgtaagcctgggactttaactatttctcaacttttttagctgaataatttttctttttaaaacaaaactgaaatctgttgtatccattttagaatttatctcagtagtttgtatattcatatatatgtggtgagtttaagaagacgtatttagaacatttttatcttgttagcaatttgacatagaaaaatgaaacattaatgtttttattgtgagtcatgtcactggcacagttttcctctagtatcatgtgtggtgttaccttctatgtaaatttgccaatgaataaatgtttagtaaacaaacattttgtatttcattgtttcactcctctacaagatactgactagtttacttagtttgtaggtcactagttaactagttgaagatagaggaaagtttacctatcagaaataaattgaagccttctcaagtcatagaaggtttcacatttatgatgtaccaactactagcaaacataattaagggatcattgtattgtctaggtgcagcttag

SEQ ID NO: 60596 - DNA, 1050 bp, Homo sapiens
gtgaccactcatctgaacctatgatacaagcatattttacagagaaaatatactctcgagctcagttggtagtcaatatagaggtgacgtattctgaaagatcactgaccactgaattattttgttgtttttatttgccaaatgtagaatgagttaacagtaatcaacaaattaattgcgatatcaagagaacaacataaccttaactaaaaaatctcagagtggagaagagtgggacatacaaacattcatttatgtaagataaatataaaagctaatccctcacagtaggatgctggactgatatttttttctcttttccgtccctcctggactgattgaatagtagtttttactcattgcaaaatcattagctgatcttttaacttaagtcccacaaagcactatatgaaaacatctcaactgtaagtttacaaaacatatcattctcttttaggcctttttattttggccacctgaatactttcccattacacaggacagttttcattccacagatatttattgagcatcttatgtgtatcagaaaatgtgttagatcctgaggacatagcagtgaataagacagatggcatgcattctactggacaacgtatcaccttagtcttttagagaccaattaaaatttttaacaccttctcaatgttttccttcacagaaaacattgaatgctacaggaggacttaaaatgcagaaatgaactgaagatcagtgttctgcttttatctgattcagattattccctattgttccccccaaatagtgacaaagtaaacctgtacctgcctgaaaatgttttgataaaagcactgattttattccctgtaagagatgtgaaattggaatccccctgaaatatctctgtgttttattcacttctccatatgaatttttgtgaatgaatatgatttaagtaaggaaacagctgcagtagacagtaatagactttaatattcaatattccttatggtatcattttcatacattgctggttattactatttcttaggacagcataagcttataaag

SEQ ID NO: 60597 - DNA, 1070 bp, Homo sapiens
ttattatctggtctagttatcaaatgattctataccttaaaactttgatttgattgggaaaattttaaagcaaaattagaaacagtgccatgattaggaaagcagtttggtgagacttgttttcctccagataataaattcatgatgtactgtgaatgagcaagtaaaaatgtatatctagaaaaatttcttaaaacacacacataaacacacacatcagcaaaattttggaagacagagcattatgtcagccatcatataattaccctttatatattttgtggattttaagaatcaacaaaattttctttaaaataaatcattgtgtccctgtgtgttgaagatggctttggtcagtctgtatttatgtttttcttcaattcttctagaatgcagagccaagccagatgcagattccaaaagaaacggtaagagctttgtcttttgaaggatgcagagatgttggaaagatacatggaactaacttcttactaatttaatacgaagttacttgtcctgccttttcctggctcgtaatatttaatacatgggtttattaaatgccaaagtggtcttattttaaggtgacttactgttaccaccccaaatggagtatattttgtgattaattttggtcagatagacgcaaaaaagagagagacttcctattcacttgcaaagtgaggaccaaagcttagttgtttggcatatatgcaaagtatttcatgagttgtgaaatgctaaattataagtggccacaaaatggaaagaaaagttaaaaaacttgattcaatcatggaaaaaaagggagggctaagagaatacagtaaaaaaagtatacacaggaaaattaaagtgacgtgtcagtattaggctaagcatagttgttagaataactataaaagagataatttaacaaaagttaaggactcacagctcacattaaaatgcaaacatagttgcatcctgttaagaaaacaagtcctgagacagactggggataaaagagtaagcttagttccagcaggcagaactaacacaataaaaggaaggattgctctatcagtctc

SEQ ID NO: 60598 - DNA, 1660 bp, Homo sapiens
aaaaatatgattgcatttacacaagctaatttagaaagactatgcttaatcactgaaaggagaaacaatggttttaagtgtttttcagaccttgagtaatcttaatgatatagagtcccatagatctatcttgattttaatttaccaactgtgagaatgtatgacaaaaagcacatgctgcttgtgcatgctgccaatacttacaaatattttatataaaaattatgtttactataaatgtggggaagaatgctgattatctttgattaggactaaatgcatatattttaataataatgaatgtaggagaattgaacaggctttccttgtagctagcagatttttttcttacaagttattacatttattagtgaagtacattaaaaacatagggtgtgtcagtgttaaacttcagattcagttcaaagtgagctaatgtgctttgagtggcagcagttcttcaaaaactggaatcaactcttagtacaaaaaaagatgtcagtataattattctttggcctaattttggagctatgttatataacatgacaacagaatagcctcagtgtacttgcttccataattatgatttcttaatatttattgccattttggtattctcaaatacccagctcttttgtagaaattagctttttaataaagtcagaggagaaggtcagtaatctgtttcagtcagtgcagaatgttttgttggctttgttaaatgaaaattgatatctacttatctttccttgaaaggtcattgcctgaacttttagcttacagatttaggggttgttgctgatattttaatagtattgaggttcctacaacagtcagcattcatagttcaaaaaagttagtattgcaaaaggagagtaattaagaattctttcttaataaatgttattgcaagtcattagagtttcatgaaagcagagacatatggaaaaatctccccagagcaataacaaacatttcatatagacagtatgccattcaggtgttcagcatggaagacatcagaaatattaatagtccaagcaccctaaagtgacttcagactaaagtaaatgaatgctttgtttgatgttgagaataactatggtaggttttgctacaggaataactatggagtgttttctttatttctcctttaatgtttctttaatctacatttttattcacccttttttgttcacttatattttatacttttcattacagttttatactgagtgatgtatcagattaatgtgctcttttctagatttttcacctttacagatctctttattcttcccataatgagcaagcatttgccttaacaatattttaactgaaatggaaactaatatcttaagaagtaactttttaaaaaagcttaggtagaaatcattattgtaaaaatgttgtgattcattacaaatgtatcattatctccccagtttttcctgggcacgtgttggcttcttgcgtcttgattctagtgacatataaacacttttctgctttgtattgagcatgtaagactgtctgtcaagaaagctgccaaagaaatgagaatttaaattctgtgaatcatcagagtaatttataaatgcatcattaatttagtacctttaagcataatatgatccccagatttggtagccatgat

SEQ ID NO: 60599 - DNA, 1053 bp, Homo sapiens
agactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacgacctatcctgtttttgttttgtggaatttcttttcttagcagcaacacacaagggtagaaatggaatttattttaaaagtcaacctactaacccaaagcaccctgagtcttatctaattattttgtgaaagaactgatagattttttaaagttacttaccttttaacatatttcaaattgtatttcttatatgtctcaggtttattttgctctgtagaaattaaaatgtaaaagtgcagagaataagactatgtctatgagaagaagatagcagttactgtagtaaaatttttgattgtgaaagaaaatggcttcaggacattaatatcaaatgcagaacaatagtaaggatttgaccattttgactgccccatttgctgtataagtccagccctcaaggaggactttagaggtagtgcacgtcaatctcagtatttgatgtggggagggaccaatttgtttgaggctgccaggagtttatagtaggttgctgagaagccaggccattgactcttgtcttttgttttcttgtattattgcattacttccctttcttttttttcttttcttttcctctcttttctttttctttctttttttttttttttttttttttttttttgagacagggcctttctttgttgcccaggctacagtgcagtggtgcagtcatagctcaccgtagcccgcaacaccccatgtcagccttccaagtgctgtgactagaggcacatgccgccatgcccatctcatttacaaattttttgttgtgttggagtcttgccatgttgcccaggttgatctggaactcctggcctcaagtagtccttctacctcggcttcccaaagtgctgggattatggaagtgagccaccatgtccaggcctgcttctctttcttatggtg

SEQ ID NO: 60600 - DNA, 1141 bp, Homo sapiens
aataatgcagaataccaattgtatattttgaagagaaggaacacaacccagaccacctcaaatatcaaatgtcattaaggaaaatagtaatgtaagcttgtgaagttaacgttagagagttttttacagccatgtagatcttattgtgacctgatgtgtgatgaagttttttttgttgttgttggtttttttgtgtttgttttttggttttttttgagatggagtctcactctgtcacacaggctggagatcctggctcactgcaacctccgcttcccgggttcaagcaattctcctgcatcagccttcctagaagctgggactacaggcatatgctaccatgcctggctagtttttgaatttttagcagagacagggtttcaccacgttggccaggttgatctggaacacttgatctcaagtgatccgccggcctcagcctcccaaagtgctgggattacaggtgtgagccaccatggctggcttaagttttttaaaataagaatcttgcactgcttactttcaaagctattttttagactaggttgaatgtttttcaatcaggggcattaatgacaattagctcgtcctccaacccctgtcttagttgactacctgctgatatgtagaaatagagacaaataggtagagagacaatattatcttccccatgatgatgtttttcttttttttttttttttttttttttgagacggagtctcgctctgtcgcccaggttggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgatgatgtttttcttgagttatttccttgtatatgttattcaaaaataaagttaactgatcctcatctatattcgttcacggtttcattactttggtgatttctttttttaaattattttcttagtagaaaaacatttacctaa

SEQ ID NO: 60601 - DNA, 1020 bp, Homo sapiens
gacataaacttgtattacacagaagaatagggtcggtccaagagaaatgttctgtgtcattttaatgtagttatctctgatgattgctctccctccatgccatcagactagtgttcaggtatgtagtgtttaatgttgccttcatcaccatgcttatattccagaatatgtatatatatgcctatgcacttggtgggatttttgttctgttctcttttgttgtttattgtgtgtctgtgttgttgcagttttttgttttgttttgttttggttttggtttgtttacagtacacgttcatgctccctcattcatcattgtctcacagtgatatggtaaagctcgtagaagtccccaacgatggagggcctctgggaatccacgtagtgcctttcagtgctcgaggcggcaggtaacgtatcttggaggtttttaattgaatcataatgtagagtgttttatcttcatttatgctcagatagagagtggtgttgacttagcatatgcttaataggaaacattctcatttggaggcaactgctccttcattcctatatatatgtcataatcacagaaagcacttagcctgatgaagagaggttttgcaggaacgtgaagaaactgcatttgaattatcctaataaatttattgttcatcacactcaagcaaacattttactttgctgtaaattgatgatggactttcaagtcagaactccagatgaatttgcaacgttaaggagagcttaaaagcactttttttgggaaagcttaatgcaataaaaattatctagatgacttaaatttgatttaagctttaaatttgtgtttagttcttcaattttatgagtttttttattgttaaaaacctttaatatgaaattttaaaaaattaggcaagccatagatttctgaaccttgagtctaaaaatcatgtactgtttgttaatctcaacttcattactttacagaacatgcatccttaaaaacttcaaatgttatgtcagtttccttgattctgt

SEQ ID NO: 60602 - DNA, 1091 bp, Homo sapiens
ttgttaatatttgaactttaataacggttctgtgagttgaaaaacaccattatgattttaaggtggtctggaaaacctaggtagttgttgcataatttgacgtaactacttgaaactctggttctcttaaaaacaattttgataatagtaataacattactagctttttttaaacatgcccaaattcagttgtgtatgtatttgtgtatatgtgaatcagtgtgctgtatttagggtaatttttggttaataacagtaattacaagaattattccttttcaaattttataaaatgttttaattgacaaaaatgtatatattgtgcacgacttgatttgaaatatatacattatggaatggctaaattgagctaattaagacatgtaatacctcacgtacttcgtttattttgtgtggtgagaacacttaaaacatgttttcttagcagttttcaagtatacagtatattgttattaactacagtgactatgttgtacagtagatctcttgaactttttcctcctaatggaaattttgtatacttttaccaacacatccccacccaccatccccctaaccccaggtaaccacaattccactctctactttgatgagttcagtgtttttagattccacaataagtgagatcatacagtatttgtctttctgtccctggcctatttcacttaacataatgtcctccactatcattcatgttgccacagtgatagatttctttctttttaaaggcagagtagtattttgttgtgtgtgtgtgtttgtgtatgtatgtatctgtgtattacacatttttcttattcagggtctattgataaacactgttgataaacaacaagataggttgattccatgtcttcgctaatgtaaatagtgctgtaataaacatgtgagtacagctatctcttcaacatactgattgcattttctttggatacatgcccagtggtgggattgctaggtcatataatagcactatttttaactttttgaagaacccctataccctttttcataatagccgtactaatttatattcacaccaacagaatgcaagggttccctttgtccac

SEQ ID NO: 60603 - DNA, 1040 bp, Homo sapiens
ttctaggaacaatggatgtttgcttacatgttcaatatataaaacatggatgttacaaattctgatctaccattaatatgtaatacctagtatatagcttttggggagtattttcctcagttctctgagtaaagctttttttgtacatggatatttggtagaaattgacatttgatatgagaattattttgagttttggaaatcattttcaaatacagaggaaatattcttcattatggtattgcataaaaagtttcttagtcactggagtgtatcctggtttgaggataccccatacaggctatagaggattttttgtttttttgagttgatgatgataggtgtcccaattccttattatcattagggttcattagacttctgtatgagacacaggattctaatcttccctgttcccatgggatacagtataactcttcagactatagggggattaatttgataacattctttaatttttaaaatatttatttgaattttgcaaaggtgatacattcatagttctaaaatcaaacgttatacatggagatgcaaaatagtagtctccctcccccaactctctattagctagctctcctccccgtattcagccacagttatttgtttcttgtggctcctttcaaatggtaccatgcttttatgagcaaatacggaaacatattctcttttcacctttttatataaatactactacagtatcctgtgctttgattttttttttcttaatatagcttggcaatccttatagactgacacataaaaggtgtccatttttgaaacactttgataattttcctttgtatagctgggccagtgtttattgatgggcattaaggttatttactatcctttgctgttgcataaatatactgcagtaaataacctgttatagataagtcattttgtattgagtttctcacagaagtatgcctaaaaatgaaattgtatgtttacacattgtacaggaatattacatacatttgtaactttgatagatgttgtcaacctgacctcagtag

SEQ ID NO: 60604 - DNA, 1027 bp, Homo sapiens
tttgctgtcctaaaatggcccaggcattgtcttgtttactatagctcctagtgaacccttatatacttttgggtaaatagtctttcaataaattgaaaggaaaaagttcataatgtccctactttttctgatatcatgtattatgggtggatctttgttgggtgaactatattgactcttttataatgccatataatgtgatatggtgattttcattaattatgggctataaactgtagattataggtaaataaatgaaaacttgatgaagacatgtacatttgtaaacctcataaatagttgtactattttgatgacattattgcttataacttagcatctgcatatgacaaaaagaaaaaaatgattataaactaaaggaccaagaaatggagggaaatgtaagttctctcaaagtaatgcaatgttcctatttttttaaatcttgatatgatggagagcacagcctttcttgtgcataagtttaatcgtttgtgaactttcttcaagaatgtcttgtagttgaacatggattcagtgttagaagataagcccgctcagtctgtccccgctggcctgtatccagtggtgtctgctgtatcaccgctgatcacactagccgtgggaaagccacctggctctccagaggctttgtagagggagtgagggggcagagggtaagagctgctatgagctacttatgtgagatttttgtgggacaaaaggaaaagccaaaaaagtgttcttataggcccaagatagttgtcaactctattagctctaaaagtatttaattaaatatttaagatgtttaattatcaggaaatattaaataactcttcatgtttatataactaaagtgacataagttttctgttaaattggaaaaacaatatttgaacaaaccatttgattatattgaataatttataagcaattgatttgaacataacatagttaaatattccctccataaaatattacgtattttacttgtttgcgagctgattttagctgtttaaaattt

SEQ ID NO: 60605 - DNA, 1023 bp, Homo sapiens
agtctaaaaacatcttctttggcataagtgtaaaaaaatgatgttccattcctgaaatttgatttgagtgaaactgtatactagaagagtagaagccactgatgttttcacatccagcagaataattgattaaactaaaatctgttgaagaggacaagaaccacagaaacaaaacaaaactccctctcaaattttttcagaagtaagcactattgtttgtgcagaagaggaatcttaggttatgctttatacactagaaatctattccaattattcccatttaattatggatttattctgttaaccattcccggaaagtcatctgactttaatgacctgatgtctcttctgaggctttctttttctctttagtttttgctattaaacatataataaagaggattgcatcatgtacatgaaaaaatattttgtatgcttaaaaaaaaaaatcctctgcctttccaatttgggaacaccagggtagaactgatggccatcttcctttagtcgtgtggtctggagtgaggtcagcagagttctagattttatgtgcctccagtggttttgtttttgctctgttttctacttaatgcttatctctcattatctgtttctgaaggcagttatgaccttatcagcttttccagtgggaataagcagaaggaatggaaaggcaaaagagtgctttaaagtgctaagctagctggcccctctagaagtctggggtgtcttattctttgggtggtattggtcctacttacggggatagtgaatcttctttctataagaatattggttagttttacttcaataagaaaagataggttgtatgtcttattagaagtctgtagcagcaagcacaatatgatttccaaaaagagtagccggggttttcagtgactaatcaccttgttcagaatagcccatagctgaatcctacatcagagtcatctcacaagttatgcttctgaaattttgactctgacactcaagaaacaaacgaacaaaaaacaacagcacttt

SEQ ID NO: 60606 - DNA, 1112 bp, Homo sapiens
agcctcccgagtagctgggactacaggtgcctgccaccacacccggctaattttttgtatttttagtagagacggggtttcaccgtgttagtcaggatggtctcgatctcctgacctcgttatccacccgcctcggcctcccaaagtgctgggattacaggtgtgagcccccgcgcccggccttgtacctattttattggtgagcaagtagagccctggagagtttaaatagctcacctaatagttcaaccagctgttaaatgttacacctaatagttcaaccagctgttaaatgataaagttgtgatataaatgtgctgaattctcttggctgggtacttgcacttttgtatttaatttttattggggcatcttgttgcaatatctgttttatttcgactttagttagattgtgtttttttggggggaaggggagagtaaggtttcaatagacgttactcaaattccctgaatcacattttctaaaattgtagtttttagccatgaatggaggacagaaatagtttccttgaatattaatatcctttttagagaacatgctttttctgctaatggggtggtagagaggaactcagttctttagaagtttgtgccatccatttctttactctaaatgcttcccatgtggcaatgtaattctccacaaaagtcattacttatgagaaacaatatgtaggataagattatgataaatgaaaataagcactttctacattaagataaaaagtatctgtggagacagtgtacctgaggaggcactttcacaattaaggggaaagctaaggtagactgtacctagggactttcacagaaattacccaattcttctacgcatccatccagtccattggagtttggattgtgggctgaaaaatggaagaaagtggtaattatcttacattgtcagactagttatatgtgatttaaatctcttcattttcaaattgtagtaatttatttaaatatatatgtatatatacattcgtttttaaattcagacgaaaaatatttagataaatataaaatatttatgatgcacatctaaataatgtataagactgtaggtattttggaattaggcaaccactata

SEQ ID NO: 60607 - DNA, 1050 bp, Homo sapiens
caattaaaaagcagccaagcatttgtttggttttcttaaaatgctaaatagagaattattgttttccttgattattattgaaacttcctgttttgtatacaaatttgcaataggatttgaattgtcacagtgagctagttctaaatatagcactttaataaaaaaatgcttctgtaaatttgtttacttccttggggagtcatgtgcatgtgttatcattcccaagagggacaaacataaacatatttcatgaaaaaattcaaagaggtgttagaaaatgcagattattttgccctatgtttgataagtagaaaaacaattatttctatataactttttcaaattaaagttagaaagaagtagtggaaatccctcagatcttttctgagttgatagaactgagagtatatagttaatggttatttaattatactttagctaaattcagtgtccttgcttaatactaaaaaattaattacattgcttaatactaaaaaaatttcagagagatgtgtttttggatgatcctgtgaccactgactccatgaagctgtagagcccttgaaatgaggcaagggtaactgaggagctgaatctaaatagccggtgtggctagtgactccatcgtctggggacttgatggaaatgcagagtctcaggccccatccagacctattcattcagaatctgtatttttcatgaggtcccttagggctgatatgcaatgctgtctcttctagagcaataattctcttctagagctgtcttggctgcatgttacaatgacctgaagagcttgtgaaagtaattcctgggcttcttcctagaccaaattttcagtatttctgatggggatcctggaaccagcattttacagagtattcccacgtcattttaatgactggtgaagtgttagaaccacatatataactcaaagagtatacaaacaagtgtgacgtttggatggggaggtcttaagtactgccctggattttccactttttgttgaggttagtataggaacagtatatgtaagaaagagttagtctg

SEQ ID NO: 60608 - DNA, 1052 bp, Homo sapiens
ttatcggaagcagaaatagttacttacacttgaaaatttgtaatgggaatgtagctgtgaatatgttaagaaagcctgtttaaatcaaagcaagaaatcccatttccaaatggtagtaagacgtgtgttacatggagaaaataattgcctgaaagtgtttgttgtatttgccaagattagattgtacactggtcaataaacaagagttctttttttttgtttttatctttcaatccaaccaggtacttgggttcgtttttctgttggtgcatgtcacacagagacccatattgtggattattttgtcagcatgaaagcctggcagatacaattctttcccctcttctcgctgcacttgatatagatctctcctttacttcttgataatacgtttgcttatttatttgttcgttgcttttagtgtcagcagtggctttgtgtcctcagttctgtttgctcctgcctggctcctctacccagctggagaggtgcctcatatctcagaatttctgagtcactcccaatcagtgactcctttctttttcagtgactaagagaaagctgcccacaagccagcaaggtgctgataagtgtgcctctgagattctcacctctaacttttccatggaatggacagctggtagtctctctctgggctacattttaaaggaaaaaaagaagtctaaatcagtttattaattcatggtgttattttgtgtttactcaatttatttatattgattggtaaattagtaatttacaaactattatttgtcaatttattgcctacatatcaacaaatacttttcttttttttttttttttaatcttggggacaagcacattggctcagcctgtaatctcagcactgtgggaggcagacgtgggaggaccacttgaggccaggagttcaagaccagcatgggcaccatagtaagatccagtctctacaaaaagagtaaaaaatacaaatagctgtacctggtggctcacagctactcaggaggccaaggcaagtggctcgtttgaaccaaggagttcgggctgcagtg

SEQ ID NO: 60609 - DNA, 1056 bp, Homo sapiens
ggtgtgcgcgatcatgtctcctgagtgcagatccacttcctggggatgtgtaaagaggttgagacgttactcagcccaagtaactaggacatgtattctggaatgggacactactggccccttaggtagatggagtggaacttttacagagtcaaattggaaccatgtctgtgatatacatttaactgtctttattttcaatattaacaaatcaggcttagatctgaagctttcagggtcacacagttcaggtgcaaatcattgagtccaaggctggtgatattttgtgtatgactttttcactctatgattttttttttccttcagttcccaaggactttttgtagaagtcagatatttgagggtagcccaggtttaggtcatggctagattccttttacctcacaattcaaatttttaaatatctcctctggaagatctagactgaagaatgaagtttcctttgaaaatgatgtaagcccgaggaatggtgaaatttctggaaatggtgttgctataaaaatttggggaaacaaagtatctgatttatttcatttctttttttgctgccttttaaatcttttgttatttttaactttttattagctatgttaattttagttaatttttatccattacttgggaaatttgtctgaaatgatggtatttaattaactgataagattttactatcttcctaacatttagaccttaaagaaatatcaataattgttatagaaagcttgtacctaagttagtgccccctcccacttcttgatttcttaattttttttcttagcaagcatatacagattgattttgtctttctagaatatccaacacctttggtatagagatctgtccttctaacatttgctggtatcagagtactattttctggatctgatgtaagtacatattgcaaatagaaataatattcctattgtatttccttttaacttgtgaagtggagcatggcatacaaatggtattctcagtatttcaaataattaccttcttactgtgcaagttctattcagcatataaaacccatcc

SEQ ID NO: 60610 - DNA, 1077 bp, Homo sapiens
cagttgagccagtgtctcccagagtggtcatacgtgctaggtgctctgatttcttgatgttcctgttgtttttaagatctcacatggaatatttgatgctaggaaccctaacttaccgaattcagaggtttttcttcagtattactttttatgagtgggaaactataaagattacattttatttatttatttatttttgagacggagtctcgctcttgtcacccaggctggagtgcagtggcggatctcggctaaacaattcacagtcttgtgcaatattctgttttgttcatttattacacttaggatgaagtgtcacactttgtgaggtgatttttttcccttgtcatttgccacttgcctaagtgtacttcgctgtctgacagtactgaatcaggtcagtttttaggtggcagcaatttataaataaccttctctttccaaagaagaagcaacagcttattagtggtttgtttatgaagcttgcttttagttttaggcagcctggatgttaattgtctaatcagagttgtgtttcaccataaacactaatgtggtcagtgtttgagtttctgtttctctttcttggactggtattgaaagacataactgattttagatgtctaagcaatggcttttctttgtatttgctgtcatgtctccttattaccatggtctgtggggactggtgtatgaaagtgattttattgtcagagtggcttccagttcttggggcattaagacatttccagtaatttctgtggttgcagagataaagttgttagtgggaagtgtggaccccagtgtagtcaaggtctgggttggttggacttcgaatctgtgaacacccattgtctccttggctttggcagatgcatcctggttgctccttttgtagtactgctcttatttccttctgtgtcattggctctctcattcttcaccagaaattgttttttcattttgtttttaattttctttacccagaatataactcaattcagaattgactaggtcttcaagagaaggaatcaaaaagttagaatacgggccagacgtggtggctcatcccagtgc

SEQ ID NO: 60611 - DNA, 2311 bp, Homo sapiens
accacccaagttctgttgaaacacatacccataatccccacagagctcttctttcagaggatttctcatgggaacaagttctactgctagtagttgaattatctatgttatcacaattgtatgaagaaacatattggatcaagatttctactgtttgcgaaaatatcggctacaaacacacagaaatgcaactgtcgagctctgagttacctgttggttgcagttttgttctcctgctgcagcccactctctggaaatgctggggcagccactgtttgatttgtttggacctggctgatgtaaggtctaagaatggatatacctggattattcctgtccaagtagttgaaagtggactgcttttttagagtgctgaacaggaattgaatttgggacgtgatagagaccaaagaaagacttgtaggaagtgaatgtcatttttgttcaaagtatttgcaaaactaaagccaataaaaggctgccttctcggtggcccttttatttagttcctggctttttccttggaatcagagaaaagtatggcaagtttccccacagaagagagtggaatgtcaaggaagattgttcataaaccacattcattgagtgactgctgtgtttagggtgacattttaatgccagctggtagttaattgcatgctattttatttttttttctgttatcttaaaatatccttcatacgtgaccacgctattttatttattagtttattttattttgagacagagtcttgctctgttgcccaggctgcagtgcagtggtgcaatcttggctcactgcaacctctgctgcctgggttcaagtgattcttgtgcctcgacctcctgagtagctgggactacagtcatgtaccaccatgcctggcttttttttgtgtgtgtgtgtgtttttagtagagttagggttttgccacattgcccaggctagtctctaactcctggcctcaagtgattcacctgcctcagcctcccaatgtgttgggattacaggcatgagccaccacgcccgcctgcccatactattttaaacagtggagaaacttctgtaggaaatgagacggacaaatgaagagagaaagagcctgcctgtgacctacagaaaatggagtttcctggattaattaatgttattgcttacaatgtttgaagtatagcctaactgctataacctaaaaaaatcaaatggaaagactgtgtgcttgatcagtagaagatgagtggcccgaaggtgtccatacctttgtataatttgcttgtcaccatctggttagcttttagagcccattgatgtgcaacaatatttatgacatcatggggaattttttatgttaacacttcataatgtaggctattttttcagtagttatcaacacgtagggccagaatttgctggttaatttaatgcttaaattttttaagcatcatcattgcctgaaatatgtttttttcttttttccatctgtgcagtgcattttttgtcatcattaagcaatagcattttaattggagtcaccacttggtcaatagatgtcaggtcatggcatgggaagaaaaggaaagcgcactcagtgataacctgtcctatcgggaactcacccaagtacttactatccactaccctgccttcagtgatcctttctatgtaatgttaaagttaaacatgtcatttccttacagagcataggagctgtataactcaacgtaataaatctcgacgagttcttggcaatgatgcccatattttatgtgtgctaagattatctctagtcataattatttaatacatatggtatatgtaacatttatagccttcccaaagggaaaaatgatgtggcataattctggcagattgtttatattgttcatgtttaaaatgtattgtaaaaaatgctatgcatgtgattttgaaaccccagtgttctatttttaaatgcttgtatgtctgtaagaaactaagcacagtaagtaatccagtttttaagtatttcctcttgtaaattgctgttaattgctaatgttcattgaattgacctgctaatgggcacaggctgacaaagggagtatccctctagctttttgatgaactgttcaataatgtcagacaatccataaatttgcatgaatgtttaagtttcatcagccgttgtggtctaggcaaatttctgtgttcttattatcaaacattgagaaactaaagtttataaaaaataacttgttagagtgagctaaacatttaagaagtattgcttttgtgtgtttgatgggctaaacaattccttgtcttttcaga

SEQ ID NO: 60612 - DNA, 1085 bp, Homo sapiens
ttcttgtcatttttactctttaaaatagtacattcaaaaaaagagtgttaataataacacttaaagatatattcttatctttaagcaatattggcttcaacagcagtcacatcagtgtcttgtgctttatttggcctgatgtgggaatggatggtgccaattgtaaaaaaaactttggttaatttatttagtcagtatctagatagaactctataagactatgatggggcttttgtgtaatattttctattgtaaaagcaaaagaacacatttcttgtgcatttaggtaagagaaaaaactcacatatttaaaacctgcttttttgcgggagggtggagataatacacaggtaaatttttattttggtttgttttgcaccaccttctttccatttttggtcagctgttcaggctgcatttccgggataatgtatttaccatgcattttagtcattgtacctctcagcctccagctggccttcccccagggtatctttgcacttgcaggtcagaaaagaccaagttatgaatgtgatctcattttcaagggttttaatctgtttttggaattagtcaaaatctgtgttttgctgtaagattaagcttgtgaaaggctgcaaggctttcctctttgcagatgctttgaatgacttgtatagaaatgtcccacagaggtgcttcctgttgttttcacatccctttcaggaatacacaagcccccctgtttgtccatctctgagaaagacaaaatagctcaatacttcttgcaaaatagaaaatgtcatttgttggttgtggtggtaacagggccggacattattcctcattcccatcccaaaacattgttgactcagctccagacctcatgtagtaagaacagccgtcctcctgtgttatcactggggtggctccaggatcgatggaatgtattgagttggatcatcagtgccagttcactggactgtatttaatcattgaaaaatgaagatgtgtattttccttttgacacaatggaaaatcagttgaatcacgactttttgttccttgaatttgaaaaatggaacaaattatgaaaagccaattat

SEQ ID NO: 60613 - DNA, 1034 bp, Homo sapiens
ttagtgatgaaattttttttcatccccattttacagacaggagatgagccatatggtgctcattttacgatagtgatagaatgatggatttagacagaaggaaaggtgtgtgaacagagacacattatcgattctcattcaaatcggattcattctgctatgctgtgttgccttcagctgagtgtccagcggtttgaaacatttctaaattttgatttggggccatcatgcagctcagtgcttgtgcttcggtgcaaggtctcttgggcagagatgctaatttaagaatgttgtcggtttaaatgttcctaagaggattaagcaaattctacagcatataaatggacatatttggaagatttttttccccaagcaatttcagaaaacacacatgcatcatttgctaaaactctgcaggtgtattaatgagttcatctcacatgaatggacagtcactgagggaacttcatatgtaggcttgagttcaggtatatgaaatgcaggctaagttttaattagaatttatttacagctcgaagctgctcctttgtttttctgcctgaagtcagtaatgaaccattcctctttgcctagtcattagtattcagagctccatcagcctgcagttcaaaccctttcccttgtttttgtcagagaagatgatggagcaaggttgcttagaaacacttagccacactctcaacgggaattatcaatctgtgctgtatgttcacccccacacgcaggggagaaaattgagttttactgctgatgacgttaattgattgcaagttgttttagtgggagtgtgatgttgaaaaccagatttcctttcatttttatgcattagatgcagagaagctatacagtgacatgttcattccactgtaactaaaaatatcatagaggtatctaaatttggttttgtatgttttatattcagatcttgacactggtcagcttacaggattatctttgggttggagactgtttctgtagtgatttctttagttcccagtaaattcacacagtca

SEQ ID NO: 60614 - DNA, 1064 bp, Homo sapiens
ttcagtctctaaagcaataatggtgggttgcccttttgttaaagagtctcatgtcaacaaattcatgtctagtttaggctaggaagaaataatagttgggaaaacaatagcttgaaaaatcagtagggcatgccaggcatccttgtatcttcacatttgtgtatcacgtataatctaagtgatactaaaaatttgttacgctctaataaatgatgatttatgtataccaaaggctctaataaaatatctagaattggtagcatcatagatatgaattaaatagatggagatgaagtaattaaaattagttcctaatttgcactgattttttttaatcttcaattttgtaggaaaaaaaaattggagcattaaactgatagaaaattgtaaagaacattctgcttccggtagggaaaatggtctgttttcttttcttactttaacataagatcaatactaatgtcatttatattgtactttagtgtttacaaagtagattcacatatattctcttatttcatctgtgcagtaacctctggaagataaggtttcctcattctgttttttaatgtctgtttcttaactctgtgtaaaggcagattgattgggcctcatttcctcaatttagaaggctggactgattgatggaacattaaagaaggcagaggtaaataagggatagtgattctaaaaataaaagtgacacttgaagtggtttgactagcagtctcacttatttttccaaaggcaaaaattaaaaaaaaatcaaaaagacaaaaattaaaacccagagatactaataaaagcagggagcacatgtatctttctgatcctaacacttagagtagcagctatcttgacagcctatttttgtgaatagaacacttagatgtccatttttaaggacaactttgttttttcttcctggtgttttgttgttttactggcatatatctaaatttgatttaaatttcatggcattaaaccaaaaacttagatggttatatcgtgtcatttgttatatttattcagtatttgttggtgcattttggtaaattttttac

SEQ ID NO: 60615 - DNA, 1064 bp, Homo sapiens
aaagaaaaagaaaaaaaaagaaaaattagaaaaagtggtgagccttagtactagaaatagtaaagaattagcaggtgaagtttagcagattttttttaaattaacattgttagtttaatttcagttcctaatagattgatgaaataaacattaacaagaatgtgtaaacatctgtaagttaatgggtgcaggactaaagcattttaagtagtaatcatcatacaaaaacctgattgctttccttgatagctctatggaattacttaattttaaaaaggctatagatgttaaatatcacgattttcgagtaagtgattttttgaaatcttattcaccaaactaaccgaattggataaagaaatgtcaagtgtgtaataaactgtccaagagttagtggcaattgaaaacatatcaagttgaagagaaccacaggataatgtgtatcttttcttttaatgatctagaagaattagctaagcaatatattaaatctacagatgatcatgaatgaggtgttttctttttgttttttatgagtgttactgagaatgaagcagtagggtcaaacatgcaagtttaataaaatggcaaaagatgaaaaaaaagtctttgcaaaaagctaactaatgtttctggggatggataaatccctaggaacaagagaggggaagacctaatgagcctgggaaaacctaatgagcctaaagtgttttattccatgtaacgaaaacatatcaaacagtaatcttgggtgactagcctatttttttgtctgcccagttagcttaattgacagccatcattagatggcattatgattgggcaaaccaggaacttctgcagtaatggaagttttcaaaaaaaggtttgtctctcaactgaaaaataatagacaaacatcacagagacgcttaaaaattgattgagtcaggtaacgtttgttttcatgtgaattattaggaaactccgctcgattagttggacaccatgtacctctctttttcaaggtactgtacacaggagcttgagaagagatgaaatggggccaagaaactagcatctga

SEQ ID NO: 60616 - DNA, 2255 bp, Homo sapiens
ccaaggtgctacatggagaaactaaagagagtcacatggccaagatgtaccacactggagatgccaaaacttggttaaaagccctcatctgactgactttatttatttttattttattttatttttttgagacagggtctcacacttttgcccagcctggagtgcagtggtatgatgtttgctatagccttgagctctctgggcacaagtgatcctctcacctcaccctctcaagtagctgagactacgggcatgagccatcatacctggctaatttttgtatattttgtagagttgaggtctcaccatgttgcacaggctggttgacttattttgaagccgattttctttttgtcgtcctcctctaccttcaggacttttcaggtagtataatcctgtcgtcgtaattcctggcatcacttactccattcttgaggttttctggtctcttgcatagccaggtgagagctgagttgaaaagctttttatacaggcttcatggatatgtatactggtataagtgcatcacacagttaataaaaatattggagaagaccatttagttcacttctttataacagcagtgcctgtacacactttcctcaagactttctggtagttggaaatatgagtttaaaagtaatagtcattaaattaagtggaaactgtgggtcatttcaaagacattgtttttacaaattgattatacacatactaggtccttccaagagcatgcttaggttgaacagaaagtcttactaacaaaacacgtgccctgtgctctgtattgtcctcagggcatatgattgactattacagtaataaacccttgctttctctgaggtgcaaaaagaagctatagtctgagtgcttgggagaggcataagtcataattgtaggctgtaataaatgcaaatctatgaaaaatgggttagcttcaaacagctgagtcgcagagtcttgcaaaaccatgccccattattcctctctggagcccagatcatagaagaattatccatcttttttaacagtgggatttctaaggcttctcagaaatctccggtctcttggtttccagcaagagaacaatatcgagtcttaaatgacagaaatgaattcctaaataagttgaactttttcaagtttttaccaaatttaaataataatgctcatatgaatggtagctcatgtcttccctgtgcaggtggtactgaactaacattctaaatttgaaatggcaggctctctgttcccctgtctgggtaatctctgataaaacattaatcatctcaaggttctattcaagtccattgatggaaattgtgaaatgtaatttagcttgaggaattgaattaatgttttctaatagccctgagatattcactgatttataggtttgaatgctgggaggtgcatttgtgtttctctgtgtgtgcgtgagctcatcctagttaatctaaataggtgtttagaaatgatgcacattctatatcataaaaatatgtattatctctgtgactggtgaatattggtatggtttatttgtgtctgtcatggaacttatacattgctttatacacctggtataaattcgtgctcaactgagaaatatttgttgaattttaaaaatcctttaaatgtatatgcatatatatgtagacatggaatcacagatgtatatatttagttctaatgttttattttcaagcaggtgcagaatttatctgatttgattacttacactatgtgcctctgttgtgcaaatactagttttctcatcctttgtttttctccttacagctcctttatcactttgcaatatctagctctgctctgtaacatttctgcctcaaacccacattgatggcgtacttgtgtctttctcactaccctcttcctttacaatgttacagcttaacaatgggtgcagcatccatttgtctttcatttcattcccttctgcatgtgtagcgtctgagaagtttctggcccaggtaggcatgcagtaatgtattgaatgaatatggtaagggaagaaggaaaaaacatggttccaagatcctggggaggtctagttgaatggactgtgccttttttgtgtcaccttggagcagtcatttcatctcttgaggcttggtttcttctctgtgaaatatgcatgattattattatatagtttttgagacagagtattgctctgttgcccaggctggaatgcagtggtgtgatctccactcactgcaacctccaactcc

SEQ ID NO: 60617 - DNA, 1134 bp, Homo sapiens
tgatctgtagtgactctcacatttaacttgaattagagcttgggcacaaaagcaataatttgaacaaagtttgattcttaaagagtaatatggtatccacttccccacttccattgtttttcaagaaaaagttggtatgcaatacaagggtaatattaagcttttatcttcatcatttatttatttatttttataaagacagggtctcacaatgttggggaggctggtctcgaactcctaggcttaagcaatcctcccacgttggcctcccaaagtgctgggattacaggtgtgagtcactgcacctggcttcatttattcagtatttgaggcagaataggaaaaaagaaaaccaaggaaattctaatgtataaactgtgacagagtgtttttttttaacctaaataatgaattccttatatttgaaataactaagtgaaaataaaattttattttgtgtctgtttcaatgtaaaagcttatttcattccactacagcatacagaaactttattctttttcctagaaggttatagtaccagacacccttcttccttgaaatagtttagatgggactgactgaaaagaatcactgtaattggcatgtagagtgtcactgggtactcgttaggataagaaaatgtagtgaaatcaacttgaaatttaaccaaattgatggcattgtgccttgtaaggtgctttatggaatgtagtcacattttatagtagacttaagttctagttttaagtaaattttttttatttttacattttcaaatgacttttaacaaatactctgaatgaatactcagtaaatacttaggccattaatattttgcaatggaaatttctattgtagtttcagttcatgaatctttgctccttaccccatcccacaagaaagacttaaacattcaatgagaggcaaatttgacttcttcaaagccggaatggaagaagggagacagaatgtcacaaactgtagtctgaacttgacattgtgatattcttagagaatgtttttacttttaagccttaaaaagtattcatgttcttgaactgtggaactccagtctcaagtttggttgtttggcaagtaaattaagactaatcattataacagtcctttgctaca

SEQ ID NO: 60618 - DNA, 1650 bp, Homo sapiens
ggatttttgtggttggttcaagatccagattttttcctagacagcctataattgtattccgatttgccttatgagaagtctagaaggaagggattctaaaatagtattaatcttgtgatttgtcaagttaatttttctggtcatatttgaaattaaatttaaaaggcatcagaaaatcccgaaattactcctgcatgtgtcttttccttgccttccttggtgtatgctctgcgttccttttgatggtttggttttgatctgttctgccttccagttcggatagtacatggttaggtaatgcctaaccaagggttagtaaactaagtcagctaaaatgtttctaaaatgtcatactaaaggtacaaagttgtgatggaaaacatttatttatatgtatgttaccttatgttgtagaagtagctagtaaacagagaatacctttgaaagctataattaattttaccagccatcacagttttcctttatccgagcactgaagcattaatacatgtaagaataaactggcccttattctgcctcactcaaggtgcatgattttcatctatttttgggactgagtttggaatgcatcgttaacatagaccggtttcaactctgctaaactgttcaaagactagaatattttcagcaactaggtattttttaaaaaggaaaagaaagcaacttactttttctgtcattgcatgaatgtatttccctgggagctgcttactttctaaaatcattaagagctgaaaatttcaaactcccccccacctctccccatcaccacacaccaccctttacagacataaataggtcttgtatattttcagtaatcaaaagctgtgggtacttctaattgttctattgcatatcaaactttataaaacttagagtatacctactagttaatcatacatacacaatgtttagcagtttaattttgctcagaaacaataaagattataaactgaaataaaacaaaatgctgtcagcaaccacattatatatatatttcaaaaaaggaaactcctaatctgtctagcgtattctaggaactccatatttcacccacgatcatactggctcctgagaattttcctcacactgattcttggttacaggcatgcttatttttccttctttgattaactcaggtccacacgtaaccctttttgggttactgggtcatcttcctaactgctctaagcctagatttctgtttaatattagagtattctgttcccataatgtccgaccaattcttgatgagtactggcatttttaaattttttaaacagtgacagaatgtagtgacagtttttctttgtatgtatcagagcatttcttatgataatagctgtatcggtggcctcctaatcaagagcattcagcaactttcacgttccctggatggtttgctaggtacctggattattgattggaacttcaggagagtttaatgactctcatccttcttgccacatgccctagccgatatatttaatattacttccagtcgttgccaatagaatgcactttaaatagtgtaggaatatactaccagagattagagtagatgtggatgaatctatcatgaataaccagagcttcaataaaaggcccctttggtataaaattctgaac

SEQ ID NO: 60619 - DNA, 1084 bp, Homo sapiens
aggcatgagccaccgtgcccggcctgctttgcgttttttaaagtcaggtagtgggatgcctctagcttcgtttattttgtttagtgtcactttggctatttgaggtcttttgtggtttcatataaattttaggattttttttccatttctgtgaagaatgtccttggtgtctagataaggatgcattcgatctgtagatcactttgggcaataggaaatgtacttaatttttatttagaaagttaagcaaaaatatcaaccagtattaaaaatgttttaaatatgtgttagacatttagacatctttaaaatcttttaaatatatgtagacatttatatttaaaacatttaaaaatacatgtctatgtttagttatgtttatgcctgcatgatttaaagaaagaaatgatctgggtccaatgagataacttgttaataaactgtttatcattcataatcagccttgttaccctagaataggacacttattttaatgtctgacttggtttcttttaaatttatggcttttatttctttttttcccttaatcttctgactactcattgttagagaacttcttgatattttcaattagtttccagagcttctgctctggttagctgtttttttagcgccaactctgaaataatttcccaggttcctggtccttcctctgagagatttagtccttcatcccatgtagcggagcaaaaggagagaggtcattggcctcacattacttttctatgttggttgacttaatattattacttttcccaagaaggaatacatttttacagtaggaaaactttttttttcttttcttgaatttagctgtttgcctttgaaagctagatcaagcatacaaacacatgtatgtatgagtatacatgttctcatgtttccctgtttataaacttttcctataaggatagcctaggtagtacattcttaatgtttgctatagttttatatcttgaataagttagttcaggaaaagatttgctgacaatagatgataaattcgtagcttgtgatgcaacatcattttaaaaagcaagtttaaaaattaaagttattagaa

SEQ ID NO: 60620 - DNA, 1034 bp, Homo sapiens
ttggtggcatttgggagcaagaacacagaataaccaaggggaggtgagattataccacatgccagtggttgatgatctgggcatatatggcatgggtgattatttgaacaatatctatattttatgcttatttttaactccatgagagtggggtctctgaggaggaggtggtggtggtgtgtgtgttctttatatcccaggtgcctggcctcaaggtatttgttgagtgaatgcatgaagggatgaaccttcataagggttcattctgctattatattatgcagaaacagagagaggtaagcttattttatacaatatcagggagaaggctggagagccagtgtcaggaacagtttcctgaagtcagagctctcaaacattgaggttggctgcctgtggaggaagggagttcaggtaaagggtgagcagtagaaatattgtagaggacattcaaagatttttaactggtagttaaaccagatgatcctaaaatgctatttatattctgagactccattaaatatttgagcacctactgtttccataacaatgtgagcatcacagcagacagattcagcagtgtgagaaacgagatgactacccatgctggagtattccaatctcatggtggtggtggtaaaataaaaattaaaaaagaaaaaagttggcaaataacattataattctatacaataaaatgcaggatatttaagctatttattcattcaataaatatttgaatgccaataaacttcataagtgtcagcatcaccattgtagttgaagagagaacaacacaattttttaggagaaggtggagttgagctacaccgtaaagactttatgggactgtgggccgggcatgatggctcacatctgtaatcccagcactttgggaggctgaggcggacagatcacttgaggtcagcagttcgagaccagcctggccaacacgtgaaaccccgtctctaccaaaaatacaaaatttagccaggcgtggtggtgcatgcctgtaatttcagctacttgggaag

SEQ ID NO: 60621 - DNA, 1357 bp, Homo sapiens
catttttaaatttttggttgttttccagtttttcactgcctcactctctaaaattatattgctccaaacacaggtgtatctgcctctctgtccatcctggtcaggcccatcagtgctgcgcagtgtggctgtcaaagctttttgctttctggcctctgtctctcaggcgtgatgaagccactcactccagggcagggctgccttatctccccaacggctaaggccaagtgcagctctgttattggagcacagccacacccactcgtttctgtaccgactgcagctgcttctcactgggacagcattgagcattggcgattcttgggacagaggatatattgcctgcaaagcctaaaatccatactctgtggccctttacagaagcatgtgctgagccttcacctaaattgtagcaggaattcaataaatgttgactgaatggacgtattagagatttcccaatcaggttttacttaatatgtacacagagtcactggtccctggcatttgactacttgaatactctgtagtaaagacacagcagagtatgtgcttgagcttatttcttgtggatggatcatcccatcccgttattactaaatgaaaatcttgtctaagctcctgtgcagtatctctcaacaggaaaagggaataatttggggagagaagttgccagagtttggaaagtattcccacgtagcatgggtgaacatcctgcatttattgtgaattggttccttcatcatggctgtgcaaatcccaggagagtggggcagattagggcacaacgtgtaaactcagcacctcttctgcctgggctttagagcagaaagcagactctgtccaccaagagggcttgcagcaactttggactcttcatgaagctgatgaggcaacctgtgtgtacccacctctgcccatcatttcttcctggaatcagtaatcttcccacataacactttaaactatttcagtcagagggcttatgtatggtctgttagttttgaagggacgtcataacaaagtaccaagaactggatggcttgacacacagaaactcattgtctcacagttctggaggctggaattctggcatcaaggctttggcagggtcacacccccctccccaaaggctctagagaagaacctgctccatgcctgttcctggcttcggaagcccaggtgttcctggccttgcaggtgcatcagtccagccctgcaccttcacctggccttctccctgtgtgtctgcacagcatcttccctttgcgtcttgtctgcctctgtgttcacacttcccctttttataaggacgttagtcatctcggattagggctcaccctaatgacctcatttt

SEQ ID NO: 60622 - DNA, 1359 bp, Homo sapiens
aatttgagaacagaggaaattttagacattatgctaatggcatgaggatcctaggcctagttagaagtcatctttgaaataacttcatagagccgtatttcatatttctcttctaagaattgtgaaagaacttaattttatttccccagagagagaactataaatcatacgtatatagtaacaaagacaaagaatgtttgtggaggattgaactcaatttagaactgatttacacatcagagcaagcctgctgaaagcataagatttttacgtggttttgccagacaggttgaagggactatattaaggataaatagttgagctgttttgtggtatttttatttcaaaatacccagaaatggaaagcagtacttttcttgtttgggtgtgattcatggactgtccagcagagggcactgccagtttgtgagtgagcatccttgctggcagctgagtgagcctgcgcctgcacttcccagaggaaatgggtctgagtgtgatgtggaaatagttacattttattttagaatgttgtcatgaaagttatcataggtgtcataatagcatttgtaaggtgtcacagaagatattgctgtttcctgctacctagatgtactgaacattttgcagttagctacttagcatggtttagctaattggggactgttactgacacatggctggatccctactttgcctctcctccttgaatttgagttatataaaggaaatctcagtacttaggaatttaggggaaaatgtttaatttttgatgtgtaaccaagaagaaagcatggcagtttcttattggtggcttcatgacttactgtgaatttttaatttttctgaaatctcaggtatttctttccttgctgtgaatcctgggaaatgattgcatttgaagtggagaatcacacagcctcctttagtccactctccacaatgtccaaattatcttttggttattcttttgtctaccagactatcacagccattatattctgtggactgaattgtcagttttctccactgtaagaatggcgggtgcacagtccgtgtgtcttgtttatgtgtacacttgcagatacagagttgtttttgcctcagcttttcctatgtaaaagttttaagtactgtgtaaacatgcttgtatacctggcttttgaatatatttcacgcctgcaaacttaattatttgatgtgcatggaagttgtagaagagatcacttggtttttctcttaggttcacttctgtttttgtttctcttgctccttcaactcactgatgacaggtgctttccaaactgccggcctgatgcagaggtgctgattccccatttgctctgcccttctttaggg

SEQ ID NO: 60623 - DNA, 1069 bp, Homo sapiens
agctgggactataggcgcatgccaccatgcccagctaatttttgtatttttagtatagagagggtttcaccatgttagacaggccccctgagtagctgggactataggtgcatgccaccacgcccagctaatttttgtatttttagtagagacagggtttcaccatgttagacaggctgatttcaaactcctgacctcaggtgatctgcctgccttggcctcccaaagtactggtattacaggtgtgagccacggtgcccagccaaaaatgccttttaaaaggtgcatatgattttcagttccagcttcactgagtattagaatcttttaaagaacgtttcagggtgcccagaccctttgctcttgtaggattcacgcctgcagcctccaggcccagggatggggcaggtgtgctgtgcagttgctgtgggcctcactgtgtcatggtgcactccaccctcattgctgtagcctcgcttgttctttcttcagttgtacaagaggaagactgagactgctagtcagagggattggtattttcttctgttctgaatatagaatcttgggaggttttatggagagaaattaagggcatgtctgtcttttatctatgtttgtatgtaacatggtgtttaatgaatataacccatgtgctaggtgcttcacataaatggattctcataacactctgcgaggtatctgctcttttactgtgtgtgtgtggtgtgtgtgtgtgtgtgtgtcttactctgttaccgaggctggagtgcagtgttgcaattatagctcactgcagccttgatctcctggcctcaagcagttctcccacctcagcctcccaagtagctgggactacaggtacaagcatgtaccaccagctaattttttattctttaaatgttttgtagaaatggggtattgctctgttgcccgggctggtcttgagctcctggcctctagcagtcctcctgctttggcctcgcaaagtggtggcattagaggtgtgaggtacagtgcccagtctgttttccgtgttttgtaatttaataagatgtgagcctcaagacca

SEQ ID NO: 60624 - DNA, 1009 bp, Homo sapiens
tttacctctattcagcaattagattccttacaactcataaactgtatgagaaattgaattccactgtttttgtcactgagaatgctcttgtcctagcagacctgtgtgtgctaaattaaggtctgatctccatcagtcactaagatgtggccaaacataaaggcttttcatagttgttataccccgtaagtgatgaccctgagaaatgagagtgagactgtcaaggtacatcttttgtccttattccctagattagttcttgaaataagccaccagttaagaattttgggatttcctgtgcactggcagtggttgaagggtttaacatgcctgaaaccttgagcacaaatccctcctgcagctgccctgggccatgtcagccggcaccagccatgctgtggcaccagagaataagcctgcacttaatgtcatagcatttcagagaactgtcggagcgtggggctggcccttgggatttagctgctgcttgtatgaagcagttttaaaatattaagcttagaaaagtcccactgagctgggtaaagactttgtgtcctttgggtccctctctatgttttatcagttttcagctgcagggcagatgtctcccctgggctgcagtcttaggcactaagatgtgttgctggcagatttgactctagaagccccaaagggcaggcagggataaatagttttgaattttgtttctagtctcttctgtgttgtattggtttcagagttcagtatccagtcacagtggacagttttgtagtattttgcagcctaaaaaatttatgcaagcagtaaattaaaaatctgaaaaacacacgcatacacatgtgtgcacacgaaggcacatacacatccctccatggagtcttccactcttgtgtgttttgtaattctctttatttttatttgtttacttggagacagggtctcgctctgttgcccagggtagagtgcagtggtgcaatcatagctcagtgcagcctccacctgctgggct

SEQ ID NO: 60625 - DNA, 2148 bp, Homo sapiens
ttcatggtgagtgccctgcatgggcataccatcattcaccctttataccatatgtttgactgtaccttgtctatgtttggatgcacaaatacttaccattgtgttccagttgcctacagtattcaagacaataacacgttgtacaggtttgtagcctaggagcaagaggctatgccatgtagcctaggtgtgtaggaggctctaccctctaggtctgtgtaagtgcactctagcctgatggcacaactatgaaatccctgaatcacacatttctgttttaccttaattaattatggagataaggccttgctgtgtttcccaggccgatctcaaactcctgagctcaaataatcctccttccttggctcccgaagtgctgagattacaggtgtgagtcctgtgcccaagccatgcgtctctcagaatgagtgtgcccctgttaagcgatgcatgtctctgtatgctcatgtcatgcctggcctttactggctacttgtacagtcatctgtcagctgtgacttttggggctataaatccatcaaagttcaggaatctcccaaacttggttcatttaatgcttagcagacgtagctccacagccatatttaaaactgatgatgatggtgtcccttgtttggaggattcatttgtaagtgaccataatgagtttatcctggccattccccagagaacagcaggactcctggttcatctaggatgtgtgaagtgactggccctctgagattgctgggcttccttaaaaatgtcacatacaaggacatagattttcacattgtgtagtattgtttatatcaggggtccccaacccgcagaccactgtgtggtactggtccatggcccattaggagccaggctgcacagcaggaggtgagcagcaggggagggagcattactgactgagctccgccgcctgtcaggtcagcatcggtgttagcggaactgtgtgtgagggatctaggttgcacgccccttttgagaatctaactaatgcctgatgatctgaggcggaggccagatggtttcatcctgaaaccatcctcccaagcccccatttgtggaaaaattgtcttacatgaaactggtccttgttgccaaaaaaaagttgggggccactggtttagatcttgcagtattgtgaagtaatttttggtcttctgagagactccaagcagcacaccagcatgaaaagatgagccattcacggcagctcttggcattggttttaagatgaaatacatcaatattaaaaataactataaaacattcatgaaagtttttggagtttctttgaagaatgtctttgaagctgacttaacattattgcatttattacagttgctctgcagttcaactgggctttataggtttgcatctggggttcacatatgcattttaagacgaggtttgagtctgtttgtataaatcaaatgcagtcctcagactcatgtgcaggccgcatggcgatcccgggatgaagtagatatttctatttataaacagattcctgagtacttcagatattatttgtatgttggactcctgtctagaattggcacatatctacatgtacagagaagaataatgaaatgtcaggggtctcactgcaccctcctctttgatcccattctctgaggttttaatttgggcccaggaagcagcacttaaatatccctactccagctgctagcttcaaacaatacaaagctaggcttccaaatatatttatcatttcttggttgaatatttgcaaaaactgacctaccctacgatttctctcaaataggccttagcaactacaaatatggatgagaagatagaaagggaagctttatgtttgcttgcattttagctaaaagataattagaagtgcaatttaagttatgataatggaaaaaaagagctacacgttaagtgtggtgcattgactgcatcgagaaaaggtgcagtctaaagcccagcaaagcttaaaagagaaaaactagaaaaaaagaactttttggaatataaactgtgacagattttttgtattttctgtgggcttgaaaagtccttaacgttttcgttgttactgccctggtactatttatgtgttagaatacagaacaactttaaatttgtggagtctta

SEQ ID NO: 60626 - DNA, 1082 bp, Homo sapiens
atatcacggcagagtgtctgcgggagagtgacttgggaggagctgtaggatggaagatcttgaaagctccacattagaggtgaacttggagcatcttgtgattgcagggcaaatgggttgtgggaaatggagaagtaagaagtagattgtgattggtttttgtgttcaatgtgatataacttagcaatgcaggagtttttgtggaacctggaactctatttttgtttttcatctgttgaacttgtgccattctgtagagagttatagatatttttccatagaaaggcaggcagtgcagcttggattctagagcagagagtttggattctgttggcttgagttcgaagttcagccctgctgtttattggctgtgtgaccttgggcaagttacttaaccttttagcacgtctgtaaaatcatgataacaattgtaccgattgcatgggatgttgtgatggtgaaaacattgttatatgatatcaccttatacatgttagctattattcttgccatttttttgtatttgcaaattctttcccaggagccagtagtggaataatgtttacagtagttctttgaacttttttttttttttttacagttttactggcaccaaatgtgtttatctacacctagtccccattagaaccatgcaattacattcatgtttgtataaaggttgtcagtttaatattcaagcaattaataaagacaaggtgtgagtttttctgttaatgcacctctgtcttaatgtgaagcaacgtataagcatgcatcttaccataattggtgtgcatgtctgtgtacatgggcacaaacatttctctttcagccctgtaatcacatctccaagtaatctaagtcaaaaagagcaaaatctaagccagtggacatgctgaggctatctcagggtcttctggaatgatcaaggccagaaatcccatcttcatatacattttttttttttttttttggagtcgaggtcttgctatgttgcccaggctagagtgcggtggctattcacaggtgcgaacatagctcactgcatccttgagctcctgggctcaagtgatcctcctgcc

SEQ ID NO: 60627 - DNA, 1035 bp, Homo sapiens
aaatgcatgcgcggaagcaaaaagtacctaccattgaaggcccttgggtttgtgttttataacctagatggcctggcttagtaaaacaggttctaactaggtacctaacttgcactacaggaagaagagaagtaaggctttactgagtcaggtggtatgaattagaaattaatagtattatcctgagtggagcttggtggctttttcagtggagtcattttcaccatccttttacattaaaaatgtaaattgattcacagtggggggaaaataaaaagtgatctagatgtgtaccttaaggaaaagaattcatacacctttattcatgtatgctattatgtcttcatttacatgttattatgtatcatctagcattatcctatgaaccattaagaaatggcctctgggtgctacaatgtgagtggcacttcctttaaaataccccagccaaaaataaaaaaagtgaagcaatgaaacagttttggcgaagattaataattactacagctgagtgagtgatacataggagttcaataaattatcctctctacttttttgcaagtgtggcaaattagatcattaaaaaaactaaaaagtttttgtaattaacatttttaaatgttgggaacaaaacccttagaaataattttattcttgctctgttatttagtggaggaaactcagggcagatgacatgtgttggtttgtcctgtgtgtcaaggctccttggaggcagagcctcttgggaggtgcaggtttcctggttcctcactttgtgctgggtgtgcctttcaggatctgattcctgagggtgtgtaccaagccagtactgtgtgtgcgcttgcattgccttactcttcactaagaacatggaatttgtaggtaaattctaagcagtgaaattgtagaaactaaaacactttgaaaataatatatataaatttagcatgtcttctgtgacatgcacaattataaatgctgtacttattttaacacacgtggtgaactctgtgaatgggctctggtgttttgtcc

SEQ ID NO: 60628 - DNA, 1048 bp, Homo sapiens
gagcctgaggcaggagaatcgcttgaacccgggagacggaggttgcagtgagccgagattgtgccactgcactccagcctgggcaacagagagaaactttgcctcaaaaaaaaaaaaaaaaaaaaaaaaaatcaagagcgtgcaggtggtagaagaaaacagctgtattgaggctgtagtgttacagctctgtggctgctcccgcagagcagggctacccgctaggcagtgagcgcagggtggcagctcaggggcagttctacagtcatgtttatacccacttttaattaatgcaaattaaggggcaggttattctgatctttctagaaaaaggtggtaactttcaggtgttgctgtggcagtgttaaactgtcgagctggtggggatgtcttgtggagaggtgctttttatacagtcgttctttgtacaatagacagtgctacttcttgttaacgaagaaatacagatataaccaggataattttgagtacagaactgttcatcaaaaaatattaaaacatacctatgttctggctaagtgctgtgttagaaaactacttgctaagaatatgtaacaagttgggaattagaactctcctcctgtttgtttgtttttttttttttgatgcagactctcgctctgtcttccatgctggagtgcagtggcacgatcttggctcactgcagcctctccctcccgggttcaagtgagtcttcagcctcccacatagctgggatcacaggcatgcttcactatgcctggctaatttttgtatttttagtagagatggggtttcaccatgttgcccagactggtctcaatttcctgtctgtctgtctgtctcgatatcttttcttctctgtctcttgtttgtagtagagagaataactttgattcctaaatagaaaacagaatatatatgtgtggatacttgtattgtgttgattgtcttcattactagtttcctaatcgtagcagaaaaggtggtgttggctactaatgtcaccccagccctaaaggagtaatgtgttcttgataagtttgtg

SEQ ID NO: 60629 - DNA, 1001 bp, Homo sapiens
tggaataaattaaaacctagtttcaatattgaatcaaagctaagtggcctccctctccctctcaaaggttaataagtttttcaaaccagagtgcgtgaataatttaaaagatagcatatggaataatttcctttgcaagaaaatcagactaatatttttaggtaattcagtttactaagcacctagtttgtaccaggcattgggcttagtgctactatactctgtgtgtgtgtgtgtgtgtgtgtgtgtgtgtgtatgtgtgtgtatatatatacatgtatatatatgtgtgtgtgtatatatgtgtgtgtgtgtgtgtgtgtgtgtgtgtgtgtgtgtgtgtgtgtgtgtgtgtatgtatcatcaagccaaagtcttatagacatgtaactgaaagaccagcaggtgttaagtgatcaggtttacatttgagaaatatccccctggtggctgtgtgaagaatgaatgaggaggcagcatggaaggcagaggccagtcagcaggttttctggaaccaggattcgaatgcaggcagtgtgtggctcctgccagttttgtggaaggaggttgaaattgatggcgattgggctgggtggagatggtggggcattcaccaaggtagggactgctgcgaggttgccagactagggatgggagattacattcagtgttgtcttctgtgagtttgagtgtcttggagctgttagttcggcagctggatatttgggactaaccgtagataaatctgtgaatccaatataaatctgtgaaaagtcagtttaaaacaatgtaccaaatataatctaactttagtgcaataattatatacattagaaaaagtttgaggggtagaccaaaaagtgtcagtactggtcatctctgaggacagtgtgtgtggttcactgttttgttttcgttttcactgtccactccatattctacttctgcttaattccagtaggaaagaagcattaggtttagttataaatatagcttagaat

SEQ ID NO: 60630 - DNA, 1031 bp, Homo sapiens
acaattctatgagtaagggactcttgttactcacatttctcagatgagggaaacgggcagagagaggttaagtcatttgctccagctatgtccagtcttcactgttaattcctaggctccattgcttgtactgaatgagctgatgcttccttcatatttgtaactaatcagctcactgagcggattttagaagctctagcatttctactgctccagcatttgctccgcagttacgttgttgtcacttgggctacagcatccagtagactgatgttcagggctctcctgcagactgctgctgcccgtggtagcacagcccagctgacttgacctatccccagagctcttcttcacctctacacccctgcctttgtcctgagttaataatataacataacagtaaaaacaaaaatattttgtggtcagttttctagttactgggtttaatgacaactagccagtttagcttatatatattcactatagtatttcctttagttctatgtgctatgtttactgtgatcatagtaaaattattttaaatacttgattgggattagaacagggcagcctcttatatataacttaatttttttactagcaagtttagaaatttaccagcaagtttataattttttctagccaatgtatgagcttataaacaaaacaaaaaactctttagttatgtaagagaactgaagggaaattacagtgctatcttcaccactgcaagagggtaggtgcttgtataagcttttaaaaatgggcatgacttgcaaggctattttagttgcatggagaaagccatagatcacaatgcagtttccaaccatactgcattgacttaaaaaaaaataccctgagagataaataattaaacaatatgggatgcatttcatagaatcttcaggattacatgcttattttctcacgaacactgagtttatttgaattttggattatgtatatactgtccctgtgctccatacgaagtttccattaagaatgtgttcttgctttaatgatgtgca

SEQ ID NO: 60631 - DNA, 1428 bp, Homo sapiens
ttagctgtacttttgttaatgtgactgttttgtagtttaatgttttcagaagattgcgtttctttttttttcttacctttcaataagcgttctcaggttgaaagagtgcatatctcaatgatggtatgtaatgttttcatcgaatagccctttggcagccggccttttaaagttagagacagggaaaacaccctgctgtcatatatttttcaagaaaagattaatagctgtgattcattctgcaaatagctattctttttgagagttagtcttgcaaaatttcttcccttccttttattgttgtcctatcaattctgagaaactgagaaaaatgagccttgggattatttctcattatacttgtctcactgaatttagtgggcttatttcttcactcctctcttgtaaatatttgcagactcattacagcatttgcctttcctgtgatttaaattaaaaataaagattttggtaagctgtatgtggcatgatgaaaaaactaggagactgtggaagaaggaattaggagatgggaatgttggatattgctattcaactactatttgattgtgaaaaaaattacttcttgatttttgaacttcaacttttctcaattgttggtgacctctagagtctttgcaatccctttaagttctgtgattttaatggcaaataagtacttttattttacgacctcaaaagtgtggtcattttatgagaaactttataggacatgtagctataggtttttgtgttgctttcagacaaacttggaatgatagttcaggtaatgtgctaatcactacaaatttgtctagtcagcgctagagcagcaagtgtaacttttatagctgtccatgtcagtggattgtgtaaagactaataagacttgaaaagactaagaggtagtgaacagctctccaaatgagttgattgaagtctgtaggcaactgagggtctcatatcagaatacattttctttgcatacattttatgccatgcaagttgaaactcaggcctgctctgtagaagaattcctaaaagaagatgtcttaattttatattttgactttttttctgatttggaagatcattataaaggtgagagaaaacagcgtaaaaaaattgctcatagcgtattcaacagatgattataatgatgacttaatcaagtatgcacaaatatctttatcatatggaaaccctgcccgtagaagtttgtagctgtgaaattcttaagtttggggcacaatgttgtgtacttacactaatagagctatataaccgggtcaaattgtgggttggtttaagaatttcacaagagaaatgaatagttgtggttctttccttgtgtgtatgcgctcattaaggctgctggaatcctcacagcgtctactcgctttgcaggacctaatggagtacgttttt

SEQ ID NO: 60632 - DNA, 1416 bp, Homo sapiens
aatcttcatgtgaaatggaacaatgacttcaagttcagatacccatcactggcagtgctgtatgtacaatctatcaaggctagttaggatgtctttgtggctcgagaaagcagatttttagatacgggagagtttggttacttgtgtttgtgattctgtgctctctattaattggcatgggattttcggacctgaaatttagtgtagatttcagtttattctgaaagataagtgtgaggttgagatgtggtcttctgtgtgacaggtgctgatttatgttggagtcctattaggatagatgcgtcccacattcagttgtatgtttcttaggtcaatcaaagaaactgatctgaaggtgtaccaccaccttctctcccaagatgacaaagctgtgttgggtcattggttgggagcagtgcagatgagaagacaaatgctgttgacaagttgtgtgtctagttccttaggaaaccagtcacctggtgttgaagacagcagcagaggagtaccgtggcctagcatggagctctgccatgcctttggttctttctgtggacacattttcatggaacctagagattttctggtttggggaaggatacaatggaaaaataattatgagatgatgatgataagatttaattgaatatttgctaagtccagtgcatactattaggccttcaacatatgaatttataatccaatgaattagatattacgttcctttcttacaaaaggacattgaggcttggcgatattaataaatggctgagtggtacttggcacccaagaccgtgtgactccgaagctcctgctttcagtgaaggagcctgtggtaggaacatagggtctgcagtttcagatgttgtggcctgctgtgccttgttggtgattgtagattcttcacgatcaatatggagaaggctgcctgcattgtctcccttcttcttttgaaaaattagtttttacagataattgcaaacaatgcaaaattaaggaatgcaatctctttttgacgttttactccctagtagtgactggtattaaaaagcctccacgcagtacaggatgtgggtagatcaaccctggattggttggttgggatgtgattcattagatcatctatgagattctctgttttttaggtcagagtaattgccattgatcttatgatgcagttctgcttccaggacacttaatgaacacggaaactgaaaagtaaagaacttggcctgtagggtctgtgagacgggaccacccctgggagccgtgttgtgtagaggccatccagccaaggactgcaaacgtggagatctgttgtggcagtggattggattaatctctattaatcagtctattaatctgttgatctctagctgaacaatctcttttgttgaattgttgcattatgatatt

SEQ ID NO: 60633 - DNA, 1011 bp, Homo sapiens
tctcgatctcctgacctcgtgatctgcgtgccttgacctcccaaagtgctgggattacaggcgtgagccaccgcgcctggccgtttcttaattattttctaagaattactgtgccatttcctttacatagtatggactatagtggcgtgatcatggctcagggctcactgcagcattgaactcctgaaatcacttgtaatcccaaagtgctgggattacaggcatgagccactgtgcccagctacaattttttaagcaatagaaggcctgtccacattgccgagtcttcctttggtgatggttcatctgaggattgcatgcccaaagccctggagtgggaggcttagattcttatcctagcctttcctccaacagtcgacaccccagagcgtgtgtattcatttctttcttccctttcttctctctctctctttccctctctctttctctctctttccctctctctttccctccctcccttcctccctctctttccttcctttccttccttttacttcctttcttttctatcttttgtagatatagggtctttctctgtcatccaagctggagtgtggtggcatgatcatagtacactgcatcctccaactcttgggctctagagattctcctacctcagcctccgaatatctgggactacaggctcatgctaccaagcctggttgatttttaacattttttgtagaaacgagatcttgctttgttgcccaagctggtcgcaaactcctggcctcaagtgatcctcctgccttggcctcccaaagcactgacattacaggtgtgagccactacaaccagccttgtttttcttatttgtaaaacgatgaggttggttgctaggttattgctgttgatttttctggggtcaggccagagactgggttcctgggagaccacagggtccaaggggtggtcgaggatgcagagggtcctagttgcccgagctcctgggtgtgcacccacttccttcagtccactgcagctctttgg

SEQ ID NO: 60634 - DNA, 1052 bp, Homo sapiens
aactgttgggattacaggtgtgagccaccatgcctgactgatttgttccttttggtggtcaatcttggttcagtagtatataaatttagagtgctgctgtattttgagcagctgctctgtcatatgagcttgaaatattgggttctatgctgcttctatgttgtgtaagtctccaaactgaaaggatttgtgactttaaaaaatgcccacttttgctcatattttttgtttcctttatttgtttggcacttgttttcacagcggtgacttcagagcacaattactgagaaaccttgagtgttgatgtaaatcctccactgggttctactattacatacatcttcgtaactaggtaaacttccaggagtcactgaaatttggtatctgtaaatgaaaaattatatcaaatacagataccagtgaaattgctagatttcattgatgatttcagttcagtattctaaagtctggatgtcacttagtacttggcaggattgcaaagcaatgacatatgtgcatgcaggtagttttaattcaagccaattgtgagaaggatgttttattggtataagatcagtgtagtgttgagttggttgtggttttcaattgctgcttttgttttggttttaaattataaattagttcatttgtctttatcatcagtttacagttgcattgtgtcatgtgcatttaacttatactaattcaagtctcaatgtttgcttaaaaataattaacaatatgtatttttttcatgcaacatctccttaaatacaggccagatgcgtttcttctggtattcaaccatagaaacagcaatcccttccaatgctgcaggaaaattggcagggttaggctttgtgaaaggtaatgcagcactcagaaaaccacatgtgcttactgtgtgtgctatttaagtaattttcaaggataattttgtcttaaccttagccttgattttagaagccaagccttgcctaaaaggtgactccgtgcagtttgtggagagttctttggccagatctataggatgtagtgctgtgtttttagca

SEQ ID NO: 60635 - DNA, 1031 bp, Homo sapiens
acagttctgtttgtctaaaacgttcaagaacatttccactgccctctgcatgtttgtgatttttgggccattcagttcagtctggattatccgatagagcacagtgttctgtcattggttcaggcatttggctgtcttaccccacagaactgtgtgttctaggtcgggggcaatattttatatcttttacactctgtgtatagtgctgagcatgttacagttggaaactgttaattaatttttgttctattttcctgcactcaacttttcctcccagaggccccacctgaatttaagaacaaataagttattataaagtcttgtaggaaaaggcctggtatatttagagaatcagatccagctgtcacctaccattcatacagaaccatactaaccttttcctaaaagtaccatcaggctgttggttttgtaagttttctttcgttcattttccttttaaaccaagcctcatctgtgaaaggaggctgaaatctggcagacctctttattatgctctatttgtccacatgtggaaaccaccagaaaccagtaaaaaagaatgggaagtgaccaaagagcagacagaaaataccagttgccctagggagcacccagctcttccaaggactgcatgggtcctggtcagaggggcaagtgaaataccgcagctgcctcctgcagaggggtatctcttttacttgtgagcagcgtctgcagctgtgcaggctctcagcagtgcttagtgtcagccatgtcccttgatttatgctcgtgtgagcctctgcacatgtgggtgctccagcaggctagaggggggaggggtgccccaggtccccagaggcacagagctttttttggataccgagcctgagctgagaagcgtgggatgcaagagtgatgtcctgctccaagttcaaggaaagtacaaagtaagcggaaatgcatcccttcaaatagaggaaatcccaagttgcttttatgtttcccgttatagctgtgtgaagtcatatcttgaggtttagctttcacgt

SEQ ID NO: 60636 - DNA, 1081 bp, Homo sapiens
acagagtacttaaatagaaacattaattggatcagtgtgtggatctcatggagatctgtccctgtcatacgctggcaggcacattccatttctttctaatccccagatgtaataagatgcctgggtctgtggttacttgcatttgccattcataaaattgctgatcagtcctcccaggtggcactgttgtttataaggctgttcaaaatgtcagtggacttctgccatccctaagagcctccttgttatttctcttatggggcctaactgctgtaaaatatgtattttaacatctagtgggatatatttctttgtttctttgggctattccttcatcatctgttgaccacttttagtcaatagttatgggtcaaagctttggccagaacacaaaatacttgataggaagagtcattgtgagaataaataacatgtagtggaaactctgacattgggatgggacattgagtgggctcatctgctgagaatatttgcaagatggagcttccacagagcctcatgggcaaagcctaaagagatgagttagctgggtgagagggaaaaagtaagttgtcagagttctgtatttcatatgtgatttcgtttgtatgtctgcctctgtctgttgacattacgtcactgattattggctttaccacacacatgagtgaagaagaggaagatgcgcagggtggggagaaatgcagggaagacactgttccttttttttgagacagggtcttactctgtcacccaggagatgacacgtaactacatcaactggtcctacattttcaggcgaacatacaaagtgcttctttgaactagggttctgtataaaatagtttgaagagcaatgtatagtattaatttttttttcttctctggaatgttacgtggagtgaaattcaaaagtttcctaatgtctagataaatttctctctgtccacacggtccgcccatgtcttataagaccttcacatgagcctgtcccatttgtgccttataaatgcacattagtgatgtgatctctgctcactgcagctttgaaatcctgggctcaggcaatcctcccacctca

SEQ ID NO: 60637 - DNA, 1944 bp, Homo sapiens
tcagggcagtgtagaatgttacacagtgatagtttatgtctagccaggttttgaatgctcttactggaaacagtcatatttcctattatctaactgaatagagaagtaagcagttgagaatacagttgggctgcacttgtctttttttccaagtgagttattttgtattttttgatactctgaaatgatcagtaagtgtgtgtgtctgtgtgtgagcccatgtgcgtgccacgcatgcgcttccctgtgcatgcgtgtaggaggctgggatggaagggatggccataactgactgttggaatttccaggaaaggcttggaatttatttttgggtcacaggccatttttttggtttctttcaagcactaaatgatttttttatgtaacttcacagattaaagaaatgcagtcagtttttgtatgacttagtaaatcttaaggaaaaaaccctacttacattaggatacatttgctggaatatttacacaaatcttacaataaaacttttcatcttttaaaattttttatcaactcagccataacttatttattttttgcttcattttaaagagaatactcattctttttttcctctttcctggtacttcagcttctcatttgcttgcagcctctgcattgcatggatgctggtttttcagcagttctggccctaacagaagcatcctaaggataggaggatttcagtctgggcttgctagccttatcagggggagagcagagttgctaagtttccattctctgtcactttcagttactctgctgtggctgctcagtgctgttcccagtgaaataattttagcatattttttcctcttgtttctgcatcagcgtcattactgttcatgcctccctggggatcagactgattggtaaattagtgccagcagaggaagtagaagacaatgtgtgagcgtgttttatttaaacacatacactctacaatttgttttattggattttgtcctttgagaacaccacaagtaatcccattacagtctagaaactgcttgctcaccacgcctccacctttgaaagcacataagtctttaataaatgaggcaatttccagattcatcaataattaacccagaacatgacaagttttatcacaactcaaagctttcccatgattcaaacggtctgctcctgccactgaattgtctgtatagtttctggttcagcttcccagagctcaggattctgccatggagacactggtttgagcaagcatactggatgttttcttgaaaaatgttaagctttaattgtttataataaaataaattcatacttattgtaggaaatgtggccagcacagatgattttaaagaagatagtaaacacccatattcttaccacccagaataatctacaaaagagcatttctttcatttctttgcattctttctgtttgtttgtgtatatataaatacaaatgcttatttttttgggggggcgggtggtaacaggatcttgctctgttgcccaggttagagtgcagtggtgctatcagagctcatggtggacttgacctcctgggctccagtgatcctcttgcctcagcctactgagtagctggaactacagacacatgtcatcatgcctggctaactttttgtatttttttttttgtagagacagggtctcagcatgctgcccaggctgatcttgaactcctggcctcagacgatcctcctgtcttggccagccaaagtgtttcgattacaggtgtgagtcatggcacctgaccaaatgcttttaaaaatattgataattgaaatcataatgcatacacagttgttcctagttactttacttaatttatcggtgtcttcccatgtctcgcaaaaattttggtaatttttttcctttttgagacaaagtctctgtcgcccaggctggagtgctgcggcacaattcttc

SEQ ID NO: 60638 - DNA, 1162 bp, Homo sapiens
catctttgtagggtgtcatggagattaagttattcactgtagacaatgcccctttcatgtaatagattctgtcagtattagatctttttctttctcttcaagtttcaaacatagattaggcaaaattttaatggctatttcacaaaatcagcttgattcttgtttatgacatcaagtgttgtttttccaggttgtctgttaaagggctacttttttttttttctaaaagtgctttagaaattccagtgttagtatgtatgcatcatttagctaagaatgaagatataaagatcacccaacagtttaagctgattcttttacaggtcaaggagaattgtgtttgtctagctgtcttagccgtgtaggactttctacttgttacttcctaaataattgcagccgcaacactgctacttcaaaggaaattacataaattttatttgctgtatttaaagtacattaaaaggcatcacttacacatttttcattaaaaatacttttaaaacttggaaaggataaaagtataaaatgtaaatactgtctgtattaataaaatgcagagatgttttaaaggcctttagtgtttattaactagtaatagttctgagaataccctggagctcaaatagataatctgtgttataaaataaatgggaaagttgacatttttgtgacttttctaatccttactatataggcctctataattcatgtgcccataacacttcttaagatgtgattttgggcatcttaagatggtgatttcgggcagctaaatcagcaacaaaggaacacagaacatcttttgcttaggtaggtagttgtaagggttgacagattgatgcaacttttaatactttagtttggctaaaggcacccagtgcaaatcacctgaagacttcacccaggagttgacctatttatcatactaaatagggagtggcgtcttgaaggctcattcacattctgggcttggcaggcagtgcgatgaagtcagacttgcagttatcaacaccctggctttgtattcaagaggactacctcctctcatccgtctttttcataccacagtattgaaggggttgttttcctctttgaagaccttaaacatctcattaattaaagtaatgcttcttccctctccccatatgcatttagggaa

SEQ ID NO: 60639 - DNA, 1043 bp, Homo sapiens
cagacactgtaagatttaaggttttggaactcagatgtatatttttctagtgtctggtttttcccttcttgtatttgagacggagtctcactttgttgcccaggctgcagtgcagtggcagagtctcggctcactgcaacctctgcctcctgggttcaagcgattctcctgtctcagccttccgagtagctgagattacaggcgcctgccaccacacctggctaattttttgtatttttagtacagacagggtttcacaatgttggccaggctggtcttgaactcctgacctcatgatccgcccgcctcagccttgcaaagtgctgggattacaggcgtgagccaccgcgcccagcctttccctttttgttgattgtaccgcatccctttagattagaaaactaatctatgttatagggtttatatatttcaaaaagcctctttgagatagactacactaaaaatcagtgtttccttcttcaacacttaagaaatcaacttgatattatgtctcaaaaacctaaaattgctaaccaatcaaaagatgtgtattaatattaaaaacacaaagaaaggagtgttgtttttgtgttggtggtatatatgagactagatttttttgttcaatttcttttacatagacaatacaaattggaaaaaagtttttatgtctgtgttttaattttcttctctaagtccaatgttaagtccaaaattaaaaaataaactctttagaagtctgagggacaaaggaaaaaagaaaactcttccaggaaacgtattttcttataccacaaaggcatttaacatgtgtcatttataatgctgaaacccagtgtgcaaaaccatatgtgaataatggttagccagattcctgcccagcagggttatactctaaacttggatttcttttattacagacagcagcacctgcagaagaaggaggtaaaatgtgcaggatattggttcctgatgtactacaacacaggatgtgactaatcactaaattcattaatgttgaacataggatttggtacctttac

SEQ ID NO: 60640 - DNA, 1052 bp, Homo sapiens
aatgacatatatatgtgtatcagagatgctcaaaacacttcaaatgaaaactggctgtctttaggagttttccatatagtgtggaatccctgctttctcaggcctgtccaatgtgtcctgtttagtgtctggtaagctcctggctgctgagcctccaggtcccctggtctctgtgtgctaccccctaccccctctaagggcttcaccaattgttctttagccagagactccttctacccagctcgccagctacctttgtgcagtggaggttgagaatgccccaaggatgcacgtaatggaccagcctttccagcatttggctttggctcccagaaattttgagctttggcaaatcttacaagctctgtgagcctctgtttccccatgttctcatattcagaggtgctgggctggactcccactgccagttccctgagctgtgcagggactcctgctctgcatggtttgttttggtgctcatgggaccataagtgatgtgcagtggcttttcagatggttatacagggtccaggacctcttactgcttccctccatgctgtgagaatattttgcctcaccccgacccccccaactttgaaatgacggggcttgctctccaggtcaaatggatgctattcagagttagggtaaattttgcttagggttggctgggtgagaaggctcacgcctgtaatcccagagctttgggaagctgaggtgggaggattgcttgaggccaggagttcaagacccagcctgggcaacatagtgagaccccgtctctttttaaaaaaattagccaggcataggccgggtgtggtggctcacgcctgtaatcccagtactttgggaggccgaggtgggtggatcacgaggtcaggagttcgagcctggccaaagtagtgaaaccccatctctacttaaagtacaaaaaatagctgggcatggtggtgcacacctataatcacagctacttgggaggctgaggcaagagaatcacttgaatcctgggaggcagaggttgcagtgagccaagatagcgacactgcact

SEQ ID NO: 60641 - DNA, 1075 bp, Homo sapiens
gtcaggatcaaactgaggaggacagaatgccagggcaagaccctgagacttcgtgcagtaggaaggactgtggtgtttagctaagagtcagggtaacaagtagttctaggaggatgacctgagcaaccttagatgaggtttggatggataattccttagcatttcattctaaataaaggttgctgagtgaccaaaaggggaaggagagagtgaagggcaaaagtgagggcaaggaggtgctggagcccctttgctcactgttcccacctccctcatagctctcctctcagcctgtaggggagctttggattgggtttggtgacttaggtttacaagccatttaaccttgggtataggggagctttgtattgggtttggtgacttaggtttacaggccatttaaccttgggtacaccaaccctacggagccccattatctcaagtggaatattccctggcagggttaatgtaagtattaaacaggatgatgagagggaaactctaaagtcctgggcccggcccatactagctgctccgtaaagatgaatggaatcaccaatatgttttatccaccaagcagttttacacccagggaactttcccaggtgtcccactattgctgcttggatttttcctgtttacttaaaaacgcagcatgtaatttcattgaaggataggtaagaatgtgagattgaatgacgtgcagcaccacaatcaggagaacaaaattgtgtgttgcatgtgtgtatgggctggggaagtaaaagctgcgggtattggcttgattacaggttgattattggggcctctggcttctgtccccaagcacatcactttagagtgatttaatagcaacctgttgttattacaggttgagcatcctttatccaaaatacttgggaccacacaagtattttggatttttctggactttgggatatttttgtatatataatgagataggttgaagatggaacccaagtctaatgtattgttagaatttatgtttcctacgtaccttatacacatagcctgaaggtaattttatgcagtatttttgtgcttgaaaataagt

SEQ ID NO: 60642 - DNA, 1052 bp, Homo sapiens
atgtcccctgctggtaggggccggcaggggcggcccgtcgcgtccgggggctgcagggtttggggagtcgccggcttggggtcggggaggcgttcccgggagggccaccgctggcacttggcactcgcttgcgagcatttactgagctgatcccacttgctgggctctggaaagcacaaccttggaagagtcgcggaatgaaaagttttcctgcgaggacctcagctcctacctatcccgggctggttccatgtggctgggctgcggggccgggcctgacttgggagttgagtggatttccctttttcctggtggactgataacattgtctccacttcacagcattcctctactgtgtgtcagaagtgaaaaggcgttttgttaaattgttttaccgactgtgtctgtgtttgacaacagcccacgctgaagtttctcccaagcacccggggatatatttcctttgtagtagagtcctctttggtggggagcgcattcgtttgggtgcagtatttcccatttgttcccgacagtggcctggcccctgtgggcttgggggctgcaaatgacgttggaaagtggcttggtcagccctattgagcgtacacagggtactccggtggcatcttcagttctctcagaaattaagaagtaaaagctttttagacttttgttttgcttttagtatatattggaaaaaatagcataaatttggccttttaaagataattttgggggacgtttggagacccgacacaaggatggaagacgttggctttagtagctctgttatgttccttacagttgaactcttttattgaaaatcaaataaaattagtgggaattgggcacctgtttatcttgcaaagctgacaaagggaaagaaaaccatctaaatggacatttagcatttttaagtgttgtttatgtgtgacagtttatgctttaaatgttccaaaagagtactcaaattgttcaggcactctggaaaccaacaaaacaaattgtgcaaggaaagagaaataaagtaatatgcactctgcagtacgtct

SEQ ID NO: 60643 - DNA, 1056 bp, Homo sapiens
cgggttcacgccattctcctgcctcagccccccgagtgattgggactacaggcgcccgccaccacgcccggctaattttttgtatttttagtagagacagggtttcacggtgttggccaggatggtctcgatctgctgatctcatgatccgcccacctcggcctcccaaagtgctgggattacaggcgtgagccaccgcgccctttccacattttcacatttttaaatagagccacagaagtgtcattcacgttttaagcagttaagttggtaaagatcctgtctccattttgtaagagatggattacattcaattactactcacaacagccaactggaaggttattccattgcttttgaaagattattccattgcttttgaagtactggttgggctggcatctgcgatggtagccaaataaatgagatttctgtgtaacacaagctggcactggacgcactcgttcgctccgcccttgttctgatactccacgatacagcggatcagttggtcattctcctcaaggagccgctggatagtctcttgattgacttccaccttgcccctcagccagtccactgacatcccgaggaagctccggaaccacagaccaccaagcatctcgttgttgaggatttttgcatctatgttcatgagagatatttatctgttgttttctcataaataaatgtctttgtctagttttggcattaaggtatactggcctcaggatgaattgggaagtattccctttgcttctatcttctaaaagagattatagaaaatcagtgtaatttccactttaaatgttttgttgaattcacctctaaacccatctgagcttggtgctttgtgtttggaaagttaccaattattgattcaattttaaaaataaatataggcctatttggattatctatttcttcttgtatgagttttggcagattgtgtcttttaaggaattggtccgttgcatgaaggttatcaaatttatgggcatagagttgttcatagcatttcattattatcctttaatgtccatgaaatatgaaata

SEQ ID NO: 60644 - DNA, 1047 bp, Homo sapiens
tttccacattgtagttcctattttcatacttaatttggcccatttgttgaaacctcagtacatttgaggcactttaaactgattggttaaaagtcattacttaatagctgaagaactggcagtagtttgacttccacatctcttccacaggtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttattaaaagaatgagtgaagtattgctgaaaagtggaaattcggttgggtaccatgctttttctccccttcacgtttgcagttgatgtgtctttttttttttttttaatgtatcttaaaggacataaaatttaaaaacttaaatattgtaatatgacagataacctaataattgtatctacattaaaatgacaaacatgatactgctgcttgtcaaataaaaaaaaaataaagaaatagaatgccttttttatgtggatggagtatcaggttgaccacaaaatatattgactcaaagcagctaatgcatctttagttgcgtttttatctgaatggtttaattcacttgtactcctatttaaatcctacatgaaaaatgtctagattattgttcttgactgcataggactgcattcagcataaagaatgctttatttttatggattagatatattggatctaaacattttgaatcttgaagatgtaattccatcagcagtttctggtggtgtgctactccacagacatcgcagagtgtgagcaggatgcttgg

SEQ ID NO: 60645 - DNA, 1680 bp, Homo sapiens
gatccgcccgcctcagcctgccaaagtgctgggattacaggtgtgaaccaccgcgcctggcctacagctcatttctttcaaagaaaatttgtcagtagaaaatgcttcttaaactttcatatgcaaatgagccacctgggcatcttgttcaaatgcagattgtgatctagtgggtgtggagtgaggtactgacaggccagtgtgaggaggggacttctgctcttcattattttaactcagcagtgattgttgctttggtctgggatagactgtttctatcacttatgcttcctgattgcctccggtgtgcagtccttgggctgatgcaggatgtgaagataatataagatgttagaccctctccagaaacttaattcccgatggggggagacaaatattaactgccatttactttgaaacctaaaatggtcaagattccattttcctccaggctaataaataataatttgcaatatatagattgtattttgtctttgaaacgctgtgaggagatcctcttaatgtggcatggtctgcttctatgccttgcttctgtgtttcttgagctccgtggagataggccccctctcctggcttctctgcttgagccacataaaatgccacttcacagctcttccctttgaagcctgatccagtatgcatttggagctaattactgcagttgacacaactccatctaaaagcgtcatgaaagattctgtaatcactgataagaaaatgatcttgcaaattattgctgtgtcctcctttattgcctctttaccttaacagtacagtttacaataatgtaaatttttttctaatctttcaactttaaccctagaaattgtagatgttttagcagtggttatgtgatattggcacaacataactatataatttgctcaatattgtggtgcatacctgtaatcccagctgctcaggagtctgaggcatgagaatcacatgaacccaggagatggaggttgcggtgagctgagagcgagtcactgaactccagccaggacgacagagtgaaaccctgtctcaaaaaaaaaaaaaaaaaagtatttgcactcactgataaaatgaattgaaaacaagttcagtgacttaatgtcttgttgggtcttttttcttttcttctgtaaaacaggaaatggagcagactagaagtgcagttgatgaggaccggaaaatgtatctccaagctgctatagttcgtatcatgaaagcacgaaaagtgcttcggcacaatgcccttattcaagaggtaaaaggagggcagtcctcagggcttcttagggtagagggcattgtcattgtacagattcagtctctttcttcttaaagaggatacagaaataacctgatcctcagatagcataaagaaatgtttcatacttaatcagaatcgtactcactcacaatttcagtattaaattcagatttgcaggctgggcacagtggctcatgcctgtaatcctttttgttgttgttgttgagacagagtcttgctctgtcgcccaggctggagtacagtggcgtgatcttggctcactgcaacctctgcctcccaggttcaagtgagtctcctgcctcagcctcccgagtagttgggaatacaggcgtgcaccaccatacttggctaatttttgtatttttcgtagagacagggtt

SEQ ID NO: 60646 - DNA, 1020 bp, Homo sapiens
ttttgttactgcggcatttgtaaaaaaaaatgtggttgctttttcaaaatggggtgatggaaaagttacgcactttggtgtttcataaaaattaaaatgtcaaactctaggcaatgagcttgactcttattttatcaaaaagtagtgtatatagaatagtaggaccagaaaatagcttattcccaaacataaactgcttaagattctggcagatgtaaaagtagaaaataattgggttttttcctgtttgtttgaacaaaagaattatttttctcttaaatttggtaatctataatataaaagttatgagagtggaggcttttttgcttggtcattaatttagcagaattgcttgcagcaaactcttatttaaagattttggtttttataaatataaatgttttatttttaaatgtaggaagatattgatgcagaatcttcgttttcattaaatatgaactttagcagtaaaagaacaaaatttaaaattactacatcaatgcagaaagacacaccacaagtaagtgcttttaatgtcaagttttttttgagggggaaacatttaagcattggactttacaagtgtttacattgagattgtgcaaaactttgcacagcaaaattaataatgggatatgtcttttctggtttgttgttggcatttattaaccttacagtcaaacagaaatctctacttgtattttagttttttctaaggaaaagggtatggttttgttgtatttgctcttaaaccattagaatgtgtaactatgcattctctccgaaaattcccacattgagaagtaataaaatttcatatttttcatttgtaaaataagggaaagttctccagttcatttttttttttttttttgagacggagtcttgctctctcgcccaggctggagtgcagtggtgtgatctcggctcactgcaagctctgcctcccgggttcacgccattctcctgcctcagcctcctgagtagctgggactacaggcgcccaccactatgcctggc

SEQ ID NO: 60647 - DNA, 1064 bp, Homo sapiens
atgcctggctaatttttgtacttttagtaaagatggggttttactatgttgaccaggctggtctcgagctcctgacctaaagtgatctgtctgcctcggcctcccacagtgctgggattacaggcgtgagccgctgcgcctggccttaaagactgttttaacctactggtgaagttatgatagttttactgatttataccatatactcaaaactaatagacttccatcctcacctccccaagaaacaaaatgactaccttgttaacagcagtggctttacaacaatttaataaaattattggttcactctttccgaagaaaatgtctgaaataaagtaaatttgaaatgtttctttgaatggtcaattcactgtcagtttttgttttaattgtaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggtatgtagtaatattccaaagaatttaagcatcatcagcattaaagctttttcatgagatgtttgcagttttaaaataaggctgtaattgttattgtgctctggaaagcacttgtattcactacgttactgtacgctccatagagctgcgagcgttaaggcatcacagagcatgctgtgtgagttggtgccatgtgccgtttatagtttgattttatttgtcctatactgttacagcttattgaataattgtaaaagaattgccatctggaagattttgattaattgagattttgaaactagcctttaaagactttccaggtttttggttttataaatgtgcttaatttcatggttctataacaggaaatgacagcctgttgatgtctgtttgtacacatatttaatatgtgtaactccattccaagtgttcttaatgtcagcactcaattaactgtcatctgttt

SEQ ID NO: 60648 - DNA, 1291 bp, Homo sapiens
tatatcagttgctttattggtcaataagtgatgatttgatatttgacttgttctttttaaaaatttaccttatgatgtatattttatttagtttacatttatgattattacataaagctttagaagcctggtgtggttgtgcatgcctgtagtcccaactacttgggaggctgaggcaggaggatcctttgagcctaggagtttgaggctgcagtgagctatgatcttgtccactgcaatccagcctggcaacagagcaagacccggtctctaaaaaaaacagcaaaaattctgtccgctgatcttaccttgtatcaccactttgcctcctttgaggcgtgatatatacagaagcaccctttgtaagatttattatcaatttctacatgagcttgctaagtactgtgacaacttactgaagaagtcagcgaaagggatgacagagaatgaagtggaagacaggctcacgagcttcatcacagtgttcaaatacattgatgacaaggacgtctttcaaaaggtatgttgtgaacagaaaagtttcatttgtattttggtcaactttatttctgaatgctaaatcattagaaaggaagtaatcttttaaaatatttttaaatgtagttctacgcaagaatgctggcaaaacgtttaattcatgggttatccatgtctatggactctgaagaagccatgatcaacaaattaaaggtaatgtaagtctttaatgtggtattgtcctagaaattcattcacaagcacataaagatgttcattgcagcattgtgtacagtaacaggaaacaattcatctggttaaatgtgtatttgtgtagtcacacagtgggatatacaaatactgtattaaaaggacaaaatgtatatgtttatatatgaagattcacaagataatcagtattaatgataaaagattattactacttataaatgaatacacctaaaatattcctttaagtacagattttggagtgcaattccatttcaatttatttttacatcatttcagcttgcttacataccgataagtggtagcaggttcatatttatcctgtgttattcaataaattttcttgcatagtagacattttgaatataatatgcattccttttttcctttttctttttttaagagatagggtctcactatgttgcccaggctggactctaactcctgggctcaagcgatcctcccgcctcagcctcctgagcagctgggacaataggtgtgcaccactgcacccagttgctgtgtgctcttttttaaacctcca

SEQ ID NO: 60649 - DNA, 1050 bp, Homo sapiens
gattgcaacattgcaatatcaagagactggaaaccacctaaatttccatcagttgttaagaaattatatccacataatggagtactgtgcagctgtaaaatacatagaaatgctttgtgtactgataggaaaagaccactaagttaaaatgtgttctgaagctacaaataatatacaaaatacagtacactgtattaaaaggggcaaagggaagaatatatgtattcacttgaatttgcacaaaatatctttgggaagatgttaaataaccacatccctttcctgtggggagaggggcttgggtggctgggaggtgggcatgggggacttttctctgggtgctctgcacttggatccgtatattgtactcctgcacttggatccatatattacctaataaatgaaaatatttgggagttaaccctcagatgtctttttcctctcagacatggcaaatatgtacgtcttactccgtgctgtgtccactggtttacctcatatgattcaggagctgcaaaaccacatccatgatgagggccttcgagcaaccagcaaccttactcaggaaaacgtgagttgtgtgggaaactgcaatgttttcctcctaatcagatccagcgtggagcctttcctttgactttattgttttgaaagatgaaagaaaaagtcttaccatgccaacgaaagaaatgtctttattcaaatgttttaaacctagaatttgttggactcattttggaattatcagattattagaaagctattgataggctgctgcttagccatacggagggtgtccattgaacagttgttaactttccacaggaaaataagctcgccatttttaaataactgtgtttttgtgtaattggcattgataacgtagtttgttgtcatggtagtagtattaatcagtggtaatatagacgacttgcaatttgcctcctttccatatcctctgaatttggttgtccaggaagcaaatttagattaaaataatcttctgtaagtatatgcttgctgccccaaatacccaaaacaataaccctc

SEQ ID NO: 60650 - DNA, 1046 bp, Homo sapiens
tccattttcttacctactgattgtgatcttttttgtttaaaaatgaaaaattgcatttcttcctggtgattagaatataaattagaaagctaacttgacttttatcttttaaccattctctgtttaatttttggaaagtggactttatcttgactttcccaagaagagtctgggaagtagcaaacgagattatagaaattctgaaacttggataagagctgttgggctagaagggtattgtaagggcttgcagagaaaggtgggctgataattttaatttttattatatttctaatctctacataattcatttcttttggatttgttagtaggctattccatggcttatatgtaatcttaaaaatattcttctaaagttgcaagtcatttgctttcctactgactttaacttaatatccattgatattacatttattttccaggtatctcaacacccagtttattaaaaagaataaattaacagaagcggaccttcagtatggctatggtggtgtagatatgaatgaaccacttatggaaataggagaggtaggacattctttaagtgactagcaaacataagtatgtttttatacactgaggtaatttgattgcacatcattttttaaggacactgatttggctagcttaaaatggtcaagatttaaaagatcctaaataaaatgctatagtgatttcctaagaatcctcaggaacgaaaaagatgtgacaactactcttttgataattaaatttataatggatgaatgatagagttaatggttctgcattgtgaaaaaactcagaaacaattataaagtgttgacggccctgtagttaaaaagtgcaggggacaagtacttaaaagacaggctagaggagaggaaacacaaatttatggatacaacaaatttattgtaactttactttaaaagtaattaaattcagagtgaaacaattaaatgggcagtttggtccattcaagttcttgaggtacagtgcaaattaaaatatggaaaattatgctgattgtgaaagaagtatta

SEQ ID NO: 60651 - DNA, 1012 bp, Homo sapiens
tttcattttgaagactcacatctttcccagttgtttcatttttaatacgtgtagttaatatgtgttgtgtaaatgtaatttgtacagctagaattatgtaaattattttagaacattaattttgatacattttattgttgacagtgaaaatgattattgcttttcaagtaaaaatatttttcctctttatatagagagttttggagtcagaagaacaagtacttgttatgtatcataggtactgggaagaatacagcaagggtgcagactatatggactgcttatataggtgagtgtgcctttaaaatctagacaagctaagcagcgttgcctgcattcagtagttgacaggataatttttttattgcctatttctcattcacatatgcaaaactaaagcattctctctgacatggacttttctctgctgtggggaaaggtctatagtcagggtaaggtgggtatttaggagccagggagtgtgtggaacgttctgtgaaaagtaaaactgtactcgattgcatggctctgtttcttctgattgtttacaacctgtagcacatgtttaatctcaacagagatcaatgtgaaaattcaacttgcatgaaacttagtgggaaaatctcagctcatgtcccctcgatatgttcttatttgactctagcattcagtattttatgtttgatgcaaacgatgttagataaattactgggttattttccccttgaagttctgcattccccatggtctaggcatattgaattacttgtagtttcctaatggcccatggtctctcccatcttcctgcctttcctggtgctgttccatctgcctggattgcttctctttctttttctatttttctttcttttattttgtccttttttttattttttattttttgaggcaggatctcacctaggctgcagtgtagttgcatgatctcagctcactgcagcctcagcctcctgggccctagcaatcctcccacctcgaacacccttctccccag

SEQ ID NO: 60652 - DNA, 1006 bp, Homo sapiens
ctccttgcatatatcatgctatttaattatgtagtgctttaaaaacaaataactggccgggtgtgatggttcatgcctgtaatcccagcactttgggaggccaaggtgggcggatcacgaggtcaggagatcaagaccatcctggctaacacagtgaaaccccgtctctactaaaaaaaaatacaaaaaattagctgggcatggtggcgggtgcctgtagtcccagctacttgggagactgaggcaggagaatggcgtgaacctgggaggcggagcttgcagtgagccaagatcacgccattgcactccagcctgggcgacagagcgagactccgtctcaaagcaaacaaacaaaaaacaacaacaaaaaaactaagctcatggaattattgctaacattgttattgttttttaattgacagatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcgtatccttttaatggcagcttgatcaatgttctaaaattgataaatttgttgaaaactgagaacatgttcaatgttatggaagaactttcccatgtaactattttctaatatattatcatctacatttccaagttcatcacctcttttatggcaatcagtatttgataacctttcattcaacaagtatttgttgagtacttagtatctgtcaaggactactttaggctttgggaatacagttggtgaacaaaaaaaaattcctttctattataaaaatagaaatagacactaaacaggtaaaaaaaaaaatctaatgtcattgctttcaagaagaggtcgtgataaatgaaagcaggataaggacgtgggggaggcttggagcacctgtgtgggtgctgctcttttagaatgggtggccaaggaaggcctccctgaggatggt

SEQ ID NO: 60653 - DNA, 1032 bp, Homo sapiens
cctcatgattcacttgcctcggcttaccaaagtgctgggattacaagtgtgagccaccaggcctgtccaactatcagttgtttttaagtaaattgatgacaggatcagccctagaatcttaatattatgaggacttatgactggctcatgttaaatcttggaaaaacaagcagcgatttggaatgttatgagatttataacaagttattgatctatgagatgtatgactgaaccctctctcagtaatcagttaatcacaatatctattcagagtgatttggctctgtgcctgggtttgaatcttactggtaacgtatctgtcatattgcagttagcataatctttgggttacctttaagaatgtatagatttctatatcagtactttatatttggcttttcattgggaaaggcttattggagacaatccctttgattcttaaaagttttgagacagtagtagtgttaggttaagattgtggtgttggatctgtagaaacttccggggtgccttgaaccctgttgatttttcttttggaggaggagaggtggaatatttccttttgctttaagctttgttattctggagaattaaaaattcagactgatactgtgtcttgtttgcttgtttgagacagagtttcactcgtcacccaagctgtagtgcagtggcgcgatctcagctcactgcaacctctgcctcctgggttcaagtgattctcctgcctcagcctcccaagtagctgggactataggtgtctgccaccacacctgactaatttttatatttttagtagagatagggttttgccatgttgaccaggctggtcttgaactcctgacctcaagagatccgccctctttggccttccaaggtgctgggattacaggtgtgagccactgtgcctggcctcttttatatagtttaacattataaataatgttagttacatctattaattcagtgacttagtctttctctattgtaggttgcttttcaaagaatgaaacatggatttgccatatgtaaatt

SEQ ID NO: 60654 - DNA, 1001 bp, Homo sapiens
gtttcagattttggagcatttcagattttggatttttggattagggatgttcaacctgtatttccaaatacttaagatagggccttaatttgtcttcctttttattgtcttttcagacaaatgaccatggaaacagttgaatcccagcatgatggaagtataacagcttctttgacagagagcaagtctgctcatgtgcagactcagactggccaaaattcaatccctgctttagctcaggtaggcaataggcaggcaccgttgaaagtcaaaatatatggaaatgagaattaggtgcagattctgttttcttgccattgatcttaaattttccatgttccctggttatcagccattcttgcttatttgattgtgaagaaaagatacgtgttgtaattagccttgcattttaacagacattcagcagtgccccatctccattgccaccaccactatggaaggaaaaacaaaaacccttcctgaatatgtaatcctcaaagtatgatttgagagggttgctaattcgaaattgatacagttctgatgtccttagctgttaagatgacagaaatcttaccattttccccgtatatatttgtcttaatcattactttcttttcagttaggtctcgaactttgaattggtttcattcagaggtcaccagtatcagttagtacctgtttctagatcctaaaatttatttctgagatatctattaaaaatatagtaaaaataaacacatttgttagttcatcaaatatttattgaatgtctgctgtgtctaattattccggatgcatgtggatatgtagtttcaggacttaaatatcccatggtttggtagggtagacagatattttagcaataattccagtagggtaagaagtgctgtaagatactatgtagaaaatgaataaggcctacagaagagggagcagccagctgactaggagtgctttatatatctcctttgagctaggcacaaaggatgagtaggagt

SEQ ID NO: 60655 - DNA, 1365 bp, Homo sapiens
ccagagatgtattttacccttaacatttcttgaagttaaaacattttttccatcaatagatgtaaattattaaatatgcattttttaaagtatgcatcttaattactgaatttatttttgttcatttttaaggtcagttattatcctttaaatgctgaaattatttgaacctaattgatgacaaaaaaaaaaatctgtgaggaaaatggagacacgtatacatagtatagtccttttcttgcgtgttcaagtagtttatcacagtagaatgataagagtggcgacaagatacctgatgtgacaaattcacatacattaaaagcttgattatctttgtggcatgggtattttctcctgtgtttcccagaagtgtaagaataattctcatcattatctttttttcctgtgatggcccctgattccaagagtttctaattctttctgacactaattataaaacaagaaagtctttccaacctcttctttgttttatgacttttattgaggtccacatatttctacttagttttaacctggctggtattggaagaaagtattgtctattattattatttattatttaatagagacagaattctcagtatgttacccaggtttgtgttgaggccctggcctcaagtgatcctcttgcctcagtctttcaaagtgctgggattacagatgtgagccacagcacccggctgaaagaaagtattctgttatattcagtagactttgtttggattttgttaagtgaacgatttaattgtccttgtagaaagaggtgccagtggatcttgtcctagaatacttacgtgttggatcatggtcaagccacttaatctctgtgcatgaactttaattttcacctttctaaaataggtaaattaatagcctacctcacctaagggagttgttatgattctatgacagatgtgtgacagcccggtgtaaaatgataaatatttaatatttggtggtgatatatgattatctgaggcaacaacatttttctcagtcctgttgattgggtgtgtgtgcttatgtgtggggcgttcatgagcaaaaacacgagtcatatgtggaggtgaatatacacctccgtgtacttcgggaagtatatattcttgcttgcattgttgatattttaataagctcttttgattttgtccaaatcaatttcccatgtaattataatatgaagtgagttttgtaaactctgctaccctaggccctcaaagtattaataattgactgaatatatcaaaatcagtcatgttgttgaagagattcattattttagttttctgacttctttaataatcatatcactgtattattacttgacttgaaaaatgaaatcat

SEQ ID NO: 60656 - DNA, 1458 bp, Homo sapiens
ttatgatacatttcagaaaatcttgtattataggtagcagcaattgcagagacagatgaatctgcagaatcagaaggtgtaattgattctcataaacgtagagaaatcctttcacgaagaccctcttataggtaagttaaccaagtttcctaatgtaaagatactttttccaaaatggtagaataattatacatcaaatcaattcttcctttatagcttttctgttttaagacttattcatgtatcttagtgacttaccttgttaaattgtattttaggaaaatactgaatgaactgtcctctgatgtgcctggtgttcccaagattgaagaagagagatcagaggaagaaggaacaccacctagtattgctaccatggcagtaccaactagcatatatcagactagcacggggcaatacagtatgtatgctgcaattcgatatgatacagtgctagctttaagtcttctctagttatattgaagcaactcaggttttggcattaaattgttccattttaaaatgcatcattaatacctaaactgtatcatagaatgaaagtatatgttaaaaagtgagatctttgtattgacagctgtcatataattttgaaaagtaaaaattttgactgccgaatatagaagaaaattttggggtaaaaaggagaatttttcctatttacatgtttatattaatctctagtaaaacattgtttttgttgtctttatgatgcatgcgaacataaatgtctgtatttcattcttgttggcttttgttacccacaattacatactattcttactaatctgagagttttctaaagtatgttttcaatgtttcactactctctactctgttaatttgtgctacagtttttcctaaaagagaatggaaaaatgatttaattttttaaactgtagcaattggatagataattttatttgaaattttacacactgaaagctctaaataaacagatacattcacattcagtcttgtgcattttaatggaccgttaattctgtgctttttgctctgattaaagcactagtttttttcccaaaagaagagtgtttgatacgtaaaaagcaagagctagaaagaaaagaaaaaggaggagaaaggttagggatatcacatatcctaagctagccccttaggtactggaataatgtgatattcctgtcctttctgaagtataaattgtccatggaagttgtctaaatcaatttcccatgtaattataatatgaagtaaagtgagttttgtaaactctgctaccctaggtcctcaaagtaattgaacaaatatattgacagcagtcatgttgttgaagagattcataattttagttttctgactttaaaaagagctacttaggtactggaatatatgtgatattaaataatgtgtttatccaaataaggtattaagattttagatatattctttgttttt

SEQ ID NO: 60657 - DNA, 1027 bp, Homo sapiens
cctaattcattaaatttcctcttgaaacaaaggttacttaaatcctccatcctactatacccaacctcttcctgtaccaattaaagactatcacccaagacttcagtttttttcccacaaatggcccttgtctctgcttgtgcctattgtattttacgaggaatcttattagagtattaactcatctttctggaattcttatacatgaaaggtaagtgggtcaatctaaactgcaccattatgaaaagaaaaatatgaactttgtggactccttataagaattcagaattctcaggaggctcacgaataagcaccaattcaacttcttcataaagggaattagaacataataggcttacacattcgaaagttaatccagttgcagttcttaatagtgacgttgtttacatttctctaaggcaactgtttcaaaattttttaaggcactacttaatgtaactctggcttttaaactttgatgttgctattgttgttatagcatgatttagtcttccttctgctataatgcacctcttggcttttaaggtacaagtactcataggtgctctcttatggtcactctgaatttaaacctgagaattcattggaacaaaggtctgtttgctgctgtttttaaagttaatgcagtgagatttcatttatgaatctttggattgcaatttggaacaagagtggttttaaatataaacatttacatgtgtatgtattttaattagctcatgtgtataaatttaggattagaagtatataacatgggccgggcgtgatggttcacgcctgtaatcccagcactttgggaggctgaggtgggcggatcacctgaggtcaggcattcgagaccagcctggccaacatggtgaaaccccatctctactgaaaatacaaaattagccgggtgtggtggtgcacacttgtaatcccagctactttggaggctgaggcaggagaatcgcttgaacccagcaggtggaggttgcagtgagctgagatcacacgattgcacttc

SEQ ID NO: 60658 - DNA, 1038 bp, Homo sapiens
agcatattaatgtgactcctcaaaagtcacctgacattgacacatgaatgcagtgtcacgtgagtacatgctgctacacactgcttataaaacatataaaatgaggttaggttaatattattttaagtcgttaaaatggctttttttttttttttttttaagacagagtttcactcttgttgcccaggctggagtacagtggcgtgatcttggctcactgcaacctctgcctcccaggttcaagcgattcacctgcctcagcctcccaagtagctgagattacaagcacccaccaacacacccggctaattttgcatttttagtagagacagggtttcaccatttggtcaggctggtctcgaactcctgacctcaagcgatccacccgcctcagcctcccaaagtgctgggattacaggcatgagccaccacacccagcctaaaattgaattttttatagattattattactctcataggacagtagagcatatatttgctattatatggaacattaaatttcagtgttcgtaatttcccatcttttatatagactgacttatagattttcacatactgaactttaaaaggtcccttatgtataacttacttagctggattgtaataatttcataatgtatgcatatgtgaaagcatcacattatacactttgagtatatacagtttttgtcaattatacctcaaagctgaaaatattttggtgagttaattctatgtggtctatgtgttatagtgattgtagcaaatttgaaaatgatcagtgcttaaatagccatttttatgtagggtttaattttcacagagaagggaacgtttttggcagtgtgggataccaggcatggaggtgtaggatctgggtattaggagcaggtggtggtagacaggaagagaaccacagcagtggtggtgatgtcagcagcttaccagagctagggatagaagccccccacttagaagtgtgacatctaagttaacctctgctgcttacttaaaggtgtatttaggattagtgccatg

SEQ ID NO: 60659 - DNA, 1048 bp, Homo sapiens
ttttgaagactaaaaatctccagtgttgatatttaaggtttttgaggattaattcttataatcatttttgatcgaataaaattaactcattatgtcggagtatgtgccttttgggagacaaaaataattaagagaattgaaaggatctataaatgtgtttgtagaaattccacttggggatgtggtcctattgtagtttactgaaaacagttgtgggcattgttaccagtggaatgtgtgccctaagaaaacaccatttgtgatgaatgctgggcgaactgtgttctcaaatcattcctgttgtctaatggttatcttacaaaaagcatgtgcctggttatgtttgttatgtggctttgtacagtccttacctaggatcgattggctgttgagttcggggggcagaagtgcactgacccactgtggattgtgttggaaggctgttcctgtagtcatttgccttgtgttgcttccagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaa

SEQ ID NO: 60660 - DNA, 1044 bp, Homo sapiens
gactatccaattacttgggaccaccagcaacagaagccccccttcccaaacccagtggtttaaacaataaggaaatacactaccttgcaaaacaagaagtctagtggtaagaaatcccaggcttgctaatttagtgacaacgatggcatcacgaccagatccttcctcctcattcttttccctctacctgctggttccccgaccttaatattgctgccacagtcccaggcatcagaaatggaaaagacagcaccctttttggggggatactgcttttttctttgttttttgttgtttttttgagacggagtctcactctgttgcccaggctggggtgcagtggtgtgatctcggctcactgcaagctccacctcccagcccaaagactgggctgaaaggcactgggttgctcatgaggattcagcccctagggttgaggatcttccaggctttggggaagcatatggccatcaatgtcgaataaaactgggcttctggaagagtggcttgtagacactggggacgtctggcactgggactgagcacttaccctgtacaagaagtgaggaacagcttgtgacaggctggggcttgagccatgctcccagacctgcatgggaactcttattcttgctcatgaaatgtatccctgaagccaagcttctgctaccaaaatagcacgatttgacagcagtgctttcagccttacagcagatactgcctacgacctctccctcaacagaacctgcagtaggggaagctttgcaggggggaacgttgcacatctcgcacacccttgcgcgtgggatccacagcgctcccacacccgtgcgcgtgggatccggagctccccgcacacccgtgcgcgtgggatccacagctctccccacacccgggcgtgtgggatccacagcgctcctcacacccgtgcgtgtgggatctggagctccccgcgcacctgtgcgtgtgggatcgagttctcactgcgtgtgtctttctttgaaccctaaaagtttcatctggactgctgggtatagaaattcc

SEQ ID NO: 60661 - DNA, 1034 bp, Homo sapiens
ctttctttctttcttttttgagatagggtctcactctgtaacctggactggagtgcagtggtgagatcatagctcactgcagccttgacctcccagtctcaagcagtccttctgctttagcctcccgagtagctgggaccacaagtgtgcaccaccatgcctggctaagtttttaaattatttgtacatacagggtcttggcatgttgcttaggctggtctggaactcctgggctcaagtgatcctcctgcctcagcctcccaaagtgctgggattacagtcatgagctaccacacgtggtgggtatatgttccttttgaagtcagtaggtagtttagttgaacttgttcgtagcttagtccccaaagatttaatgaattgtgctcattaagaggacgtttgttggaaaagagatttcacaatgatggatgtgtactggagtttcatgtatatttttatatactctagattctggagaatgatcactcagttttagtgtggaagacagaatagacatctttagaactgtaaaaggaataagctatttttgttgagtatgagaagaagatagccttcgtagaatcacaggctgttcagagcatcaaggacctcatactgtaggagatcctcatgttacagataggacagctgagctgccaagaggagctgctcctcggctccccaaagctggttcacagcagttctcagtctgagagcaagtcttctgatactggggtcagatcctttcactgcaacacactgtacctcttttaaaccagttcttatagcaaggtaaaagtttctcaagaagaaattgacctatcttaatgtttttcttttttaatgtgatgttagtctaagtaagaattatgttttagggaattgtattagttgaaaagctgtacaagaaattaccccaacatttagtaacttaaaataacaacatttgttgtctctcagtttttgtgagtcaggactcccagtttagctgagagcctctggctcagggtgtctcctgggattacagctgagct

SEQ ID NO: 60662 - DNA, 1262 bp, Homo sapiens
gtctcctgcctcagcttcttgagtagctgggattacaggcgcccaccaccacgcctggctaatttttgtatttttggtagagacggggtttcacaaattggccaggctggtctcgaactcctgacctcaagtgatctgtccgtcttggcgtcccaaagtgctgggattacaggcatgagtcaccgcacctggctggaagccatagtcttataacctgagcttagaagtgacatttcgtcactgctatttgatagaatcaagtcattaagttgaggggacagtattatattaatacaagagtgtgaataccaggagatacattggggcccatcttggatgctgcccacgacaaacatggattaagattctgttcattgtgtttaacagaagttcactaaaactgacttccgcaaaacagacggggagtgggagagagaataactatgggatctgaggatttttcatggagacaaagggtgaggagcataactaagtctcatgaggaactggacttggaaggtggacagtctgtaggaactgaggcagctttctccttcagtatcttaatagtaaattctcctatctttctaagtcagtcttatgtttcaggtgtctcaaatttatttttcttttaatctttattctttataaaatagctatttttctttgtctacacatggtggaaaatggccaccccagtggttctaggaccataaaagactaatgggaagaatttctgtgtcccaggagagaggattgagtttcctttgccccactagtgggatggctccccctatgaaagttgtccagtgagcagggtcaaggtttaggtttggggtacggacatgagtgcaggagccttactctcctgtgtgttgtcagggatggataaaggggatgaagttggaggggtttagtgaatggttgggacagcaaatttcagagaagagcatttggaaataattttctcaaatatatatttttaaaatccatatttgatttttttccctcagggattcccaagcatagtagagctaaaatgaattaatttgggtaaaagtaaagttaaggctaagttaggaaacacttttaaaaacaggaacctgctgcgtgcggtggctcctgccttgtagtcccagcactttgggaggcagaggcgggtggatcacctgagatcaggagttcaagaccagcctggccaacattgtgaaaccccatctctaccaaaaatatgaaaattagctgggtgtggtagcgcatgc

SEQ ID NO: 60663 - DNA, 1060 bp, Homo sapiens
ttgctcatggataggaactgtgcctttcacattccgcagtctctgcagtggctagcacatagaagaaactcacaagcataggggaatgaaggaatgaaggcagggcatcatgacccaccctgggcagacttgccgtggcacggtggcagtcttccctgagtagtggctttctgttttgtgttgcagctttaccttctcctaccttccctagctttgttagaaaacgacacatccattatttagggacaggaggatgtaggtttttttaggctcaggtggtgtatttgggctttcctattccgggtcagaactcagcatgaccgtgccaccctcaggccagctctcccctctcccctctgcagtcttctcttgaggtgcatgggggggggagggcaggtatcaggtttcttggccaggcctcgccctgtaagtcagaggcgctctttgggtgccgtggctcacttttcttgggtgcatcacctgactccagtatttcatcccttgggctttccagtgtggagaaagctgctgatatagtacaaactcagatgaaatcatttagacccagaatgtcagttttctccgtaccttttatcatatcctctctcctgacctgcgctgttcccagtcagaacattgctcagtgagcacagatccagaatagaggttagcagggataattcccccaggctggggggagtttgatgccccgtctaccacagccttgtcctactgttagacagcacctgtggcctgctggtagccataaacttacttttcaattctctttttaaaaactctgagcacctgcatttccccttcagttggcacagactgataaccttgtaaatacttttcatagcttaccatgtttatagcttaccttacgtggcttatgtttttggctggctgccccgtgacatctagggaggcagctgaatttcaggataatctgatgcagtcaccatgtaagaatagttaatgccttggaatgattgcctgaagatagcgatcctctggaatcagactgcctgaactggaggcttagatccaacactct

SEQ ID NO: 60664 - DNA, 1058 bp, Homo sapiens
tatctctgtgttttccaagcaagcttttaatttttatttgcagttgcattttcttctttatatggctctgtattttccaaattttctgcaataagcatgcatttcttttctgattagcagaaagttttaaatggatgccacttagctgaagtttctgtgcttctgaagaaatcctttggccttagatattctctgtgagaaacagaaaacctctcaagtgtgttggcagcttaggtggatatttgttctttgaatagttttctccttatgttcttccttcgtctacttcctattctcttccctggaattttctcctctccatgactggctgtgccctcaacatcttagaaatgtttctatgtcttttcatttttgtttcattggctttgcttatttagatttcactttgaatgcacagaatgtcacgttcctctgtgcccagatttcgaaataagagcaggtcctggacagttcagagcaggccagaggtctaattggaagctcccttcctgcagcacaggaggtgtgccttggggggaaatggccacaccaggatgctttgttctgggctccaaagtgtgggtgatgttcctgctacagtgcactttgtgtcctggccgtttgtgttcatgacgacttccctgtcagggcaggagctcagcagggcaggagcctccatgtgcattctgaacaggggctcaacagttgttttgaattgagtgagtgagtgagtgagtgagtgaattcactgaattattgaaaactgtaggaactgtgtggtcatctcaaatttactataagaaaagttaatagtaaacttttaattttattgttcaaggcctgatctgtgctacccacaggaaaaaggaaagggaaatgaaaccttttcttttcaaccagatctttgtgatctgcattggagctatctcagcaatcagcttcgtatatccaaacaaaattctgtcattctttagttgaagcctgcctcttgtgtggcctgccagtccttcacatccagagtagttaatcagttaagtaaattttctttgtagaatagc

SEQ ID NO: 60665 - DNA, 2097 bp, Homo sapiens
actcgtgctctgtgtgcgctagtctggcctcatgcatggccagggtgccctgtcctgtgacagcagggggctgatcgcctgcacatgcgtccatccgatggcttgatggagctgccttctatgtgtcagtctctctttttaaagtactcaacagtatcctcagactaatttttgcttttgcatttttgcttttgttatctttgagatatcaagagtggaaggcagcattcattccagagaggacaagacttctaaggaaaagagaagtgtttttttgtgagtctaagaacagcatatgagtgatagaaaaacagttccatagtcccttcaacagatcagcaggaaggcttttgaaaacagtagtgaatcttctttgcagaggcatggactgtaaggagaaaaccttcttctatcttttgtacactgctgttttagggtaccccaagataacattgttgattcctggggacctaggatgttatctccttgaatgaaacctattcttcatgtcttttacagtaacgaataaatgtgttgatggattcatctgtacccacaaaatgagccttcagaaaagaaaatgcaaagttcagtgatactaggttattacaagctcttcgtgttccctgtgactgacccttctacctctctggggcagcaggctcccattctgagaaacactggtatctggggacactgcaggctgagctgctcagcacaggccatgcatgcagtgtgagaagccaccttgttagagcagtatcaattatggtgactgttagagcagtatcaattatggtgacctctgtcagccttatggggttggggttgggtgccacaaggagctccaggggctcccagacagaagcccagctgtattcaccagcacccagcatggagaataatgggtttccatgataagtaatgctgctgatgtacatcgtcttcctggatctcaatgctttctagatattattgttatttatatttcccttatatactgtggagctttatgggtctggtagggttgggaataaatagtcctatcatttgttaattatgttaaactaatagatgcatatgagttttatgagggttactaattacttttttattcagttaatggaaatctgttaccccttaattgatttcagctgcagttattttgttagggtgctcttgtttaaatggatgtatatttccctctgtgagccaagttcattcagatctgcatttgtgcaggtcctgtattcttatgtttgataaatgagcaagtgggtatgttggttggtggaaggacgggaccacgacacagaggcccagtcctcatccacctgccaggggttggcatgcaggcatataacatttctgttgcatcttttgttttcacagtgagagaaaaacgcaagagtctcttcattaaccatgtaagtgaagctgtctccctgtgttcttcataatgactgtacagtgtaaagagctaaaataactgtctgtgatggatgaaaatggctcatgtgctttgtagatacttggaagaatgttgcagtgtacttatgcttagtttggtttgtaattggacaagcatcactcagtatttgtccactgtcccaaatatttttccagaagccctagaccactattgttcatgagatgatgtgtgtgaacaataacatatcaaacatcacccagcaagtccaagcgaaagccacttctttttaattttgaatcctttcctttctctaccctcacccccaaattattctttttctcttgtagctcagttccatttgaataaacacatagttgttttccatgaggctctctgtctccacacttgactcttcccatttgttgtttgtgggtccagtagagtctgcgtgttcttctgatgctccaagaaaggataaacttgataacactaaatttaaaaaagatgttcaaacatttggctggagtcttttggccattcttagccatgtctccctcccctggtggccaggtgcaggtgccccattgagatacttcatccctcttccttccttgagcagagatgtagctggctggctccagcacctactccacaccctatatacc

SEQ ID NO: 60666 - DNA, 1942 bp, Homo sapiens
tatgttttagatgtaattaaagtgaacaggtataggaaggtttttgttgttgttgttgttgttgttgtttttgagatggagtctcgctctgtcacccaggctggagggcattggtacgatcttggctcactgcaacctccccaacccgggttcaaactattcacctgcctcagcctcccaagtagctgggattaaaagcatgcgccaccatacccggctaatttttgtatttttagtagagacaggaattagctatgttggccaggctggtcttgaacccctgacctcaggtgatccacccgccttagcttcccaaagtgctgggattacaagcatgagccactgcgtccagctaggaaaatttaatgcatatgaaagatacacgtatttttaaaaggctgtgtaaagggatttatgtaaagtttatttaaaatttgctgacattttgactttgcttttttttttttaaggttagctgtttttatgaatcttttaattaaagtgtaaaaatctctgattatagattgtgggtgacattgtaggtggttggagttaagaatcactcctgaaaaaaaaaaatcactcctgaaactcagaatgtatgctttttaccttagcctcacttttctatgattatcttcctgccacctggtgatagcacaccaaaaatgaatgggttattctaagaagttaaaaaaaaaaaaaagatgtgaaaacagaatgaatgaggagttgaatagccagcttcctttgtcttgtttgccataggtgcactttgaaacgagaaagccagactgggaattctgtgtagtgtgatcctcaaaaaaaaaaaaaccaaagcatttgtctcaacactgagtctggtgatagttgaggaaactttgtgaggaagtaaagcaactagggagagttacttatcagctaagcaagagtcacattattattagtgggacttggagccaaaagaactttgttcaaaccctcgttctgccacctgctaattgggcaatcttggaaacatcttgaaatctcagttttcttatctcctagggtgggtcataattccagacctacttgactcaaaggtagtgatttgcagcctaattataacaccatatacgtatgttgtattattattgtccattggaatttaggtaaaattgatttaattttccaagttcaatatcaaaactgatgaaagtctttctggtattttgagtatggatatagttttttcataatcattaagaccaggattttctgggaggagtatattctgttcagctccctttggagaatactgacttgaatcatttgctcctcttaacacagttcagttccaaatcagtttctgccttttagctttgagtgaggtaggaataggagtccttgtaaaaaggtgtctattctggttataggcttcatctgtaagtcataaaagtcaagtaatacagtgagctacatctaggaactgaaatttaaaacattttaaatcttgcttttgcctctggaatagaatgagagtttattgagcagctgctgtgttagcatcaatgccatatgcttggaggatgtgaaagaagactaagtttttaaaatatcagtaaaaattttaaaaatccaataagattaaagaaatccagcttttactttgaaataatttcaaatgtatagaaaagtaacagcaataattgagagtacaggattttcatgtgactaaaggaaccttagatgctctggttctcagaccccctgttctgcttcacccagggatgttgacatggggtaggtgttttgttattttctctcttctttttgttttttcttcttctttttgcggaatgtctagaaatgataatgataatgttacacacactggtacattgagaagcttgggtaggacatcaattccttaagtgtattggttatgtctgtggaggac

SEQ ID NO: 60667 - DNA, 1768 bp, Homo sapiens
tgcttcagcagcgcagtgctaactgtgatttaagaaattggaaccccaaagaagtaactagtatcatttgttatctagttttgagaagagattctgtttataacattgtttatatatttctcagactgcctcacattttccttactttattactgaggaaaccttattaaatgagaaataaattttaagatattgaacagggcatttggtctctaacgttgaggcttcctttactaaatttgtgaactgtgtacacccagggtgtgttgcaggcgggcaggtcaggcagaagacattgtgatccccaagggattattaagtttttttgttgctgaaaatgacacttagacattcaacatagcatcaggcacgtggaaacttgtttgcataatttaactttttttctagtttgcttttgatcaggaactatccagattgatgtgtactaatcatattgcccgattgttgccagaaatctatttagtgttcaactaggtgtcatcagtgtgtgctataaattctatttacttcaccagtaccttctagaaggaattctgttctaaagttctccaaagagcccaaaagttgtacagttatgaaagaacctgtcataagaccacacaaagaactatctaaaggtcattcattggttgtattttcaaaagtatcagataatcttcccctttaaaacttactttgtccttaacaaagcaatattttttcattataactttacctgctgaaattcaagcagattaaccaggagattctaaattaacattggctgcattttccatggcccctaaatcaactgtatttcaagagtaaggaaagtgggtacagtggacacttgtcttgatcttagtgcgtaaaaccaggccaccatctaaattgcaggcttttgttagtttagtagatcccatgtttcatacaagccatggggcaggtgatttttgtggactctgaaacatgctttttgatgcttgattgcaagagtttactgttctcctgatgcaggaagttagggactaggtgtggtcctggtgacttttatatatggaagagcaaggaagttcattttatgaataaagtgtttttgtactgttcttggtggtaatgttgacatttcttgctaagacatttttcctctgtggtcttatctcaagttaagcgggggtgatgtttcttggaagaattctgagccctgtgtaattgccttaatcttcttgctgttgttttctagcatcctccaggacaaatagcaaggaaatacagttcctgctccaccattttcctagatgatagcacagtcagtcaaccaaacctcaagtatacaattaaatggtgggtatatggatttatttccttccttccttccttcctttttttttttttttttttttttttttacttaactgaatgctttttctgttccttaacctgacagctaagctggttggttgtggggtctgggagtgataagattggatgggtgggagtaggggtagcactgataattcaggaaatctttttaaaaaatgattttggtagttaagtgtggggtattgaaatatttttacatagtactatttacattaaaagaccagaatcttaaagtattttaaatgtagattacttaaaatatattttttatttttgttcatgctttctacccttgcactttttattgaagccatcctggcataactccactaactttttaccttctaaataaaatgagactcctatgttcccagttggagacccg

SEQ ID NO: 60668 - DNA, 1053 bp, Homo sapiens
attaatgcatcctttccaagttttttttttttttttgtcagtagtgagaaagcttgaagacatttacataacagatgagtataaaatttttccagttttgaccacacctaatctacagcaaatttatttttagtgatttccttttatcggatctttccaaagcgtcctccttcgttttcatgaggacatagccactctcatggtaatcatatttcatgcataatgtgacattcatgtatgttacacgagtctgctaagcacagctggtgtgaactagtttgggaacaagcagagccaccacatgctaagtgcagagctcagcccgtgggagccccacacgttgtcggtttacaaagcgtggttagtcagtgcaggggaggttggatgacagcttctaatgaacagtattggagaaaacacgaatatccagaagcagacacctagaaagggattctctatgatcacctatttccatactgtaattgtgattcatggttctttatggtgcttgagaattttggatttaagaacttacaaaacagtgcaactttggaactctaaatcttgaattagagtaatgtatcagtgaaagtgtagattttatcttgttgcctatttctatactagttcaaaccttttaaacttgtaaggcttaagaaacagtgtaatcccattgatgaagctcagttgtgctttcaagacaattttgcattagaatctctaagatatttctcagtacttacttagactatgatggatcctgaagtgaatgtagccagagctgataataatgagttggctttgtgaagcacctactctgactgctctggtcagttctttacatgctttaataacaactccttaaggtgatactggtatcttcattttacagataaagaaattgaggcacagagagattaatttgactaagatgatacaactagtaaattggggaattgggaaatgaattcaatctaccactcagaccattaatctattgctctcctagattaatgatgataaattgcaccaaaagtaagtgagtggaagtag

SEQ ID NO: 60669 - DNA, 1044 bp, Homo sapiens
attttttttttttttttaagacagagtttcattgttgttgcccaggctggagtccaatggcgtgatcttggctcactgcaacttcgcttcccgggttcaagcaattctcctgcctcagcctcctgagtagctgggattacaggcgcccgccattagtcctgactaatttttggtatttttagtacagatggggtttcaccatgttggccaggctggtctcaaactcctgaccttaggtgatctgcccacctcggccttaatttgaaaatttttatcccaagttttagttgttgtaaaggatgttatttgcaatatattttatatagtagggttttaaagttaaaagtattcattagagactgaatataccagagtaatatgaaactcacagttacccattttcttagaggtgaaaattttacattgctgctttttctccttgaactcattattttctttctagtttcctcacacattagcctcttcttcaaaattctccatatcaaaaatgtacatttaagtcaaaattgcagtagtgttttctggatgataatgttctaatttattaaaaacactttcaggtctgagttgtcattagtacacagttgatcaaaatatagacatactaaagctgggtgcagtggctcacacctgtaatcccaacactttgggaggccgaggtgggtggatcacttgaggtcaggagttcaagccagcctggccaacatggtgaaatgccatctctactaaaaatacaaaaattagctggtactggtggcgctcacctgtagtcccagctactcaggaggctgaggcaggagaatcgcttgagcccaggaggcggaggttgcaatgagccgagatcgtgccaccgcactccagccttagcaacagagcaagactccattttatatttaaaaaaaagtcagtataaattattaaatatacaaaaagtaaaaccttatgggaaatagatttcttaatgagatcagtagtttgttctttcattagtttatatttttgtgtatgatgattattgaaacc

SEQ ID NO: 60670 - DNA, 1507 bp, Homo sapiens
atgagtaggtgaaattttgaggagttttattatagtagtgtcactcaagtcttaaaacagtttttgaattatatgctaaaattacacagccatctattagtaaaggctatttaaatgagcctaccaacccctgcttcagtttgttgaaagcaaaaactggaaaccatctaagtagcctgtcactagagtcattcacttttccagcaccacatgttgggatatagtccctttcctgggttcctcagagggagttccccctgaggcagtgaaccttagtaagggcaggtgagcagcctgcctttcccttccagggtaggagaagagcaactgggaaagaagaagccagaaggagaacctgcacacacagatttgttctccagcaagtcagttttaggagagtgaaatgaaagttacagatctagaaatctctttcctaatgctgtgttctcaagcatgcttagagacactttctgtactataaattgaatgcatatcccagcttgaagtccagagtcccgctgagtcctgtaacagatgctattcatgacatgggctgaattgtctcctctaaaatagatgtgtgaagtcctaacccccagaccctcagaatgtgaccatatttggagatatattttttaaagaggaaattaaattaaaatggggtcattagggtgggccctaatccagtatgtctgatgtcctcataagaagagattaggacacagacaacacagagggatggccatgtgaggacacagagaaggtagcgtctgcaagccaaggagagaggtctcggaagaaaccaaccccactaacaccttgatcttggactagtagcctctagaattgtgagaaaataaatttctgttgttgaagccacccagtctgtgggactttgttacctgtgctagtctgtagccctagccaactaatacagattttggtactgggaagtgaggtgctgctgtagcaaatacctaaaaatgtggaagtggctttgaaagttggtaaggaatagaggcaggaggagttttgaggtgcatattagaaaaacccaagactgccttgaagggattgttggtagaaatgtgggcattaaaggtgattctggtgaagactcagaaaagaggacagctgtagaaaatgcctctaccattttagatgcattcacatgtcatcatgaacagaatgttgttggcaatatgaatgtccaaggtgcttatggtgaggtctcagaaagaagtgaggagcatgttcctgggagctggaggaaaggtgatccttgttaaaaagtggcaaagacctgaccaaatagcgttctagtgttttgtggaaagtggaatgtttaagaaatgaatgtggatgttttagccaaggagatttccatgcacagtgtggaagtcacagcctagtccctcttgttgctcgtagtatactgtgagaggagagagagaaacagaaggaggaggaattatttagtaacaaggaaccaaatcttctagctgaa

SEQ ID NO: 60671 - DNA, 1054 bp, Homo sapiens
catcatctgggagttccttagaaatgcacattctcaggccccactgcagacctactgatccccacagtgtgaaggtggagccccctgtctgttctaacaagcccaccaggtgatggggtgcgtgctcaagtgtggaaactactgcttccattcttcccggcttgtgagttctctttttaagagactgaggcagagactggacaccctccccccataatccctgccttttgcctaagaaagcccctacacagttcctcccttcttttctccctggaggtagggaggggccaccgaggaagccaatgtcctctaggtctgcagaggctgagtgttttcctctgggcccctgcggaagggccctcactggactccacgtggcagctcttggctgctgcatccaccctttgttagcagcctgtcctcacggagacctgcagccagagcctgctgtgtgtgtgttagatctcagtgaagtgattcgccctgaaacgcttcctggtgatgatcccagttaaccagtcctcatccttctgggcaccagatcaagtggatttggcttttaatcccaatatggtggtctaaccagacatttacttagatcactggtcttcctggaggatgcagttttctggagtctggtctccagcaacttgccttggcaggccacgtggcctggtgtggcagctaagcataggctatttttgtctttgctttgcaggaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggtaagatggtttaaaacagcgttttgtggtgcagtgttgccaatacatcatctgagtaccagagatgcatgtggtcacattgatcatttcccccactacatgatgtaaaataaagatgagctactaggatatatagctgggcagttgattatgatttgttctgcttctttttt

SEQ ID NO: 60672 - DNA, 1173 bp, Homo sapiens
ccatccttttctgtggagtccctagctggtggtctggctgcagctgtctttgccgccagcggccgagctctcctctctgtgaggctcagctccaagcccgtgcttcatgccagccctgccaggatggtgctgttcttgccccgcttgcaggtgaggacgccaaggattcaaaacagcacgcgtgtgggtggggcccgtcccacacccctagatggggagccagcgttgaccctggtcgggccgactgtgaggtgacactgtactgttatttcacatcctgagagtcttttctcagactgtaagctcttgggaaacaagagctgagtccacactcccttcgtatctccctgctgccagcagagagctgggctctgggccggagctccacaggggcaggggctctgcctgtccctcatgcagcgccctcggcgcccaggacgagtgagcaatggacgcagatatggcccgccctgacccacactgtctttcttgcccctcaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggt

SEQ ID NO: 60673 - DNA, 1461 bp, Homo sapiens
ttgtaattgtgatgatctactctgtatgggtaccaaaatcaccttctctcttcaagtcaaagttgaatttagaactttgaatacaggtcaaaaaatgtagaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaattgtatagtctatttattgtatgtatgtacatacagtctgatacctaaaatttaaagtggattccataaaaccagactcaagtcttgtttagactactgaatactgttttagcctgtgccctggattctacctctgtataggaaaattttccatattcattaattagtgttgatctgtattaattggttatgtttcttgcactaaggatgtttaaaactccgctgtaagtgtagattttagttttactggcaggatgaatcacttgacacataggtagatacttgaggttcattttcttttctttttctacatgatgatgaatagttatgttttcttctctgatttgttcaaagtttgccaaaagaaaacacaaaaccagtacagtacttactgataaatcgtagtgactgtaatttgtttgtaaggcgaattaatgctctacaattaaagctggattactattgaggaacacattgtcttagtgtagtttttgaatggaaagtttttgtcattaaggatgaaggaaacgacacaatttgttactttaattttatatttgatttaaacaacaaataaagtcattgggacaataaatatatatcccgatgaatctttttgatttgttttacttttcttatttttttttttttaactagaaaaagggaaagaagaagtcaggagtttaaaaccaaattggagggcagatgagaaatcctgccaagatcgggatgtgccttcatgcatgaggtgaggccagaggtgtgggcacctgtacctgcctcctcttctgggctggctttcctgtctgcctgctctcgggcttgggcagagccatctccatcctggggtttcctttaagctaagctgaaagcaaaatttggggagtgaatgatttaaacttttcctgctgcttttggtaacttctcacctggggccatattttacagatttgaatttttttttttctttttttgagatggagtctcgctcttgtcacccaggctggtgtgcaatggtgcgatctgggctcactgcaacccccacttcccggattcaagcaattctgcctcagcctcccgagtagcta

SEQ ID NO: 60674 - DNA, 1364 bp, Homo sapiens
ttacaggcgtgagccactgctcctggccaggctaatttttaaattttctatagaaatggggtcttgctgtgttgcccatgccggtcttcaactcccagcttcaagtgctcctcctgcctcaccctcccagggtgttatgtctttagctgcatggatttcaagccaaggcctgcaaacagcttggttaaggtgctgacttgctgttattgaatgcagcgccctgctagagctgttgcacccaaacagggctggggagatgcccaggagtgcttgcagtcacagtggtggggctggagttcgtacctccaagtcagcaggctccctgcctgttttcctgttagattttcttactaagtttgcatatgtgaaggggctaaaggtcctgtctgtcactcttctcagcagtgatcaacctcaaaatgagcttcttaatctggcagctgctgtctctgtgcactgtggcaggtctgagctgggcacagcagctgggtgaggacttggcctggcaactgtatctgtccttcataggtttttgtgaaaagagttctgcagaacctgttacagtaagaagtgaactcaaacatgatgtctgacttaatgatgttcagattctacaggtctcaataaactttccagtgtcctttaagggacttggtttcagtggggggctttccttttaagaatttttgttcatataaataagttatttcaaataagggataaaagaatggcattacaaaatatagtttgggatagaaatattaaatgtagcgagaatttatgcataagatgttaacatcggtattgatttttttgtcatggaaccttgggttttagtctcagtccaaaagattaacttgctctgtgaccttggacaaattatttgacctctctggacctctcagtgaccttggctgtgagggagactcttgttttcatcacctgtcttagtctgtttctgagcacactctgctcagccattcagccacaattgttggacgctcctctaaatgtagcaagggtggacatagtaaaagccaagtgcaagcctaacggtgacagaaaacccaggacgaggggaagtcggttgtgttctccaggtcctctcctaaagaagggtggccatgggtagaagcagcaggtcttacaggacctgggtacccagttttccgctgctgtcccttcttccccagctctcccaagtacagctgaatgctcagcgtggcctctagttggccattcctggacctggtttgtgagttcttgtctgcattggtggatcctggaaatctcgaaacagtggaagtgggtgtgtgaatccactgccaagtgcctctgtcctgaagaggatgctgcttcatttc

SEQ ID NO: 60675 - DNA, 1072 bp, Homo sapiens
cgtgtaaaaaggatcttggtaagtgtcaggagggaaattgagtggttatgatagtaactaggaggtggcagcttgatggacatgaccttttgagtggacgtctccgtggaagagatggggagaagggaagatggatggagatgtggttggagaagagctgatcagcccaggcctcacaggcattgctgaggaacacagatttgaagaccaatgggaaactgccacagaatttagttagttctggtgctcaaggagtgggtgtgacaggcagcacggttcccgcctggacggccacaaggtggagagaagggccacatgtacttcagaggttacacataggaaaagaaagaccagttctcgccacacttctggggtgaaccatcggtaagttgtaacagataatgtgttcctgaggttagtccaaatcctgagtaccggtaatctaccatgcatcatacacaatgagactgtgtcaagatgaaaaacccggacccctgctctcaaaagctgtgtttgggctggatcaatgaaaacagacacattttcatcctaaacacatcttcatcctagcatgggcatgaggtggaatctctgaacctgtctttggtaataaaaatgtagacagagcggttcttgaacatcatttcttcctgcaggcacttgtgggttatatagtcatttatcttgtgttcagtatttttttagtaccttgaagctaatgtgattgctaccaagaaaatctaggagaaacaactggaaaattataagaattcagtaagattatagttacaagattagtacacaaaaattgagttttctaatttaccagcagcaatcaattagagaatataatggagatgccattcaaaaatagcaacaaagtgttgctattttgctgcacatgcctgtagtctcagctactcaggaggctgaggcaggaggatcactttgagcccaggagtttgggactgcaaagagctgtgatggcatcactgcactctagcctgggtgacagagcaagaccttgtctcttaagaaaaaaacccaaaccacaaaataggagcaaattatg

SEQ ID NO: 60676 - DNA, 1105 bp, Homo sapiens
cctcccagacccagccccttttcctccattgatgtgcggggagctcctcccgccacgcgttaatttctgttggctgaggagggtggactctgcggcgtttccagaacccgagatttggagccctccctggctgcacttggctgggtttgcagtcagatacacagatttcacctgggagaacctctttttctccctcgactcttcctacgtaaactcccacccctgacttaccctggaggaggggtgaccgccacctgatgggattgcacggtttgggtattcttaatgaccaggcaaatgccttaagtaaacaaacaagaaatgtcttaattatacaccccacgtaaatacgggtttcttacattagaggatgtatttatataattatttgttaaattgtaaaaaaaaaagtgtaaaatatgtatatatccaaagatatagtgtgtacatttttttgtaaaaagtttagaggcttacccctgtaagaacagatataagtattctattttgtcaataaaatgacttttgataaatgatttaaccattgccctctcccccgcctcttctgagctgtcacctttaaagtgcttgctaaggacgcatggggaaaatggacattttctggcttgtcattctgtacactgaccttaggcatggagaaaattacttgttaaactctagttcttaagttgttagccaagtaaatatcattgttgaactgaaatcaaaattgagtttttgcaccttccccaaagacggtgtttttcatgggagctcttttctgatccatggataacaactctcactttagtggatgtaaatggaacttctgcaaggcagtaattccccttaggccttgttatttatcctgcatggtatcactaaaggtttcaaaaccctgcattcatttctggagtccgtgattttgaaagcacctggtgttccagggagggaacgcattgctgaggtgtagaggttaatgttttaaaccatagctcaccctttacagtagaagtcacttgacaatctggtaggggagcaggcgctcttcaatggattaaactaacgggttaacatcttaataaccttcagtgcttgtgtatac

SEQ ID NO: 60677 - DNA, 1053 bp, Homo sapiens
aaggtagcaagcaaaaattgattagttggactgcatcaaaccaaaaagtctgtacataccaaaggaaacactccatatttaaaatgtcaactttttgaatgggaaaaaaatatttttaaaccatttatcagataagaagttaatttccaaaattcataagaaattctcacaactcaataacaaaaataaaaaaaaatgggttatagacttgaatagacatttctcccaagaagacatacaaatggccaacaggcatatgaaaaaaatgctcaatatcactaataaccaaggaaaggtgaattgaaaccatgagataattataatatattataatatattacatatatattacaatatatgtgtagtatattataatatattacacatatattataatatatgtgtaatatattataatatatatgtaatatcctattttgtattacctcacactgttaggatggctattatcaaacatcaaaatactaaagtgttgacaaaggtgctgagaaattggaaccccttgtacgtatttggtgggaatgctaaatagtgaagtcaatatggaaaatatagggattcttcgaaaaattaaaaatagaataaatctgatccagcaaacccacttctgcatacatatctcaaagaatggaaatcagaatcttgaggatatattagcactccaatgttcattaaagaactatttacaatagccaagatgtagaaacaacctaaatgtctgctgaaggatgaatggataaagaaagtgtggtgtataaatactgtggtatattatttagccttaaaaaggaaagaaatactgaaaatgttacaacatggagaaatcttgaggatattatgccaagtgaaataagccagtcacaaaagaacaaatactgcatgattataatatataaggcatctcatagagtcaaactcatagaatcagagagtagaatagtgcttgccaggggcagggggaggggaacatgggaattgctaattaatgggcataaagtgtcaattacgcaagatgaataaattctagagatc

SEQ ID NO: 60678 - DNA, 1095 bp, Homo sapiens
gaaatatactctaagtaacaaaggacacacacacaccttcaatgacttctttctggacattttccttttcagaggatggactcatagatcaaatgccatcttgtcacctcccatttctatactggctaccctttataatgtttaagaaaaaaaaataaaatagttctttgtaattggagtttcactctttggatgaatttagaggagagcaaatatgttgaatatgttttattaatgtaagttttgcttgcagaaactgtaaaaaagagaatgtatataggcatgtatatctaaatgtctctgcagacatttcggcagagatttttatggctatatgaattctcctttttatgctttctgcaagaaaactttggggactcatttatggttgtccccttaggcccccacccactctgtttgcttcttcagtgctttgtgtactggtgggtaagtttagttacatgtatgtttaattattgtgccatttcttaaaatagtcatctatcaattatgatccgataaaaactgggtgacataagagcccccttctcaatgcatcaaatgtacacattgtcctgttacatctgtgagggactcatgcctgctgaaaggagggagtatcacagaacaaaagggtgtaatctttaatgtgaatctgaatcaactcttaagctcaagggactgaactgaaaaagctataattgaaaactacagctggactataaatgcagcccacttatgagatgcacattaatgggactataagaatattagaactattatttgtactcatttatctcaaatttgatgctaatggattttttttctaagatgcatgactttgactaagtcatttactctttctaggtctcagtaacttactatgcaagggactgaataatttctgaagtccctccccattaaaattattgtaatggttctatgacatatgcggtgtccaaaacactgctgtagctattattaaattcaaattttaatgataatctttgggacattgcaacaaaataatttaagagtcagtttcagttctcaaccgttaagataaacccaggtatttcctttcttagtatcata

SEQ ID NO: 60679 - DNA, 1072 bp, Homo sapiens
gaaagcatcactttaatgacagaagccacatttggtactctgcaaatctggttaataatcctgctgtgtgctttgcggttggccatgatgcatagtcacctgcaagcttatttaaatttagcccaaaaatgtgtggatcagatgaagaaagaagcagggtgaataagtacagttgagctacagaaaatggtggcttgagtcttttattatctttttgtcattgcactgcagtatgtggtgcctctggtaacactgtttcacacaactctgcttttgaaaacactaggtaatcattcctggggtatttatccagaatctgtctctaccttaccagtggataatagtctactctacaattctgtttactctgaattaccatcagctgaagagaagatgaaggttactgttacacaaataacagtggcactgagcagcttaaaaacatttttacacttcttgttttttgaggacttctgtcttttctgacctggtagattgctgcttgcctcttttctacaagcctttttgggcttttttatcaccagtatctgactgtggcatgaatctcagttaacaaaaaagcatatcaaaatcacagtttaaattcaaatatttgtgcccttaaagggctgacgaaaaccagaagaaagcaaatacaatggaaaaaaatcagaatatcttgtattaaatgtttcctctgtattctcagggtgaattaatgttaaaattacaaaatagattgttaactgttacactgtggcattggaattttaactgttggtatttactggtatgagggctatctacaagggtaatatttctgattaccttggcttacagaaacctccagcagtctttgaaacatctcacatgactccagttattgattgcttttaatggtattatggtactgctggtcgtcatagtggctgcctatagaacaatcttcaaactgagccatgctttaggggagagaaaggggctaaagtctcttctgttggtaatatattagttactcttgaaacgataaaatccaacagaaaggaagagatagctactgtatattatagta

SEQ ID NO: 60680 - DNA, 1063 bp, Homo sapiens
ttcttcttagcactattctagctgcatgccagattttttgacacattcttttttattaagttgtatatatttttattaacttcctttgatactttctctttactcatggattatttagaaatattgtttaatgtacatatttttagagattttaaaaaacttgttattgatttctgactttttttgttttgatttccagttttattctattacagtcagagatcacattctgtctgatttctataccgttaaatttgttgaggtttgttttatggcctaggataaggcctgctttggtgaatgtctcatgggctgtcctccacactgtacctgctgttgtttcttcttcggaattctaaggtaattggttttttttttttttttgccttttttccacagttaatagttgttcttcaggaaggatggtctgtaggtggggtacattgctataattaaaagcaagacttctccgcactttttagttccatctttatttctgtatgattttactttcttctgtttctttcctgagtataatcagtttttgttttatttcttcctgttctttgtccatttctgtttttaaaatttttgatccatagtattttttaatatctccaaatgcttgtttaaggatatttaattctgtttcattgggttagtattttcttctcccttgtagttgttttcttgggcatgggagatggtggttattgtggttgtcagctcaaactttttttccctcattttgtttgcttcacttctcagcaaagtcttctggtcacccagtctaaaatttcatcatgcccctcatatcttctaatctttcttatctacctttttttttcctttttgctgcttattactatctaacatatgtattttacatatcttgtctattgcctttcaacctaccgaagtataagctccaagatgattgggacttttaaaaaaattgtttcgccactattaatgcaaggcacatagtaggcactcgattactgcttgttgtataaataaatatatgaacaattgattaaacaaaggtttatttgaattaagg

SEQ ID NO: 60681 - DNA, 2596 bp, Homo sapiens
ccttaattgaatgaaatggcatcctgctccgctttttttttttaatcaagctgtcagattttatgcagcccgatttcctaaaataactcactaattcagtgattgccaatttattagccacagattcccaggtaactcagaaatcactggaagggtctctgtaagttcatggggtctccaggtgtcatctagaaccagtcctatctcacacgtacagctatttctatttttcaaatgtatgtagataagttgtaatttaggagttttacagagtcaacaggtactaaaagtaatactgcgatcatattggaggttcataaaaacgtttcacatttttttattaaaatttaagttttagtttaagttaggaaaccacttcatcagtccagttgatacctgggtctgagctgtccagtatggtagccacatgtgactatttggagttagaatgaaattaattaaaaactcattttttcagtttccctaagtatattgtaagtaaccacatgtggctaatggctaaatggctgaaaagtacagatatagtatatttctatccttgcagaaatagatactgctgatgttgacacttaagatgaataaaaagtaacttaaccataaaatgtaatcttaagagaggtaactcatctaatttatagcataacagagagaaatgaaattggggatggttaagcagtttctacccttgttcagtgaacaaatacatcatctcttcataaagaaataaatgaaatttactgtttttccctgggtattgcctggattgtaaaatgcttctcccatctccttaccccaaccttcttccttgtaggttagagttacttgttattggtaaatagccactatggaggctaaggaccagaagaaacacagaaagaaaaacagtggacccaaagctgcaaagaaaaagaagcggcttctgcaggatctccagctaggagacgaagaagatgcccggaagagaaatcccaaagcttttgcagttcagtctgctgtgcggatggctcgatcctttcacaggtatgttaggctacggtctggtcattcttccattgattctttttttaaatagtaggagcctctcacaggtgacatttggattcacgagtctagtccagctccaaaggacatggagattcatggtgtgtggctttcactaaaacgtgagaagcttttcccatagaagctgccttgcctccagcatctgcatactggttagtgtttattgcccaggatacaagaatttatagactttgtttgttcctaaattttaaactgtttctatggtgataagtgtgctttttccccccaggtatgttttacatagttgtaatataaaatacaaaaattacaatatttaatactaacatagctttatttagtgagcccttgtgatatgcctagcagtgtactttaaacattattcaactaaatccttccagcagccttaccagagtaggaatcattcttgccctcattttatgggtaagaaaactgagatcaagaaaacaagttacctccaatcatataaccagtaagtaggagagctaaatgtaactccagcgcctctgctcttatctgctatgatgtactgcctcgctatttaccttttggttttttaaaaaactattaaaatcactcttaaaacagtcagatttaaggagtgtttaattttcgctctctatagtattgaagtcatcttgttacatctttattgaacagcaattatttggatggggccagaagttagcaagttaataattgacaagttaattatatttatatattgtctgttgtactctctataaaatgtgctaaagtactcatagctataagtgtaccaaaaaagtctacttataaggttgataccttttactctattttgaaaatgagtttactatttatttatttgtttattttttaatgaataggactcaggatttgaagacaaaaaagcatcatattccagtggttgatcgaactccactagagcccccaccaatagtggtagtggtgatgggacctccaaaagttggaaagagcactttgatacaatgcctcattcggaactttacccggcagaagttgactgagatcagaggccctgtgacgattgtgtcaggtaggagatgccaccacagacacagagttggcgtggctgttgtcatctgagggacatgcatgcgtttgttgttttcttgagtggaacatgttaaatattgtcatatcatgggacttctcttatacttagtattactaagttggctatagcttcagaaaagggtaagttcccagagataaggatgtgataatgttcacatttcctcccagcactctgggaggttccaaggcaggaagatactcgaacccagcactcgggctggaaaatcaagctttgctgctcgattgcgacaccagccacagtcctcttcctccgtgtagaaggatgtgtggtccagcctcttaaggtgatgctttccttttcttcctggtttcctcctccattttttgtatgagaaatgataatgttcactatgtcttatcctgactgctctttggctttgccaaacatgtt

SEQ ID NO: 60682 - DNA, 1053 bp, Homo sapiens
atttggctgcaggagccttcagcctgtctcctgtgtcctttcaactgtctctgttagtctttgagcatttctcactttctgacagaacaagaggatccaggctcattttgccttctttctgctttgggcctggacttacccatttctcttaaggatcatgtgtttttagcttagaaattaatcagctttccaaaagatctacaaaacagtaacttctcttttgagcaatttttttctaaaattagatttttgttttttaagggttattcctttattctctctataagttcttttgaagtgtggtgttagggaaccatgcccgagtttgcttcttaactcttccaatgtttatcaaatcatattttccctatgctatgtcatcttaaacaattccttgacattttctatttctttgtattttcattgactatattgccatttctagattagctgattaatgtacaaattgaattattttgtatttccttggtaatacaggctaatgatgccaaaggaggaaaaacaaatggacttgaacactggtcgaatgcgtcggaaagccattttcggagatgaagatgaatctggagatagtgatgatgaagaagatgatgaaatgtctgaagatgacgggttggaaaacggctctagtgatgaggaagcagaagaggaggaaaatgctgagatgactgatcagtatatggctgttaagggcatcaaacgacggaaacttgagttggaagaagacagtgaaatggatttgccagcatttgctgacagtgacgatgaccttgagaggagctcagcggaagaaggggaagcggaggaagctgatgaaagcagtgaagaagaggactgcactgcaggagagaagggcatttcaggatcaaaggctgctggagaaggtagtaaagcagggctgtcaccagctaattgccagagtgaccgtgtgaatctggagaagtctttgctgatgaagaaagcagctctccccactttcgattctgggcattgcacagctgaagaggtgtttgcatctgaagatgaatctga

SEQ ID NO: 60683 - DNA, 1039 bp, Homo sapiens
ggccaattggtgaaatcccatctttactaaaaatacaaaaattagccaggcttggtggcgggtgcctataatcccagctactcgggagactgaggcagtagaattgcttgaacccgggaggcggaggttgcagtgagctgagatcatgccactgcactccagcttgggtgacagagtgagactctgtctccaaaaataaaaaacaaaaacaaaagagtgtccattgtgtatactggaaaaattgagattgggattttgatgtgaagtgcggaaatgtggattgggtccatttagtttacctaaacagatgatgaaatactaactgttttacaaagcattccctagtgcaaagttttgcctgtgtgtgtagtgacaggaacagtgagaatgaggcttggaacgcagagcacactgtgggcctgtggtaggtggggccagcagcacatgcatacctggctcacagagcagcctttgggtgttcttttcccagaggagctctacggtgactttgaagacttggaaacaggggacgtgcacaagggaaaatcaggccccaatactcaggtatgactttgtcgtagctggctgttcttggtcattgtgttctgagagaggcccacattgagaaatgcaaatcttacttgtgatgtgtgaagattgcagactggatagatagattccttcctaaagggtggggatgtggggaccaaagagaagctttcttgtttacttgttaagttttggatgacagttactaccgtttcttgccatagtcatttgccaagtccactgtgatttttcactcacggaagtcttagcttcttggacttacattcaaccattggcatcattctcctttttttaaatttaagtgtcatttaaaagaatgaagtccctgttctccctagtatttctttagaacagggtctgggagcatctgggtgagggacacgtctgttatttttattctagtttgtgttcccagccagcttaaggattagcagctaattgtaatgcagatgtaaccatttcctgtagc

SEQ ID NO: 60684 - DNA, 1078 bp, Homo sapiens
ttgacctttgaaaggcatgactaggctaactctgaagtttttgcttcacaccatttacaatttaaaattacctagagccttgtgggccattggaaaagactgaatgtttcactctgaaatgggagtccttggagggttttgagcagaggagaggtaatcagatcactctgccaagagatcagtcgggtggcacaaaccagaaggctggcagtggagatgagagaaagagtcaaacccggatagactttatttggaagctgggtcagtaggatttcctggtggactgaatgtggggtgtgtgagaggaaatgaggatgtcgactggaagttcctggaaggacgggttgttgtaagttagataggaaaccctctgcagatgcagttttgggaagatgatgtttggttcggctgggtatcatgcagacaagtgaaatgtcaggtctggagagaggtctggccagggacttagatgtagatgccctcagcatgtagatgccacttaacgctgtgaggtggccgggagtgagtgcagagtgagtgggaggagcaagactggcatgggcgagatggggcgattgtggccgtgagtcctgagcagtgcctaggagggagaagcagtgtgagcatgcaggcacacaggaggccagttgtacatggaggcgaagcattgttcagatcctgctgccatgttaactacggtgaaggcagagttcaccactggaggagtccttcagcgtggaggccttcagcaatcttggcaagcaccaattttcatggatgtaggagaatgggagcagaggaactggaggctgcaactgcagaaaacttttgtggggttttgctgcagagagaagcagagaaatgaagccgttgttggtggaagaagtggaatcaaaaggttttgagataagagagagaacagagggaagagctgttggaataaagtccaggaagagtggatggtgtctagtgagcaagtgatgtgtggccctgagtagaggcatggacaaatattctgtgcctgagctgcctgtagaactttctgtgatcatcgagatgcacgtcagtgcttcccaat

SEQ ID NO: 60685 - DNA, 1049 bp, Homo sapiens
ttcaaactcctgacctcatgtgatctgcccacctcggcctcccaaagtgctgggattacaggcgtgagccactgtacctggccaaatgtgtagtatttttaatagggtaaagcctacataattctgtccacagttcctttacttagaaattgctcatttgttcatgttaatcttatgtttattacagataacagcatacaggtttttttattccccatcatgtacagctgaatcgcgcagaatttgaagatcaagatgatgaagccagagttcagtatgagggttttcgacctgggatgtacgtccgcattgagattgaaaatgttccctgtgaatttgtgcagaactttgacccccattaccccattatcctgggtggcttgggcaacagtgagggaaatgttggctacgtgcaggtgggtccctttgctacatatttggtgcctgaggctctgtggatttcccctccatcaatcatcttaccctctcgtcccctcagatgcgtctgaagaaacatcgctggtataagaaaatcctcaagtcccgagatccaatcatattttctgtagggtggaggaggtttcagaccatcccactgtattatatcgaagaccacaatggaagacaaaggcttctaaagtataccccacagcacatgcattgcggagcagccttttggggtaaaatatgattacaataacttgcctgttgccaagattaaaccttacaggctgcgttattatagctttgtgcttttctttcataaaattccactcctaagatttttctcttttctgggagcggggaggtggtttggagtatatatgtaaatctatatccaaatctaaatgtccatatccagtatgttaaactagaatctaaaatttgtggttcgctatatttctttttttccttttcctttaaggccctatcactccacagggaactggtttcttggcaatacagtctgtcagtggcataatggtaactatcttggatgatttcttttacagattggtttgagaaatatatcctgggtgtgggttatt

SEQ ID NO: 60686 - DNA, 1839 bp, Homo sapiens
attattggggatgatgtctttaataatacatttcaagataggagaaacttgttctatatagttgactttaacaaaagcctagggcaaaactttcaatttattaacagtatttatgaggcagttaagaatttgggtcatcctccgtctccactaaaaatacaaaaaattagccaggcgtggtggcgggcgcctgtagtcccagctactcgggaggctgaggcaagagaatggcgtgaacccaggggcagaggttgcagtgagccgagatcatgccactgcactctagcctgggcgacagagcgagactccatctcaaaaaaaaaagaatttgggtcatctcaattaaatatagaatttaagattaccttgaaaattcagtgcagagtattttgccttcatctgttgtttgagtctcccttcttttagccatccttccatcagaaatagaataccaagttaaacttcttaattagaatcaggaatcaggactctttggctgctgattgaaggaagaactgtccttaaatccagagtgggccagttgtggtggctcatgcctgtaatcctagcactttgggaggccaaggcaggtggatcacctgaggtcaggagttcaagatttcaagaccagcatgaccaacatggtgaaaccccatctctactgaaaatacaaaaattagccgggcgtggtggtgtgtgcctgtagtcccagatacttgggaggctgagacaggagaattgcttgaacccaggaggtggaggttgcatgagccgagatcacggcactgctctctagcctgggcgtcaaggcaagactccatctcaaaaaaacaaaacaaaacaaaaaaaacatccagagtggttgatagtcaagacaaaaagctagattatttttgttagtctgggaaataagcacctcagtggcccaaagacaaggcctgaaatttccatgaaaagaaactgggatctattcatctgttctgttgagaccccatagttccataccatagaaatgggcacagtgggttttggggggagagttgtaagtgtaagctgtctgttcctctgtttactgagaattgtgggtgtccactgaggcagttcatatttggcagatgattgagtcctgatttctcagggccggcagactctggtgttactaatcttgtggaaaagtcaacccattgagaagattttatgcagaagttttaaatgcacattgatcataatttgaatatgtcacagtctttgtttttcttttcagccaatcctgaggcaaaagaaacattttaattcactgcacattccaaaagccttgcagaaggccctgccatttaagaacaagcccaagacccaagcaaaggcaggcaaggtgccaaaggacaggcggagaccggccgtcatacgcgagcctcatgaaagaaaggtactgttgcccatgctgtactgcacgctgcgtttagataggaaaagaacactctcaatagcacacttcctgtttctactgtagtctcagttattcagggcactggaactaaagtcagaggaagagccagagtccatttccctttctttgcctggtcctgctctgccctgtgcttttcatgggggataacaggtacatggctggggaacccttctgtctcggttagctgcacacagtgtccacagaatgatgaacagaggtggtaaaggtaaaatgggatcacacctgtgtctccatgccaacaatgacttcctagcacaggatgcattttcatgcagttaatattcatttggatcgtgggttgcctctagtcttagtgcttaggatgcgagtgtgtggtgtctgagagcatt

SEQ ID NO: 60687 - DNA, 1409 bp, Homo sapiens
ccagtctaaagccatgaatgaggcctctcactcccacctgggaatgctggtcttcagggaggaaatagagacgcatcttcataaacaggcatacaggacaaacagtgaagctgttggttgaaatcataattaatgcgttactgtatgaaccacaaaacagcactatttatttagccttacttctacttccagatgcagtgcctcttttggagaagacatgtttatttttcatgttctttctgacattactttagcaattcaacttgatgtgagaagaaaaaacaaatgtttcaacacaaaatctctgttttgtgagaatactgcactatggaataattgacaaattgaaatctcatatttgtcccaaaagttgttttgagttagttctacctggtgcccatgttctgattgtgtgtgggattgcatggtgtcctgattgcatctaggtggagcggatggaatgtgctgggccactgttgggtggagagcagcacattcttacagaggagatggagcgttatgagcatagtatgtggataggtatcttcacctgcccgcccctgagtcagcctccttgacttgatagcttgaagaatccttttccactgaaatagaggataattaattgacacatctgaaatccccaatcaatcaatcaagagaaaggtagaactaaaaactccttaacttactgttgcttacacccctgaaagtctgtttttaagcaaatgggtaatagtagaaaataggttagaatctatggcttgattaaaaatatgttattacattatcatgttcaggattaggattagtagtcagttgctgtaaactattttgaacaaacagaaaagaacacggaaacatttttaacagagcatttaattatgttggaatacaggatcctagctctgtctgggaacattagtttatttgagccagctctatcagggtcttcccatggtggttcagaatagatgagcatagcatggttttgtttgtttttgctttcaattttctaatttggcatggatccatatgtatttactatcctttttctaatatattaatatatgctacatttgtatttgcattactataatactttgagttgaaaaagagtttcattgtggagagaaaaagcaaatggtatgccacaagatcactctgatttgagaaaagggaggaggggaagatagtctgaatggaaatctgaaatacggaatgttttagagaaatatgtcacttgcatatagaatgttttaattgaggtataaattaatgagacaaagtgaaaaagaaattatattcagataggactgcactacattatttgtcacacatggatctgttaccatcaggtcaattcctagtatgcataaattttttaacccttttaaaagagacctatg

SEQ ID NO: 60688 - DNA, 1480 bp, Homo sapiens
accacacagccaatatcgctctgttttttttttaggacatttcattaccatccagaagtgtctcccactgaaggcatccgtggttgtttttaaggtaagctattttaagaagagccccttttcagctgcagtatttatatttgttatactcaaatttgtttagcagcctggagtgaaaaaagttttgtccctaacattaaccttgagcaggacaccacagggctcttttcagcttgagttttagttaatgaaaagccttaggacttctgagaaatggaacagaaaaccaattctggagtaaaaataagcagtaagtgttttaagtgtacacatgtgttttggaaaggaatggtctcttcgccttgccttcagagaggaagtaattttgcttctgaaacatttcctgatgcaaaacacttatgacatgtaaaagattaggcattttaagtaattcttctatgaaatgtttttattttttatgctgcttgtatgtctttttcagcctagccaggccactgccttcttgaggaaggtgttgacccccctacacatgggcaacagttaatcctggctaatcttggaccagctgggtcaagtctgtgctgaggatggggtcatggtggccaacaaaacaggcacaagtttctccccagtaggctcctattgtgggtttaagacccctttaacaacacaagagtgctgtggttagtgtagagcatgagacttaatttggataatgagaagacctttgagaaaggtggtgtatttgagcttagaccttaaggattagtgggatttaggtagacagaaggttgaacagagtatatttggggagagaattaaccatgagtgtcaactatgtgcgtcacatccctgaaggggcagagagcttgccacattccaggagaaaaaaggaagtgatgtgagcttaggtagaagagtgttgcaggcaaaagttgcaaggcctgagggaccccattgggcctgtggtccttgttctgaggtcagtgggaaaccactgaggacttggatgcaggacagtaatgagttttaaaagtacacgtgagccgtagatgggattgcagtaaggcctagccactgtgcttggaaaacttttttttttttttgagatggagttttgctcctgttgcctaggctggagtgcagtgacgcgacattggctcaccgcaacctctgcctcccaggttcaagcgattctcctgcctcagccttcctgagtagctgggattataggcatgcgccaccacgcctggctaattttgtatttttagtagaaacggagtttctccatgttggtcaggctggtcttgaactcctgacttcaggtgacctgcccgcctcagcctcccaaagtgctaggattacaggcatgagccactgcgcccggcctatgcttggacttatttaaaagatatatcggtaatctggaattggctgtttgtacatacaggaattagaa

SEQ ID NO: 60689 - DNA, 3096 bp, Homo sapiens
tatttgtggctctaaaaagggtcttttaaagaaataaaattacagtataatgacaacaaaatttacaattctgcaatataaaatgtcactgatcatattatcgaaattgctttatagttgttctccagttcatttgaattaagattcagaggtccacaaaattgcgttagttaaaagtttaggaattgcgttaaaaaaattttttttcaaagattttttttcaaaatctttacgtgtgtccatggtcaaatgtacaaaccaaggtacgtccgctagttccattttagaggcggcctcccagagaggggctgtgtctaacttgctggcttctcttccactctgcactgcccgcccttccccgtggctggcactctggactttccccaggtcgcgctcgcgcctggctcccttcgggagaactcggagaaatgtcttcccgccgccctgactctctccttcccccacttcctgcctgggcccagcgcgcgggccacggggccgcacctgcaggcacgcgtttcccattggtgacatcttggcgggcccggcaatggcacttcctcctctgcaccccgtgacccacgtccggctgccggtcttggatcacgaggcctccgcttcccggactccggaccccgcgcctcctcggggccgacgggccagtccctggcgtggtgagccgccgcgcgggcgccccggccccgccactccagtcccggccgccccccccaggtccctttccgccgccccggtcgctcggagacggacgcagacctacgagcgcctcttcccttccctcccttcagccgcgctcggcccgcgggtccccgagctcccgcctaggcagcgctagcttggcgggccggggagcagcccccaccccaccttgccgtcgccctcgctctcgccctcagggccccggaagcccgccaggggccccctcccctcccctcccctcccctccccctcccgcgaggcgcccttccctccgggaaccctcccgtccctgcccccactctccccgctgcgccgctcgctccgccccccgcccggaagctcccgcccgagcccgcgcaggccctggggccgaccttcctgccgggccgggcggtccgaggctgctggagtgccgtgagcaggccgcgggaacgtcgccgtcaccttgtctcggggcctcggcgctgcttcccgccaaaacacgtttaccgcgcgcccgggcctcccaccttgcggaagggaccccaccaccacttggatttctgttgcaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggtaagtctagagcatgaaagtccgcgggcccggccgggtggactttggtttgagagtggaactaagtgagtaatgggggcggcgcggccagacgcgctcccagcctcctggcgagagtgctgcccggtttcccgggggcacgggagtgtgtctaggaggggaggccaggatccttcctcgagtcctgtcctgaacaaaagaaaacgaggtgggtggtgcttgaacggccctgtttactctgcagatagccgaactggtaggactccggcgcgccctatttatcttgattggctctgcctgaaggcaagcgttaatcccgtccaacctgtatcactgcgaagagctcgttcgggagcgctttttggaaatgcagattcttagcccccacccagatctgttttagggttggtgttttaattatctaggtggcccccgtgcaagctcgatctgaaaacctccgggtccagtcacctgggggagctgagcagccctccccgcccccagcgctttcttggcgctgcggacggggagaccagactcttcctctgcgtgcgttggcggtgcgcagtggccgtggtctacaggcttacagcggctggtccattggggtaaatgggtgtacgtgggtctggttgccagcttgtgcatgtccccagagacgcctcagggtgttggtctgtggatcacgcagggataaacaagggcataagtggatcagatcattaagatgactgggttccaccctttagatccttgaacaagtcggattgttgaagccttttgaaaacctgattccagagtacttgaaactgtttcacccctgaataggtttcctaataaatgtaatgctttccatttgtacacccccccaatagtgtcttaagtaataatcactggaagtttgcaagacaaggcagatttgattatcttcatgttaagacaacaggttcagcataattagctggttttactaattccacatttccaaaactcaagcagcttagttctcagaattccatagccctcagcccgtgtcctagtcctttggggcagcgtttttactgggatgttggtgatctagtgattatgatgtatgttctagtgaagcatatttcaaagaagttacccaataaaactgaaagtgtcttttggatgtgtctccacactgcttacagaggggttcctataaatcagactgaacaatttctagcaagcacccttgctccttgcccatgctatcccagtgaaagaggggtcttaaggtcaagtcccctgtggttgtcacttctcccccacccatctccctcccaagtgccctgcccccgatatttaaatttcctcccagcacttagggtcctcagtgtacaaacttagaattgggcagaggcgggcggatcacctgaggtcaggagtttgggaccagcctggccaacatattgaaatcccatttctactaaaaatacaaaaattcgctgggtggggtggtgcacgcctgtaataccaggtactgaggcaggagaatctcatcaagagtaaatctcatcaagatcaataaggcgtttcccttttgttgtgctctgtattgccctgtgaaaagataatacttccaaaatgctgttaggtggatggggtgtgagatttaatttaaacccacgggctatataaagggcttcccagctgtttctgtccttac

SEQ ID NO: 60690 - DNA, 1631 bp, Homo sapiens
cagggggctgaggataccccacaggcctcctttctctccagctccagggtttgactatgcacctatttaggggctgcttgctcaagggagagaggtacaggaggtggtctgggaaaaacaaaattgatcttcctatcaattgtatttttgtttagcggaatctatacacacccatttctttggatattatttccagttactccagctaatccaaataatgatatttgccctcagttaagaacagattttatttttaggaacagaagtctagtagcagttttgctttttattaacgttttaaggaacatttaccttagatatcatgattcttgggcatttgcaaaatgcagtcaatatcaaacagcaatggttgcttgttttatgatcggtcagaatttgtcccttatattaatttcagtacaaacagtatagataaaatttatctaacattacattatactactcttgatgctttttagtaacacagcttttgagaaatgaacgctgagggaagcagtgtgttatccccccagacttagctacagcaagtaagtgaaaggacctgatagatggtaatggaaaacagctttcctgttgcatgcagatcaggacagatcccctttggtggatataaatgtagtaataatggagtaaacatttaaaatgttaatatatgctccatctgcagcttctcagtcttttttttttttgagacggagtctcgctctatcgcccaggctggagtgcagtggtgcgatctgggctccctgcaagttccgcctcccgggttcacaccattctcctgcctcagcctcctgagtagctgggactacaggtgcctgccaccacgtttggctaatttttgtatttttagtagagacgaggtttcaccgtattagccctcctgacctcgtgatccacccgcctcggcctcccaaagtgctgggattacaggcatgagccactgtgcctggccacttctcagtccttaatagcttttaggatagctctgtgtattgaatttggcacgttgtgtgaattgggttagaattctcacacttcagatacatgtgcccctgaaaagttaagtacaaatgtgtgcgttggtgcatttttttaaatggaattagtgtcttgtatcataattcttgagttcatgacagcaggaagtacttaagagtgactgaataggaattttataaaattgctgggttggaagatacttttgaggccattaaacccaattttcaatatttccaacagaaaaggaaaacatccataacaaatatggtctatgatctgctcacatactatataccatgatggggaatttttgcccccaagatgcatcttgtgcttctcatgtggtgaacagacacgagcagcagaagctgtgtcctaaaatttcttcaatctaaaggattcaccacgaaataagaatatgaatacaaagcatccagcaccaaaatgtatcccagtaaagggctttggtaaaaaatataaataatttgaacaagtgtccagaggggagataatgtacagaaggaaaaaagaataatgggcttttaacttcttttttttccctcagtttttatctttttcctatatagagatgggagtctcactatact

SEQ ID NO: 60691 - DNA, 1062 bp, Homo sapiens
cttgggcttctgtttcctggtgtccagggcaaagggctgagccgggcagtagggcctagtcggggcctggctcgccgggagcaggagggcttccggcaaagccgcgtgcgctcgacgggcaggcgctgaggattggggccggcagcgcgcctgaccccgcccctcgtaggctccgccccgtgctcgcaggcgggggtttccatggtgatggtcaacaagcctcaactgcctctgctacaactgccaagttccccgcgtcccaccctcctctaggtgctccaagggaccaccggggtgcctgatatgagagcgggagtgtagagactcggaggccgaggtgaggggcggccgaagtctccgaggtcgaaggccgcacacccgggacctagcggggaccgggtccccctgggggtggggacggggggtgggatttgagattagggagactatccgaagtccagggccccgtacccggactacctggggactgggcctattggggtggggatcgttgggctggggctgggatttgggatcagggaagagcgatctgagtttaagcgccgcaaacctgggaccgagcgaggactgcacataatgaggggccgtggcgctgagatttgggtgacgggattcgaggtcgaggggcccgtacgtgggaccggcaagaactggacccactgggatcgggagacgcagcgtcggaggtcgagagccgcacgcccagacagtggtcccacgcggtgagcaccgcgggctgagattttggagtcaggaaagcgcggggaaggcacggacggccgggtgcgttagtccggccccctggcggggagctggcgactgccggagggctctgaaagtgagaacaggcctggcgcagtgggaggcccagccgggaggatctcttgagcccaggagttcccgacaagcctgggcaacatagactgtctctactgaaaagtaaagaaaaaaaaattagccacgtgtggtggcgcgcgcctgttgtcccagctactcgggaggctgaggcgggagggtcgcttgctctgaggtcgaggctgc

SEQ ID NO: 60692 - DNA, 1018 bp, Homo sapiens
gtgtgggaagggcttcagccagagctccaaccttcacatccaccagcgggttcacaagaaagatcctcgctaactgacattagcccattcaggtcttcacagcgctcatactgtaaaaactgttaaatatttagtatcactcttactttatattctacaaaggagagagatgtaagggttatttagatatgttccctcactgaaaaatcactcattcaaaatatttaagtatcaagcactttgttatgctgtacaatgaatggattgttcttgtttctcagatgggtagagtaaaagtgtctgtactttacaattcaactacatgttctacccagcattttaacggcaagaactttatatttattctcaagcagggcatgtttccctttgttcacattctctgagaaattgaaactctggtttctcttcaaattttgtgccttgtgtttttcatacttctttccagtcctgattagccccctctaaactatgattgtacactgcgtccattttaggccaagagggcagttggaaatacaatggacatggaaattattgtgtttattgcaaaaagatataatagtttgtagccacacaacaaaaagctggaagagagttactcatgtagtacattcccatataccattttgataggaagttgaacagcccctcccaggcaactattcaggaacataagtagtcctttttggtgagtacagctagtttattgggatacttccagagtgaatgtgaggaagggtccaaagtaacatgcctggcactttgggaggctgaagagggtgcatcacttgagcctaggagttcgtgaccagcctgggcaacatggcaaaatcttgtctctataaaaaagtgcaaaaattagctggtgtgctggcacagacctgcagacccagctactcaggaggggtacctgagagcaggtgataataacaaataggttccagaggcagagctggaaaaatgaatacataaggagcagggggcagcttagaggctg

SEQ ID NO: 60693 - DNA, 1041 bp, Homo sapiens
taactacagataactggagagctgattggctccaaccaatcatgaaggctgaaatgttgttttcttagattctgaattcctctggggcttggagggaagaaagtagtaggtggttaggtggggaaccaaaatggaagatcccaattacatgccaagaccaaagtgtaaacaggagtgactattaacttgggattggcaggaagagatatatgtttatgtgttctctgctttcccacatcctgcttcctcctagactcatttgtgtgtggtcctggtacctttgggcccattttgcagtgatattttagtaactgacattatgtcaaacaatctaggtttcttacattcacttatgtctcaacaactgttgactttttccttctcacatatcaattattctgccctttcctgtttgtttctgtttgtttttctccctcaggtgctcaggaacagcccatggaagaatcatatgaagaggtggtgactgaggtcgtaagcaggagtggacatgtttggatttccaacagctaccctgctggactgtcatggaagatatgcccagaatgtagcgttcttcagtgagtgagtcagttgatggctggatgcgctcagctcacagatattcagtgtccctgttctcagcactggtcggcagtctgaggaagcagaggagaccttgctttggtagagcttgctgttcctagggttataagaaaagcctgtgagctggagttagaagtaatagtagaaacagagcaagagaaccatcttgatatggaggtagcgttgaagtagtctctgagaatgaatgagcagcttaaatctcagcactgtctctgaataaggcaagggaacaaggagaagattaccctggagtgacagacaccaagaaaactgttaatggtgatgaatggacccatatttaaagtgcaccaggaggctcagatgcagggcagtattcggaaaaaaaaaagtcaatatctgcatagagaataacttccaaaccaaaattgatttcagttttgccatagcttagtagac

SEQ ID NO: 60694 - DNA, 1042 bp, Homo sapiens
ataaccaggaccactgccatagttgccaccatcacctcctaatccattatatccacatcacctcctccataactacctctgctgccaccacctccaccaccatagcctcctcttccaccaaagtttccatcacggccaaaattacctccaccacctccaaagtttcctctgtgacccatacaattgccagatccacctccacgacccctctgtgatccagccggctgcatcacttgtttagcaagggcctttttcacttcacagttatgcccattaatagtgtggtatttctgaacaacaattttatcaactgtatcatgatcatcaaaagttacagaagcaaatcctctcttttttccactctgcctgtcttccataacttctatggtttcaatcttgccgtacttttcaaagtagtctctcaaattatattcttctgtatcttctttaatactgccaacaaaaattttcttcactgttagatgggcaccaggcttcacagaatcctctctagaaacagctctctttggttccactacacgcccatcaaccttgaatggtcgagcacgcattgctgcatccacctctgtaacacaagaataagtcacaaaaccaaagcccctggaacgttttgtttgggggtctctcattaccagacaatctgtgagtgtgccccatttctcaaaatgttctcttaaactatcatctgtagtttcaaagctcagaccaccaataaacagttttctcagctgctctggttcctttggatcatggccctcctccccccagtggcgacggcgactgccggagtcgggctgggggcaaccaggcggcggttttacctccattttgagacaggactcacctcttccaactcgagatcaatatgggaccgagaggaaggtggccagcgttttcatttaggcaactctgcctggatcagcacactttccctctgcagttcaggacttactctgaacttcattgataacttgtgacttcaggaaaaaccacactgtcttgcagtatctcaattgagcca

SEQ ID NO: 60695 - DNA, 1001 bp, Homo sapiens
gatcttctcgcgtgcttattggccatttgtttatctttggagtgacggctatttaaatccttcatctattttttaaatcaggttatttgtctggatactagactcttatcaaatatattatatacaaatgttttctcccatgtgagttgtcttttcattttcttgataatatcttgtgatacacgtttttaattttgatgaagttcaacttgtctgattgtgtgtgtgtgtgtgtgtttggtgtcatatcttaaaatgcaaggtcatgaagatataccctatttttttctatgagaattttatagtcttagttatttcatttaagtctttgatccattttgagctaattttttatatggtgtatgagacagaggtccaacttcattcttttgcatgtggatatccagttgtctcagcaccatttgttgagaagattttgtggttctcatttaatgatcttgacactctcataaaaaatcaattggtcataaatgtgagggtttatctatagattctcagttctagcccattgatctctttgactgtccttacccaagtatcacactgttgcaattgtcatagctttgtagtaagttttaaattaagaagtgtgagtcctccacattttgttcttttgcaagactgttttaactatttaggatctccttgcaattctatgtaaatatgagaaccagtgtgtctatttctgcaaaagaggaggttgggaatttgataggagctgcatttgagctgtagattaatgtaggaagtattgccgttttaacaatgttaacttattttatccatgaatgtgggatgtgcttccacctatttagttttttattttttatttttgagaaggagtcttgctctggcaccaaggctagagtgcaatgtcgtgatctcagctcactgcaaccttcacctcccgggttcaagcgattctcctgccttagcctcccaagtaactgggattacaggcacgtgtcaccacacccagc

SEQ ID NO: 60696 - DNA, 1049 bp, Homo sapiens
ttcattggttctcattcagttcccgccatcgaaaggccccgtcccgcagctttccacgcgcgccccactttacgcctaaggtcctcagtctctccagtggggccctgtcacagggacaataagcggccctccagccggcgtcgctcaggctgcggacctcactgcagaccgggccagcggtgcggggcccagcggagcctgagaaggtcaaaggccggagcgcactgcgcctcgggagcacagagggagcggaggaggggcgaaggggatgggtggggggtgccgccgagggagtcgcgcgtcagagaccccggccacggccagcactcggctccgggcccgcccctcaccgcgcgccccgccccgccccgcctggctctcccctctaaagcgcccggcgcgcgcctcccaccgccgcactttcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacggtaagtgcgctcggcggggaggccctggcgaggctctgggcttcggctcccgcccggcgcagagccgcggctcctctgcctgcgcccgcagtttgcgccgcccgacacagtgggggtggaggcagctcgcttagctgggcgctctggtgcggtgtcgcgttcaaagccctacttttgcgccgagggtttgtgacctgcagagagcgaccgcctgacctcaagctggctgcagagcgaggtcagccgggacaactgggcaggaacgccccaagagagcgttcgggactggcgcgggaaggcgcgagggtggggagccgcggaccccagacccctgcctgcccaccctccacccactgccttcccgctgcgggctcggtttccacaggcgaatgggctccgaggtcctgctgcgcacagtgctggaggtcgggcggtgcatggcgagagcgcgctttgcaaagttcgcctcatgccgcgacttga

SEQ ID NO: 60697 - DNA, 1045 bp, Homo sapiens
cctggcaagtggacgctgctgctgttggaaggcaccgggagaagggtgaggctgagacacagctaggacagagagtgcccacttctcctctggtgggtgtgggaccctgccgggcctggtggccataggacctggtggcgcaggaccccctcccaggtgcagtgtgggcagagaggtcccctgcttggcatgagcagacaggctgtgcgtccctggaaccacttcttcaccgcggtgtggacgtgcctgccggccagcagctggcttcctgtgggacacctgactcagccactgtgttctgcgctgtgcccctggccaggcatgagctgagcacatctcaggctccctcccacagggcctggtcacacgccccagggcacgtagtggctgatggtccttcctgaggggatggggccactcaggaggagggatgtgcaaggcctgagtgttcagagcatcccatccctagggggcacagggaaggtaggcagctgctctgggggaagggctgatgtgtggacccccacaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctgtgagtacccggtggcttctgtgacacctgctcagcctgagctcccgggttggggatatcccgagcctcagggtgggagccctgttcccttatgggacactggcacaggagggtgacccagcctcatccccatgccctgtgactgcctcagtccacagcctcgcccagggtggcctctccctccttcctggagaacattccaggctcccatgacctctatttctgtttctcaaaccttcctgcaagccaccttgctggcaagaagggacgactacagccaggggggctcccaacacctatgcaagccgaacatgtctcgccatctcttgttctatctttaaaattcacacgaatttagcctcttactactctg

SEQ ID NO: 60698 - DNA, 1099 bp, Homo sapiens
tttaccagaaaatggaataaagaccttcccactggcaaaatagagccagggttcacccaggatacatctggccccttagtcccatggaaacaaggcccaaagcttatccagtctgaccagatgatttgtggaggaaccagccctgcaaaatgtgtcccgggtgtgtaggacgcaggtgccttgcagctgcggaggggcagcgggatatccttgccaggtgcagtggtgggcagcatccccctgccctcagttcctcagtggtgatcagacaggaagcttggtcgatcagagccaagcaactgagtataaaaacagccagatgcatgggctatatttaggccctgagagctgcgattgtttgggatcaggctagctgctcacgtgccctgcctgagactcacgttgtgcagggtagggccctgtgccctcctggtcaacttttaacagagatgttttctcagacctaggaatgggaactcccagggttttctttcccagagagtccaaaggaaacagaaagccaagtctcaggcttggtggaaagaaccattgttcaggatccctgggctgagagttcttggtgggagacggaccactgttgttaccgcacatgagccacacctataactgcctttctggcacttgggctggggatccatgttgccaaacacagacccaaggcagcagtgctccctgctgagacagcgtgtgtgtgtgtgtgtgtgtgtgtgtgtgtgtgtgtctgtgtgtgtgtgcgcaagccagtggtgtgcaggggacaaagacataggaaaatgaaactgtcttgccaggatttttctcaccccagaagactctttttcctggaatgaacccttcaaataccactgggctcagggacacactggtccctgctgggtagtttcccagagatgtcccagccactaagggatctggcctctcttgggccagaatccccagaaatatgtgcagaaagatgcccagactgtgtccaccccctgcctcccacacccttgttccctttctcccttgtgttttgtaaatatcatgcgtgaccattttcaataatttaatttgcataaaaattgcctagaatccc

SEQ ID NO: 60699 - DNA, 1100 bp, Homo sapiens
ttcactgcactggtagggtttctccccagtgtgggttctctgatgttgaataaggtgggagctctggctgaaacaccggccacactcatcacactgatagggtttttctccagtatgaattctctggtgctgaatgagatttgagctctgtttgaagctttctccacactcatcacatttgtagggcttttcccccgtatggatccgtcgatgctgaatgagattagaactctgaaagaaacttttcccacaatcagcacatttatgggatttctttccagtatggatcttctggtgttgaaaaagagttgaactctgactgaaactcttttcacattcagtacatttatagggtttgtcatccaagcttcttctgagtctactgaagcttgagtcaaatcgaatagtcatgccccacttctgccgctgccggcctgttttgcgcttgttctcataggcctttccttggcttgagctccgagaaatacccgctttaggctttgctaacctcatggtgaataaccaaatgtatttgtaagagagtttacaggcttcttctgaactagtgtttcatttcctagaggtgtacagctcagaattttctgtgtgtagaaggaaaaaaaatttagagatgatcagaaaaaaaattacagatatctgttaactattcaattttaatatctcttcaacccaccaaaattgcattcatgtttaaatttaaaaagtataaatgcaaacaaagataatatggggggaaatttgggggaaatacttgcaaagtaattctaacaattccagagtttaagcttaacaaatatcaccaaattttgactgagtttaccactggagtttctgtctattgggacaagacaaattaaaagtgatcaggtgaaatataaatcttccaagcattaccaaatgagtacataattttgaagaactaaaaagtggagataaggtaaatcttaatgggaatggagtaactccaaaagacaatcaaaatttgtgtaacagaacattactatgctttaatatttagttccatgttaaacttctactaactagtaactgcctaaggtatccaaatgaataagaaatga

SEQ ID NO: 60700 - DNA, 1263 bp, Homo sapiens
gcatacacaaaactaatgtgaatagcattgatagatcctcaaaagggccccatagccacaatcctgccaaggagtgacttggatataatagggcggccaaagatcactgctttcataaaaaactgtgatcacctcatgtttacaaaacaccttgtgaatatcttgttgaatggcacttgtcaacaaggccataacaaggccaacttctatggccctgcactcaaatgcaaggccaggaggaaggcaaagttcaagtttgaggaaatcagaaacaggcaaaacaagtgatccatccaaaagctgtgactttagatctattgtctaaataattaaaacaattccccagaagaaaaataaacagaaggtagtagtatacaaaatatttcattttttattttcatgaataattgtcattaatacagcagaaaccgatatgattataaaagataccaaaaaatcagaagaatgttagcattcaatagaaattaaaacctgagctgagggctcattagagtctgacacttggcaccattctcatggaagtgaagaaacatgtttgccggactccttaaaacaattcatgtaacacagaaagagttaaatttcaaaggagctacaatgtactgacacattacgactcttgttgttgacaaacatttaagcagggctatccaaagctcacagtcttgaaggcagggaggtgtgtaaattgtaggtttttaattaagcagtaagcaagctgagatttttcttggtaaaatagtttgtttattcatgtagatctaaaaggctggctcagtttgtcagagcacaggagaatgccagaagaggtcaagggcatggggatgtatcgacatgaatccatcccaacttgtggaaaacaaacgacacagcagttaccatcacaaagaactctattagtaggaatagaagacttgaggtccaattcagttctcatttggattctatagtatctctaagaatttggttaaaaaaaacaaaacaaacaaaacaaaaaaagggaaatccttactcctttcattaacaactgtccacaaggagaagaaataaaagacaactaatatagataggccttactgattaaaaatctgtgagcttgaatacattttaatatgttgaatctagagtgataaaccaatggttaatatactacaaaactttacaaacaaaatctcatctgttgcagaacttcaaaagtagtggaattgatttcttctcccttttttcttccacagaaagtcc

SEQ ID NO: 60701 - DNA, 1009 bp, Homo sapiens
agtccaggctttctcatcctgctgtgctcccagaacttcatcagccattggataaattcttcaaacaccttcgggaccaggggagacagaactattctctttttgaaacttggcatgttgcaattccgcatgtactgacttattcataccagtgaaactgaagagatccagctcctcagagtcaaggtgcccaagagattagctggttccttaaggtagataagagatgatgaatgttgagtgcctccagaattacccccatagccaatgataacagttattgtcaccattaatactcagcttgccttctgtggcctcaagcctcccctcctggctggctttacatccccaggggaggatgcagaggtatcccgttaatattcctttttggaccccagttccaagctcaaggatgaagatgtctcagcctggaagtgctgtcgggtggacagctcagaatgtggcctgagtgtcatctgagaactaactgcgtccaggtctgcaattagatcagtacagaggttgaagcctatagttccagcactttgggtggctaaggcgggaggattgtttgagtctaggattttgtcacaagcctgggcaatgtagagagaccccatctctacaaaaaaaattgaaaattagctaggggccgaggcgggtggatcacaaggtcaggagatcgagaccatcctggctaacacagtaaaaccccgtctctactaaaaatacaaaaaattagctggatgtggtggtgggcaactgtagtcccagctacttgggaggctgaggcaggagaatggcgtgaacctgggaagtggagcttgcagtgagctgagatcatgccactgtaccccagcctgggcaacagagcaagactctgtctcaaaaaaaaaaaaaaaattagccaggtgtggtggtgtgtgcctatagtcccaactacttaggaggctgaggttggggaatcacttgagtcctgaagttcaaggctgcagggagctatgatcat

SEQ ID NO: 60702 - DNA, 1086 bp, Homo sapiens
tctcctttctgtctcccagggcacatccagcccgtgcctgtgttcactgtgccccgaagtgcaattacccataccccttctcagcctggggaccccaggcaaccacagactgtccactcaggggagctgaatcccaggtcagccctgccaatgtcccttaggaactgcccaggcaaggcccctggttttgtatacttgttcctgccacccagcagtagatgagtgtttcaggtgaagaccaggatagattttctaagtgtgaatccccacttcacatatggaaccccttatgctgaacttgaaaagcaccaagacttcctgtagacaagaaagtgcttaggtagggacagcccctgggcatcccacccaatgtagctggcaccccactatggcaaaggtgccttgataactgagccctgtatccctcccatgcccagccagattctcatgggaagccctctcccttcttttctgcctaacaccatctcatcgtttctggcctcactgtggacaatccacacacattcttctttcctctcctggcggggcacagagccacccccttgccttttcttttcttgaaggttctagttcagctcctgattcatcagacccttctagccccctgcatctagcagtgaagcatgaagcctggtggggatgtggtactcccatctggtgtggccaccagctctgccaatgttcctgtagccttggaaaacttgctctctcggttcttttgggtgctgtgtactccccagcttccccccttccccccccattttgcacctgggtttagtgaaaggatggcatttggttgacccatatagaaacccagaatgaggtctcagggccaggaggcctggtatttgtaggccagggaaggggaagaggcaagtggtctggggtatcaccagccagccctctctgatttggcctctactccccataagtcacagtaccataagcaggcttctggcctcagcaatttggtctttgtgcccaagtttattgtgagaatttcctgaaaactctataaaaggtctcttcctactgtaggcctctaatgtttctcccctttttgct

SEQ ID NO: 60703 - DNA, 1067 bp, Homo sapiens
tccagcgggattgacactcaaaaaaagtctcacttagaaatcttcccttccttacctttgtatctcctttacatcatgagagatcaaaaatccattttgccttacatatgctaagaagcgtggcattctttctgttcataaaacagactcatgacttttaagacaggacaagcaggccagaggctttttttttaatcacagatctcatgggaattagtggatgctaaatggcaattaaagcatgattcctatgcttttgagcctgttttatgacaaggtgttactttgtagacctggcccatacatttcttttttgtcaacactgaaaaagaacagtttctgagatcgaaatggaaggaaaggaagtgagtaatgacaacaaaactgaatatttaaaaaatattcctttatagttaaatctctccagttggtgttggcttcacattgaaagagcagccatgtgccaccctggccggggtgtgtgcactgcatgcaggttctcccttgcatgcaagatgggtgctggcccactgtgaggcttctgctcggggaagttctgtggagtcactaccagggccaagaggcaggtgggctggctctgggacgagggccaggtgtgagcaaactgccagggtccgctgtgccactgctccccggccacatgcccgcccagctgtcgccttaaccagactgaacagacaggatccttcagggcccttggccccactctcagtgcattctgtcatcagggattaccacctgtaccattttcataaaacaaaaccaaaatcactaccatcaaatggccttgtccctctaaaaagtctgcttaaaattctgtttttaaaacccagtttcctagttttccaggcaaatagttacctccgggaaagttgctgggggggcctgaagcacaatgtagcgcagatgcttcctttccaggccattctctcacccagcctgcacggaggagatgggagatgctgggggtcctgccctcagtctttttgggccttaggcgtttcgttcatcctgctaaggggatgaagcaaacacgaggtgattcc

SEQ ID NO: 60704 - DNA, 1105 bp, Homo sapiens
ggaaagccaatcttacctacctacaatgctctcaccccaccggagcccttccccagaagcctgagcctcacactctgtgttgtctttctagtgggagaagttgcagatgacgtccagcgagcgcaggaagatcatgtgctcagtgacattccacgtcattgccatcacatgtgtggtctggtccttgtatgtgctcattgaccgtactgctgaggagatcaagcaggggcaggcaacaggtgagttctcaggctggagcaagctcagcatgggggccgggatagctcacaggagtcctggggtcagaggattttccagttagccaaaaacgtctgggtttccggaggagggacatcagttaggaggcactagcctcctttttggcatttcttttgctgtggtggtagtttttgaaacccagtcaggagagttcatattctggagcatgagaatctccgcaaactacatcctataaaagcaggaagtagctggacactgtcttccactcttctttgactgagcaacattggatgagttgtgaatccattggtcagtggtgcaggcttgtggtccccagatacttgaggctgagggatggaggattgctgaggctcaggagttcaaggctgtagtgtgccatgatcacacctgtgaatagccactgcactccagcctgggcaacatagcaagactccatctcttaaaaaacaacaacaacaacaaagaatcagttgattatgggaagttcagaagttgtgtttttctttacttcatatcttaaataaaatctaataggctgagtttttcccttccaggaatcctagaatggcccttttggactaaattggtggttgtggccatcggcttcaccggaggacttctttttatgtatgttcagtgtaaagtgtatgtgcaattgtggaagagactcaaggcctataatagagtgatctatgttcaaaactgtccagaaacaagcaaaaagaatatttttgaaaaatctccactaacagagcccaactttgaaaataaacatggatatggaatctgtcattccgacacaaactcttcttgttgcacagagcctgaagacactggagcagaa

SEQ ID NO: 60705 - DNA, 1048 bp, Homo sapiens
cttcaggctagtagctacaccttgttgcatacttccttggaaatagagagtgctttcaaattaatttctcacttattgctattagtggtcccaagaaaaagagatgaaattgcagcatcttgtaatggtgagttttttaggtctaggagagaggtactgtcatctttgtttacttgctgagagacgacagaaatgtgtagttgtggggtatgaaggtaaagtcagtgattatagctaaaaagcaaacgtcatttaaggtcactggtatttttggatgttggaatgcaggttttgttttacatagaaattttccctctaattattttaccatcttatgttctggaaaatgattccatgttgctttaaattcatctttcagtgaagttcttatttcttaccaaaaaatgacagctttgtcatttcttacatcgttttttcctttctgttgccaaatgccctccagactttccatgttggtgcggtaagctagacatttttagtttgtagtgattgttttcgtttgtgtttgtatgtttttgtgcccatagtcacttctgtaatgttcgtttctgagtttcctttggggggattaacctgccactgaagtgtcagcttccctgtcatgggactgtccttggaatgacaggttttccttccaccataggatctgccactgtgaaggagatgatgagagccccctgatcaccccctgccactgcacaggaagcctccacttcgtgcaccaggcctgcctgcagcagtggatcaagagctccgacacgcgctgctgcgagctctgcaagtatgagttcatcatggagaccaagctgaagccactgagaaaagtacgtgggaggaagggatgcttcacccttcctgaaaccagtgacccccagaaagctggtgtctcagatcatgaggtcatggcttgcctgcgttcatttccttaaaaagctggggctggtgcttacatttgcattgtagagattgttgtttctggtgctgattttcaagtccctcttctcaggaagaagctctttctgaccat

SEQ ID NO: 60706 - DNA, 1032 bp, Homo sapiens
tgattatttttcttaatttacagtttcaagattagatctgttgggagcattctgtgctctacctcagcccctggttgagctatggattggtgtcccccatggtgacgtggtctggactcccttttgtgtgaagagctgtggcagggcagtgaggttttgtggaactcagggagcatctggcactatgtatgaggttgtgaggtgggagagagctcttaaatctaccagccttgttgatcttgggaactaggagagagtgctagggaagccagtgccagcaggcctggagcctcatatttctttggcatttgtatgataccttctagtacttcgttttttgacttatatatgaactaactcaatttagatgcttagaaaataaacggccactggacctgcaagagattagtagtggtgttccatagccttagacatttcttacacttttatccacagataagaaaaaaatagtgatatttgatttgttttgccaaggcttagaaggatctaatatgtgttactcgttgagcagcgggaagcagcagacatttctagggtttctccctgtcaccattcaggagacagtgcacacaatccccttggctcttacctgaacactgaccacaggtctgtcattgcaggctgggagtcctccgtcagcatcagctccggctccggtgtcctccttctctcgcacttctatcacgccatccagccaggacatctgcaggtaacactctgcttcagatgctgccatgatcagtgtgcagccagaaataagcattagtgtctgtaggttcttgaatttccatttgcttaatcaatctgcctttggtctaaacagttggcgagttttatgtgtggtttgctcaccaagttacccatgctagtctcatttcttcactatgatgtctattctcttttaaaattgtttttactttctgtgcttttatcccactgttctgcatgcagttccagtgcagtgttttctgagtgttgtcaccacagttccgtgcagtctgctgttgtctc

SEQ ID NO: 60707 - DNA, 1083 bp, Homo sapiens
acagaatggcctcttttcttttaattgtggctcatttttgaagttgaatacaactgggtatttatcgaaagcagagttactcataatgaagcattggtttgacagagtaacttctgtgctaagcagaaagtttgtcaagatgtaatctcagtctgcacattgcaatatgtaaacaccaagtgagtttatctggctctgtggtatgaagtcaggcctgccgagttgaccgttaggagcagatccctatctcttagtttggaagtgggagggcagtaaccgctagcaatctcatgagcaggaagcacaaataaaaaagtgatctggtgagcaagatttctaaaacggcccccaaaaatgtccccacaattgcctggaacctgggaatgcattgctattattactcctatgatcatgttgtgttgtgtggcacagttgaccttaaaataagggagattatttggggttataaatacaggcccaatggaatcccacaagtgcttaaaaagcagagaacgttctctgactggtggcagaaagggaagtcagagagattgataccgcaagtgggctttgaagatgggaaggggtcatgtgactgcagatgcatgtggcctgccccaggtggagtcagccagcagacgggccctcagtcctcaagctttagggagctgtgttctgccaacaacctgagagaatgtgtaaacgcagtcctccccaggcctccaggaaggagggagactgaccagagcagagagtctcagcatgcgcatgtagactcctagtctgtgggaactgtgaagtgatacatttgtgtagttttaagccactaagttttgtttacatagcaacacacctcttatatgggtggcaaatgctttccatgtagaggaaaaccttctttctagagatctgtaagagccatttgcttctagagcctctgggccaacagccaacatgaactcttgatttagccatcttcttcttttatttttttttgataatttttattttctttgtagaaatacagtcaggcagtgactttcaagtgactttgaccatgatccaaagtaagaagtagctttt

SEQ ID NO: 60708 - DNA, 1047 bp, Homo sapiens
tctttagatatgactcatttggaaatatgtaagcatggacaaattggtgaaaatgaatattcatgtacttcctagaagaataccaatgagatggacgatttatttatagcctgaaaccaggaaaattcctccttgaagcagtttgtttcctggcattgatacgcagagctcccctcccccaccctgtgatgatggtctgcaggaactgatcttttactaaatgtaaatactgacctgctgatcacagggcaagcattttgctgctttttctgcatccagaactcattatgtagggtgggttttgtggggaaaaaaattttgttttgttctgtcagacatctgtggttaatcatttagcttttctacattaaaaaaaatatttcaagtaagtctgggtgacaggttggcacacaggaagagcaaacagatcctgtaacatttactgtcattgacgggaaactgagctttcattccttgtatggcaccaagtaagtcttagaatcgttacattgcagattgctatggggagactataggcagaggtgaaattggttgctagaatggacttgtcatgaattattcattcactgcctcgttccttgaaaatcagctggaggaagtagtccagtttgatggcaggagtggtatgctgagggcttcagcaagccctcacaagtccagctgcgacagccagccatgtgctgctgctggcagctgtagggtggcagctgctgtgcaggcagcgcctgttccccggcatcaagcacagggaccatgttgcggggaagcgctgcactgagcgcacaccaatgcattcttgttggaaaatgaagcttcaggtaggagacgtgccctgtcagctgtgcctggtttctcactgattcagggatgccattaggctttatggaacagacgtgtagaacccagagttgctcaaggatgcctcactcttgaggttcccagccagaaaaacttagcagtttaattttaatttcattttcaatgatgtactttgtttctaacaaaactgtttcttgaaattgcgaa

SEQ ID NO: 60709 - DNA, 1085 bp, Homo sapiens
caacatgtatttctaagagccagggtattctcttgcataaccacagtaaaattagcagtcaagaaatttaacaattggtacggtgttgttatctaattcatagtgcagtttcaacagttgtccctataatgtcctttattgcccttttgttttccatgtccagtatccagtcctgaatcgccatgaaattatcatatttctttagtctcctttaatctggagtactttgttaacctttcattgtcattcttgacattgatcttttggaagagtacagatcagttatttttttagaatgtccctcactttttacttgtctgaaatttcctcatggttagattcagttcatgcattttatgcaaggataacaaaaaagtgatttttatttttctcagtgcagcatattaggagcaacctgatgtcagtttgttctaatattgctgataacatcaaacagttggtttagttggtatctgccagatttctctactgccatgatactgtttttctctttgaagttaatatttgttgacaatgtgttaatatcctgttcctcatcaaactttcacccactagttttagcgtccagtgatgactttccaactgcatgcttccttctgtagctattgattggcattctactgtaaggaagacctttccctcctccctccacatcccatttatttatttgttcaattatttatttgaatgattcatatacatattcttatttagtggtctgtaactcattactgttattatcttgatactaaaatcatcccaaatttggtctgtgtaaactctttcaaactggcttctgtgttttcatatgtctccagaattctttgagtacctatttactttctggtgcaacaagatgatctgggctcattttgtatggcccacccctcaaatcagcttttcttcgaggagtattgttactattagtgaggaaaaaatggtatttggaaatcaagatctggatatatgatgtgcttattgtgactgatgtgtcattatttctaggcctactcagtggccacagctaggatatgtttgtttgtgtgtaaatagatatatgtata

SEQ ID NO: 60710 - DNA, 1022 bp, Homo sapiens
taaccctcacataccatacttcggggcctttttggccccaaaatttctgataaagacgtttctctttccatgtttccttgcatcccagtccctggggaagtaagtgtatgtttataatagtgagacttcattcctcattgctgatttagttgctccgatacagaatgggaatgggagacttttgaggccaaccgaatgggttaggacatatctgaaaaacatgaaaacgctaaaaagcatgaaaactgaaggagtatacgaactcaagtcgttgagagtcatgaaataatgtgaacatgctcttgtgtgaaatcttgagaccctggagcaagagaattttggattttgagagaactgagttcaggagagaaggatgtcctgtttcatatggtgagtgaaaatataaacagtatgaggtggtagtgtgtagacaaaattatcaggttttttttttttaagagtagcacatagtttcctaattgattttggagactagggttttaagagatgtactgaaacttgaagtttaatgttacaagagggaaaccatactcttttacaccttgtctgcttggtgcttctgtgagttgagcaagaattggaagtggaatgtactgtaagtggtacccaaggtgacctagtggaaaggttttctcttttcaaaaccaacttacttccctgatctttggcttaagcttaagcaagtcagttcctttctttggttctcagtttctgctgaaaaatgaggaaattggattgattactattctaccttttggctccagctaggtttgccagataaaatacaggatgcctagttgatatgaatttcagataaacagtgaatttttgtaaaatttttaaaataaatttttactataaatattacgtgggagcatacttgtactaaaaaaaagattcgttgtttgtctgaaattaaagtgtaactgggcttgctgtatttatatttcctaaatctggcagccttagctccaacatttttgtctcctttaaattagtgc

SEQ ID NO: 60711 - DNA, 1052 bp, Homo sapiens
tcatctttccaaggtttcttccttcttagctcctctaatttttcttgcctcagttggtatccactgaattatccagcttttcttatattttcatatattttatatcttctgtaagtgggagcattggtatgtcataaggtattccatcccatcctcatgcctgcttgctaccatttttgcttatttttaagagctagatttcttgtgtttagttctcaactttattcataagatcttgaatttttgtggtactttttaaaaaatctaccatgccagagggcaccaagaccaccccaggtgtgatggtttgctaggaagattcacagggctgtagtatgttgctgtatatagttgtacttattacagcaaaaagatacaaggcaaaatcagcaaaggtaaaaggtgcatagagccacgtctggaggaaaccaagtgcaagcttcctagagtcctctttcagtggagtctcatgagatgtgcttagtcctctatcagtgagttgtaacaatatatgtgaaatgttgtttaccggggaggctcattagagactctgtgcccagggattttactgggcctcttcattgtaggcaccctctgcctagcatttgcggttcagactcccaaaaggaaagcaagtgttcatcatgaactgtattattgcgtaaatagtttggcacaatgaacgactcttatcagttaggttcatgggaaccctcctgaacctcctgaaatagatgttcccaaaagccagccaaaggccagtgttgccagcaagtcttttcaaggatagcagtttagcccttttaactttttttttttttttaggattgataactttttttctgtgtaccagtccaatgaaacatttattcaacatagtaggaaaaattgttggagatctaaaataggtcagcaatgtcatatctaatataatcagttcattttctttgtagtaaaactctgagaaacagcagtaaggaaataaaacaaaattatttttctttaatattcccagaaaagtatactcagtgaaggaaaatagcatcttctct

SEQ ID NO: 60712 - DNA, 1145 bp, Homo sapiens
ttctttacttttactatcaaagtctcaatggttgccttttcctttcaatttaccccttctcccttcaaaaagtgatgtcttcttgaagctacctcctttatcctgaacaactttaatgcccggtgtggtggctcatgcctataatcccagaactttgggaggcagaggtgggaggatcacttgaatccaggagtttgagaccagcctgtcaacatagggagaccccatctctacaaaaaatataaaaattagctgggcatggtgatgtgtgtctgtagtcccagctgctcggaggatcgattgaccctgggagggtgaggctgcagtaagccattattgtaccactgcactctagcctgggtaacagagccagaccctgtctcaaaaaatacacataaaaataaagtcacttccttttaatttctcggtagcctgtgtttgatatcccatatcttagatctatttttagtatcttcataatcaagtgggattttgtcttttgtggatttttctttgttccatcagcaaacctctccttttctttctttattttttttccctttttttttttttttttttttggtgaagctccatacttctccatacttttgcctgtctgtcaccacaggcataggctttgcagatgagtttcttggattggggaatattttgaagttcatatcatatgtctcccagtttttctgatgcatgggttatgagtgattttatttgtgtatgttgttgatctgtgtagtttttctggagcatggagaaattcagttttaggcagctgtcattaatttcaacagcccagaagtcatatccttaatttttgaagaattttttgctggataaagaattacagattgggccaggcgtggtggctcacacctgtaatcccagcactttgggaggctgagatgggtgaatcacctgaggtcaggggttcgagaccagcctggccaacatagagaaaccccatctctactaaaaatacaaaaattacctggacatggtggcgggtgcccataatcccagctactcaggaggctgaggcaggagaattgcttgaacccgggaggtggaggcctgagattgtgccattgcactcctgcctaggcgacaactctgtctctaggataaaa

SEQ ID NO: 60713 - DNA, 1348 bp, Homo sapiens
tctagcttttggcttttatcaataaacttcctttgaatattctcatacattctttggtggacatagcacttgtttctttggagcatatacctagcaatggactttcggagtcagagggaagatgcacgtttaactttagtattatgccagacaattttgccaagcattttttggtttttttgtttttttgttttttgttttttttcttttttgagacagagtcttgctctgtcacccaggcgctatctcggctcactgcaagctctgcctcccgggttcacgccattgtcctgcctcagcctcctgagtagctgagaccacaggcgcccgccactacgccgggctaatttttttttttttttttgtatttttagtagagacggggtttcaccgtattagccaagttggtctcgatctcctgacctcatgatctgactgcctcgacctcccaaagtgctgggattacagacatgagccaccgcgcccggccaattttgccaagcatttgaaccaatttacattcttcccagcaacgtgagagttctagtttatgccacattcttgtcaacacttgatattgtcagtccttttaattttaaccattctggtgactgtgtaaatggttttcttttatatttctctaatgaggaataatattgacttttcatatgattattgaccattaagatacgttttttatgtgaagtgcctgttcaagtcttttgcttatttttaaattgagttctctgccttttgcttactgatttctaggcatctttatatactatgggtacaagtcctttgtcagatatatgggttgcagatacttctaacactctatggtggcttgttcttttactttcttattctttgggtgaatgtttttaattgtattctaatttatcagttttgttttgttttgttttgttttgttttgtttttgagacagagtctcgccctgttgcccaggctggagtgcagtggtgtgatctctgctcactgcaacctccacctcctgggttcaagcaattcttctgccccagcctcccaaatagctgggattacgggtgcgcatctccacgcccggctaatttttgtatttttagtagagacggggtttcaccttgttggtcaggctggtcttgaacttctgaccttgtcatctgcctgcctcggcctcccaaagtgctgggattacaggcatgagtcactgcacccagcttacttttatgattatcatttttgataaccttttgatgaaatattttcctaccacaggtctttaaagctttatgattgtttttctctcacttaggtttagtccagctgaaatttttttttttttttt

SEQ ID NO: 60714 - DNA, 1028 bp, Homo sapiens
aatgtttttcttttgaactcttagatcatgtctgtttttctcctgaatagttcacattcctagatttcattatacatcctgaactttagatgcattagtttggtactgtatactactttaacctttatcctctgatacatttattttcccttttcatttttcatgtcaagctgtttatctcctgccttttgaaatcctcctattatcttcttgcctacttttctcctttctttgaatattgaaccattccttcctggctatgttcctttctttctgtttttacaagagttttggataagagagaattgttcttcccaaagtctttcctttctcattaagccctccttttgttactaagcaatgctgtgtgcaccagtgactaccaacgtactttctgacactttgtctctcttatttctcccctctttcacataattcatcactcttttgttaagaaaagagtaaaaggataagaggcagtgtggaatagctgtaagagcactgagagtcaggagaccttgttatttttctattttctgttttattaaatagatttgctattttctgcactttgggtctccggcatgccacttttgttctctgggcctccttttccttaatgtgaaatgaacaggctaaaacacgtaatcacagaggtcttttccagtatgtttattcttggatttctttatggcttatgagaatttgtttcaccttttttattatttgtaccagtaaatatgttaacattttatatgtatttacattgctatatctttttatattttagagagtggccactctgcctgataagccagcacataattatgtgtacatttaactgaatgcattttgatgattatgatttatttttgtgttaactatccacagcatttcagaagggtgtaccttgaagctagttttggctatgcgtggcggacctataaatactagaagaggtaggcatatatatatattaaagcaatttgacagtaacattctttatgtcagttagtatttttatagcc

SEQ ID NO: 60715 - DNA, 1500 bp, Homo sapiens
cttagggatctctagcatttgttttcaataaaggatacaccaggccttttcctattaaacagccatgtccattacattccacttgtccctgtgtcagtctgcaggtccctttgtttattctgcccttccttcccccagattggttggggaatgggtcttgaatgtggcatctgacctgaatgcttgcttcagagtaaatctagatccagggtgctggcctagagaatgaatgctgtctgccgcagacatggacagacttgagagtggaggcccagagagtcttttgagggtgtcagtggactgtgccagggggttagtgtgaaattcgtcagactgcctcacacttcgataaagagggtcagataaacttcatgccagtttggagacattgcagacgccaacccaggaatttgagttccggacccgtctttaatactccttgcaaaacattgctttctgtttgctagatgaagaggataacttattcgcaccccccaagctgaccgacgaggacttctcgccatttggctctggaggtggcctgttcagtgggggcaaggggctctttgatgatgaggacgaggaggtgagtccatggcactcagcaacactccctgcagctagctgtgtcaggggtccacagggaagaaataggctttgcttgtttagtggggaaaaaacagtttctcagttggaagttgcttctattttcatattttgggacattttgaactaagaatcacagagtgagaaatgccgtatccttctgtgctttgttaggtgaggagaagatgtgcacgtgttaatgtgaataatttactaggtgattgtttcttgccttatctgttgtcttccacgtttgtttttaattcctggacaggcctaaattattttagggtctgattttgccatagttatcactttgcaactgattttctggcagagtagtaaatatgtagctttaaatcttgtaggttatttttccttaggaatcctcacatgcagctatgctttctcctggttttttgaattctttgtcatataccttatttcaaccagagtgacctcttcacggaagccccccaggatcggcaagctggagcctctgttaaggagggtaagctggggctgggcagctgcgtctccgtgtgcagagttccaaaactgtctttctcactaggagatggaaccctgaggttgttcccaagccttgtttctgtgttaagcaggaagctgttgtttttactgcggtccagttgaaagtaattcatcttcactaattcatgtcttggaaaaaacagtaccaccggtaaacccataccacagtcttgcctctttgttaggagagaactcataaaaagtcagacaagaaaagtaccctagagcaatgttgaggatgattttcattgaatgaagtttaatttaaagaaacgtttttaacattctgtatataagttggagaccagtaattccccaacccagtgtgcattaaaatcatct

SEQ ID NO: 60716 - DNA, 1697 bp, Homo sapiens
acatggtgaaatccaatctctaccaaatataaaaattagccaggcatgatggcaggtgcctgtaatcccagctactcgggaggctgaggcaggagaatcgctagaacccagaaggcggaggttacagtgaggcgagatcaccccattgcactgcagcctgggcaacaacaaaattactcaaaaataaaaaaagtaaataaataaaaatatttctctagtaacagacaattttgatattttaatattttgctttttatattcttgtggttacattcttattaaagattgcatttttatttagatttgaagtaaatcttgtgtattatttgttccagcacatcttttgctttataacttactgcatcgtgattatgattattattttaaacagctgttacgattttgaaggaggagcctaaaggctaagtggcagtatctcttctttagcttaataactagtagttctaatttggtattttatactcttagcacatcacacaagtgagtgatgaggaagaggatgatgatggctgtgacctttttgctgactctgagaaggaggagaaagatattgaggacattgaagaaaatactagacctgtaaggaaggctgtagttgctatcacttggcagggttttagaaccaatgactttttttattttttattgtgacttactttgtacatctctcatttttgcatatttgtcatttcatctacactttggaaaataatggcaagcatctcaaattgcctcacaagtaccactttcttgtccagatgttatgattttatgagtcagatcattcagaatatgtctggttccagagtttgaagaccatagtgctcctgtctccctgcccatgacctttttcttattttcttatttagatttttaagtattaaagtcaagtattaaaaaaataaggaaataaagagcatctccctttgaaggaacattttgagtcccattccttgggtgagctgtatagggtacatatgtttaagttcatttaattaaactcagttttctcctcagttcaatttctttgctcttgtatacataatgttgttaggtgtccaaagtgaagtgtactagtttgttacaaaaaagcgattcttttgatttctcctgctgtagaaaagaagcagacctacatcgtttgcagatgagctggctgcccgcatcaagggggatgccgtgggccgagtggacgaggagccgacaagtgagccccagccgcgttgatggggagtaggggaggggtagtgcagggccctctgctggcttcaccaaaggcggatttctctttttattagtaattaccacatatatttattagtaattgctacatataatttaaattgtagtgcttattccttttttggttaatgagctcctttagataactgaacactgtggacccacaagaaaaacgtacatgtacacatgtagataaccctttacatataatttcaggggactaatggaaactccagagaaccatgggcaacagcttaagaattcctggctgaatatttactcctatattttgaacacgtaagaatgtgctatatagcatattctagttataagagagtagaaagataacataataattctttcaacaaatacaatcctgttatgcacatgagcctgggatgaaagcagaagccttctgccttacaaagagactc

SEQ ID NO: 60717 - DNA, 1062 bp, Homo sapiens
cgaggcaggtggatcacctaaggtcaggagttcgagaccagcctggccaacatggcgaaaaccccatctctactaaaaatacaaaaattagctgggcgccgaggtgcacgcctgtaatcccagctgccgggagactaagacaagagaatcacgtgaacccaggaggcagaggttgcagtgagccgagactgagccattgtactcgagcctgggagacagagcgagactctgtctcacaaacaaacgaacgaacaaaaccaagaggggacttagatggatgccacagtgttgtctgagatggagcccacttgtggtggtcttggtagtcccctgggcatatcccaaaggcctgggctcctctgctgtggcagcatggcgggagctggactctgtacgttgactcaaaggtctctatgtttgggctagtctggaagtgtctgagaactgggggcttttactcaaaatgacattggttgattgctacataggtggttgatcttccagttgctgacaggtggaacctgaggcagcaggacagcctggcattggccacgggacatcggccacaaccatagcaacttcggcatcaaatggggcaggagagagaacattaaggtatcgttcaaagaatactagaggtcttggatacttctgtatgcctgttctttatcttgtcctaaaagatcttccgagggtccctttagggcaaaaccagaaccttctgtgttgttataaaggcagggtgggtgtgccattctgggcatttaaagtgcagactctagacttgtatgcatgcgtagcctcctaggttaacatttaaaataggctctgggaaacctagtttggtgatagggagactggggacactgatggtgacctggtcctaggatgggatgaaggtagcgaggatgggaagctagaggaggctaacctttggggtgtcttgatggcttctgaaaagggcctctctggcccccagtactaatacttgttataccatgaacttaagctgctcttgatgggaggggaaagagaagattattgttaacaaacactattgca

SEQ ID NO: 60718 - DNA, 1030 bp, Homo sapiens
ttggagttcactgttgatgtgtttgtttggctttgaattcaaaacagatacaaatttggaggtgagagctttgccagaccccagcagggatggggcatcggtcctgactggtcttgtttattttgtcctggtaaattctgttctttggagcataaaccctggagtcctagagccccttgcctcagcaggaatcccccctctgtctgctccaggggctccctgcttctgcccacctgctctccttccatggcattcaggacccccgacagctgaagcctctcttcatatagcttgtcccctctgggcctgcctgtcttgtgtccaggacacaagacacgcatcccttgtctggccccaggctgccatcactgtcacaagaaactcatagagtagagctggtctgaggtcacagtgctggtggtggtggaaaagcagggatggcctgttccactgtgatcttacctcctgtgtcacctggattgggtctctgtccccttagacatgctagatcctaactttacaagggctgaaggggtcttctacacgcaggtcccaacactttgggctggggttggccaccgtagcttagtgggctaaagctggagtttgaatctggatatataggatccacacctatagccatgtgatcttgggcaagttacaagccttgatcatcttcctcatctgtaagatggggatgacaatggtgcctccttcacatgcttggtgtggagattaaatagaataacccaagtagtgcctggcactgagttagtgctcagcacacaggctggtagtgttgggcacccctctcatagccacattcaggggccacctcttaccctgccagcttggctgtgatcacagcccacatcccacttccttaaaagtcccttgttcagagcctctttccaggttcctcgccccacagctttgcaccctgcctgggacttggccctctggctggggcttctgaaaatgtagttcccagagtgcattgaggagggctaccctagccctcaccactcat

SEQ ID NO: 60719 - DNA, 1132 bp, Homo sapiens
gttggaccacctaaaaatcccctgtgctccgtccattcacccctcttaccttccccaggactcctggcaaccactgatctttttactgtctctatagttttcctgaatgtcacagagttggcttcatgtagcatgtagccttttcagacaggcttctttcacctagcaatatggatttaagcttcctccatgtattttcatagcttgagaactcatttctttttagtgctgaaaaatgttctgttgtctgggcatactgccatttattcatctaccaaagggcatcttggttgctttcaggttttgactattatgaataaaactactataaatattcatgtgcaggttttgatgtggacatatgtttacttcagttggttaaatacgcagggcaacattgctgtaagactatgtttagcttcataagaaactgccaaactatctctgtacaatttcgtattcctactagcaatgaatgagagttcctttttctcatataaaaataaatatccttgtatgtatagttttatgttcaggtgtgagtatatctgtaggataaatttttcatcaagtggtacatgtaaaatatctaccggtattggcaaattgctccccagaaagattgcaccaataatacatgaaaacgcatattttctcatacccacgccaatatttgattgttaatcgaactttaatattttggctaatttgataagtgaaggaacaatgtcttcctagttattgtgatttgcaatctgttccctgtgagtgaggttgtggtctgccggactgcgtgagtgagaattcctgttctggcactctcaagctgtgtgatgctgggaaagttgctgaacctccctggacctcagtttcttcatctatagaatgaggatggtaatgggtctttaccttattaattggattggaggatttaatggcatcattcatgtaaagtgccagcacagttcctggctcaaaataagggccaagtaaatgtaagctattattattctccaatatgttcataagcacttgaatttcttcatttctgatctgcctatgttcatatcaatttcccaggattttttcttattgattggttagagctctttgtatattaataacatacgtt

SEQ ID NO: 60720 - DNA, 1029 bp, Homo sapiens
ccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactcaaagtatctttggatgtttagcagggaccagtgtaggaccaatttaatttgtcagaaacagagctttggggagccacgaagcctgagcgcctcgtgggcatctcccagtgggaacactggatgggctgtacctgagcacctcgtgggcatctcccagtgggaacactggatgggctgcagccaccgctgccctggggacaactcttgcaaatgagggtagattctattcacctcctgatgtgtaggctacatccttgtatctcggggttagagagggatttaaagtcagctggtgctgttccaacctgtggcctgactacccccttggcatccacccaggggtggtccttggtgtgcttggggtgcacttgggtactcagggtgtactggtgatactcagggtgcagttgagtactccg

SEQ ID NO: 60721 - DNA, 1117 bp, Homo sapiens
tcttttcaataacatagttggtaggcagaagcttaggtgtcattcttagaggttcttagttaattctgaggtccttaagatctcatgtctgcttccagggaaggctccttactgaaatctgttacctcactgccagtcacaagaacactgccatccttttgtttttgtttttaattgagacagagtcttgctctgttgcataggctggagtacagtggcacaatcatagcttattgcagcctccatcttgcgggctcaagtgatcctcctgccttagccgcccaagtagctgggactacaggtgagtgccaccacacctggctatctttttcttttttttaatttttggtagagatgaggtctcactgggttgctcaggctgccctcgaactcttgagctcaagtgatcttcccacctcggcctcccaaagtgctgggattacgggtgtgagccactgtgcctagccctcctcctatttaaaaaagatattcttccccttgtcaaagcagagttttttaaaaattataaatgtgactcacaaatttgaaatgaaaccaggttaaacattttactcaatgtattaattagtgaagaaaccaggaagatggcaaaggtagttcaaagaacagtttgaggatctaggtttttcactggcgttttgaaccaatgttagagtaagaatgctagattagattaagaaaacctggttaatgccagacagaaataaattataatctttagtgttaccttatcagacagaaattatttgtatcactgctggacaaaaatctataggttacgttgtaattgcattaagtctaggacttttaatcagtagtaaacaatgaactgaataaagtacaatttccccacataagtaatctttgggatggcctgtcattattttatgacattgaagtgacattccacttatcttttgccttactttcacattttaatttagtttaattttattttttctgccacagggtctggctctgttgcccaggctagactgcagtggcatgatcttggctcactgtatcctcctcccaggctcaagccattctcctacctcagcttttcaagtagctgggaccacaggtgtgtgccacc

SEQ ID NO: 60722 - DNA, 1117 bp, Homo sapiens; identical to SEQ ID NO: 60721

SEQ ID NO: 60723 - DNA, 1117 bp, Homo sapiens; identical to SEQ ID NO: 60721

SEQ ID NO: 60724 - DNA, 2046 bp, Homo sapiens
gaaagaaagaacatgaattcatcaatccattcagcagctattttgaacgcctcctgtgtgccagatgctgttctagaagctcagaatatctatgaacgcgataggcaatgcccccatatgccaaggccctcatatgctagccttgactcaaggaaaactgtaggatggggtaggtttcatttttggaagttgtggaatcagtacttatgttttgaatgtgttaggtttgagatgcccagtaggtttttcccaatagaagacataagcatagctgggaagaattttgcagaggactctgaccacctaccacctacaggtgccatgaatatttagcacatttgatttttcacattacctattcaccttctctccatttatcagtcacctggtagttttttttagtatggtgaaatatacacacataaattatctagtagatatttgggttgagatatcaaatgtgctttttagaaatttaaatctgaagttctggaggatgtcgggctagagttaacctttggaatcggcatcatatactgtacatagtatttaaaatatatgggactggtgaagacatctagtttaatagtgtacacaaagaagaggaggcgaagccaaaaaagggagggaggtagtggtcaaccatgttgaatgttaccgtataagatgcctttggtaattaggaggattttaatcattttgacaagaacaactttaatggggaagaggggccttaaggttgggtagagtttttttcaagatagaagaaagcagaatgtttatatggcaatgtgattaaactcgtagaaaggaaaaactgctgcagatgaaagaggggaacattgtaaagggtagttgttgaatacctgagaaaggagaagaccctaagcaggtgagtagttggttttgaaatgagcagggacacttactctgttgtaactagaggggaagctgagataacaggtgcagatacagtgggtggtgggaaaagagtctattggtataggcatccatcagcttagagggagggcagcgggggagaggaaaggtgtgggaacttggaggagagatatgtgacagagtcctagagagggtgaaagtgagcgtactagagaaatagagttggattcccaggcagtgctcagggcccatttgagacgtgtagtcttacatttaaagtgatataaaccagtgtggttgtttcatgttcaactttggaagggtgttgtgaggattaaagaaggtaatgcatgaaaaacatttaatagagtgtcaggcgtttaatgaatgttaacgctttttatttgagccctcgttttgtttttcttttctgtttatacatatgtgactgaggatggctggcaattaccacttgacaggctgttctggggcatgttctcccatcacagagaactgcagtttgcagctactcagaagtctggttcctgttgtgtttacatgtacacagcttgataattgaagatgtttgctttttagagccattgtcctggactgtttgggctggggtttgtcacagtgacagtccttaagtttttgtgaaaatcttttatgactgcatttcatattggatctgatgtactggtaatctacagaatctacaaatctaagattggcaggaaaattttcagtttaatagattttcatttctccctgaccacttgagctgttttaaaatacaaataataataatggctgacagaaagctcttaaaagtgccaagtacttttctaagcacatcacatgcctaatcttgtttaatcatcacctcagctctacaaggcaggtacaattattatcctgatttttcagatgcaaaaataggctccaagaggttaagtaatttgcccaaggtacccataccctgacctccagtttctactgcagacaataactttttctttttttttaaactgcttggccatcactcatctgcattgcagtggagtacttaagatgttggactccaaagccagattgcctggtttcagaaaactgccacttagtagctatgggactttgggtaaa

SEQ ID NO: 60725 - DNA, 1468 bp, Homo sapiens
gcttccctgtcgccgttcgctgcgctgccgggtgagtgcggcggacgccgcagggccgggacggcaggcggccccgtcgtgtttatgttattgtgccgctgccgccgccgccgccttctcctcagccgtaaccccctcctgggagtgggggcgggagcgcgcggtgggcgggggcggcgcgggaacaatagcggcgcggaggcgggggccagccgagggggcgtggggctgcgggacctgggtgcgctccgctgcccgccagcccgcctgccgccgcgagccccgcccgcctgtcctctcgcgtcctcttcgcgtgggtcctgcctccgcggcgggagaagaaaatggagcgggggggtgggtggcaagttctgaaacacttcggcaagggtcggacggaggtgtctttgcggcccgccgcgccctggctgcctccggggcggcggggagccggggagagcgcttctgccggcaggtccccaagcctgccccgcgcccatagggaccgtattttgcttctcgatgctttctttgtgctaacgttctgggcgaacgcaggcagcagcgctgaaaagggccagagtggcctgcagctctgggctgcagggcagagagcccaggcccgtggctcgggtgggaggtgtccatccagcttggcccgagcttcggtggtcagcgcgcatttctcttgagggtcatcggtggtgaccttttgactttttcaccccaccctcccatctctttgtctcgcatttgtgttcccgattcagagatggtagaaccaagtccattttaaagtaccctgatgaacactttccgtttttatttctgaaagttccctgcttggtctttactgcgaatttaataacatgttgactacatggcattgtccagtgattactatttttacctctgaaatccagcgatctttccagtagaattctggtccgtcagtccattgtgttttgagataagcatccagcaagtacctccttggcaattagaacatctgttttttcattcattcattcattcagcagctgtttagtaccgtactcagatgaagaggtttggtgtgaaggtaaagtatcctttcatggaagaggatgctttgactgaagtataatagatggacctttaaatgagacagttacataagtgatgtctgttaaggaaggtatggttatattctgggtcattttttaagcagtatatctggaagttcaagtgtaataggaagtagaattagatttggtctaaatatacaacagcttttatttatttctaaattttattttttccagtcttgcagccttacagtcatttgtaatggttacctcagattcccctgctgtggttaacgttaaacctaggaggtcagatgctctaagtgaacatgtttagtgctgtgcctgacaaaagcaagcaatcaaaatgggacttccttgagggcaggcctgtcttgcat

SEQ ID NO: 60726 - DNA, 1664 bp, Homo sapiens
aattgttgagttgaattttttctttaatatccagacttagaaaacaaatggaaggcttcaccataagctagagattcttggaaaggtaggcttttatttattccacagcatcatgccttctaatgagaccgtatgctcccagagactttgtggaagacataaaatgagttcattatcctcaggaagcttataatcaaggattagactgaaggcatcgctaaacagttaatttatgctcttttaaaaggtatatgaaagggttcccgccaaacaaaagcccacttcacatctctgtgcaggccaaatttcactgaaatccagtttttaaaattgtgtgtgtgtgtgtgtgtgtgtgtatgtgtgtatacgtatgtgcatggagagagacagagaggagacccctttttggaaaacttagtagcttccattctttttcttggaggtgggttatatcacaaatacaagagatacctgtgtttcctgttaccctttattatatttcagatttagttaaaatctgccattctttagaaagtcaaggaactcaaaccttacaatgattgctagcgtgggttttaaggtcagccctgagttctaatcgtgctccaatctaactgtggtataggctagttcaggttatataacatatttgggcctgttttattatctgtcaaatgagaataataatagcacgtaacctcatagggctgtgaggtttaaattaggtactgcatgtaaagtgcctggcactgttgtggtggctggaatgctagatacaagtattcaggtagtttttgctattgttatcacttatatttaactttgaacaaacataaaatgccaagtaaacgtcaaaccagtttaatgcacagtgtccattctaattctccagaatatgccatttgtttcactctgcatctctggggggtttatttaaaattcgatcatctcatgtaatctgaattgactgagatgatttatattaacatttggaccagtaatcctctctatcttaaaatttggaaatgttccagaagcaaatattgaagggaacatatttgccactttcacgattttttgccttttcccacaggagaaaattgcctaagctttcctaggtttgttatagacatctaaaggaatgagaatttaggagctacgaatagctttatcatgtgacacatttgaagaaaatggaatgctgtcacatcttttaaatttagtgttattgggatcttcgattctgtgaagattgcagatttgtcagagacctggtaaccacaacaattcattgaggcctggaggcctcttaaaaaatgagggagattatttattagtaccacttagaaatattatcttttctgtattttctgtggttttctaagtcttctgtttagcgtttctatgattataatggtggattaaatttcttgttccttctcaagagcatctactatgagatgacactggtttttacttcggcagtatttactgagcattgcactatactaatccaggtattcggtgatgtaggaaccaaaggaaatagaagtcagtttctaccctcagtgagctgagtataatttgatagaagataaggattaacgtaagcacatttatgtcctaacacaaggaagcaaatattgttagtcatttcattagga

SEQ ID NO: 60727 - DNA, 1005 bp, Homo sapiens
tttatgcctaaaaaacaaattcccatccccaagtatcatcgtcagcaaacatttttatatgtgtgtcatgtaacttgccatatactaggcagtaaaagtgattaagacacagttgtttctaataaggattctctgtggtagggatgaggctgatgtgaaaatgagactagattacagtgtgctgaataccataacaacattagaagataactggggacaaagtagagagaatagtcaactctgtcaagaactaggagttgtcagaatctacaaaagaggttcacctggaagataattaagttgagtagataaatgacaagcatagggaatagtatgtttaaaagcatcaaaacattttaaaaatgacattcttaaaactagcatagctaaagtatgaagtgtaatataggacttagcaggagatgaagtgagttgatggcatatcatggaggcttttgaatatactgcaagggagtttcagaatatatttgttggctttaaatttttgaggaggtaagtaatatgatcaggtctttcttttaccatattataggcagtaaatggtagctggatttgtagaaaaccatcgttagtgacccttaatcagctcaggccaccataacaaaatactgtacactgggtgtcttaaacaacagagatttatttctcacaattctgtaggctgggaagttcaagatcaagttgctggtcaatttgattcttgatgagggcctgcttcctgacttggaggtggccaacttttcaccttgtcctcatttgcctttcttcagtgtgtgctcaaggagagggagagaaaaattgctcttttcgtcttcccttgttttaggccactaattccattatgagcgccccactctcatgacctaatctaacccttattaccttccaaaggccccatttccaaatactatcacattgggtgctaggagttaaacatatgaattgtgtggggtgtgtgtgtgagggacaatcaatctgtaacac

SEQ ID NO: 60728 - DNA, 4140 bp, Homo sapiens
tgtttacttgggtctgcagggttggctgtgtgacactgctccaaactgtgggtcaagttcaggcttgtcccatattcaggtttcagcatctaaactgaagcatacaccagagacatccttttctcatggtgaaaggtagaagagcaagagctatgctgagtcaaacacattcccccatattccattggacaaaataagacaagtgactgaacctatcgatagggtgaggacacagtctggggtgagcaggaatatttgcagaacaatctaccatactttcttccaggggtctagtagcatttagcttttccaaaatggcaagaccctgaaattctaggctctgttcccttttatttctgctttaaaaggtggctacttcttttaaatgcaaccagtagctaccaacacaaactactgaagttttgctttccagtcttttctagagcagggttcaacaaactttttctgtcaaagccatgtagtaaatattttaggctttgtggataatagtctgcgtcacagctacaagactctgccattgtaacacaaaagcagccataggtgatctgtacttgaatgagcatgactgtgtttcagtatcagcactttctttacaaagcaggcaggccttaatttgccagcccctgtgctagagcttcaggttcattgtacaagtggctgtgcaggtgacagcttcatgaaatgttttgttactacgtaacctagatcacctttccagccttcgatgtgagtttccctgctgctcaactgctaagccaggatcttatgtttttataataattaacaccccacctctgacaccagtttcagtgttagaatagactcagctgtactgaataacagataaacccttaattctcagtggcttagcacgactcaggcttatttcctttgctgaatgtgtggtgcagatcatggtgggtttgtggactgtgcgtttacatagatgatcagcaacccaggctgccagagaatcctctggaaagttcctaatcaccaaagcagggcaggagatgacaggaagttgtgcactggcccttctcttctttacttccactcacatcccatgaactagaactacccacgtgcccttgcctaactgaggaagctagaaaaattgggggaagaagacagaatgttgggttagttccactgcctgcataaattctaagttgctattcttatatatagttagcagtgtaattaacagctgtaaggtacatattgatatatatggatgaatttcaattaatagtctttgaggctttttttgacaatttttttgcttaacaaaaatatctgtctttaaaaattgttactttgctcttaattttttcacaatgaagtgcttgaaattggaatgttatttctaaattggaatctgctagtataaagagccagtaaccttcaaccatcacactaaacattgaagtagtatcaaagcttgtaatatttattcttaaacatgcagtgtttctttgctgaggtactgtattttagaagtattagcaacattatatttacagaataccaataatgaaaatttttttcttctgtttcattaagacctttgaattgttggtatatttaatttcataaaaccactagattacatatcttctaaacccatccatgattgcctgtcgaaatatgttaaagacaacatacatgcttttctgtatgttaacattacaaaagtaatacaaaagtaatagttgtctttcaagcaggctattttccttttttgtattaatcggtgatatttaatatgtatactgcatgtcagtacaggtaatacagtgcatttgtgttgtggatttatgctttcttcgttttttggtcctttggcttataatagtattcatcaaagctaacaggcaaagtatgttaaacatgaagccatgagtgtttatgctgctgcctgacttttgatgggcacagcacagaatatgttaaagtaggggccaggtgaaaaattctgaattattcagtagtatctatagcaagtaattttatagattagtggcaccaaggcaatggtgtcctacttctacaaacagacagaaattttatagcaaatttgtgtgacttcaggtgggaaatcagggatggaaaaatggataatgactcttctagtcctttggaactgggtatctgccagtctaaaagatcaaataacatttgttaggattgacaagatggctcgttgttgacttaaaacatctgtataaagcttattgtgactttaaaatgagattttaaaaatattggtaatatgttatgcaaatgaatataaatgctaacttatgactttcttttactatagtagtttttttatgtgagctttgcgatgtcttttcaaatcccttttactctaaccaaaaatgtctagctaatcataatttctagcaattaaaacattactaacttctctaataactgtatgtattcataaattttaaatcccataaaactgacttctcaggtttgccttttaacgatgaatcagtgcagtaatattacagtgagaaaaacgaacaattaacatgaatgttttgcaagggatagtataactttattgtgaactgtaggattttcctatatatcatggcagtcattttttaatttttattttctgaaggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacggtcagcacacacatttatttgaaatatttttctgatttagcttttttctttattcagtagatttttaatgtaaatacttaagcagaagtacgttgagttaaatgtgtatcattgtttgaaatgtgtatcaaaagtttgcaggtaactataaattttttcatcaatgtttggaaaaacttggggcccttatttgtttaaatacggatacataacatcagtactaccattggatgaagaatttgttgccgtggccctgagacagaatttatgctctttgcttgcctataacttgaaaatgaacatttctaacatggtctcagggatgtatagtgtactgacagtttattattagtgtacatcagtgatatttgcctatatttccaaccccatgaaactaaagctcatagcagtagcactcattgtaaattttaagagatacattaaggcctctgcaaagctgatggataattaaggtgacctcttgaaggaagcagtaaagtttcattaaaacgttgtatccagccttaaggaaatgacttttagtattttgtatgggtatatccagttgtatcaatcaacctaagaatcagtgttgaacaaaattatctggcatgtagatcatgaatttaaacattttgtatgcatatacctacttatatttaatttaggaagaaattttgttgagtcttagaaatttaggagatgaataaatctgctaagaagcatgggattttatggaaataaaccatcgttttaaaaaatgtggtgacttcatccaaaatactaccaagaataaaacctagacattttttctggcaaggaatctggaatagcagttcattttgaatcaggaaattgtaataagtcaacttttaagattctttttttataaaagatacaattaagctgagcttgattttctgagctgattaaaaacaaatactttaaacatttgctattaattttttattcttaagtaaatatgctgttctttttacttacactctacctgaaatttgaagttttttattttttgggaattgataacttcacgtgacccaccagcatgaagattgcttttgcatttgctgtaattgattgtcatagatatggtgttatgtgtcagtgtcctataaatatgatcttaggatagctccctgccagaaattagcactaagaaaaactgtcatatatagaattgaggctgggtatggtcgcttacacctgtaatcccagcactttgggaggccgaggctcgtggatcactcgaggctaggagttctagaccagcctgagcaacatggcaaaaccc

SEQ ID NO: 60729 - DNA, 1022 bp, Homo sapiens
tagtcagagcacattcactgtcactcatttttattttatactgctttttataattttaaagtatacatggtgtgtgtgattttatttctttctttttttttttattttaaccaaaatctttatgttaatgtcattgcattttgttttcagttgacatttggtcagttgggtgcatcatgggagaaatgatcaaaggtggtgttttgttcccaggtacagatcgtatccttatctttggcctaaaatgtagtttctaaaggtcaaaatgtatgatagcacttcagtttggtcaggtataatgtattttgtctctccctaatatattgttaaattactcttaaaataccacctactatttgacatagacttttccttccgttatttattgtttcatatgttaattctgaaccctgctcaattgtaattatgcacaattacttgctggctttgagttgatttaacctaaatcaaaaatcatggcttgcattaaaaatttataataattatacacttaagtctagaaatacgtacaacttaatatgaattttggagctgtctgttgcttctggccatccttttgttttgtcccctacctcctttttgttaatgttctgtgtggtttgtgtcttttgattgttgtctcattactcacataacatactgaccctttcatctgagaatttcagcagtagtagttttgtatggtaacgatagctttggattcatactttttgttcatcccactacttttaatatttatattaacagtgatttgttatgtgtttaccagctagtaacacttagaattgtttcaggaggaagaatgggaaaaggcatattcacaaggttacaataagtgagttttaggccttggccttcagggtcctggagtgtaaagactagaggaaaggagaccaagaaatcctaaccttacaacttagcaaaaaactgaatcttttttataagggtcagagctttagaaaatttttttaaacctaagctaaacaaagaatggcaaaaga

SEQ ID NO: 60730 - DNA, 1102 bp, Homo sapiens
gccacttttatcgaagcctttatttttattacaactgattattttctgttagtgtagaaaactcagtaaaacaggatgtgttctagaaatattgtctaggagatataatcatgttttctgataaattgacagaaaaggaaaaattttgtatattattatagcattgtgtgcagtttgcagttagagccactatggatagtaattgtcattattcttagttgcttatcattttatttagaatttgtgagtttaagcttccattttaaggtaaaatcagttagtttgaacacacaataaataaggttaataaagcttatttattgatcatttctgtccacctacaatcattgccttttgcagggtgcctgtgagatataaaatttataactgccacatcctttcttaggaatttttaaatttctattttcttgtaatatgaatatgactaatgtattgaacattagttatggagtatttttcttagctacttgatattagatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaaggtactttttacaaatatgtacatttaatcccatttggggtgtgtagtgtgtgtgtatgggtttgtgtgtttatatgtattcatattcttatgggacatgaacccaaggttttctctggatggtggggaaaaaaatgaggtttttgttttttttttctttaatcttatatattttaatcatatgtataagataattttacagtaatatttttaaaacatatgctttttaaaaaatctcaaattgctgaaagttattaataatttgagaatctttacaaatatatgtacattaacaccattatgtttgcagccagtcaggcaagggatttgttatccaaaatgctggtaatagatgcatctaaaaggatctctgtagatgaagctctccaacacccgtacatcaatgtctggtatgatccttc

SEQ ID NO: 60731 - DNA, 1026 bp, Homo sapiens
ttaattttaaataaaaatgtagatacatgatgatgatgtttttctgtttcttcatgaagactacgtcaaataaactaatgaacatattcgagcccctcctacacaaaataaagttacctcccactgttttttgcaatcttgcctggatacctaaccagagaactaggatgttgaatgctctgggggaacatcctaactcaggtataaaacaaattactgtatccaaaggaaaacagaattctgtgatctgtgatataaataaaatgtggcaatttcaagagctagaagaaaagaaaaaagacagttaaacattttatttcctgcaatgaaggagtcttcctaaactattatgtctgtataagtaagttgatgattgatcagtcttgatctaatgatatatttttataagtcatctgtgtggctaatatttcaaataactacagagttaaaatactcccagcatactgacttggttattattgccttgtgtttttcagccaccaccaaagatccctgacaagcagttagatgaaagggaacacacaatagaagagtggaaaggtacattcgtcagattcttagagggaaaactgtgaaggagcttctggtttttatatggtgatttattatcatgttagagaaatttgtgactttaatatgcataaccgaaatgtggtaatattaatatttttacataagtagaaagtaagtctgcttccttccttaacttaatcttaagttcccaagtttcccaccccagacacagacacattagtgctctgtctcatatttttttccatggtttgtgaatacacaaatgtgtttagtgtctcccacctctcctcttccacccttttaaaatcacgtatggttgtgtacggtgtatgctatatgtacttgctttgtttatttattatatatttttttgagttggagtctcgctctgtcacccaggctggagtgcagtggtgtgatctcggctcactgcaagctctgcctcccgggttcacgccattctcctgcctc

SEQ ID NO: 60732 - DNA, 1045 bp, Homo sapiens
tttatctttcattctgatttgttgtgaagcttttgcacactctaatttaaatcttggtagcatatatctagttgagtacccacagtgcaccaggctctattccagggcccaggaaatggaagtcagtaagacacgtggttcaagccctccctgagacagatggtagtacagaatggtatgtggtatgatgtgctgtagcacaagttgctggtagagtgaaaaagaaagcttctaccccagcactatcaaaccaacttcagaaacagtgaattacaggaaagattagtacttccttttaatatgatccattgttgagtgtcaaggaattgttattaattaacatccttgaatcttaggccgacatttaactgactgtcattgtaaggacactgtttgaagtacttcacatgtataaaaatttccacttaaaccatacatgcgttgtgagattggctcttagactttgaaaagttcatttttgtttacttcttttacagaattgatatataaggaagttatggacttggaggagagaaccaagaatggagttatacgggggcagccctctcctttaggttggttacaatataagcttggttaagattacagtttacttcttgtgttgtaatcttcagtggcctgaaacctgcagttcttcccatatttacaaaatcattattattccaggcttaataagtataaggaaatacagttttgttttttctactaatacattatactaatatatcagtaactgttcataagatgcacatctttttctatgatactgacattctgaagaacagaaatttaaaaactttttgttggcattgttgctgggtctttaaagaggaaacttctcaaaattcaatatacatacctttctatgatcttgacagtctttactttggataaataaaagcttcactgcaaaatttagtacatgtaataccaaattgctgtctttctctttttgatattattgatttgttgaatgaaggcaataacattaaaaccatcactagaaagtattctttctctaaga

SEQ ID NO: 60733 - DNA, 2799 bp, Homo sapiens
aatgtggttcagatgtaaaattcttgtcttaaactgaaaaacacattcattgaaaggataggactccacgattctagacattttcagaattctcacctcatagctgtcaatgaagagtgtttttaagttagtgtgttggatatcatttgcgattatttttagtgagccttcgaaacccaagagaaaaaaattaccactggaggcagtcagtgcagtgcaagtagcttgatctgcagctgtctgcaactgatttgctgttttgtttctcatagcacaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttcaaaaaatgtagaattcattttgtagtaaagtagtttattttttttaatttcaagtgatgtaatttaaaacctaagttgtgtttcaaaacagcaacaaaactgtattgtattttttttgctgtaattaactgtataatgtaaacctaattattttatcatggtttaaattttttgcatatttgctttatcttatgctgctgatttttttaactgaatttgtaagattttgtttatcaaagcaactattatgtggtgacttgcctatatcatgaattatttaagatttttatagttttttttaattagaatttatttcagatgttttgttcatgatactatccttcagggttatgtgcttatcaatgaaataaccccagaggagtgagggaaaataacttgtagccagttatattcaggaataactactgtaaatgatgaacgtgttaggagacctccaatatttgctacttgccaatcctaatttagttacaagaattggtaggcaatcctacttaattttggcaaaagccccgtcatctaaatggcagaataactcagagcatgtctttgaagatgctgggcgtctaccaccaccttatgtccccaccctacccaacaaaaataagtaaaaagaatatggtgtattctacaaatttgtggcatgctcaaagtttatgatcacataaaggcaagaggatacttcatgaataatacatttcaatgcaaataaacagatggttcacttctactagctatgagcctgtttttgtatacactgagttaatctactcaggctgtaggtcccagcaatgttctagagtctggtctttccctttcctgcagcttcgggtccttggacctttcctgtttcctattacttggagtgtctgtcagttgagcaccagttgttctggtgtttcatttgattctacttgtagcataatcatttatacgagctattgggaggttccaaaccctacctagatttgtgtaggtgatgtatcaaatgagcaatataccgttcatctgaaaatagtagcacacagccatatataggatatcattttctaaggactgtttcttcacattgagcagagcaggcataaatggtggttatttagtctaagtcttttatttttttatacctgattttcaacataacacgcaatgtggatgtcgagtagtgttaagaatggtgctgctcctgacaagtgtatgttaactgtttacattttctatctgtagaattatttctctattactgaacttttcctaagtaaaatgtctttgaagtctcgttatttctgaaatacgttgtctgtaatagacccaggcaccttttaaattatctctggaacaagagggatttcatgtaatgaactaggaaatgcatactcacataagcaacaaggttctaggcagaaagccccttggaatttgtgaccaacaggagcaagaacaggtgcggctcaacatgcaatgtctgaaaatttgcttggcattttattcatatatttagtgcaaaattatttttgagtgagatattttacatcactgttaatgtgcaatatttaagattaaaatacattagcttttttatatactttgaagtagcaagtttgttttcgatggcttagagtcatgatttccagcttcccagcctttttatcagtcccttttctaatacaacaaggtgcattaatttgattaggcaaattagagttctaagacacttcttgaattgtagacagaaaatattggattcacaatttcagcagaaatttgagaatgagtgtgtttatattaatttcacaattagctgtattttctgtagcatagattatgtcactgttgcactttcacagcagacatgctttcagaaggttctcatattttatgtttgattgctgataagccatctctattgatacagattttggttaagtaaggaaaaccaggtgtgtgtctgtatcatttattgtaaatgccagctgccacttgccaaccatcatgttcagttcaattcaaagaaaacaaactctcattacttagtgtaaactaaaatacttaacaaattatatcctaaaaacaaggtctctttgttaaatgttgcatgccctaggttttaaattactacatccaaatacagttttcgtcttaaatttgttaagctaaatatatgttggttctttttattttggaatcctttaagcatcttaaacattttttttttgaagagaagttacaaataacatttctatcaggtagtacttgt

SEQ ID NO: 60734 - DNA, 2306 bp, Homo sapiens
cacctttcttattctataattttgatttttcaattttatatacttaatatactcactgtcttactatcagaaagttattttgaccaagatttttattatcttcatagattcagaaagagatgctaattctgtaccaatgtcttcctggttactattctcttccctctaatatatactggccatttgtaaaaccattgtgttgttgggatcacttagttatactatacgcagatagagcatctcaactctgtcatagtgtttgctgaacagttttcagtgtcatgcacctttggctgctaattgttcctgacgtgcactcttccgagttggtaaaggcacagtgtgttcatgccagacttctaagagaaacaccagcctcttaaatcagaagcctacacacaacccccttaacaatccaaagaagcttgatggtgtgcaaagaagcatcctgccagccttgtcattgttctgttctatgctaatcctgctgtgttgtctaaaagatggagggaagaggacatcagtgtctgatagtgaaatcatcagcaggaaagtgaagctctttccttggttacagataagacttggtttacactattggccagtatctgctaaacatatgaagacttaactattcagtgttgcctaggcattcgcctgcacaacattttgaggttagaacatagaatattttcagaaatactgttgtagtttgtgagtgttgttcattagttacacattagctatagagtggatgcatgaagccccatgacaccagtaaacttctcttaccagtaggtaaaccaaacaccattctgtcattagcagccctcttaaatgttgcctctccgtatcctgttgcatttttgtgtgcattgtgtttctactgatctctcttaggtttttacggaatcaaaggaaactaatttttccttaatagcaagaaagatgaagaggtaaagggcattgaagcagaaatgtatagtttggggtacgattagaaaactcgtaaggaaaacagaagtcctaatttcaaactgactgctcttcgttaagtgctcttaaggagagtctagtaacagtaacactttctggccatttctagtttagattctcttcgttactgaaacttttgagaaatattacctgtggattaattttgcacaatgttctattctcataatgacttacaaattaaactaggtttttattgaactacctcacactaattttctatgctttcccaagtaagctgttgccctgttagatctttactgagtgaattataaatgtgtgttaaatactttctagccaatgttgacacaataccagtaagtatgtaaagtatataccttacatcagtaagagacacgtgtaaaatctttgactgtatgtcttgcaaaattgtgctcgttgacattattactgtttttgtaagtagaaacctgctcgtgatatcggtccatttacattttacaaaaggagtaaatcttagtaaaaattttacgaagaaataaattacttttgtaggcccaatatttggtatatttttgagaagctgttaatcttttagctgaataatgaagttagactgaattacgtgtctccctggactgtgacatctattttctcattacagtttatcctggtcagcagggtgtcacacctggaaacctgagtatgatagctgacatttgcttttctccctctgcgatgtcattcctcctccattcctctccttccctgtgttccgttccctctcctttcctctagacaaaacaaaatggggcactttttagggaatgctgagatcattattgtggtttttcatcattcatgccctagtcattaaacatgcaccactggaatgtaaacaatgttatctagtatgtcaattggttataatattttaaataaaaaagaaaaaagtggtatgaaaattatgaaattaagagttttttcattgaaaacaaaatctgtttgtggtaaagtttttcttggcaattttaggattgtccgtggattgggataaaaggggtcttgctagggccggtttcttagatttggattttgtacagattgtaaagagcctaaatgatcacgctgattatctggttgatctggtcttggatttctggtgtttgaaattgctggataaactttatctaaaaaaggaactttgcttcaatgcccttaacctagttcttggtagacatatgagagaacagccatcgtgaccacttggcaaaaataagtacttaaaattggggtctgtttcaaaacaagcaagaggttttagctttgac

SEQ ID NO: 60735 - DNA, 1059 bp, Homo sapiens
cacccagtgggcaaaagcccacaggcagcagggctcagcaggggtgtggcggtgcgtccaggccgcacacaggagactgggcatcacaacttgcttctttgatgactgctgcttccttactttgcaggtttctggatgaagttcaggcatactcaaatgtcaacaagatgagtgtccagaatctggcaaccgtttttggacctaacattctgcggccacaggtagaggacccagtaaccatcatggaaggtaagtgggaggtgtacctggtggccctgggtgctgccggggtctgggctcatcttggtccacggcaagtccttggaaccatcccagcccagggccaggccagcaggaggggtggctcaggtggcacatctccatctctggggacttggcaggaacttctgcagacctcacccccgacccccatgaggttcagctataagataaaaaaggaactttgccctgcgatgggcagcagcaggtcactgggtgcaattagaatagccaggggtttctgtggatggaagaggctggagggatgggagaggtcagcacttttgcccttgaacacagacatgtttgcttttcttttacaattaagcaattgtcataggttcctggatgtcagctttgcaaaccctggagaatttctctatgataaataacaataagtgattaaaaatagcagcaacagcagccgctttcagtaagcttctaccaagtgctttgtttgtatcatctcatttcaggctttacaaccagcctgtgctgtggtaatcgcccccactttacagatgaggaaactgaggccaagagaggcgaggggactcaccagaggccagtcagccagacttagcaaagggcacaggtgtaggctgccatagaaaagacagcccacctcatagggcccatggaacactgtccccagtggagtatgcatgagagacgtgctgctcagacaggaagcccacagctgaggctgttcttgcccttatcccatgttgagggacgtggcggagtgcttttgctcaagtccgcactttggtcagccct

SEQ ID NO: 60736 - DNA, 1158 bp, Homo sapiens
tcttggccgtgcttcctccggtgacctacccccaggctctatcaatggcaagatggcacagcagctcggctcccctccttttgggttctggggacaggagagcgagtctcctccatctgctctggggccggggccatgtccatcctacccatcatgggggcttacccaggccctggatgcccctgggtggagccaactatacccccagcctagggccgtttggggattctgtttcccctgacagtgcccccacccattatggggcagttttttcatagagttctctctacatcaggaaaaactaccctccatggggcttatgccctgtcttcttggatctgccccaggatgggcccaccaggacctgcaggcagccctggcctcccagggcttctcctctgggggcagaacactcagcccctcagctctttcccaggcccgtcactgcagccaggggagggtgtcagctcctctccttagatgtggagtccaggactgaccactgttccctagcggtgctccacccagggaggtacgggggacccttcctctggagctttgtgaagctccatcccagtgttgacgctcagtgagcttgtcgtccattctgaacctcagccagccaggcctcttccatcctgtgtctcagcgttagggttgcagattgcttcaaataatgtcacctgggtaaggcctgggagccgagacttttggaagctccccaggatcagatgctctgccctagtgcctgatgctacctgaggggcttctgcagacacagatcagaccttgccactcccctactcaaactctgctggggctccctggagtggcacaggccgtctgcgcctcacccacactgccaagcttctcccatcctgctgggggggtctccacctgggcacacctgctctcccaaggtgtggttcctggcatgctcagcctcctttctccacctggcctgcctgctgaagcccccttgagaggcagctgggcaccctagggtgggttccatgcagacctgactctcggcctcccagcagcctggggcagccttccctatgtcttggaggccctcccctgtctgccttctccctctctggctgcttctaccctgcttctggaattgtgtcaggagggccatctccatggtgggca

SEQ ID NO: 60737 - DNA, 1760 bp, Homo sapiens
aggttttatacactttgtttttgggtcaagcagggtgaggaggagcatttactgtgttctgctctgtgccaggcactgtatcagggaccgatgtatcttattccaaaatagcccctgggtgggaagctaagtaagacaaatggagccccacttttagctggctcagtgcccaggtctctgagaagtcccaagcctggacatggagctttggcatcttgcccctggaacaccccacaagccaccctgcagggaaggtctctgcacagtgggtgtgaataatgtcagacactccaaagagtcaggcacgcaccttgtagagcttaggggctggcacaagtctgtttctccagttactgtgccgtggtgtagacagctttatggatctcaactccttcccttctttgcctgggctgccaggaacctcttagcctagtgatatatttagttttcatagattttctcagaagttcctctgcctccttcctctctccctctattcctcatttggtgtcttgtcatgtattgttttagatcattctctctctgatttcttttctttctttttgctaatgttatttaagagtaacatgcagaaaagcatacaagtcataagtgtacagttcagtgaattttctcaagaggaacataactgggtaagcagtgctgggggagagacacagtgttaccaggaccccagaagcctttgagccccttccagtcactgacccaccaagggaaccatgtcccggcctaacagcacagatgcgtttgacctgtttttaactttacatacatggagtcatgcagtgtgcactctggggtttggcttcttttgtttctgatgattttttttgtcttctaatttttaaaacatttcataaaatacacttagcataaaatttcctgtcttcatttttaaagcacacagttcagcagcattacattcatttcaattatcgtgcaaccatcagcactatccatctccagaacactttccatcttgcaaagctgagactctgtgcccattcaattctaacttgccatctcccctgtccccagctccttgcagccaccattctactttctgtctgtgaatttgaatactccaggttcttcatataaggggaataacacagtatttgtccttttgtgaatgatttacttcacataatgttctcaggttcacccatattttatcacttgtctgaatttccctcctttttaagggaattcaggcttaaggctgaatcaagttctactgtatgcaaataccacgtcttggtactccattcattgatggacacatggcttgcttccgcatttcagctactgtgaataatgctgctgtgaacatgggtgtgcaagtatctctttgagaccttgcttttaattcttttaggtatatacccaggggagggattattggtaattctggttttaattttttgaggaactgccatactgttttccacagcaactacaccatcttatcatcctgccagcagtgcacaaggaagggttccagtttctccacatccttgccaacacttgttactatctgatcttttgatagtagccatcctagtgggtgtgaggtggtatcagatagtggtttggatttgcattttcctaataatgattgatgctgagtcacgactatggttttcacattactatgtcatctgtcttgtccagtgagctgtgcctcatttattctcattgctgcactgtgttccatggtaagaatagaacacaggaga

SEQ ID NO: 60738 - DNA, 1038 bp, Homo sapiens
tcttccaagggctagtgggaaatttgcccagaccgaagaggaaagcgctacccagggagaaggccctacccactcacaggcccatgaaggcagacggattcatgccactcaagcagtgggcagagctggaggaaaggggagggaggcaggaggcaggcggcaggcaccaggggcactgccaggtcagcccctcccctcatgggaccctctgcccatgggcacttcctcctggatgccctctgcctgctcatttgaggtcctagcagaggcctctggtcctgagaggtgtagcttcccattgctacctttcctacttatcctggccccagtgtccttgggggaagtctgtgccccagaggtcaaagcagaagaggtgaacgaatacctgtcaagaccacatgagaggagcatgggccaggttggaagtgagaggggatggtggagactgcggagaagtagcaagtgtgagtcctatcaaaagggcacagatgctactgagctctgcaattgttgctttttttggaactcaggcctggtgtcaccacgtctggattttttaagagaagctgggaatccagatttgtatatgaaatctcttgattataaataactaatttaaaaatgtttcaaacatcatgtgagctaaacaggcacatctgtggacctgtgtggcccactgttaggcatcagatgttgagctctgactgaggtgagagacagcaggggctcagtgtcactggaccagcccaggccactcttgggatggtggaaaggccaggacgctgtcagtggtgggccctggagcctcctcggactggtttctcacagctgtccctggcagctagcaggccaagcttgcagcaggatcacctcctgtgctcaaggctgatgaatggccccttgggtcccatttctgggcaggggcgcctggtcttgcccaccaggtcccaggtgggagcagctttcccttcgtgttagtattgcaacctctgcctgttgtctgttcacatgacccatgttttcaggaactgctggtgc

SEQ ID NO: 60739 - DNA, 1051 bp, Homo sapiens
taagggaggccgggcccagaagccccagcacagggtgcctcccacaggagggccgcggggaaggaagcctcttgggaggctaagctggaatgagacctcacagctcctggcagctcccctccaagggttccagtggccagctgggaatgtggggccagtctgcagcctggtggtacctgggggctgggcctcagggaagtctcgccctcatagcaccccctaaagacaggtgtgatcctcccattttatagatttcatagatggagagactgagccccaggaaagggaggcagctcctctcctcagtgggttagccaggacgtccaccagaccagtgctggtgcagacccagaatctttgtctctgtgacctttggccttgaacatcgcctactttcccgtgtccccacctcagccccaccatgccagggcagggtgctgccaaccatgctccttcacccctgccctctgacgcccatgctcctccatcatgtgccctgcacccccacccgcctacctggcttcttcctgctcatctttagacgttggcttcagcatcacctcctccctgaacctgttctctctagaagtgcccaggaccctgtggatgtccctttcctggctcttccatccctgttttgggaaagtgttcaggaaggcgccatgggggagcagaagggtagtggttgtgctggggctgggagctgcttggatgtgcaggcactgtacaaatggtgggctggcccaggctctgcacccctagggtctggtggagggagtagggcagggccttgcctgcttgccaagtttgggctttatcctgaggacgatgtgtgtgggggaacagggagcaggggaggccccagggagatttatatgtttacagccttcagggcagctctctaattcctagagtggggccaggcacaaagtataggggttatggaaaggtggatggacagacagacagcaggagttttgggggtaggagatgggacagcaggccgggctggagccaagagatggctgggtggaattacccatgctccatg

SEQ ID NO: 60740 - DNA, 2749 bp, Homo sapiens
ccccctgcctgtcctgagccccaaagaccctgctcactgaggacttgctggctgcatcctgtgcttctcacagcaggctggcccttccactgccagccctcgggagtcacccaacggctgccgtgtactcacttcctcctttattgaaaactgtgtattagacatctaaatgtactggattctattccaggggtgaggaattcatgaggataggccacacctccgccttccctcatctccattctctgtgggagggatggtagacaaggacatgtgtctcgtggtgtccaggggtgagacatgtcacaaagccattgaagctcagtgagaggacggcgggggtgtggttaggtggagtggccaagcaggcttaatgcagcaacggggagccaggggcatgctggggaagagcattccagcagagacatggacacgtgcgaaggccccgaggtagggacgagctttgggaacacgaggcatgtcaggaaggccggggccccgagggagtgaagaccaggcgagtgggagggcctgaggtaagagtggtcaccaaggccttggggtcctggtggggattttttattttgttctgtatacagtgggataccaggagagctcagagcaggagacacacaggacctgagtcagatttatgtaaaaggtgccctggccaccacatgaggagtggaccatagagggacagcagtagacacagcaggccaggagagtccatggggtgggcatgcagctgatggtgcaaagtggccagctgcaggtgtatccttaaggtggagctgccaggttttgcctatggtctggacatggggtatgagagaaatgaaaggtgactcccagccgtgcagtcgctatctctaggtcggtgtccatatgaagtggtcatgaaaagatctttcataatgggatcaccatggcattggggccagggccaccgactccctgctgaatgtggagactgggagtctgaaagctggctgggctctgaccacacaagctatggacgtcctctttctccctatggtgtttgatcagcacacagtctgggcagggactcaccttttggggctctgggccagtctccagatttcacaagccacatgggctgagccccttcctttgctcctctgtttgcccactctcctctcccacccctggctatggtctacctgaccacctttcattgaatgataaatccctcacaaggaagagtcaatataatgttgagagtgaaagttgttctctcaggcttcatgaatgatatcacactgtcagccttggtctccttgatccctgaaggttgcagcacatttgacttagggccctagattaatggcctggaaaggtctgagcccacccagggatttctgcagcctcacagtggctttggttccaggttgctgaaagtgaaccagtggaacagaatagagcccagaagcagaatcttacatagttggactttgatgtatgacaggtggcacttttgagcaccagggaaggaacattatcataatcttggggtagagaaagaatttttaaatgagttacaaaaaaacactaatctattatgaaattgttgataaattatattttataaaatgaagagcatctgtttgtaaaaggtagattaagaaaatgaaaagataagctatacattgggtgaaggcgtttgcaacacatgtggtcatcaaattactcactccccaaactcctacaaatgaatgaggcaaaaacagacaaggcagcagaagcgtgggcaagagacttggacagccatttcctaaaataagaaatcctcatgaccagtgaacataggctcctgcgcacaacctcatcagtaatcagggaattgcaaattaaatcacaatgggatacttgtatgcacccaccagaatgactaaatgactgaatgaaaaagacagtttcaagtcgtgatgaggatagaaagctatagaaacttgcacatattgctagggaaatcagcagtgtctgctgaagttgatgctgtgcacacctgtgtcccagcaattccatatgaagcatgtcctacatagaaatgtgtgtacaggtatgccaggagacttggatacatgggatgttcatggcagccttattgatgatagcctgacactaacccaagtgcccagcaacaatacaatggataaataactatgactcagtcttacagtgggaaactccacaacaatgggaatgaatccactacagtgccacctacatgcatgaatcttaaaaacaatgtggaactaaacccaaacaaacaaaataacatgttgtattatctacctatataaagttgaaacacagggcagaagtaaacttgttatttatagatagataggcaacagaatataaagaaaagcaaagaaatgaatgctatgaaagtcaggatagtagggaggagggaagaggttaagatgggatgggagaggggcatacatatcttaaatgttctctagcttggcttgggtagttacacaggtgttccttttacaatgacatgtttatctgcatatttatgctttaagtgcttttctagatgtgtgcatataaaaaataaatgaaacaaagggagaaacttgggtcaaagaagtgagatgacttgcccaagatgacacagccagcaagggggcagaactgagaagtggaggtggatgttctggcctcaaagactgtgcttggtcctggcccaaatagcccgtccaagagctgcacc

SEQ ID NO: 60741 - DNA, 1699 bp, Homo sapiens
tctcccttgcacagcgagggcgccccttcttcccattctgcgcggggaggccaggccggtgtggccccccacccctgcttggctcccagggaggcggaggcagccccggctccgtggcgccccctggcggctcctgggagagcgcgcggcccggcaccccgggagagtaacgggccgtggggagggcgccggcgagggcagggagcagcgcggggccgccccggcgcgcggagataaaagcgggcagtggcgcggcggtcgcgatctgcgcgttctcctattgattagcagggtctgcccggaggccggcatgcccgctgcgcggggccgcggtggagtgtgagggcccgggagccgcgggccggcggtcccgcgcaccctgcgcccagctgggcactgcccgtgggccggacctcggccgcgccgccccggggcgcaggcggcaggcggggagaggagccgagcggcggggccgcgggcggctgccatggggctgtgctgctgcaaggactggaggggacacctgcgagcgcccaaaggtaactccggcgcgcacgtgcgccccgctccctgcggccgccgccagaggctgccagccccgcctcggggactcgccacggggtgtccagggccgcccgcacctgcctcagctttggaaagggctcaggtgcggctgctgctcctctgagtctcctaactttggaaggggaggctccccttcactcggggcgcgggggcgcatcctggggctcctcggtccccatgtgggagtgggggtggggtccggcccctgggcgggagtgggtagagcggaggggagggtccgccctccagggcccggggctggccgcggcgccggctgcaggtccgccaagtccacggccgggacggaggaacccccggcgcccagacccgctcgcaggtctctgcaccgcgagcccggcgcgcgccctgcgccgcccctgcggcttaactgccgggagagggaccattcattctcgcccgcctctgtcacaaacttggacggtggggccctgactcagagttttccaaaactcgcggcggcaacctgcgagcagagctgcttgaggaatgcagcagtcttggagagggcccaaagcccagaaacacgcttaggacgttggcggccgccggaggtccggcctcccgggggctggggcccggccgacttaacccttgactgactgaaatgatccctgttgatcgttgggaacatagtggtgcatccctttactgcagcgctccctaaactcacctgaccctaacactcacctgccgcgcttattaagcatgcagattcccaggccccaccctggcctgctggataggctctggggaaggccttgggaaactgtgtgtttaaggagttccccaagtgactcctatggccaggtgagtctgggaagccttgcctgtaaaccatatagggtaaggcaggctctgccagaatgagcactaggtcttccttcctccgaaaagtgtattctgcatccagatacagaaaaggtcaggcagccttcgaccttgtccaggtgagaatggtgccatcaatgtacaggctggtttcacaaagggtttgaagtagcttataacatatataatacttaactatttaaaaacctaaacaggaccccacatttacacaggacgtagagaggtcaagggaaaatggagccca

SEQ ID NO: 60742 - DNA, 1113 bp, Homo sapiens
gggtctcccatcttcctgcaccccctctctgcctagcacctccatccatgcagcatgctgctccagccatgctgtatcatttacttggcccgaggcactgcccctgggacttccggtgccgctcccggaggcctgcggtcaggtgggaagaacagagctgcaggcatccaagagaccgaggagaggacctgctgcttcccccctgtgtgcgccaccttgaaaagtcacctcatcttcctgagtttcactggatggtgacagtaatgacctttgcaggcccttggcagacattttggaatacagcagtgcctggcacacagcagatgctcaataaacatgagaacctcccgtcaagtcagcataggaaagactgagaattccagcatcctggagaaccaggcctcccctgatgggcttgggggcagagctggagcatgtggggacaggagcaacacacccatagtgaggctggagagggatgtgagccacttatcctcatcacatgtacacagcccgaggatgaggagagggctccaggaaggggctctggtccacagtcttccatgtctggcacagagcagggctccacaaatcctggtggcaggaataacgctggagaagcagaggaccctctggctgatgcaccagagcagagctgcaagaccagccaccccgcaagggctgccctgaaggaatgtggaaaccagaaggatttctttcttttcattttttaaaaattaagagaagctaaccttctttgtcctgtgaagggtcacttaagtggccctcttagatatgcaaatgcaaggctagaaagcagccggcctcctgggattcctgtataacaggaatttttgcagcccttggtgatggggttttttttttattgagtggcctggcaaagattgtgcccttctttggcctgcagaagaggggtgattggttgagagagcttggggaggaaaagaaatttgtggactaatttgcacaaagagcccaggttttctgaaaggaatgagacaaatacaccaacacagtgttttcacacttttttgacaagaaatagacattacattgccccctgggagcccagggcaacagaagctgaggctt

SEQ ID NO: 60743 - DNA, 1191 bp, Homo sapiens
gcaatcttggctcatggcacctctgcctcccaagttcaagcaattctcctgccttagcctcctgagtagctgggattacaagcacacccaccgcgtccagctagtttttttgtatttttagcagagacagggtttcaccatgttggtcagagtagtctcaaactcctgacctcaggtgatctgcactgcctcagcctcccaatgtgctgggattacaggcatgagccactgcgcccggcctaggccctctcttttgatgatctcaacaatccttgccagatggtgttcgtatccccattttaaagaagagaaaaaaagagacatggacagattaactgattcatcaagggtcaagccaagctcatcagtggccaagcaggcatgggaagccaagtgtgactgcagaggctgattcaagaagagtaactaaaaaatacactcacccagcccgattttaaggaatttagtttcacacggcgaacaaagtaatttcaagcactggtaatttcaggaagtcatattttgtcaccaatttgaatttctcttgagaggaaatgtgagaactaatgagtcacagtgaccccctgtgccaattgctatttcaggatgtgctccccaaaacattctcactgcagcagcttccatgccaaccccagacctgccctggagatcggacatgggctcctcttaaccaggagcttggtgaggggtccagggttctttagcatccaggtcacccttttacttcaaagggctttgagggatagaggtgttgcctgacctggacaatctgggtgcctgatgtactgcctgtcctgcagcccacattgttgcatttggagagaagtgatcactcagttttcatggccacttccaatccaaccttcaactgaggcaccattgcaagtatgccctagatgacaatcattcactcaacagataactaagtggatgtggattaaagcccctggagacacagagccataagaaggatgaaatcttttctcgacaaagacagtaagaaagctaaaatacacagagctagaatcaaaactgtgaccacgcagccctccctcacattgccagtcagacccaggctgccctgaccagtgctggctgaccagctgggcagcagagaacagtgggcacttcctaggtcacttgaaccagggactgtcagccttcaaccat

SEQ ID NO: 60744 - DNA, 1032 bp, Homo sapiens
ctctccatctggcctctgcctgtgtccctccaggcaggctctttagcagggcacacagtggctccgggcccccacaggcacaaaagcagaagctgccaggcctgccaaggacttaggcccaggaaaagccagctttggtcaaagttagtcaggggctcggcttagacttagtgggaggggacaaaagcctcctcttctgtgaggggtgacaggtgtgtgtaggtgagagatgcctatggggaaatatcttcaaagatcagcagctgtcattaccttactcatctaacaaatgggtaaaaacatttgacccctaaatcccatcttgtagcccgtgaattacttggagtctgggatcttacattctctggcttggtatttaagccaggacctacctgggacaacatggagactattacacattagacatcacctctgtgccaggaatgctatttctccaatcttcacagcaaccttttgaagtccatgagatgcttcccattctgcaggtatttggggctcaggaaagttgtttggctttctaagattgtggtgatggtgaggggaagatctgaaacacctctggcccaagcttaagatgtgttggatctttgcagctctcacagactgcagggtcatgcattctgggcatggcacacctttccaggtacaacagccttattgtgagggcatctggcttccttagctgtatttcatacaacgcattgtacttgcaattggaaagacacagccagtggtctgggtggtcttagcagtcaaacagttgctgatggatgtattctgcaaaaatccactgcggcctcttacaggcctggaaactccatggatgagcctcagttttagatgaattccctgagtcatcacatcaccatatggggaagaacctctgctctttgcttatcctatgacagtaattggacaaatgaagtatgcaactgataattccatttggagcgagttactttttctatattcaggtcacaataagtaatttaggaaaagtctaattctccc

SEQ ID NO: 60745 - DNA, 1046 bp, Homo sapiens
cactgtgtaagtatgaatagtagttatatagggctattaaggggcatgcgcatttttacctatatgaatacacagtttccaattgcttcaaaatgctgtggccaacttacactgcaaccattaatagacaaatgcatcatttgcacaacaatcttgccagcattttattttactattctttttaaatgtaatacataataagtgatgttaaccttaacttgcctctccttggtgacttgtaaggctggacatttcatattttctggacatgtcactcgctcatggactgagagaacattggttgcatttattaatccccaggtcaaaggaagagatgtttctgaaactggggcctgactggttcctgctgctcctgcagggccacctgcatgccagcaccactgtgctggcattgaagctgctgctgtactttctggcaagcccctccctccgcacacggtttagagatggcctgtgtgcaggatcctgggtggaacgcagcactgagggcgtggatattgtaatgggtgagcacgtggctgtctccagggagtggggcaccacctagtcctgggatgtgaatgaggaccaagccaggccccttcttatttgagaccatcacagctctgtgcagcaggatcacctcgagccctgactccaaggcctacatccaaatgagcccagcccccctgacatcctttgcaggatcccccgcagcctcactgcacagacactggaggctgccttccattcctcccacctgcttagccctgttctcctgggcactgtatactctgcttcctcttcctgaggggatgcctcttctcctgatgtggattcatcctgagatctcagttcaaatgccacttcctccaggagatgaggggtctccctgaattgggacacctctgttatattatctctgcccttattatttttctctttagtgcttcacaaaattcataattatttgagtatttaattgcttaatgtctgtccctcccactacaatgcaagcttcatgagtgcctggaattctgtatatt

SEQ ID NO: 60746 - DNA, 1069 bp, Homo sapiens
ggtgtagtattgtcgaagactcccaatcacagctgtgtgaatgttacatatgatagacctcaatttggaagtcaatcaggggaatcaataatgtacataatttagcttttctgagactttgggtctttctgaggatccatcctctatatggctattcagtttctacaagcaggaggaaaatgactatcttttctcctaaaagctcgttaccattttccagagcattcttccatatgtcatctgtgtttcagagtcctgagttgcagaaacagtcagcacagagcaaactgaaagcagtgagccagtggtagagctctgtaaaagctagggagcatttctgcctccagggagaaaaggcactattgaaagagcatgggtgttagagttggaggacctgggtttgaaaccaagtttcacctcttgaggaccacatgaccttggaaaagtctcacctctctggaatgcagtttcctcatttatgatatgggaataaaaataagtcatggtcagtataaggtttccttatgaggatccaattaaataatgaatagggaaatgcttggcaggccagagagcatgacagtcacttagcaaacatgtcctgagctcaggggaagatacagaggacggagagccatgggcaaagacctgcgccttgtagggtctgcaggggagagagaacagccagacctgcagctaaggtatggagaatattttctgtggttcccacaagcatgggatgatgggagcacagaggagtggccatgtcatccccaccagtaccttgacctgggatgctgctagacctaagccaaaggtaggaaggagaattgtctctgtggccttactgggagtcagagatgtgtaggagcagctcagctgagatccagatagagacattaataatggacaaaggacctcagccagcagccggtttgtattaaagcatcctggcagaagcattcagaaccaaagcggtgttttgtgtttgatccatcctaccacaatgcggcttagaggagagggcctgggagggttgttctgagaagggtctgcagagagcctgagt

SEQ ID NO: 60747 - DNA, 1049 bp, Homo sapiens
gtagtcactttggaaaacagtataaagattcttcaaaaaattaagactagaactactatatgatccaacattcccatatctgggtacaggcccaaaggaaatgaaattaggatattaaagtatctgcacccacctgttcattactcacagtggccaagacagagaagtgaacaaaatttccattgatggatgaatggataaagaaaatgtggtatatgcatacaatggaattattcaaccttaaagaagcaggaaatttttaaatttatgataacatgggtgaaattggaggacattttgttaagagaaacaacccagtcgcagaaagacaaacactgattgatgtcacttacttgaggaagcttagacagtcaaactcatagaagcagagtagagtgggggttgtcagaggctgggaagcagggaaggggggagttatttgtcaaaggaagtaacgtttcagttatgcaggatgaattagttctggagatctgatgtacagcaggtgtctgtagttaacaatactgtgttatgtgcttgaaatttgctgaggatagatattatgttaaatgctcttatcacacatacacaaataataaataaaagcggtgggaggaaatgtttggaggtgatggatagttttatgcatggattgtggtgatggcttcatggggtgcatacttatctccaagttcatcaaactgtacacattaaatatgtgtggctttttgtatgccaatcatacctcaataaaatggcttaaaaaaagacagtcccttgaggaagaggaacttccgcctttggatcatctttggattggagctgtgtcatcaactcttcctgggtctccagctattcccattttggacttgccagccttcacaatcactccagccagttccttaaaataaatcactccctctctatagccacatatcctattggttctgatcttctgcagaatcagacccatacagtgcctgaagttcagtggtgtttttgcagagtccttccctgatattccatgggtgttccctccttgctcatct

SEQ ID NO: 60748 - DNA, 1051 bp, Homo sapiens
ggatagctgtgtccagatcttctgtctgctcatccatgtgactcagagaggagggttctgggcaggggggccttgccggactgcatgagaggacatgagttttgctttctctgctctaatattttgcttaagccaagaatccttttcttagagatgttctatatgattcctgtcaggattttctagttttttttggattatagcttgttcatttcttttgtttttagtttggtttatatataatgagggaagaagatgattacattatttttgtcactttgccatcattgtttagaagtcatagaaagaatttttaaataggccaataagtcttaaacttgagtacttggcttagaagaaagtcaaaactccttcctttttgactaagtggtttgtttctggggagctcttaatttctatttttataatcattagcctataaggaaattgtgtcttccttgttctcagggtgatctgctgaccttgttcactcatgaagcatttgggtatcatacttatagtgtctgaaacataaactgtattgagctagacaaggtatagcctcctcttcaagtagcaaatactatcaaaagctataatgcagtaggagcaaggtggtccttgttccagtttttgtctcagttctgctgctgatgtaccatgatcttgggaaggtggtgtctcagtgtggagatctgacacattgttaccgtgcctcctggctggagggacttggagaacaatgcagttaagtagaatggttttaacaatacagagaaatttattcatttagataaaaatctgatttttagaactttaaaagctttgtacagtgtaaatagatttaatgtatttaacatgctttatcagcacaaataaaggattttaaaattttgtcaaaaaattaaatgttaatactatcaccattaaaaatgttcaagcaatagtctgcctccccacccccacaccatcttgcacctgttccacagctaagtacagccctaggtttggtgtgtattctccatgcatttagagaatcacatgacacaga

SEQ ID NO: 60749 - DNA, 1074 bp, Homo sapiens
ttttatttgagagatggtgttgttaaaaatagtaagagatacaggataatgattaaaccttaatgagataattagccagtttacagcacacattaattactttgctattcagtatgctcttttagaatgattttcctacttggaattgagaatggttcccatcatcttttgaacaagatactgagtggttctcattctgagatgcagcagttcctttttttttttctttttttagagatggagtctcgccctttcgcccgggctggagtgcagtggtgtgatcttggcccactgcattctctgcttcctgagtagctgggattacaggctcccgccaccatgccaggctaatttttgtatttttagtagagacgggatttcaccatgttggccaggctagtctcgacctcctgacctcaagtgatctgcctgcctcagcctcccaaagtgttgggattacaggcatgagccactgcgcccagccagcagttactttctaggagggtggagtggaagaatcgagggggatagagcagaaatggcatggctgtgaaagaataagcatgcagatggaaatgtttccaggaagaagttcattgttgaaagaatattttgatctctaagtctcaaaagcaaacatttaatctactgtgatgcttttccttttttaggagtagatttggtaagaaaaggaattctaacttctctgtgcagcatccttcatcaacatctccaacagagaagtgccaggtaatatagataacctttttgctttccagggtgagacttgcttgattgaatgctgtgaaaatttcacctgattctggatgtgaagaaaatggtcatctctggtgtaatgacacctgatatttgtgttgcacgctctgatttacgatgcacattcacttgaatctaaaaggacctgctgatttcctaaagacaaagtctttaacccaagatccgtagcagcatttctgttttgccattagaaggttgacacagggataggtgtgtcgctgctaggacagcctgccttgtctagagggaaagtgccagctccagagaccacaaccc

SEQ ID NO: 60750 - DNA, 1050 bp, Homo sapiens
attgcaaagcccaggtaagagagtttgctgagccctatgataggaaggttctaggcagggcaggacccttggtattcaagtcaaggaggctaagagagactatgagtcacatgatggcatgtgaaaaggtgtttcttgaaatgtgttagatcttggaggttgaaaaagctcattcggtgtaaataataaggtattatttctaatttaaattctgcaagacctgggagattaactgatgtattatatatttcctgaattgtaattttccaaggctgaaagtttgggggattatttagccattcatgcagcagctgttatcatctctctcttatattgctttataacttgaatttttaggtagagctacacattgttttataccagcttatcttttatttttttagacaaatcttcaagcagtttttgacaaatagagtgctaaaagacccaaaacaaaggcggtttttcaaatccaatgatctctatgagctatttactctgactagtcctgatgcatcccagagcactgaaacaagtgcaatttttgcaggtattacataaaatcatttaatttaaagtaatcaattgcacaagatgatacaatatagtattagtggtgtttttcctctttacaggaactggatcagatgttcagacacccaaatgccatctaaaaagaaggattcaaccagcctttggagcagaccatgatgttccaaaacgcaagaagttccctgcttctaacatatctgtaaatgatgccacatcatctgaagagaaatctgaggctaaaggagctgaagtaaatgcagtaacttctaatcgaagtgatcctttgaaagatgaccctcacatgagtagtaatgtaactagcaatgataggcttggagaagagacaaatgcagtatctggaccagaagagttgtcagtgattagtggaaatggggaatgttcaaattcttcaggaacaggcaaaacttctatgccatctggtgatgaaagcattgatgaaaagttaggtctttcttacaaaagagaaagacccagcca

SEQ ID NO: 60751 - DNA, 1687 bp, Homo sapiens
cctagctagtgtcttctccaaaagactctattgtataaataatgtgagtgtgattaggtcatttcagttcttttaaccatctctcacaatttcttatttcatttcttattggttgctacaggaggttcttcagtcattcacatctattcatctccatgaatctccccttaacttcttcaggtctttccaagttagggggtctagatcacactatccaggaaagggaatgcaaactacacttggaattgtaaattttctagtagtcacattaaaaaggaaaaagagaaacaggtgaaattaattttgatatatattttatttcatatatctaaaatacattttaatatgtaatcaaaaattaaaaatgattaaaaagatattttactccttttttgttctgtcttcgaaattgggtatgtattttacatatgcagcacatcacaatttggactagccacacttcatgtgctcagtagccacgtgtgactagtgactactgcattggacagtgcagattgaaaggaagaagaatgagtcacggatgactctggggaggtttaccaatgttcctgacttattcagatcatttattgttaatctgtttactgttgtttactagtgatagctaccctaccctttgattattggcttaatggtgatttctcctctgctcaagcttttagaccagtgagtttgatttgaatcatcctctcaaggctggaagagccccattattgaagttttgttaatgttcttttgtggggatgggccggggcactcaccccttgtcttctgtgcccttctgcatggaccatatctttcccattcgtgcattcctattcgtgcatttttcatgcagttttttttctgatataataataatctaaaggtaaatggatcctcaacctctgactcatattaaactgcagaacttttagtgaggtaattaggagtgtaatatttaaatgcatttgataagtcacatgactgatgtctccaaatttaggttgataggacatttctgatccatatttaaaaggcgaattccttttttatattaggtttataataccgtgaactgcataccttttttctagtgagggaaaatgaattatcagcaattgaatatgacccctgtagacgtgttcagtccagtagaatttttttgtttctgagaacttgttctatcagggaaacaagatgagtgaaagttaatttctcccagctcatgataatgctgtgactagagaagaaactaagaagctggtggagaactgttttttagtctgtgttataggttaaacagcctccttgcctagggaatcttactttacatggggtcatctgagtgtacatgtactctttcttaccacagattttctccggacttatagccctaagaaaaatttgcaaccaccctgatctcttttctggaggtcccaagaatctcaaaggtcttcctgatgatgaactagaagaagatcagtttgggtactggaaacgttctgggaaaatgattgttgttgagtctttgttgaaaatatggcacaagcagggtcagcgagtattgctgttttctcagtcaaggcaggtgagtgcacagacttcagacgggaaacaggctggttctttatgacagccatcaactcacaaaatgggattcaatctaaagtaatgattctgaagc

SEQ ID NO: 60752 - DNA, 1032 bp, Homo sapiens
cagcagtgaacaaagcaagttttgttctcatggggactcacatttattcttgagggagagtgtcacaaaaaggtatagaagatgtcaggtggcagcattaagtgtggagacaaatgaagcagggttgaaggataagctgggaatgctgagggcaaggatttggggaagtgggccatttgtaagggttggtcagagaagacctttgatgaactgacacctgagcagaggcctaaagaaggcgaaggagcaagtcttgtaggttttgaaggcagagcattgcagatggtgagctgtggcagtgctttggggccttcatagacagcagggaggccagtgtggtcagggctgggagcaaggaggagggtagaagaggaggagctagctgggaagactggggaggctggcacagacaggtgcatgaacagaagtgaagacctgggcatcggaaggtgagtagggtgacctggaaaggacccagtgtgtttggccactaggaagtcatgagtgatgcctcagtggcatcaacagaggtgcccgtgaggcttgctctgggtgcgggcttcaggagtgactggaggtgaggaagtggaggtggggatggtacctaattttctcaggaatgcccccatcttccacttggaggctaatgggtgaggcactgtactggggagaatgagtgggtcttcagatacagtgcagaggtggaagggttgccctccatcctgtacaagaacctcttcctctgggaataaaggaaaatgaggtggatgcagaagtagagacatgttagggagtgaaaaccagggaatcatgcctgatcctggtaggttcaggtttgattttcattttgtttttatttgtctgattgtttttaagtagaagttgagacagagttgcgggtggcttgggtggtgaggagcatgggcacagttgctctgggcttgtggaagatgctgggcgggcatgcgtagaggaccccctggagcaggacaggccatggcaggatgctgccatgtatgagcttttctccag

SEQ ID NO: 60753 - DNA, 1093 bp, Homo sapiens
cagagtctgactgtcacccaggctggagtgtagtggtgccatcactgctcactgtagccttgacctcctgggctcaagggatcctcccacctcagcctcctgagtagatgggactacaggtgcttggcaccacatccagctaacttttaaaatttttttttagagataggctttcaccatgttgcgtaggctggtctcgaactcctgggctcaagcaatccacccacctcagcctcccaaagtgctgggattacagttgtgagccactgtacccggctttttttctatcattttaaaatcattgcttttatatccttttcactctgtcctggaattcttgttatacattgttagagatcctagatttgtctgccttgtctctttggattttctcttattttcttgcttttgttttaaattaatatattttccatccacattgttgttttgacaagaatggacacaaaggatgttttgaaaaaataaaaataataatttaatatatgtatatatttataaatatatgtattataactttgtcatctttttgagagtctccttcccctaataacggctgtattagtcagcgtttactacttgccaggttaacaagtacacttccagtgctgataatgtctgtgattgtgcatgttatgtttgtatttgtgcatttttataaagtactttagattgtgtcatgattgaaagggtgtcacttcttatttaaaactgactttaccattttattgtggtctcaggagaaactaattcgagatgttgctcattgtcatggaattttgatcacatcttactcctacattcgattgatgcaggatgacattagcaggtatgactggcactatgtgatcttggacgaaggacacaaaattcgaaatccaaatgctgctgtcacccttgcttgcaaacaggtatgacctcttttaacaagggagatttccaagtggagaagaataattaattcagaataaactatctgcttttagtaacacatttattgaatctttccttgtgccaactgcacaagaaatttaaaatgtgcattttccttaatgcagaaaactctttatttttg

SEQ ID NO: 60754 - DNA, 1256 bp, Homo sapiens
gttattgcctcattggctatgtatatttcctgtgaactcttacaaactgtagaggggccctaatttgagatgattttggtgttgtaattttaaggaccatgaacattgaaatgggaacagtgtctctgtgataccaagaaacttcatggtaaaagaagtttgatttgttattttttaaaaaatgtgtgttgtatgtgtgtttctagaagacagagaaacatattgcttatggttaataaacatctgtactggttgctgtgttccccttcataatggatacaccaccttcttttcactttgccattcatattataatgataggcccctcaatcttataatgaaaaggaaataaattgactttcaaactcagttaattttttaaagtcttggatatcatttggtaattcctaatgttattgaatttaataaactttcaaggataaatattttactttgtagttcctggtaagttctgggtatgactagcagatttccatcctgcaggttgatatatttgaccatggagctattggctttccctaaatttattaggtaatcaatggtaatcaaagattaaaggaattgtagtctgtttggtaattgatgctaatcactgtagtacacttagccattactcatgttcatctcactggtattaagagttaggaaagggtggttcagttgacgatgtgactgttaatggagttgattgtcctgctgtggtccagcaacagtctaggtctgctcctagatctcaactcagcgtgaaaatctccaattttttctactaagggggaaaatggcagaaattaaagggcatcttgataatgccagatagatgttcagccagaagaatatactagccttagataacaaaatgtgagtcatcaatgtagcagtttgcagaaggcacattataaaagagaaaaaaatactgtataacctgaaaaaacatatgcatgtgtttatgcttatttgaatgtgagtttgttgtaaaaatattttagacagcttttgattggttgtttcctaatccctgctaagtgcatattgatgataactcttttattccccttggaggatagaaagaagctggtgcatttaatccttttagaaaggcttgctgccatggaaggggccaggcagagtcccactctccttggggagctcaaggggcacctggacaggccctgccttggtgaggagcatggcttagaaactctgtaggaagagtgtcggagtctcttgtagcctct

SEQ ID NO: 60755 - DNA, 2733 bp, Homo sapiens
ttgaggctttttttttttccccactcacgacaactagagtccattatagttatgtaaatgcaaaattagtctggttaaatgggtgcaccttctccacaaccttggtgtattgctaagactttcagatatttagatgaaatatatttccttctgaaatataagtgttcaccttattttatatctgaaagtatcatattactaaatttgtaacttagattttattcagtgaacacatttttttgagtggtagcactatcagtgcttgtatattgctgatgcctcttcccccagttaagtaatcagtaatgtgaacctgattcagtgattttgaccccaaatttgctttatgtttaaggggctttgttgttttatgctgtgactatcatatctttagaacagaaatagtaattataaatctattttttgttacatagtattgcggttgtgaagacactcaattatattgaaatttttactgaatcttttctaggactaatttcatgtcttacgaaccagcagagaaattttcccttagggtatgccagaagaggagcaagtagttttgataatgaaatgagaccttaaagaaatatttctagagcagctataataatttacataagaaatgaattgagatggctggagaagagaattgtttttcctctttgaatatcagtgttttgggtaataatggcagcattaacctaagagaccgttctaatttgcctgttttttcttgtacattatcaggagctatctttttaaatctgtcttgtgatcaaaataatggaaatgtgatttttattttcatggtaggagatggaataaactgagactgcaggacaaagagaaacgtctgaagctggaggacgattctgaggaaagtgatgctgaatttgacgaaggttttaaagtgccaggttttctgttcaaaaagctttttaagtatgtaccatatgttctttcctttctatttgctatcaagccattatgtacaaattaacattttaggaattacatagtagttacctgtgggccctgaaggtacttgcagcaatttgttgcaaaaacagatactgtcaaatgaaattatagccacgtgctgttcattaaaattggatgataataagttgactaaaatgtgcattgggtatgtttgtaaactgatgaatctatatggacctgcctcagcagactaaaagcaacacatttaaaagccatttatgttgaataatttttttgttcttagtaattttaaggtgccaaactcctaatttcttaaataagattaataggaagagttgcatattaaaatcaatattgggaaggattttttttcttctatgtggaaataaaaaacttttgacattttttttgagtgtcttatattgtacctgagggtataatatttttgagctgaccaaatgtgcatctaaatattttatgtaggatgtcattctaatgtcaaaagagaagatatgggcaacaccttgatgattaagttgctatttgaagccaggtttcatgtgtaagtggccaagcattggagatgaccggatgctgcctgatagatgtgttcatgttgtctctaagggctggccagtctcccgtgatgaatgtaaatactgaggaacattttcagtctcgtcactcctgggatttacttaacaagatactttaggaaggcttcttagatgcatataggaagttaaaccattacatagcttctttctgtctcttttgtataatcaatttgtagttgggagcaggatgcaaagttctttgttcgagatgattaagtttggtctcctttatagattcagctgtcagccatgccctaaacttgtggaagaagtctacttaaaaacagcatgctctttatattttctctcaaagagcttatattatagttttaatttttctctccattggggtaggggagagtgaagagtagtttttttatcccactaaacattatagaaagccaaactctaaagatgtgaagtgacttgatgtgattgctttaactggacagaggaacagccgtgtagaagttgaaatctgaatctgtagtaatatttacagaggtggttgctttgtttattgcttctcccaaatgagaattaactatggaaaggtaaataaaggccacttttattggcaactctttttgttttctctacagtgattctttgttaagaaacaagccaaataccatcagtgttgtactagcaaaaggaatacccaaattatagattaaattgatttaaaaaagacaggatacttctgtgtatttgtagtaagtgatttggcagatatcctcaaggatcaagttgagtctgcatttttgtataaatgtcagattttctagcaaagatatttcacaattaatagtactaaactttgcttactaaaagtatttaggattcagtgtattaacaaaactctatagtagttaatataaataatattcgttttttaaaaattagtcttaattgcacattcctggaaagtattgtgtttttttaatctctgcaaaaacaggattttaaatattttatgtcataaaacttctgttcattttcttttgctgtatgaaaaaaattaataggattgatagagtctccatttttcttttatgattgcgttttagcggggccaatttaattttaaactgtagatatatttttttactgtatttgctgcattctgtggaattgaattgacagggta

SEQ ID NO: 60756 - DNA, 1011 bp, Homo sapiens
tagccaaactgaataaatgtttggcccttttcatctttctttatgaagcggaaggcactagaatgcaatcgtttctgtagtggcttatgtggtttcctaggtgctgagttctgtggcgacaagatgcctgtatattttaggagggagggaggaggaggaaactgaatcttgtcgatgcagagtgatgtggtgggaaatttagcagccacaaagattgactggctaagtctaaggaaatggtcatcatatatcaataaagtttaaaaagtgataccctgtatataaaatatttaatggccttgtgccaaacttcaaaaggcaatatattctggtgtttttatttctccttctgtaaaattatcttggagaaattgcaaagtgaagtatgtttaagtggctgtgattcttccaaggtttatgttatccacaagtttgctaaatacaagtatcctttgttatgcagaagtttggctctgcgttcatagttttgataccgaggactctctcattatgtaaactcctcgactgctgaatttcagagtgagtagcaagaattcagatatgtgtatcaggaaagtgtatatatatcaagaattcagatatgtgtatcaggaaagtgtatatatatctgttcagtttctaagttttgatagtaagggatacctatatgccagggcttcttggctttgacattattgacatttgagacttgataactttttaccgaggggtttgggggctgtcctgtgtggtgtaggatgtttagcagcatacctggactcacctgcaagatgccagtagtagtatatcctcccgactccttccacagttctaacaaccaagaatatctctgggcattgtcagattaccccagggtggggttgaagggacagaattgccccctgtcaagaacgattgttgtacaccattgcatttaactaaatttgtaaataacatgaaacccagaagacttttatagccacctagagataattcattttgtccattgca

SEQ ID NO: 60757 - DNA, 1010 bp, Homo sapiens
aatacccagcttggtgcctgaatatatttttaaaaatcaaattgtactcattgtgcctctgttgttgaatttcttaaatggatattgcaataggtagagaatgatcttgaggttgaaatgtcactctgtattaagaatgatttaactgtatgatacacagctttttccttacagacggtgtagatttaaactgctctgtgtacaatgatccttgcaacataaaaatattacaatagagcagtaaggtctgttttgaattttgagcaccacggtaggtgacctccttgaagttttggagagggcatgtttattttattaatatgatctcaggcaactaatatttgataattcccattaatatgtgtattttgtcccttttgtgtgttggtatgggcagttgtgtacattgatttgtctagtataaaatgtgtattacatgattgttcagcctatattatgtatagttcaaagaactgctaaactgattttactgttacttggaaaagtttgcaggggtgtagtgaagagtgagttttgacttactttgcacactattaaggtggggaaggaatcatgttattgtacaaaaatgaaggcaatctttcccttctttaaaccttagtcctgatgtttttttaagacaacatttggattgaagttttagaatttggtttgttcttgtgcaattgctttcgttctgtggcagttagaggacccttcgctggcactgtgagaaaaggggtggtactagggagtttggaaaatacttttttgaagacagtattatgtaacagataggaatatagactctggaacttgattatctgggtttgaatcttttcccttaactcattggtaatcttggacagcttcctttctttctccctgtctgctttaattgttaaaaaaaaaagagagagagagagaataacaatagtattgatatggtttggctttctgtccccacccaaatctcatcttgaattgtagtccccatatgtcaagggagg

SEQ ID NO: 60758 - DNA, 2084 bp, Homo sapiens
ggtgtgatgccacaatgtgcagagaggctgaggacagggagggcaggtgggcttcactttccagccagctctgatttctggggagtggtagtctattcagggggctccgaggccctgtttgggtggattgggaagagtgtgcagttccttagtgatgtctatcataggcacagtggggaactagcaacattcatgctaggtatttgccagccttgacataataaaacagatgtcactgactcctgcctctttgtccagcagtggtcagcactgcttggtcaggctgcagggcatagatgggttgcatcctgagtgagaaaatgcatttccagatatgtttttgtctcttcttgctggcaggactagggttagtgtttatcatttgacttaaactcattcccccaagttcttactctattttcatgtatcggcagttactatttaagttgctgccctcgcagactacagtgagggcaacgagcacagacgagagcaaagcttccccacccacagactgattatgcagtgtcactgggagcccctaacactggagacgctgacttaggaagtgtagcgtggggtcaccgggcaggacttttaaaaaatgttcccagatggctctgatcactgtcaggtttgggagctagggatggaaataagtcagtcttatgtatttctcttttttggggctgcagcttttggctgatgcagtttgtatatcagtttctcaaaaatcctcttttatgtgccctgcacagttgtatgtacacaggggagggcctggcagggagccttagctaaatgctgtatgtcatagatcatctggttcttgtggggtgtgtgtgtcagaatcacatgggaaacaccttcagagggtaggggcctgggctcagcgtggggagtctgaggcagcaggtgcagagtgggaggagctgggcactgcacttgtgctttggctgagctcccgctgactctgaggggagcttggtgacattcttcatggtccacaggaccttgctcagaaagaactatgttctcatttaggagagctttgaggcagttgggaagcattgttggtaaggatgttgaggcttgagaatgtaatgcttttttctttactatggcccacactcagcaaataattgcctctgggataaatccccgacccatgcccaccccgatcagggaaacatagtggggagttcagaaacggactcttcagtaggcggtgcctgagtctcctcagatgacctggtgcattgggctaagctgctaaatgcatagcctgaagtggatttgagttggttcctctgcatggtttgaaggctccctcgccacctttcagcacttctgatgagtccctatttttattgtaaaagtatgacaacaatattaagatgaaaaaatgacctcttttatgtttttattttctacatgtcattccagtctttggttctgtgaatacacatctttacatggttataatcacggcccctccagttaattggcttgcccacagttttactgtgaagtagagctgagatttgaagtcggctgggccctctacatacatgtttccttccctttgtgggattgagtagaaggtgcaatatttaggtatgaccacagggtggtgccaaaaatcaacacatagctgcccccacctccattggactgaaaaccaaaccaaaaacctaagcctgtaatctgggaatttggatgaggatatagggagatggctcaggagtctagaagacctggcaagtatggtgtggatggggacagaatttacttcatggtctggtgtaacctgaatctgtagacttgatgcctgttgatataattggtttttaataaatttttgatcctaaaggtttttcttgtgccctattttttaccttttttacatgagtaactctgagatgtaaaggggtgataaagattccattcattgtgtaagtcttacagaatgtcttctaatagtctgtgagacataatctcctgcgaagataatactcttcattgtccttcccctgagcactgggcctctgtggccagggccccattgaaccctggcttgggag

SEQ ID NO: 60759 - DNA, 1578 bp, Homo sapiens
acttctaggtctttagttggatttggaggcaagtctaagatgaaaaacttaagggaaggctggggcaagaggcatacagagggctgagtgtgagctgtgtcgcctttataccgacagtcaccctagaatgagtatcaggaaaaagaaaagggtgaattaatgcatactggataggggtttctgttttcccttttgaagcaggaaagtaattttagagaacttttcttcaaaaaagagctgaaacttaagctttggcatagaaagaataagcttgcttttgtaaatccttcctttgtcttgagaaaatagtcatctgcataattataagccaccatcatgcaaaaagtgtactttgtatgcacagcatacctttcttttcactgttgttttttatgttagagactgactttggcttttagctccatgacattgtcattgtataaagcaagcaccataaaagggaaggtgaacatgtgaaacatgaagtctgaattgcatattgccacacgttttctgagagccaggaaaaataatctgtattgcaggcctccccatggtggcccactgaacactgtgctactgccgcgcatttcaagtctccttgacttagagctcacttagctctaaggaagtcaaagggaaaaaggaaccttattacttttaaaatacttgatagtgggatggctttttcccaatcctcaacagttttttcttatttctcaaggtgaagagacctagtttgttgtatttattggcctttgtgagtgaaggttgacctggtgttttttcttgttacttagaactgctcattaacccccgtccagacactacagacattccataacctttccgaaatagatgtgtcaattcttttaaacagtaatttgaggacctgtgacttaaatcctgttctttagagttgcggcactcacattctagtagcaccttatgtagtaatgcacagatgagggctggcttatatttgtcatccctcagcacagctttcgtttctgtgcacgtttattacctgtgaagttgtttgaggaatgttgcccagtactcttgaacagtgagcggtgtcagactttttcttaactactgcaaggaattaataaaagtgttaatctcaacatattgattataaatggagcaatatatatttttccaattaaattgggtcaatattaaatatgtttaaaatatatcagtattttgatcaagagcaatttattttgattgaattttaaatgtgggtttagttaatttgatggcaataagtttttcttaataatgttaagattgtaaaacaatttattatttccagagccaatattttgctaaagctacagtgaaatctcaaatgaatttcagaaatatcaataactcttaattgccaccaaaatacgatagctcttaacattttatagctacagttattaaggctgttaaactgcagatatccacattgaaatatttgttattacatctcctttggtgctgtttggtttgggggatgaaagaaaataaaatgctcaggattgagaagcatattagaactgccagtctctctatattttg

SEQ ID NO: 60760 - DNA, 1578 bp, Homo sapiens; identical to SEQ ID NO: 60759

SEQ ID NO: 60761 - DNA, 1578 bp, Homo sapiens; identical to SEQ ID NO: 60759

SEQ ID NO: 60762 - DNA, 1042 bp, Homo sapiens
aattgaaaatattgttagtcaaaaatgcattaaatacactgaaaaacctatcttaaagtcaaaatattgtaagtcaaaccatagttaagtccagaggctcctcagtttataatggggttatgccctgataaacccatcacaaagttgaaaaattgcaagtcagaccatgataagttggagaccatctgtgtatttgagaaaagttcctttttggtgttgcttgcctcacttgggcgcacttccttagttttcctgcatcaccatttctttggcctggcttagggtcacactggcctcagtctcctggtctcctgtgaactcttttctgcttagcccttgcttcctctaattgtctccactctgtttcttggtggtgcagccattgaccctcacacacctttgctgacagttgcgagagcttggcccttcctcccaccttgggtgttacagtcagcacccagccacactggggttgtacttagctttggaaaacttaagggtagggaatatttgttacttaggatattatttttatgaagtttgaaactttttttaaggatttatgtacagctttgtgaggtctgaaacattttttatgatttatgtacccctttgtgaaaatacattgcaatagataggaatgactagctgtaaccatttcagttctgccatcccaacttgtgcttacagttgattcactgcagtgagtagagtccttgcatcttttctttaagctctccaggggcagggctgtgcgttggttcagttcacgtggccctccttttattatactttccactcaccagtctgttacctgcactaccccatcttctctcacttgcttccagaatagcagcccaaaggtcaaagctagcagttgcccaaggcaggtgggtcctcccaaatcagagagaggacatctggtctcttgtgggagcatgtgaaattgatgtgcagagaccttcttgggcttctagtgggctggaatttcaagggtgtagagcatcaaacttgagaccacttcaggtcctagtctaactta

SEQ ID NO: 60763 - DNA, 1048 bp, Homo sapiens
ttcctaacatcgctgttcctatgcattacagttgatcttgccactatattataaatcatttgtgtcataatgaaatgaagatgctaacttggaaaacagcagccaaatgacttcagctgttttgaagaatattccatggccatcaccccaggattttggtggctggctttcttagctggctgcctaaatgtcctttgttgatgatactgcatttctttttctggttaatttttcttatttattatcagaactcaagaagatacgttgtccctttttagtaaattaatacttggaaacttgaatttatgtagttggaagattattacttgatcttttgagaaatcagtctgctctaattataaaatatttaagaactacaatgaatcctatataacgaaaaggcttataaatttttttccttttaggtagtctgtagagaatgccaaatgagggaatcccccactcaagtcaaactcaggagcaagactgtttacagagtcaacctgtcagtaataatgaagaaatggcaatcaagcaagaaagtggtggtgatggggaggtggaggagtacctctcctttcgttctgtgggtgacgggctgtccacctctgctgtggggtgcgcatcagcagctccgaggagagggccagccctgctgcacatcgaccgacatcagatccaggcagtagagcctagcgcccaggcccttgagctgcagggtttgggtgtggacgtctatgaccaggacgtgctggaacagggagtgcttcagcaggtggacaatgccatccatgaggccagccgtgcctcccagctcgttgacgtggagaaggagtatcggtcggtcctggatgacctcacgtgagtgcagcccatcttcttcctttcaaagtggtggtaaaacatgacagggatattcaggtaatggaaagctctagtattccagaagtttaggagatgtgtagaaccttttatttggaggacagagtcaataagggcagtcctcaacctcatctttgagtcccagcccttccccttaggagtggca

SEQ ID NO: 60764 - DNA, 1817 bp, Homo sapiens
tgactatgtccagggaaggacaggtgtgaggctggtggagcagagctgtcttggaaaatggtcctgggcagtagagggagggctgggaagggcctcagcatggacaggggttggattttctcccatgtgtgtttggatgtcccctctgtgcaggtgggcagctgttagagctctgatgtcgggactggactacctgggctacctgccctgtgctggcttctctcttgagggcctgggatccatttgtcctctctaccccagagtcttcacctgagatgcagggatgtgaggacactacagtagcttcctgagaggttttgcagtgtgcgtgacctggggtcaggatcatgggctcaggaaggaagaatggttggggcttggaggtgaagctcagctgccaggctgaaagaggaggagcatgcagcagcctcctgggacatctgcttagtggtgggggactgcagtgctctgcaggaggtgggcgcagctgggcagaagcaaggttggggcaaaggatgatgccatcatgttgccttctctgtctccttcagggcgcttcttattgtacccccacctccggtcaccttaaacgtgatgcttccagggctcaacccttgggtgtctccacccctctccctatgacagctcagggtgtcatctgccccctgctccatcttttagttcaagaggtgtccactgcagccacaagtccaaacctgcagttagtgtcagtggctaaggagagcctggggatgcaggcctggtcctgagctgccccagcccctctgggtaccaacgcctctgccatgtcctgttggtccctcagggaccagcttccagcgggtgattcctgaagatggggccgcagcacgggcccctgagcaggtgcagcggctcatcttctgcacgggaaaggtgtactatgacctggtgaaggagcggagcagccaggacctggaggagaaagtggccatcacgcgcctggagcaggtgtgcctgaaccccttgtacagtcaagtgatgggcaagctcacgtcgctggccccggctctggccaatgtgccaggcaggccagatgaaggccggtgaggccctgtgcctcctgtccgggggtgctggggacataccgcccctcctctggctatgctcctttgtttctgcctccccagatctctccattccccttcgacctgatcaagcaggaggcagagaagtacccaggtgcggagctggcctggtgtcaggaggagcacaagaacatgggctactatgactacatcagcccacgcttcatgaccatcctgaggcgcgcacggcccatatggtacatggtggggccgctgattgcccctcacctcggccctgaggctctgtcctggctccatctgtcccataggccatgctacccagaactggccctgcccttctctggtgatgagcaatgatggggcatcatcagtactggctttgtgtttgttctgcagccagaactgtattaaggaacctgctacatgtctcaaaactcctgccttagatcttaggccggttatgtagtccttggagccttagtccctgcatctctacaaagggcggtgataagattagatctgatgtatgtattagctctggcacatggtgcgttcccaatactggcatcatgtgttcctgggaagatgggagagggtcctgagaaactccaagaagccaaaagtatgtttgtccccaaagtctttgagttgttgcctcatttgttgtcctcatgggcaagtgcagtgacatggagggacagtttctccccactcttctgtggctaggtg

SEQ ID NO: 60765 - DNA, 1052 bp, Homo sapiens
atccgtgtaccttgacagctgtgtgatctgagtaaatgactctgagcctgacggtgtctgcaacgtggccaatgcttgccaagtggtacctgctccacccctccacaggctcggggtagccccttgtctcagctggaggaggggtgcctggccctgggccctcctgcagcatccctgccctccaaccaaatcaacagatggctgccctgctttgtgcggggtgtgtgctgagcacctacctacccgccccagggctggctgtcccttggccctcaggccagcactcctttcccacaggcctctctcgcattctgcggggccgtgcggacatgaccaagaaccggacggtggactgggcgttggcagagtacatggcctttggctccctgctgaaggaaggcatccacgtgcggctcagcgggcaggatgtggagaggggcacattcaggtgagcgcagtggggctcagcatccgcacaggagacctggagcagaagctgggcctggcttggggatcccgagggggcctttgttggggtgggatcttcacagcatccctagcccctgccctcaggtggcatcatcagatggccacctcgctgaccccccagggcaagtgtgcagagctcactgctgggcccaagctgtccactaaggtcaagctggtggccatctgtggtcctcaggatcatgtgtgtgtggggggtgtgtggtgagtgtgggcgagttgtgtgtggtgtgtgtgtgtggtgtgtttggtgtgtatgtggtgtgtggtatgtggtgagtggggggagtgtatagggggtgtgtgtggtgcgtgtgtgtggtgtgtttgttgtatgtgtggtgtgtatgtgtgtatggtgtgtgtggtgtgtgtgggggtgtggtgtgtatttgtgggtgtgtggtgtgttgtgtggtgcatgtgtggtgtgtgtcgtgtgtggtgtttgtggtgggtgtggtgcatttgtggtgtgtgtggtgtgtgttgtgtgttgagtgtgtatggggtatgtgtggtgtatgtgtggtgtgtgcgtgtgt

SEQ ID NO: 60766 - DNA, 1151 bp, Homo sapiens
acccagccgctcatgtacaagcagatccacagacaggtgcctgtgctgaagaagtacgcagacaagctgattgccgagggcacagtcaccctgcaggagtttgaggtgggcaggcaggctgcaggggcgcccaagacaaactttgggtggggaccctggagaggggttgtagatgttaccagcccagtgctgggcactaaggatttaaagaagtagccactatggtccttgtccccaagaggccccagttaccaaaggggaccaagaactaaggatgcagttacagccaagtgggacacagtgggtactgcaatgtgggggaagtccagccttgagcaggagtgcgggaaggcttcctgtaggaggcagccctgagctggggttgtccccataattatctatggagtgttcgtccttccaccttcatggagctctgagggcaaggactacaagtttccagagccttctccaagccccttgctgagcgcactgcaggcctgcccagcctcggggtacctgtacaggatcccctgaactctgagactttggcttctagccatgaggtccctataggccagagacagagagttctagaagaacttggtgatggggaccaggacttacgagtccaagtggactgggcgtctggctgcgcagggctttggtgctctgtccacatcttcatcctgattccaggaagaaattgccaaatacgaccggatctgtgaggaggcttatggcaggtccaaggataaaaagattctgcatataaagcactggttggactccccctggcctggtgagcgagcagtgtgtggctcagagggactcccctgggccttgaggtcttgcactgggatcaggactggaatggccctgggtgacagctgtcattgcctagtctagaggctgcaggctctatcactgagtccccaaagctgcgtggggccgattcctgcaagtcaaggatagcattgccctctgagcatggatggccaggtgctcactgaaaagggagggcatagccaggtgggagaggaagccctgggcactggatgcttggggccagggtgctcagagggcctccctggggggcagggttagaagagctgttaccctggggcccagaggtgggtgttgggcctgtgggg

SEQ ID NO: 60767 - DNA, 1026 bp, Homo sapiens
ccaggcttcttacagctaaagcatcccttgtgctggacattgggttgttctcatgagggtccttgcacatgtgtgagcgagtttatctgttagatggtgtccgagcagtgcagcggctggagctacgggggtgggactgaacgaccctcccaggagctggcagatgtcagcgagcccatccacagtgtgtgatggtgccagagcccccaccccacttcctcctacacgctctcgaatcctttcatctttgccgatataataggttcaaaagaggattttgttgtaatgcatttctttgttatgaattcagttgcttatcttttcacatgcttttgagccattcatatttttctgtaaattcctgcttgtggcttttgctcattttcctatggagtttttgggctttatcttcctgatttgtaaaagcgttttgtacattgagggaatttgccctttgcctgcatttgtttatgaatatttttctcagcttgatttgtttcccctatcgctgggcgtgggtttgctcccccatggcaaatttgctagaatttaggtgtcttttgtgttttctggtgttaggatattgtgtagaatgctgtaagtcttccttgcttcagggtcataaaatgttgtgtgttcctcattgctaccattggtgtgaggagtcaggggattcagcttcagtgtttgctggtggcctggccgagggtctctgcgctgatgcctaggcactgcccttctctccctgccttccccaccgctggatggccttccccactcttgtgctctcctgctccatggtcagtgtacagagaggctctgagccaaggcctggggtccctgccttcctccctcaggccagtgaggaggggcagtgtgatgaggagagaggggtcagagacagcttggccctctgaggcagtgggatcgggggaatgtgccagcctgactgtgggctgcagtgcctgcctgtgtatctgcctgtctgatgtgggaggggaggatccatcatgttcccatctccac

SEQ ID NO: 60768 - DNA, 1070 bp, Homo sapiens
ccaccagccaggaatgactcccttgctcatttgtttgcccagcagagccttgggaggtgaggatggttttccgtacccatcgacctgctgaggaaatgttgttcctgctcccaccccctccctgggaggcctgggccaggccttcagcccatactgcctagcctctttctttccttttctttttgagatggggttttgctcttgttgcccaggctggagtgcaatggcatgatcttggctcactgcaacctctgcctcctgggttcaagcgattctcctgcctcaaccttccaagcagctgggattacaggcatgcgccaccacgcccggctaatttttgtatttttagtagagatggggttttgccatgttggtcaggctggtcttgaactcctggcctcaggtgatctgcctgcctcggcctcccaaagtgctgggattacaggcatggagccaccgcttccggccactgcctagcctctttcaaagtcctgcccatcttccctttcggtggctctctgggtcccctgggcagtgagcctgtcactccctcctctgtgtccctttgccctcaggactatctctcctgctgtctccagcctgctgccgtgtgtgtgtgtgtgtgtgtgtgtgtgtgtgtgtgtgtgtgtggacccatacctactggctcctatcccaggtctttctgacatcctgttccttttgttctagcaccttcagccttctaagcctcactttgctcttccataaaacagggataaaagcgcatgcccgagaatggttgcaatgagtcaaagatgacctgtgtgtatagtggaaaacttggccaaaggatgtttaaaatgaaattactattttttttcaactgaaaaagaaatttgatcattgtgaaaacaacaaaacagaacaaagcttatacaatgagaatatgttcctcagtgagactccattcttgtggccaattttgtttgtgtgcttctgttgtgtttaggtgtgtacttctagaaacatttcatgctgatacaaacaaacctctttttccagtgcaaccttatttctaagaggccatg

SEQ ID NO: 60769 - DNA, 1207 bp, Homo sapiens
tgagaatgtcatcttggggatgccacacaggtgggtccccctccctgctgtgccttgcgcattctcctccagcccaggggacagaggtgggagagatgagatggaaatcagagcggaggtgttggtgggacctgggggtagaggtgggtttcctggaaagttctgagtcctgggcctggcctgctcgtcacagaaattgccgggtacttggccagagtcacctggggccgggtgctaaccaggttatcaggcaccctctctccctggccatgttgcctctgtccctagcaagggtgagatttcagaaagcggtacactatacttcttgaggttcctgtggacaaggagaggtggagggatttcttccagggaagggagggcagggcctgggcagttgttcccgggttgtgtccccaacagggaggtctgtggaggtgagccgagggtctctgacctggctgcaagctgactgcgtgttcccttgaccttgatgaagatctaggaggcttgctcagcagtggggcgttacctctgagctggagcctgtggggaagcaggagggggaatgcaccctgggggacagagacgtctgtggccaggggtcctgctgagtgggcatgtgcagatgtgcagagtggcctgtgggaagggccctgggcttttcccgtgaccagagagctgcttgtggttggactagcccagggctacatcagcatgagggcatccaaatgcatggtgcaggggtccccattcgtggctggcctgccaggactttggggtttgtctgtcatggggggcctgggaatgcccagtgtctggtcagagagttaggcagagctggcccagtggcctgaggcagcaagaaagcatggggctttaagcctcgggccattacagcagcaggagaggatggtgcctggtgattgggtggcctgaggagggctctgggcacgaaggggctgtattaggccaggccaggcctccacagtgggggagggaaccctgaggcctgcgggctttgccaggtgagagcccggcccctctggctccaggggaaggctgaacgtgctggccaacgtgatccgcaaggacctggagcagatcttctgccagtttgaccccaagctggaggcggcggacgaggtgggtgccatgcccaggtcccggcacccttggagagctgggtgtttgggaggtggactgtgga

SEQ ID NO: 60770 - DNA, 1017 bp, Homo sapiens
cctccctgggctcactctcacttctgctccccaggttggacccagagggagggcactggggagactgggaggtctggtgagactgcggggctccacctgggcctgacctccctccctccactttgctgcccggggctcggccacgcctccttctccagccttctatgaccttcaggaggctgaccttgataaggagttccagctgccgacaaccaccttcattgggggctctgaaaacaccctctctctgcgggagatcattcggcgcctggaggtgagcacaggcgggtgtgtggggtgcagctgaagcagctctttggagcttgccagaggacgggaaggcactgtcttttttgttctagacagcagggatgtcagccgtccctcttccccgctcctcatggggtcccaatgtgtctccccagaacacctactgccagcacattggcctggagttcatgttcatcaacgatgtggagcagtgccagtggatccggcagaagtttgagacccctggtgtgatgcagttctccagcgaggagaagcggaccctgctggcccggctagtgcgctccatgaggttggcaccacctggagggccaagtggctggaggtcctgctccagggctctatgagacgtcccacaccctgcctaagagagcaggagggtaccacaggaaggcaggactggatcggcctcaccactggctgcagggaggagagttgggaccaggtgtttaggcagtttggccaagagctggcccaaggcagagcaggtcaggtgggcagggatgaggctctaggagaacaagagagcggggacactgagcaaggccagaagtggcgggaagtggctgtgggaacatttgggcagaaaattatccctggtgtggagtgactgtggccacaccacctgtctgttcactggacttttctgaagctgggtcccccagggctgcaggggctgggggagcacctgactcagctgctggatgcaaagtggattcctgagcagcg

SEQ ID NO: 60771 - DNA, 1028 bp, Homo sapiens
aggaagacctgacactccttggggccccagcctgggccacccctgactcttcccaggccctgacctggctgcgttcttgtttctgccctgcctagtcctgggacagcttcttcagggaagccagcgaggaagccttttctggctctgctcagccacggcccccttctgttgtccatgagagcaggtctgcagtctcaagtcggaccaagaccagcaaattggtggaggaccacctggctgtgcagtccctgatccgggcctaccaggtgaggggcagctgaggcacagcctgggaggctgcactggctcctggggtgtggccaggcactgaagggaaggggtctcagctccaacatcatctccccagagagcccttctccttgtcctctactgagcggcacctactcctctagccagtctttgccacatcaccattcagagcacttaccacctgcttgaatttttttttgtgcatactgacttgtgtccttgtggtctgttccttgcacacaccatgccccgagtacgtggaggagcacttagtaagggatcaattccaaagcctgttgaatgaggggtgagtagattaacccttgttaattctgttttctcctctagaatgggcatcctgggagaacagggactgatacagcaggtgcctaattcatgtttatggaatgaatggttcagtaaacaattctcccccaccagttgctcctcctggagacttaggctctcccatgctgggcccctgctctgtcagagtcccagtgatggtgtgtgtttttggtcttgaccagacaggactaattggaggactgctgcggtgttcaggccataacaagcgtaatcatttggaatatctctgggaactgctggcaggaggtattccgtcagggaaatgtgaggcagcagcaagccacagcaaggctagggtacaggggggcattagcaaatggaaatgatgctttgcctctgaatgagctgcccaatctgtgggatggaacagagttccctgtacaccaccc

SEQ ID NO: 60772 - DNA, 1070 bp, Homo sapiens
gcccaggcctctaggatagtcagaggtggaacaggagttgggaccctggctgcctgaccccagagctcatgcctggcacttggagaggtgctgctcccagaggagccggccccaagtgccccgcgctctagggcttggcatcactggctcgtgggctgggccacatgacccgaagcctcaggggctgagcattggggagggaaacttgggggcactcagaggctcccaagctcacctccctcctccctgcagtggaatcttttttgttttgaaaattttctctgttcaggcttgctgctggttgccccaggagcctgtcctccctccattgaggtgacatcacccctttcctctggctcatgtgagttagaaggagggctgtgccctgccctctggtggggcctgaccttttgtggaaagtccagccagtgagtttctggtgacatggttgagctgatggcaggggtgaggcagaagggtgcaacaggtgttggctgagcacacctgaccaggagcgttggctcagggcctggcctgggcagtacttggaagccagttataccccagaatgcacattttctggggcctgagctgtccaggggtaggggactcctcccgcctgggcgaccccttgtggggtggtccttgcacccagcttacaagctgggcggtctgggcaggagggcattagctggtattcatggggagctgctctatggcagtggctgtgctggagcagaggaaggggttctgctcacagttgtagggtggggaacagaggtcccactttacacatcatgtgtaggatgaggtggcaggggtatggggtgatctgggacctcagtaggccctatcaacccctaacctgcctggatagggatatctggggggttctccaggattggcagagggctcttagaactcttaccgtctgcggaatagagaaagcccccatcactgaaagcccaagatttagatattttccctgggaaggcacaggtgacagagtgaggtgagatgagctgcagggcctggttccccgtggtctgggtgggcttccagtctgtacc

SEQ ID NO: 60773 - DNA, 1907 bp, Homo sapiens
tcctgcttcagcctcccgagtagctgggattacagtcacctgccaccacacccggctaaattttttttttgtatttttagtagggtttcaccatgttggccaggctggtctcgaactcctggtctcaggtgatctgcctgcctcagcctcccagagtgctgggattacaggtgtgaggcaccgcgcccagccttgtgttccccatttctaataccatgtatactgggtttataaatctttaatctaggatgaagctgtggcacaccagctggtaaagagctaaaggtatctaggtggaaaatgtcatgatatagccgtgtcttttctctttgcctcagccttaatacagatattggcagctgctgcagctgagcgagatgtggtttatttcacctttggggactcagaattgatgagagacatttacagcatgcacattttccttactgaaaggaaactcactgttggtaagtaggagatactcttgacacttggtatctagatggattgtacaccattcagtgggaacacttgctaaatctggatgaatcacagtgggtacgaagaaacaaaagcatggctctaagcaggaaggacaaaccctcagaggggcagcatttgcagagtctttttgttctggcagagtttcatccacagtcttgatagggtatatcagcttactaaagtaaggtcaagaagctgaagttggtgttcatttttacttttctgtctataaaaatctaaaatgggaaagatgaatgagggtaagttcagatctgagaagccccactgtcctgtttctcagacctgccagcgctcatccagtgtgcttgctacctcaggagcaaagtgtataacgagggctgccatgacagtgcataacgagggtgcatggacagtgtaccatggatagcctgttgttatcatgagcaaagaagttgtttctttaaagagtgttaaaaatcttgtttaatttatgttgggaaagcctttcaggcatatgaaattcatgctgtattttcaaaagccaagtctgagcatatgccatttagattaagataaaactggagtgttctttctaaggttttttcaattacatactttaatgtgcctctggtctgaccttttgctctccaggagatgtgtataagctgttgctacgatactacaatgaagaatgcagaaactgttccacccctggaccagacatcaagctttatccattcatataccatgctgtcgagtcctgtgcagagaccgctgaccattcagggcaaaggacagggacctgaggagccgagcgaatagcatctcctcccacctcccaccagagacgtcctgtttgagctgtcaggtgtaatatatgaattgacttaagttaatataaatgtgtacataatccacatttgtagtcaaggacgcaatctcttccacacatgtgcagttgtcagttggtacatctaaactccctccatcctgactcacgtggacttagatatgttttgtttctattttcttctatttcagtttttcattctttgatgtttatttcttttgtccatcagatctcttgtgaaatcccatggaaggttgtgctcagcctgtcgggtctctttcttcctgcccatatattataccagttgcttctgcagcccgcagatgccagcgatgccaggaaacaagttgaaatccaggaatctctttaactgattttgctaaaaatctccctgtgagccttccactcaactcttaatatgcttgcattgtttaagtttttaaattctgaaaattaataattagggtttttttcatatgtgttgcataatgcaaacctcctaggttaaaatagtttctttatttaagatagaataatttccagaaattgtacttttgaggtatcattttta

SEQ ID NO: 60774 - DNA, 1041 bp, Homo sapiens
tctttgctcatgataacaacaggctatccatggtacactgtccatgcaccctcgttatgcactgtcatggcagccctcgttatacactttgctcctgaggtagcaagcacactggatgagcgctggcaggtctgagaaacaggacagtggggcttctcagatctgaacttaccctcattcatctttcccattttagatttttatagacagaaaagtaaaaatgaacaccaacttcagcttcttgaccttactttagtaagctgatataccctatcaagactgtggatgaaactctgccagaacaaaaagactctgcaaatgctgcccctctgagggtttgtccttcctgcttagagccatgcttttgtttcttcgtacccactgtgattcatccagatttagcaagtgttcccactgaatggtgtacaatccatctagataccaagtgtcaagagtatctcctacttaccaacagtgagtttcctttcagtaaggaaaatgtgcatgctgtaaatgtctctcatcaattctgagtccccaaaggtgaaataaaccacatctcgctcagctgcagcagctgccaatatctgtattaaggctgaggcaaagagaaaagacacggctatatcatgacattttccacctagatacctttagctctttaccagctggtgtgccacagcttcatcctagattaaagatttataaacccagtatacatggtattagaaatggggaacacaaggctgggcgcggtgcctcacacctgtaatcccagcactctgggaggctgaggcaggcagatcacctgagaccaggagttcgagaccagcctggccaacatggtgaaaccctactaaaaatacaaaaaaaaaatttagccgggtgtggtggcaggtgactgtaatcccagctactcgggaggctgaagcaggagaattgcttgaacctgggaggtggaggtggcaggtgagccgagatcgcaccactgcactccagcctgggtgacagggcaagactccatctcaaaaaaaaaaaaaa

SEQ ID NO: 60775 - DNA, 2138 bp, Homo sapiens
tgtttttatatcatacttggaatcagtccacatactctaatagacttgtgatttattctcttctaacttttgatgcaagagagttcacttaaatcatgaggcataattgtgtagatttgcaaagatcttgggggtgttgtagacaaggaggcctgaagacagtgatgttttaaaataaacttttgtcagtgtttactgatgtatctaggatcgagattatctttctggaaatttcatttatgtatgtatagtctagcattcaatggagggaaaacaattataacagtgattatggatttctaaactctgacagaatcttcagggagcatctgatttaactccatggtgtagttgagaaaaatgaggcccagagagtaactggctagtcacagagctagatagctggcagaaggctgaagatagaacttggatctcctgcctgccagtcctaactagtctaacacgtgcttatggtacaatatgtactctaatagaaatgggtgtgaaatcaagaatgtaatgtgaattggttttactttttgattttctcttaatataaaataaattctataaagagataaattttaaatgttttttattaatacttcattttcacaaatggcaaatgactagagatctagtaggaaataggatgaaaaggactcttctttgggtctctgtcttttttaatagtaaatacttaaagctaaattttcattttcagtaaaaggtaagaaatggtacttcttggtggagaaagatgatgattcattcgttcccatttttatgtgtagtttaggttaattaagaaccttttgaaatagggtgtattgaaactttaatgtatggataagttggttgagcagttttaattaaaacttatctctattttgaagttaattactttcaatactctgagattaatgaggcatagtcatggcacctcccatgttgtgggtactcaataaatattagtttgggaattaggacatactttgatggtattttagggtcttacatatattatgtcatagattctttcccaaatctgggaaatactcaacgatatcaaattttactggttcaacttaaaattttttcttcctatgtaatttttaaaactttctatttaaaaataatttcaaatttataaaaataaaaatacacacctttatgtatgcatatatatgtatacacatgcacataatttttttctgaattatttgagcttaacttacatatactatgccctctttcctaaatacttcaatttgtatttaagaataaaatattatcttatataaacacattatagttattaaattcataaatgtacactgatatcttatttactctttcatctatattctcattttgtcagatgacctaataaagccctttctagcctttttcccctctagcacagggtccagggtcagctactgcatttagttgtcatgtttgttagcctccttttgaattgagaatatttccacagcctttttttgtctcttatgacattgatgtgtttaaagaatacaacgttctttgagtttgtctgctgtttccttgtgatgaggttgaggttatgcattctctgtcagaatgctgcatcagtgacactgtcaagaggcacttgatggccatctgacactactggtgatcttaattttgatcactgtgtcaggctgttgcccagtttccccactgcagagttgaggatttttttcctctcttgtaactaataagcaatctgtaggaaaacaaaggcaaaattttccctagatttggcatctgttaatgattcttgcctgacctttaccacagtggttgcaaagaaaggatgttcctattctaacaccccaaccacacttaccagttagtctttggctttctcctgtggggaagagctggcccgtctgttttttgtttcgttttgttttatccatttgagcactactttaccttctggtataacaaaatattttgaggtcatcttgtacctttcttgtccaaactatagcattaagcacttcttgagaaatctagttccatttagggggaatgatggtagagaccaagatttgggtgctgagtgtgctcattgctactgtggtgtctcccttttggccctttta

SEQ ID NO: 60776 - DNA, 1063 bp, Homo sapiens
tactcaacctgtgtcagcacctcagagatactgctgagttagtggacttggaaaatggctttaggaatttttttaactatctgtgagctgggatcagccaggtttaacagtcactgcattttctcttatggtttgcacagttacccttccatttattgcccttcttttaagaatgagaaaccaaggtttatagacagccaataaacctgtcccaagagagcagctagcaagtgtcagaaccaacattcaaacttggctccatcttcttaaaaaccaatatatgttcattactattgttattattagttgagaacatattgagtgcatactatgttctaggaattgtactaaatatattctttacctgtattagcacacaacaacctatttaggtaagttttcttttttgtctgtataggggcaacaactgaggcatcgagaggtaaattagcctagagtcatacagatagcaagtggtagtgccaggatgcaaaccaggattgaagcccttgtgtgcttttgttatttaatccgtattggctgcaggctctggatctggatctagatttgggagttaccattctagagatggtggctgcattcttgaagagagagtgtatttaaagcaggtgagaggaccaaagattgagccattagtaacatccatagtggaaaaggagggagtgtcaagatttaaaacagtagccagaggacaagaccaattggagaataagagttggcctcgaagagtgctgtgtggtagaaacaagaagtgaaatgcttttggtactggtgagcaaagctgagctctcagggtacccaaaatgtgagagctcacaaagtgagctcagtagaaggacatgcatagtactttcaaatctgtactattttggcctccttgacagcatgcatttaaatcgtttgaataaacaatgtaaagacattgctctggctggcatgtggtaaggtctgcttggagttgaccagggtggattgccacagcagcccagaagcagtgggcaagggcatgcattcttgagttggtggcccagtcagctccacc

SEQ ID NO: 60777 - DNA, 1035 bp, Homo sapiens
ttcctagaggtgagattaatgactcaaagaatacgtatacttcattttgatccttgtagatttcactctgaaaggtgatatcaattcacattgtcttcctcacatgaacagcatcaccaagacaggactttgttactatttttcatttctctaaggttcaacagttttcgtgtttattggccatttgtttgttttgtgaattgctttttcatgccttctgcccattcatctctttgggagtagtttgattttatcactggctagtaataactctttgtatattaaaaaatattaattgtttaactgttacatgttataaacatttttctgcttcttcatttatttcaaccgatcaggctgaagttactgagttagcttttatgtgttcacatttttgtggtgtgcttataaagatgtttcctgtccctttatgctaaagactttcacctacattttcttcaaattcaaagacaaaaactgcatggtgctattttcggtgtttgaggaaacctatttttcactctgggcttattgatcttacgacagatacttttttcctgtctttctcttaagtaaaatgaatgactagattcaagtcatcaatccagaagctaggtctgctgtaagccgtggtcatttgtgatagacagtttggaaagctttataaatgtgttcacttcttttccttttttctttttttctggcttaaaagcctttcagactgcagctgtgcttgctctggtgactatcaagcatagtagtctaagatttccattatataattcatttcctcaactattgagatttaaattttggagtaactgacatttccctccccttcattagcataaatattcattaaaaatttagaatgagtcataaagtccttcaatggggaattggttactaaactatgatgctaaaaaaaaaagaaattatggtacatttatgcaataaaatattatgcttcctttaaaaaccattatagaaatgtgtctgctgacagggaaagatggttttggaatattgacaaat

SEQ ID NO: 60778 - DNA, 1082 bp, Homo sapiens
atctccataactgagagagagaatgctgaggaggcataatagtgaccctttgcctgatgaaaaaaatagtgattaaagccttcaaagaaaaagaaaactgttctaacaagtccctttcctggtagtttttcctagtagtttataattgggatcctattagttcttgaaatatctgctattttcatttctgtttgtttgaagtggaaaaataaattgggacctgtattagtttaagggattttatgtgcttagcattcaaacaaataaatattagaatttatcatttcttagtctcttccttgcataatcccaggtttttctctccctttctccctctttgtttttccctctattttggcccctatggaaaaaaaaaatgagaaattgaacataagcttgataatggacactgatcctagtacatcagtcagaaacactgttagtgtctaggcactcacaggctttgataattcttttatcctgcaggcttactgtggatttctccgtcctggagtttcttcagagaatctttctgcagtggccacaggaaactggggctgtggtgcctttgggggtgatgccaggttaaaaggtaagttgttgtagaaaaggataaaagcattctgcccacacaaaaaaagttagtccttcaaaccagatttctcatgtcctgtcatgagaccacaaaaatctaagagaaaaggaaaaggaatatttaacactattttcttttttcctattatgtttgaaggaattcttatttcatttaccattttccttcagaggtcgcttatcactttgatcccccagacacagtattttgttgagtattgaaagattggcaggaggagaagagcatataatgactgcgaagtttcaaacctgagttttcactttcctccactggagtgatttttatggacagttatttcacagactcattcatccaccaaatttaatagcacctctgccactttctaggcacagtggtaggctctgagatacaaagatggagaagatgtgatgcctgctttggaattcacagtccagtgtatgagagagaggcagtatgagaccgatgc

SEQ ID NO: 60779 - DNA, 1723 bp, Homo sapiens
agagactactataactaggcctcaccttctagactttttgtggttcaaacttaaatcattgagaatatttctgcttttagaatagtctcctacatgcttatgcctgaatcactcttcttttgtgatcataaacttctgctgtgagcaaggtacctgttaaatgcttttctcaatatggcttttctgtttgatatagtttttcaaggaaatttgagggttccccacctgtgagacaaggaaatacctcgagtgtaatagagcctatcaacacatggactaactttgagaaagcacctagttcagggcctggcacatgggaaggcatctgataaatatgtgttcttttattcactgatatattccaaaaaatgtgttattttaacaaggaattagttttttaattctttcactgaaaaaggaaaaagcagtaaatgattttgttaaatgtcattggcaacttaatcagaaactaatccaaacaactttaggccttctagattaaagcatttgtcccttactagttacatttacctattaaaattgacttaagaattttggttatgagcagcaggagtctcacataaactgacagcacaacttggagacaatgtttaatattttatatctcatgttttacaaacttttagagcagaagtctgtgttaaatcactttagagatgacttgcacaattctgcttgtgtgtgtgtgtgtgtgtgtatatatgcatgccagagagaaaggaggaaaagaaaaaaaaaaaacccacatttttctacgcgaaaaagtaaaaccagttttcaccgtcagaattcagtatggatctctgacctctggggacctgtttgctacttttaagcattactcaccagttaataattgaaaagccaatcctacaaagtgctttccaggcctctggaaaaggtctgctccatccaggctccaccggtcttattggacccacatcgtgacctgcaagtagagttggtttttaaagggggggaccagtctccttctatctaactcatactgtgaagcaatgtttaatcctgtgagagatcagctgggtatcattctaaaggagaattattttagggttagaaagatttatgacttcagcttgtaaaagtggcaaatagcactgcaagagaagaaacaaatcacttgtgaaaagttgtatttgccatgttaggtaggattttaggtaggattaagtaatgaatatgttttgtggagctttctgaatctgagattgaacaaggtggagagatacaaatcatccctatttacctttttaaaaattgatctgtttattgatgtttttgttattattcaccaccgtatttggaataggactgttattaaaccaaagcctgaaaacaaaaccagtcagtatttgctgctgatattcctaagaagttcagcatctgagcacttacagtcttttcataaaatatgtgtcactttacttttcgagaatgttcaaaatgtatcatttgtagtgggttttcccttaagtttcccaatatatagaatcagaataacaattaaatacataacccaatcttggattttatacatcaggaaactaagatctgcatacttctttcattttatatattgcattttagaatagcaaaaacaatgtattaatgttataattattttagggatgaagtctaatctcagctactcgagaggccgaggcaggagaatcgcttgaac

SEQ ID NO: 60780 - DNA, 1060 bp, Homo sapiens
ctgcagacactggtttgtttttaatattttaacagagctaaagtcttggcaacctgacccctgagaggattttatttgagcgactacctgttccttatcttttctcccctttccttcctgtcccagggacgactggcagcggcgctgcactgagatcgttgccatcgatgctcttcacttcagacgctacctcgatcagtttgtgcctgagaaaatgagacgcgagctgaacaaggccagtaaccttatttcttagttcatctggcagctgtcatctatttactgccattttattaatgctgaaattaatgctttctggtaattattgcagtgtcagtatgtctgcccacagctctcctgatttaatggctctgtcagcttgtacaagatgtactttccattttgtaattgtttgattcgcagctaaggttgccagataggctgttgcttagttttaaaccccacacatgcatttatctcatcaagtaccttagctgctatgggacattatcaatgtaaaaccatatagaaacaaatgagctctgaaaatttttttctcagacctgcttaatgacattttctctacaaagtatgctatcagggttaaaacagaaaaactgaaaaagccaaatcaaatgttgttctattttaggtaagatttatgatggtatctattattttccgtaatacttagtgccgcctactatattcatttttttcttttttattacagaaatataaaaatgaaccatacctgttgttcaaattttcagtattggcaaccataataaataaactctgttacacaacagagagctgattctgttctctggattttgggctttcccaaaacagcagagattttctttttagttcctcgaattattcactcagcagagattttcttttttttctttttttctttttttttgagatggagtttcgcttttgtggcccaggctggagtgcaatggcatgatcttggctcactgcaacctccgcctcccaggttcaagcgattctcctgcctcagcctcccaagtaactgagattacaagcg

SEQ ID NO: 60781 - DNA, 1025 bp, Homo sapiens
ctcttggctcactgcaacctccgcctcccaggttcaagcagttctcctgcctcagcccccctagtagctgggattaaaggcacacaccaccaagcctggctaatttttacatttttagcagaggtggggtttcaccatgttggccaggctggtcttgaacttctgactttaggtaatccacccgcctctgggattacaggcatgagccactgcgcctggcctctctctttagttcagtgattccttaggatttgctatgtaaacaagcatgatatctacaaatagggacagtttgacttatttttttacattctttatgcctttttgtttattttcttgccttattgcactggctggagagaccttcagtacagtgctaaacagaagttattcttgccatgttatgaaaggtggaatgtttttgccatcaagtgtgaagttaatagtgacagattgtttgtttcaggtactgagcagtacagtgaatacacaggctatgctgagacatatcgttggtcccggagccacgaagatgggagtgaaaggtgagtctgtttctgtcttcagtattccatggctaaaagcaaaggaatttgggcttgaccctcacacactctcattctgtctacttgtatttcagcaagtgaacttaaaaagaaaaaagaaaagaaatcagcattacaggttcattggcattgaaaacactattaccatcttcctgtaccaaagggaagaacagagaagataaaaccaaaagtctaaagcaaagacaaagaggggcagaattctctacagttctttacctctgagctacaatcagaaaccgtggaggttaaattccatgtttaaatctgagtagaataggttctaattagagcttaaagcctttgaccaacttattaagttatctttaatttttctgtgaaattaggtggaggaaacctatgttgcgacagttgacctaatgccacaaaccagttgatggcagaacctgcggtgtgctttgctgctttgtctcctatatc

SEQ ID NO: 60782 - DNA, 1016 bp, Homo sapiens
ggaattacagaacaaaaaaaactggcataaatctattgttgagcaaccagcactttggctattggtctcatactattgtagggaagctctgcaggtttggaatatggctgtcttcatcatttacgtacatcaaataatactttaaaagattgttattccggctgggtgcagtggctcacgcctgtaatcccagcactttgggaggctgaggcgggcggatcatgaggtcaggagattgagaccatcctggctaacgtggtgaaaccccatctctactaaacatacaaaaaaaaattagctgggcctggtggcaggtgcctgtagtcccagctacttgggaggctgaggcaggagaatggcgtgaacccaggaggcggagcttgcagtgagccgagatcacaccactgtgctccagcctgggcaacagagcgagactgtctcaaaaaaaaaaaaaaaaaaattttttttttagctgttaaggtagatttggattgaacactgagaacaaaatatcccatcagtttttaagatgaatttacattcttgaaataaaaaacttggtaaaatgcatttaaacttaaagctaacttgtttcatttgcttaatttctctagaaagtagtaagaactgggctgggcgaggtggctcacccctgtaatcccagcactttgggaggccgaggcagggggcatcacaaggtcaggagattgagaccatcctggctaacacggtgaaaccccatctctactaaaaatacaaaaaattagccaggcatggtggtgtgtgcccgtagtcccagctactcaggaggctgaggtgggagaatcttttgaacgtgggaggcagaggttacagtgagccgggattgtgccactgcactccagcctgagtgacagagtgagactccgtctcaaaaaaaagaaaaaaagaagaagaagaaagtagccagtacattgtcatcctccattaatgttaatgtaaataaaggatgtcattttccttgggaataaaacagg

SEQ ID NO: 60783 - DNA, 1049 bp, Homo sapiens
ctgaattatcttcctaaaacataggtccaggtgttacttgaatctttcccagaaccttcagagggaaattgagtaaaaattccctagacctcagaccacctcatcaccaactgtaagcctccacctactctacactgcaggcaagcacaatgaatctgtttaccattcccctcatatagtgatttacatttgttttttttttttgccctgtgtccttgtgcagctatgccctcagcctgcatgtcagctgccacatccccttgtaaagctttcctatcttcctcccatgctccaattttagttaattgtattattagaaagtatcaaatacatagtaacaagctcttcaataatcatcttctcattctgcttatgctcattctgactgccatctaaattacaaatgccgtgaggccaggaaccatacataccttattcatctttgtatccagtgattcccagcacaatactcagtaaatatttgttgaattggacagtttaagccatgaatcacccagtgcccatagacctcatatgtagtaggtagctaattctaatcaacagactggtttcaccaaaattattttcctatttaagctaaagagttactctggttttttagcattggttttagtactccagaacacaaatccaaatatatgattctctctggtagctcaattgaagaactcctcagtggtatgttttagtattttctaagttctcctgtggtaaaagaagactgcttcgccttctattaatttctgtcttttgacatatatttttacatatcaaacgattcatactattgttttactattttgtaaaataggcttcagattgtcatttagtatcagttgctttagagaacactgaagttttaagaaatcgtatattttaaaatagtttgaaagaatataagcctcatggtatttagtaaatcctattttacttgtgtgtatgactatgtatatacacaagttgtgtgtgtgtgtgtgtgtgtgtgtgtgtgtgtgtgtgtgatctaactcctcagatagtctcactaa

SEQ ID NO: 60784 - DNA, 1028 bp, Homo sapiens
taataaggcaaataatgttaacaaatacttttgatacaatggaatttgttgttaatataacataagtcaatacctcagtggccatggttgaaagggaaagaaaataattatgccttctaaattacaggtactaagtttatctgttaaccttattaatagaaaaataccattgttcagaatttctgtcgcaggtattttcatcaagacacacacacacacacacacacacacggttatgaaacagtgaaaatagaaaatggaagccagaagagaatcatatatgatttattgccaaattttttctacatttttcctcagattgccaactctagccataacaaaatttcatagatcttaatttttttaatattttgtaatgtttttcaactgttttaaagaagaaaaactttcatattatttagaggaaaatcaggtttcaaactatgttatccaattttaatttaaatatgtatatttacatgtttgaataaaggaggatcaataccaagaatgttaacagtaggcatctgtttctgactttcgagatttggggtggtttcggtttttgaatagttacctatattttcacttttgtccgcagtgaacaacttgtcattaaaataataaataagggaatgtctttttatattgtagatgtgaaaaacccttgacacgattgcatgtcacttacgaaggtaccatagaagaaaatggccaaggcatgctacaggtaggtgaatcttagtagtgtctgtgtatggttaggactttttcttgtcaagcttctgacagcaaaagaaatttgaaaaactgtttatttgtctcctaaactgatttaatgcaaagaagcatgatagcagaatgaagaaaaacaccaaacagatcactttgacagccttggtaatgttgtgatttgccagtgtatactctctgtttcttatatgtgcttctctaaaaagcctttgacagaaaatcccaagatctggacagcatcagcctcttggttcagacattgatagtaggttgac

SEQ ID NO: 60785 - DNA, 1204 bp, Homo sapiens
atggcatgttagatctgaaaggaaccccggccgcctgctaaaactcttgatcagctctgtaatacctgcaacagacagaagactggatagcttcagtgatggcagatccgctgtttcgtatcagtttgttccattggtggctgcttgtgttatcatctcatgctttcattcactaaaaatgttttctacattcattctccaccattcctggttcttccttctggagctacataaataaatctgaatttctagttttctttaacatttgaccctccttcatgtatcttaatggcttcttaacctacttccctctctaacagtgcatacaagttcatactaaactgattcgtttcttctatttcacatgtaatatggattctaaaccctttatctctgctcttaacatactcccattcattgggccctcttaaaatatagtgcctggaattaaaagtaccattctgctgtgtcatctctatggtgcagaggattgtttttcttcactcttctattaatctctaataggaatgcatatgttttgttcctgttactttggtgtagattttatagatcaatctgagggcttatttttaagtcatccaggatctctactttgcatctgatattcatttggcactaatgtgaaagaacacccatttgtataccaccatgtgggagagaagggacaggtcaaaatgcagagactggcaaggctgctgtgtcaatgagacacagtaactttgcctctaagtgagacgaagattgtccccttaattttgataggcagaatttgacttatttttatttcattgatctcttttttgttttagttgctttataagtgagttggagaatataattaaaaccagtctcccagactccacagaaccagaaacatgcattcacttaaagagggagaatgaagaaaagataaggattgttggtgttcccaagcgtaaggggctaaatgggtccaggaacttagaggctttcctgaattccatgtttgtggcatgttatagttaaccctttgattatcagcaaatactttagccaggcttaatcacagagagccagaatcatctacgtctctgactcctggggcgggggtgtagaggatgacctactgggaagttagaaaatgcttcaaaacaaaaccaagaaaaggtttctagcaatttcgtgattttattaagagctatac

SEQ ID NO: 60786 - DNA, 1037 bp, Homo sapiens
gatgaagatcttgagactgaagtattttaaaaagccttctgaattaaattactttctatatagttttagataaagtgtcttatagatgaggtttttgaaaatttatgacctgtatatagtatatattgtgattttatgatgggaagtatttgattaatcaaagtatcctattctgagatgaaagttgccttgttacgaaaaaatgctaacagacgtgctctcaaggcatttttgttaatctaagaaaccatgttcttctgccttttcttgctttgccagcagtgtttatgaatttcttttagcatctcttagtatatattaaggacatttgatgttcttctctgctaagttaccgaatgacaagagagatgttttctattatattcatggaattgcttcactagtgtttgagttgtttgaccacttacttgtgagttttaaatatgttatccatttatcttaaagttaggtatctaaaagacgtaagacccatcttaacaaaaaaatttgttttctactgcaactgctccatatggtttttgagtgtttcctgcttttgactgagaacaaggaaatgtggaattgtgcacaggaatgaaatgatggccaggctttcactgggttatacactgtcatcactaatagttcctgacatctctctctttccttaagagcttttttgtattcaagaaaacagaaatggcatggcctttttagtttgttctttgatttgaatcagacaaattacttctggccagctgatttattagtttcttttgctactagctttaaaaaataaataaataaatctgactagaaaaggatctcatcctctaaaattattgactacattaatagtacttcatttagatcctcccagatttattgctccttgaaaaatatgtcatctttgttctgtaaactcttagaaccagtaatttctcctctggctacgactgctactaacaagtagagtgattgcccactatttaagcctgagacttagctgtactaactccagaggatgtgcaaatgat

SEQ ID NO: 60787 - DNA, 2734 bp, Homo sapiens
tgagccctgatatcttgttatacctgcctgtgtccctgcccccattcccctccactctcatttcctcacaaacactcagataaggattttttttgataccgtttttgttacttatcaaactacgtagtaacattatgaattataaatgtttttagccattgagaaagtagctgtgcactgactgactgaccccagttgactgggagggctggatggtgccttctctgtggtggaagataggttggagaaatgtggttggtagtaaatgatgtctgatttgagcagctttgaagaagtctggttctagttggtttcagttctttccagatgccatttgaatctaaaccaattttccagttcttatcattacagaattgtcttctggaagaattatttctttgtattacttggtagcaatatggatgtagttttgtgaatcattaaggcattttaacttatcttccattctcttttattttttatctcttagattgtttgagggacgttcatcaaggaaaccggagaaacttaaaacgctcttctgctactttagaagagtcacagagaaaagtaaattcctttcattcttactgtaatttttcttgctgatgggaacagttcaagtcaagtgacatgtgaggaacattttgtgtttaacgtaaaccttcctgtcccaaccacattgaaacactagtaatgatgcgacaatataacctagttttatgcttatgttgtgtataagcataaacgtgtgctaaatgtaggggggcggggtttacatactctgaaatcggacccatattctctgaaatctgtaatatacatcaaaagattttcatgaataaaaaccagagaaagtatattgaccaggaaataaattttggatgctctttatttaaagaagtattcactagtttatttgcataagtcaactaacgcattgcttttctacccattcctctcttttgtgcccccctaagccctttgtggagttcttataaaactgttttgtactgagttttatatctccatcttcctctattgaaccttaacattcttgcttccccaaaaactgatagcagctaagacagtaatagtaaatgtccaacaaatactggtaatgaccagctgataatagattggtattgccactcttatctcagaagctgaatgaccatggtcaagtttcttgacacctctaagcttcagttttatcacctatgaaataatataataacggccattaccttacagggtagttatagatattaaacaagaagatacatgcttaataaatgtaagctattatcaatgggtagcctttcctacaagtggatgtaaaccagaacacctcaaaagtttctttgtgctaagtaggtaaggtcaacctggtcaagtgaaatggctttttttcagttctgggtcataggattgtcttaaaatatgtctttgaatcattttaaggtcatttttctcatatccttcttttactcttgcattacagtgtacttggcatcttcccccttgaatgtattgctattggacattgttaaatttttagaatgaaatcaattatcaggattttgatatttaagggaaaattacatgcttctctgatatggaattatctcatagcttatcgaatttcagttttgtgccctgtactgaatgaaatattacaatgcagaatcatttggacctatgagacacaaaatcaaattagaatttgtaatgacttgttaaaaagatgactacgtaaggccaggcacggtggctcacgcctgtaatcccagcactttgggaggccaaggtgggtggatcacgaggtcaggagttccagaccagcgtggccaagatggtgaaaccccatttctactaaaaaatacaaaaattagccaggcgcggtggcgggagagtgtaatgccagctactcgggaggttgaggcacaagaatcacttgaacccaggaggtggaggttgcagtgagctgagattgtgccactgcactctagcctgggcgacagagcaagactctgtctaaaaaaataaataaatgactgctttttttggctattctaggtctaattagaattattactattggttttttttgttttgtttttacagtactttgagttgccattttaagtagaattattataacgaagtagtacagagtttacttttttgtcctgggagtcaaatcatgtatgtcttctctaaaaactaacttggctttctaaattttaggatttcagatactttgaggaaaaagcttaaagtttgttttttcagctggaaatgtatatgccattataagtattgggaatttgaagaaataaattataactagacattttattttctgactttttcactgtacatgttaattaagttctttgtagaaatacagtacaacattgctcttggtcttcagtgtgtaaagctaatggtttgaagaggaaatactaaagagaataaaagaggttgcagtataatgagtggttgtgtagaagttctggagcctactcaatagacttcagaagcttatttaaggtaccgtatttcatcgaatctgagatgtcatagatgactttttaaaaatgctcttatattatatacctctaagaaggaaaaaacactcaggacagggagtttagtaggagacatgacccacaaggctggtacacctaaggataaatgagaaattaacttgaccttccaggaaagggac

SEQ ID NO: 60788 - DNA, 1459 bp, Homo sapiens
cagccaagtctgagaattgtcacaaggattttaaacctgcttcatctcctctgactttatctccacttcttacccccgacacccaccacgacacttcccccacttccccctgctctatcaggaagatgggaaagtgtatttggttacacagtgatttgaagttaggattggagcagtgaataaacagagtacattgagattctgcttgatttgtacctttaagatttgtacctacaaaataaacagtggtgttcatttgtagtgggtgataataacagccataaaatcttccaggaaagtctgtctcgccaggataataaatctgcagtctcacgaggctcctaaagttaataatttgtcatcatggttgtgaagtatgtgaccttttatgtgattttatacagatgaccgcatatggaagctagggacacttttcctatgttttagagaattatttcttaagagcaacagccattttctcctcactatgcaatagttctattgaagaagaacttttatcctttaattgaattgtatagtacatcaattcatctctaggaaaaggtggtggctacttttgtattcatattgctttcctctagtgcatagtgagcctagaaagagattttgcagtggagccttaggtattcatttagtaaatcatatttattgatataggatgtttaattaaactgccatgtggcttcttcattttgacttaaataaactctgttctagaagaagccatgctgaaacctgcaccctcaaagagcctttctttcagctggcaactggattataagagtatgtgtattaaatattttagaaagataggttctttaaataaaaattatcacacaggctgtcttaaactatttttaaaaagagatctgattttagatttggttaaaatactagcatacattagtattctttttaggaaataaatattcatataaattgtttttccagaaattgaccctgaatacagatttcagatcattgaaaacggaaccatttgaaatgtgcatttcctttccttttcctaatttatttcagtcgctcaataggattttctcatggaattaacttttccctctcagcgtagttacataagcttgctgttgtaatcatgaaaaataattacccatttcagcacttattaacatggactttacttgaagggtctctggttttaaagtcagagcacatgactagaggcagatgaagagtacctcatcattcatagccactgagtctctataatttttaaatgcctttggaaagctagatcttatgctcaaaagcatgcttttgtgttagaaatcttttagtgagctacttactcaggtcataatgcttttaaagccctgcttttctttcctcagaataaactgaattgtatgttaccaataacaatgccacatcatttcaaagaaaacggaattaagtaatccaa

SEQ ID NO: 60789 - DNA, 1071 bp, Homo sapiens
acaattctctccaatatcagagtgtcagccccgaagaccatattttttagccttttaaaattggagaatgttttactctcttaagatgagaagaattctagaattcagctggttagttcctaatgtaaattttaattaaacttaaaaactagacatttcagtgcatttattgtgtgtttagcagatgaaagtatagcagatgacttgaatataagctgctcttagactgtcataattcttgggttatatttttatgaccttcaaacattaaaatattgatgataatttgttattatatatggttaccctctactatcaacactaagaaaggggcagcaaagaatgaaaaataatgttatctaagaaaatttctttaaaatcctagtgttagcaaacaggatagttttttttttttatatataatatgctccttggttacataaatattagttgcaaggggcatatttttaatctatttttcaagtttgtacagtaggtaagtttgtttttagatactggtatttagtcaatgtttagttcaaatgtacaatgagcaactgcaatattccccacagtgtattaagtgccataaggttacagagaaaggagaagccagtttctgagttcttactgttatgtagtattgtctcattttcaaacctcacgtcacagatgcccttctcttttccacatggcttttattcctcctccagtactcagttcacgtatcagtttttctggtgtctcagattctgctaggataggtttgctactctaggttcctatgctagcctgtgtgtacctctggagaggtgcacagcaccatgacgttttattaaagaaagatataatttaataaaggaaactttcctcaaggaaataacttttcttgctgttgttgttttgagactgggtctcattatgttgcccaggctggtctcaaattcctgggctcaagagatcctcccacctcagtctctaaagtaactaggactacaggtacatgtcaccatgcccagcgcaacttttgaattaagtacaaaagggtgaataagagttttgccaaggaga

SEQ ID NO: 60790 - DNA, 1049 bp, Homo sapiens
ggcaggggaaatatattttaaaacatatcttcttgtttctgttggaagttatttgcttgatcatattccatgtttgttctttttcctttctctccttacttagtaaattctctccctacctcctaggtatgcctgtctgttacttcccctgtgaagccttccctgcctcccaggcaaggttcatccctcttgaagcactcaaatcattgttttgtaattcttgtcattatatatctcttgccactggattatagtctccttaaagggagatcctctttgtgtccctggtttgcatggtgcttaattatatgctttttgaattcaatatgtagttcataatcaataataggtagtaggtagcctttgggtgtgggccatttaatcctcttcccctcgtgcatatgagagtttccatattttatttaatgagaaatttttgttcaaaggtatctaactttgtaagctataacaagtcccttggaaccaaaatcagacccctgagtcctcagctttttgtcctggcttctcccagtgactttcttctccattagcatatcaacggggagagcatggaaattctgtgctttgccccctattgaaaagtcaatctctgctgtgaaagttaagatttttatttgagatcaaaatacgtcttgtggcaagttaaattgtatatgttggtgtttaataatttatcacattgaagtactctaggccaaatctaaagggtaaattttagatttatcaaaataaaattaaaggaaacaaatttggtcaggaactttttgaaatatcttggttcacagtaaccagcctcttattttgttgagccgattgcttgacagtaagatttacatctcctgatttctccaaataatgagtttttaggcatttctcctcaccaagagaggagaaatcattaactctatttaaaattatactatttgtttatttgggagacaggaaatgtttgtgtttgaagtccattaatcctgaaatctttactattaatttttaaaatcatttttctgaataacttggtaaatggt

SEQ ID NO: 60791 - DNA, 1407 bp, Homo sapiens
tctgatttggttttaattgacctcaatgtaggatgatcaggtaacctccttggcctcagttttctctgtaatagtgacaagctcagaccagattataactgaggcctcttctagttaaaatgtgatttcaagtagataaagtatttacttcagtcctgactgtatatgtagtatctctaaattaagagtgttgtcatttccagtacttttaaagaaataccctgatgtttagaaagacattagattaaaaggtgttatagagaggggaaattttataaaagacaaaaatggaccatgcatggcatctttgttgtgcttcaaatttttatatgggaattgtggttttcacttcccaagggtgtctggaaaagagaaattctaagaccatcagaaacctcattgtttattacccaacagattagatttgacccatagagtatgctctgaagtcattaatgtggcttttatggagatttcttcaattgtagaccattgaaactagatgggtccttgggggcttctcagaaagtccttggtgtctagcagtttctagttgatacaaccaagggcagaatgtactgttttccatttgcaagtgtttttactttattgtgaatgttgtgtgagggatatttgatatttgggatacttacattttttttcagagggcattaaggtgaattgccttaatgccaaatatacatttggaaatgaatttggaagtttatttgtatacacctgttgatgcatttgtacatgtgtttggtgatgctgatagggtgccactttatggggttccatgaaaagcagatatgtaatttaatttcataacaaacatattcattagttattatatttactggttattgttattcacataacttattttattggttttcaggtacttgaagaagcagaagctcaacatttatatcagtccatcttgcctgatatggtgaaaattgcactctgtctgccaaatatttgcacccaggttagtggatgtagcttcctcagtagcttccctgagactgccaattgaatttcccttaaactcgaatggccagggtcacacagagagagagagagagacagagagacagagagagagagagagagagagagaggaagagaagagaagaaatgggaaacagtttttgccaaagagtatagtaattttgctgtattaaggaaaaggttagagggtagagagtactacaaaaggacattaaaaatgcagcattccattcctcagcttctgtttacactgttgaagcttgtttactttgacttttttctctctttgtttaaataacctctaacttaaaaaagtattcattatttcaaaacatactagtggatttggaatagcgtattttcaaaatggcttaatacgacccactcctt

SEQ ID NO: 60792 - DNA, 1050 bp, Homo sapiens
gcacagtcttatttaggtccatgaactaaataagttagctgctaattggtgaaatatgccttcttaaatatgaccatgttaacctggctatttcctgaaaaccggttggagtttattaaaaatggagaccatttttattgaagccataattgtcatgggcgatacacatgagagatcaccctgtggctggcctgtcagactttcatgagccttcagaaattaaggggaatgagtgagtttgttttcttgtaagctgtcacattctgctcttcaaagtgtcagcctgagttgtgcacagataaatgttagaaattttcaccttctccagttgatttttttacccttacgtaatttagtagtatgattgtttttcctctaacatttaatgtttttgtacttttaatttttgaaatgtgagcttgtgctttagacttgggaaaacttagaggtagttccagtatggaaagcttagcctatagacagtttaatcaacttacacaaaagaaaactatgatatttttgctgagtaatagagattctgaaaggcaatggagaggaggaggatgagctttgtaaaatcagctaatccagatagaaagtgtcagttaatttaacatatttttattgacggttttacatatgaacaccactgttgtaggaatggtgaatcaatcataaatcttgtcttaaaggagcttctagtaagggctagaatgcacgttcataaataacaacagaaagcagaaagtcttaagtgtcttgtgaaaaaaagttcaaataaattacaagagggagaattactttttagctggagagtaaatttggatagacttgaagcaaactattgtttgagcaagatcaaaaggttggataagttttggagttaagaaggaaagatattccaggatcgtatctgtagcagcacaaacagatgctatagaaaaatgaatttctgagtttctagtatgtaggctgcacagaaggtagagtttgtgtgtgtgtgtatgttatatatatgtgctgaatgagactagataagaatctagggta

SEQ ID NO: 60793 - DNA, 1069 bp, Homo sapiens
atcaaatgaaagcagccttaaatgtttcataagactacagctaatgtctttatctctctagctttcgaacctctgatttggagttcagtggaaatttaacctttttggacctcttcccttggtgactcacagtctctggaatcataaggtctgcattactttacagctcaatttaattcatgagaactataggagccaaaagggaactaatcagaatcactaaaatattgaaacagatcaattgtgacttttatatttgtatggaatatgtggaatttctctccctggtttggttaatgagtgcttttgaattgggacatatgttgatggtctcatatttatgatttatgatttctaaatagtgcatatcccaaaggacagattactccaattggaactaggcactttgcttttataaacttgatgagttaccatggaatatcagtcttagttgagccctctatgcactagatcactgatgaagttagagttgttattttgtgtttgcaaaacactatctggattgtatttatttatgtggtggacaaagaggttagaagttatagatactgaaaagtgaaaattcattcagtagactttctcttatattctaataatgaaattaagctagtacttagtttgtcctataactctaacccttcatttgggtcaaatagcagtagaagttattccttttaaatgttgctgtggtgttgatttcattatccaaaaatctactgttagaggagtgaagataattctgtgttttaatcttgcccatgatttatatctctatcagctagctctgaagtgttttgggttttgttttgttttgtttgtattttattaacacagttaaacatgatgccttgatttataatttctgttaatttgcatttattcttcttatgttcctactcataaaaataaattctatagtccttttgagtatgctttgaacacttatctacatgtaacatttcatatttaaccctggaaggactattgtagtatttttatctgaaggtaaaaataatgagtaaataaaaacagaacgttagatctgttt

SEQ ID NO: 60794 - DNA, 1067 bp, Homo sapiens
ctcagaaagccaggatgtccacagtataccacatatgcatgaatgcattgatgctcaagtgatgcataaacatacaactattgtgttttacgttattgaatcatagctgatttgtgctgtgatttttgcctaataatttcaacatatattttaactttttattatataataaaggcataaatcaaaacttaatttcttccagccattactttgtgtatgtgaaataactttttgtaatctattttaatacaagtttatgttcttttttctgagtttctactgatgctctgtcaatacattatcatttttaaagttttccataatcacaagttcaaaaactgttattttagctaaacacaggtataataatacatgcctcaattttggagacaatgaattatgttgtacctgtttttaaaattttaaatggcctttctctttctgccaacttggagcctgtggaggcctgctgggaacaggaatactaaaaggaagtatgtctggaaggctgtggtccaaggccatttttgctgagcataagtggggtctccagaaccaaagacagcacacagctctttttaaaatagaaggtgcttatgctcaaaatgaaacagaattctgttcgggcataagatgtacttatatatacaaaacaaagaacaacaaagtgactcctggtggcaaaccaaacaaaaccagagtaatctagggaaaggtaacttggtcccagggaaatagtggcatggttcatgccaaattctgaagcaatcttcctgctaaggccactggacacagaatctgtgtgacgctgtacccctcaagcatttaaattaatgaaaagtaaataaataaaagtggatttgtgctcttggaaaaaaaaaaagtaaaaaaaaatttaaatgacagaaacagttctgaagaaaaagacagatataataacatgatcaacttaatttgcatcattcaaaactcaatatgatgtcccatttaccttttaaattaagtagcacataaataaaaatgcaagttcaatactaatagaattacacactcttatttacagtgat

SEQ ID NO: 60795 - DNA, 1035 bp, Homo sapiens
aacttcttaagaaaatggattaattgttgaaaggaagcctaaggattttagtgactatttcatcttcctttccatgttgagttttatgtctggaattgaaaagatagaaatgtataagcctttcgtttcatccttccattggtttttccatgaaggctgtcataaataacaaaatgaagtggttttggttttgcttttgttttttgcatctgtggctggtaaaggtagagagtgagagataggagtacaggaaggagaggacatttaaaagtaaaaaatgaaaaacctagactttagaatgattttgttgctgtgatgaggctagtaatatgtttctctttgtaaaccacaatttaaatatagatatatagcataaagtctttacttcaaatcatacatacaaaatagattattgcaacttagaaattgtgcatcttttgtcttcgctgtagttattaaaatatcgactacgcattctcctatcatctcttgtcctatgacttgtcagagaaagactgtttaaagcctctatcactgtaaataagagtgtgtaattctattagtattgaacttgcatttttatttatgtgctacttaatttaaaaggtaaatgggacatcatattgagttttgaatgatgcaaattaagttgatcatgttattatatctgtctttttcttcagaactgtttctgtcatttaaatttttttttactttttttttttccaagagcacaaatccacttttatttatttacttttcattaatttaaatgcttgaggggtacagcgtcacacagattctgtgtccagtggccttagcaggaagattgcttcagaatttggcatgaaccatgccactatttccctgggaccaagttacctttccctagattactctggttttgtttggtttgccaccaggagtcactttgttgttctttgttttgtatatataagtacatcttatgcccgaacagaattctgtttcattttgagcataagcaccttctattttaaaaagagctgtgtgctg

SEQ ID NO: 60796 - DNA, 1320 bp, Homo sapiens
taatttatgtgaactgctggaggaagataataatttatatatagtataaaaatactttatagtaaaggaaaaaagacagtttttaaatactttttttctaatctcctcatccccatgaaatttttattttttattttttacaaaaaaatttatgcctcaaccctattaactgacccatgaaattttcatactacaaatctgctgtgtatgtctgtgtatatataatctgacgctttcaaggaccaccaacaattgtgataactaagtttattttttacccctcaagatccagtttttgtctatttggagtatatcaccttatttagaatgcatgctttagggtgtaattgtgttttttcacctattacttgacctttctaatctcatttttttaagtgagtaataaattagtattcattctgtttgtctgtagctactgatgtccatatcagtagcagggggaggtagtaggaagcttgtctaacattatgaaatgtactggaggtaattcataagagacaggctcttcataggtcattcacttggccataccatgacgtttttttgtttctgcattttccacaggatgctattctgaaatacaatgtggcatattctaagaaatgggactttacagctttgatcgatttctgggataaggtaaaagtatccttatttctttatgaaaatattattgacaactcaataagaaggtttgagaagaatacccataattctgccacactaagataattatcttttagttttataaatttgctgttattttatatgtatgttttaggtaaatacaattaggagttaatattgaattttgttttcatctcttagaatacacattttctgttatattttcataccattatcagcattatcaaggaatgtataatagtccatgattagattttgagaatataatggttcttatattctcaaacatacaggttgcatccagttttaccttcagttacattgtggcaacatcattatatatgtatatatattttcccatatttgatattgtttctttaggtgatttccagaaattagatgactaagtcaaagggcacaaaacatttgtttaaaaatcttttaaaaacttttgtcataaaatcatttttccacagattaattgtagcaatttactatgctgccagtagtggataagaatatcactttcatagtaccattagcagagagagtcttttcatttgtctattggccatttctatatcttctttggagaaatacctattcaaattttttgtctttattattgaattttaggcattctttgtatat

SEQ ID NO: 60797 - DNA, 1162 bp, Homo sapiens
gaatggtgttttgataagaacgtatatgaaaatcaggatgacacttagaatcagagtataggcgttatagcattagaagcctgggagttctttagaaagggttttatgggggctagatgtgtctagcaacagctggagttagggagaaggataggaaacacttagtaaaagctgaggcaaggaaggattcctaggggatatggagctagaatatatactatatctggtgacttggacctggttgaatggaggtgaggaatgggaagaactgaagggttctttggtgatttcttgcctgggagctggtctctattttatagcatttgctttggttacttaggattattttatagaagatacattttgtttttatgcactgacaattttgtttaccctcaatttcaggtagatcttttgcgagcaggagaagttcctaaaccttttccaacacattataaagatttgtgggataacaagcatgttaaaatgccttgttcagaacaaaatttgtacccagtggaagatgaggtaagaacaaaaccgagattcttttagtctctgaaaaatggtttggtacttgcttgtttgacctttgattctgtgatgcaaaacaacttagaatagcttcctcatatgtttttcttttttccaaaagaatggtgagcgaactgcggggagccggtgggagctcattcagactgcacttctcaacaaatttacacgaccccaaaacttgaaggtatgttgtttttaccatgcttgcctgtttatgggccctgtgtctcctctttcaaagactttttggtcttaatagactcaggtagcaacattgtttagatgcaaaatgcttgcttcctggcactaaggaaggccccttagagacattctactaggaaatgagaagaactgagagttgcaaatgccttgcctggagccacacagaataatttggagaaccaggaataatacctctgtttcttgattccccatccaatttccttcagtgcaagcttctctttcttttttttgttttaaaattatcatgtttctgaaatatctttaaaagtaaatcaggaaagaattatgacttcagcaatatttgcccaaagggaagctgagtttcccaatgattaaagtatatgttaagcattctggtttttat

SEQ ID NO: 60798 - DNA, 2963 bp, Homo sapiens
tctcgatctcctgacctcgtgatctgcctgcctcgacctcccaaagtgctgggattacaggtgtgagccactgcgcccggccagtctgtgtctttaagatacttacagtgtagcagtggccacagacacaaaaacacataattactgcctggtgtgatagatgcaatagtaaaggtatgagcaaggcacagtggtggttagtgtgtagaagaaacaaatgttcaactttacctttggtccctaaaggaagactgcacagagaggtgagtgacatttatgacttgaaggaaaggcgggtgtttgccagacacacagctgcagggagggcattagggatcacatacaaagacatggagtcatggaagacatgctgtgtgctcagctgaccacagggagtttaattactgctgtgacactggaggtatgattggataagtgacttgtttgtattataagttgtttttagttccttctgttctcttgtagtttggatagtaaagaaaacaacaatacaataatagaatccatgatgagttctgtacaagaagataacttttaccaacataatgtagaaaaattagaaaatgtttctcagctaagtcttgataagtcactcactgaaaaaagtacacagtatttgaaccagcatcagactgcagcaatgtgtaagtggcaaaatgaagggaaacacacggagcagcttttggaaagtgaacctcaaacagtaaccctggtaccagagcagtttagtaatgctaacattgatcggtcacctcaaaatgatgatcacagtgacacagatagtgaagagaatagagacaatcaacagtttctcacaactgtaaagcttgcaaatgcaaagcagactacggaagatgaacacgccagagaagccaaaagccaccagaagtgcagcaagtcttgccatcctggggaagactgtgcaagttgtcagcaagatgagatagacgtggtgccaaagagtccattgtcagatgttggctctgaggatgttggtactgggtcaaaaaatgacaacaaattgattagacaagaaagttgcctaggaaattctcctccatttgagaaggaaagtgaacccgaatcaccgatggatgtggataattctaaaaatagttgtcaagactcagaagcagatgaggagacaagtccaggttttgatgaacaagaagatggtagttcctcccaaacagcaaataaaccttcaaggttccaagcaagagacgctgacattgaattcaggaaacggtactctactaagggcggtgaagttagattacatttccaatttgaaggaggagagagtcacactggaatgaatgatttaaatgctaaactacctggaaatatttctagcctgaatgtagaatgcagaaattctaagcaacatggaaaaaaggattctaaaatcacagatcatttcatgagactgcccaaagcagaggacagaaggtaattttctgtcaggagtatctctccaatagcataatatgctttatagttttgtaagggagtttaacgaagctatgatttctagtaaagcaaagaaatggttttgtttcttgttaactacttatgctaaatttaaacctaggctccaaagtttaaactctaaaaaggctagaaacagaaaacaagaaataaaataaatattagaaatcagatttttagtttcatgagtttccttttggtatttatgggaattactagaacatgaaaatactaggttgatagtagctactgtttcttcagccagacattcttctagaccattgtatattacacttttttttttttaacactttgtttaatgccgtgacaggcagacagatggtattatactcactaaatgagataactgagatttgggtaagagaattcactggaatcatgtaccttctgagtggtaatgctgggatttaaatccaggtgtgtcctattacaaagcttatattttgccgttaccccatatggaatcttaaatcccatccatgatttctgtgatttgagtttcctgagatagtgcaatcagcatgcaatagtgagttcacttcattgaaaattactgtgtagatgatactgtgaaccatgactcatttctgttttgagaaggtgatttacatgtgtttggaactttcttccacagactgttgaaaataagctcttgagttttataagctttataggtttttcttttgattgtaaatataaaacataacgaagtgagtgaccaagtatggcatactttaaacaataacgtctgggtaagttttgtgcttgtgtatctaagggaattaaaacagtaaataatttgtgactaaatacatttgtcttgaccttagaaaagaacaatgggaaaccaaacatcaaagaacagaaaggaagatccctaaatacgttccgcctcacctttctccagataagaagtggcttggaactcccattgaggagatgagaagaatgcctcagtgtgggatccggctgcctctcttgagaccatctgccaatcacacagtaactgtttgggtaggtagcacctcttatctatgatgagagaagactggaagtccttatttattgtgatatttattaagtgagaaacagaccaaggcttagaaagttcttctgttttctgcatatataaaatactgagaattctacagaatggagcaatataatgataacttacttagtatagaacttaacaaattagcaatcattagcaatcattatcagctgatggtgaagataatttttttttttccagtatttttaagaaacctcattggattctttttttttctttttactcagttgatagtattgtgtactgactgcagaatcctgcattcgtccctaaatttcaaaattacgtatggtttagtgtccttaaatcattatccagttgtgccttttttttgtttttgttttttttttttttt

SEQ ID NO: 60799 - DNA, 1034 bp, Homo sapiens
taatggatgttctgatagatgaaagacagattgttttacctaactgaatttatggaatcgaaaatagtcctccagaagatgagatgcttattctgaggactgtagaatgagtaggagttagatgaagaggaagtaagaagtgtttcaggagtgcaatggaggccgggcgcggtggttttgcctgtaatccctgcgctttggaaggccggggcgggtggatcacctgaggtcaggagctcaagaccagccttaccaatatggtgaaaccccgtctctgctaaaaacacaaaaaattagcctagcgtggtggcgggcaactgtaatcccagctactccggaggctgaggcaggtgaggcaggagaatcactggcatccgggaggcggaggttgcagtgagccgagagggcaccattgcactccagcctgggcaacaagagcgaaactccgcctcaaacaaaacaaaacaaaacaaaacaaaaacaggagtgcaattgatatatagagtgaacgcaagagagtgtgagagatgaggctgcagggtggtacagaaaagtcagatcaaattggatatgtagacattgctaaggattttgaactctaagggcattgataagctactcaagggtttttagtaggggagtgacttgattagacttatttatttgttgaaaagtctgtgtggctggtgtgtggaaaataaagaatggattgaaaaggaactcaagtggagcatcaagactcagttaaggagttaatctaggttggaaataattgtagcttaggcctggatgctggcaatagggaaggggatggattcatgaaagaatgggatacttgagaagaaatatttctgtgctggagaagtagattggggagttcatggcataaacattataatggatgctatgggcatagataacataaacatgtagagaaagtaaaggtgacctagggcagaagccttaggaacaccaaagtttaagagtagactgaagagaagcggctgtagaggtgggaggaaagcctggctcgt

SEQ ID NO: 60800 - DNA, 1035 bp, Homo sapiens
tacagtacaaatgcttgggaggcaagtatccaggaaaatagctagtgcaaatgtcctgaaacaaaacaaatttggcaggtttaaggaacagctcttaggccagtctgtcttcgtagttacaagggagttggatccattgaagtttgtgaaatcagagaggtagggaatgacagctaatgtaggattttgtaagttatggtaaggagtttcgattttcttaagacaaatcactgtagttgctatgtagacagtgaattgaaggggtaagagaaagcaaggagttaggaaattgttgctgtgagatatgatggttggactaggatggtagcaatagagaagataagtaacacaattcaaaatagatattaaaaatagaacaagcaggactcctaattgatgaaaagatagaggcatgggtgatgcataggtttgtaaataactgctgagatacagaaggatccaaagatgataggttttactgttttcaatgttagtgaattcaggtctggccctctcaaagtttgtgttttcttttgcacagacccacatacctgtggtaatgacccaaggattctcaaccttgccacagtaaatcaatcgttaatagtaatatgtgaaggaactgccttgaaatagttagatacaacatgtacacagtcagaaaacccaacccaaccactgtttttcccatggaattgattagtcttttttcagtcttattttgtaatttacatagtcaccaagcattcttggagtaaagtgaaagaaattagctttgtaaatggcctggactacacttcctgtaagttcaaaaatcagatctatgacactgcaattatcttattggtgtaaaagcctgagccaccagtggaagacctggtttgggattgagggtctcaggatgagtcagcccccaaactgacagatagggaggataaaatgggaaaaaattttccgccttcagtgagcctataaaaattgcaaacacatgtaacagtcaggagctggattaactctaactggattaacttaaag

SEQ ID NO: 60801 - DNA, 1084 bp, Homo sapiens
tgaaaaagaatcagaagtgtagttatgcagatttgagtttgtttttttaatataaagctgtctttatctgggtgaattgttatgatttaccaggggctgcgtttggtgcaatgaatggtcttcggctaggattgaaggaaacccagaacatggcctggtccaaaccaagaaatgtacagtaagtctcttgtaaccatctgatgtagtgatacttgaatattaagctctgttgtattggtttgatgagtacaaccttgagattacagatggttagcatagttatgtgcttttttgtctttgttttttaatcttaatcaaaataaaagcaactaaggaatcagattactgactctaagcttttaaaaaggagtgatttttttaatcagtgtccctcagtcagctagtgctatgccagcctgacttctcagctgcacctgttacattctccaaccctatgtgacttgcttttcaaattgttgagttgctaatgggaattttggattgtttgggggcatgcagatccataggaaatggtaatgaagaataagcagctcatgagagtgatggctcaagctgccatcatttaacttgaagttcttactgtcttgactttatgtttccgaaatgatgagccagatacattttaaataaaatttttagaattagagttaattccaaaaggataagacacagttttctgttagaacttgaagttacagagaagggaaagtacagttaaaaggatcggaaagtatgttttcacccaacttaagaagtaaacatggccagtccctcttgatattccttaaacaatatgtttagttttgcccatttttatgcttcatgtaagtggaatcatgagtatgtattcttcgatggctactgttttgttttaggacactttaaactccatcttcctttcatattgttcagccagcagatggcaccagatgtgctagaattagaccatgggaaactggaaggcctgttaaattgtgtggttttttgagagacagggccttgctgtgttgcctgagctggagtgcaatggcgccatcacagctcactgtagccttgacctcct

SEQ ID NO: 60802 - DNA, 3466 bp, Homo sapiens
atttttaagtttttgtattatggggaattttgaatatataaaagtagacaaaatacatagcatagtgaacacatgaaccataacgcatcctcaacaaccatcaaccatggccagttctatcccatttccttctcctctcccatcttattttgagacaaaaaccccaatatcatattaaatacaaatttggaagtagatctcctagaaaagacaacttgcttcctttcttaaaacaagttattaaaatgcttgttaaaaatgaaaaaatgatggctgaacttaaaatatgttagtaaatatgtaacataattagaaacaatatacttctgtttgtaaacattactgattttttaaaacaatcttttagaaaatacaaatttttgtttctgtagaacattaattgagtcgtttaataattaaactgaatgagttccttcactctttgttactgtatttccataatttccagcagtagtcagctgtctggacagaaccattcctgggatcatgttacactgctgggagaagaatgtcttctcttcatccagttgcgtccatcactgttctggtggtgtctggcactggtgcaaggcagaactgtgcttccttgagagtgtgctgagcattcaccttggctgcttggttctagtctaggagcagacacagggtgctttccccatgtattctagttagatggctgattccttctctttaattctactttatattctgtactttgatattctttactttatattctgtactttgatattctttactttgattatctttaacattctaagcatatgttcccctcccaaaaagaaccttttagaagctagctcgccatagttaacagtggcattttttacatagattagtttctgtaaacctctgtaagatacattccaggctgtcattcaaagccttatatatatttaatgtgtattcattatattatacatttaataataagagttttccttattattattattaaggacttatataaaagtccttaagacttttgcctaaagttttgaaagttttaacctaattttcacttatgtagagtaaaaaccatccttattgaaatcggagatattaagatgtattttagaatttaaaaaactttgcgccctgggtctagacatgttaaatagccattattgtttttaaaggttactagagaaataatgattctaaatacagattctttctctttctgccctgataggattttgaatatggtgactaggcaaggggcactttgggctaatactctaggttctctgggtaagtagagatctcatttgataataaattgttaaagaaagaatgcacaaatatcatgaacaatttgatcaacccatattctggtcctaggatatgagacaattatgtttaaacccattccaatgcataatgtagatactacttagggaaagaccatgaactaacttatgaaataatctcaggtgctaataccgttctgaataccattgctgaatttttaaaatcttttggacactgcacactctcctttccaagcacaacacccaataaaatcatgtttaaatgaaatccaggtaatttaggtccaaagtaaagagctttgtatgttaggcaaggttcaaggtcctgtagtgatacatgataaattaatccagccctcttgctatgttttcttaatagccggttcattagtctgtttacctgagtagatttcaggcacctaattgccacaattggaataggttccttgtagataatgaaaacgtttgcagttctaggcaaaaggtaacttagtagtgcttagtcagagccttatgctttcataccatattgtttatgaatgattgatcacttacaatagatctcttatggcttatgtcctgacatccaaaattttcctactgtatgaacttagttgaaaatctcaatttaaattgtggcagattaaggaggggaagacatagaaaactcattgaaaacatagaaaaagcgtttgttatggcagggtaaggtcctgccttgtcacagaatttggaagcagtacatcttcacactgtaaagctagttttcacactttggatcctaagagatggctgctttcatatgttgctgatgtctgcattcctcccaccctcctacagagtcaccccgctctgtttcttttaattgcttgtatacctagagtagtcagctgtccttgtctgcgtaggactgtcagagaaaagtccaagaaactatgttccaataatcaccccccgcccaccccgccccacagtcctggacaaactagaatggctggtcaccctctgtgtacccattgtggtatgatcaagaagggtgttctgctcgtgatcagtttcagttaaataagttgaagaggaagatgagctttcatagaagtataaaaatactgcagtagaggagttgtaaggctgagcgcggtgtattgttgcaaggggcaagtgtagctataattttgagaaagagtttaaaagtttaacattcgttccagataggaatctgcaagagcatagaaggatggcttgggggaagatactttaaaatgaaatggtgctagtgttataatacgtgagaatcaaacctcactttttttttaatctattttttcttatactagaaatacgtgtgtgtgtgtgtgtgtgtatgtgtgtgtctttaatctgaagtatagcaattatgggtagcatataaatgaaaattttaaatattcttcctgagacttcctagcggtactttctagaaatagctactattgatgtttcttctgaattcttccaggcgtttctctgcatagccagtcagtcgtgtaccatgtgcacatgtccctgatttacttattagtgaaaatgattcttctggtttttaagtgactgtatagtattccattatatgaaaagtccctctctggatcaattcagatggtacaaatgctcttgatgggcattttatttgttgccaggtgtttgctattagaaactgttctagtgatcattccatgtatatctttggataaatttttctaaatataattgccatactgacttttgtgttgaaaaaaaaaaaacagtttttcctctgctctcacactacaacagtcaacataggatagttctgtgaccagttatgtgggaatatttccccacataccaagtaatctctcttgcagtggacaccagttgggtgtccacctgtttcacttctgcctggagatagcattagatcagcaggttgagcactctgtcccacaaaactgagccccactttggatacttctgatgctgatagcaagctccaggttattttacctgtgcttctgaccaaccagctttgtcagggtttcccacaacccactctttgggtttgattaatttattggattggctcacagaactcgagggaacacatacttaacatttgcgtatttattata

SEQ ID NO: 60803 - DNA, 1040 bp, Homo sapiens
tcttgacttttcagtcttacatattgtctgttgacttccaagaggaaagctgtgttaactccgctaagaattgtacaaaatacgcttaaagtagaaaggaggtcacatcctttatataggtcagctcatttaccattctctgaaggtagtagactggtactcccttgttttatagacaaactaaaattcagacaagttaaattacctccacatgctcacacagctctgtcacggtctagtgcatcaaactctagtctgagtccaaagcccgttgtctttctcaccaaaccaaattacctccaggatagagaaatcaggaaaatttctagaaaagggaaagaagtaataaataacagttgagccagaccttaagaatggactgaattttctgatgtatctgtttgattatacgatacatataaggaaggtgtgggagaaaagtctgggaagatagtttaggcttatggcatggaaagctaaagtaagaagcttaaaattacatagaaaggcagcatgtcatcaaaggttttttggacagaggattagaattatctctgaggaagattaagctagaagtggtgggtagataaaatagattggaggtagaagcctgaagtcaaaatggtccaggaaaagtattagttgaagagatggtgaggaaaaggttgaaatgaaagatgattgggtcagctgggcacggtggctcatgcctgtaatcccagcactttgggaggctgaggcgggtggatcccctgaggtcaggagttcaagaccagcctgaccaacatagagaaatccggtttccactaaaaatacaaaattagccaggtgtggtggcgcatgcctgaaatcccagctactcgggaggctgaggcaggagaattgcttgaacctgggaggtggaggttgcggtgaggcgagatcacgccactgcactctagcctgggcaataagagtgaaactctgtctcaaaaaaaaaaagaaaagaaaaaagaaaaaaatgatgattggattactagaagactgtttgctgtttggtg

SEQ ID NO: 60804 - DNA, 1712 bp, Homo sapiens
tacttgtctcttccaggcaagactaaactcactaaaatgtttcctttgttttttttttttgagttggggtcttgctctgtcacccaggctaaagtgcaatggtgccatcatggctcactacagccttgaactcctgggctcaagggatcctctcacctcagcctgcccagtggttcagactacaggtgcatgccaccacacccagctaatttttttcattgtttctttttttgtttagcaatggggtcttgctatgttacccaggctggcctcaagcaatcctcccacctcagcctcctgagttgctggattacaggcgtgagccactgtgcccagctgcctgaattgtttttgactccccatagtactgtgtccttttaggagagtttttttgccactgattctcagttgtttgggtgattgcttttctgtgggtgggaggaattgtcctagatctctttgagggtcttatgaaagtttttgacagtttctaaaccctgcattaacatctcaatatgcgtagactctccttaggagaattgtgaaacttaactctttagaagttttataaacacttggaggcttatgagtaaatgattagaaggtagcaatcaaaatccaattaagcttttttttcctttttttttttttttaaacggagttttgctctgtcgccaggctgcagtgcagtggcacaatcttggctcattacaacctccacctcccgggttcaagcgattctcctgcctcagcttcccaagtagctgggattacagatgcccgccaccacgcccagctaatttttgtatttttagtagagtcagggtttcaccatgttggccaggatgttctcgatcccctgacctcatgatccgcccacctcagcctcccaaagtgctgggattacaggcatgaaccaccacgccgggccaagccagattctttaaagtggctctatcttctctgtaatttgctcccttgccactttgatgactccagattctactcctattcccattgtcttttaactcccacttcagggcctttgttcttgccgttaccatttcctagaacaatccttccagatacctacctcaaatgctgcatcatctgtccatctttgttcagataccaccttttctttgaggccttaaacactgtagtacatacagttttgcacatacattttagttgtaggataaattgctaaaaattaagttacttgagcaaattatctgcatgcttaaaacgtgaatgactactgccaaatgacccttctagtacttgctaacgtttgccagtgtgagcatctaccatcactttttttttttttttttggagactgagtttcactctcgttggccagactggagtgcaatggcatgatctcggctcacagcaccctctgcctcctgcctcctgagttcgagcgattctcctgcctcatcctcccgagtagctggaattacacgcatgcaccacgatgcctggctaattttgtgtatttttagtagagacggggtttctccatgttggtcaggctgatctcgaactcccgacctcaggttgcagtgagcagagatcgcgccactgaattccagcctgggcgatagagcgagtctgtctcagaatgaaatgatgtgacatgacatgacatgatgaaatgaataatgaaatgccgggtgtggtggcacactccagcctgggcgata

SEQ ID NO: 60805 - DNA, 1047 bp, Homo sapiens
tctctacaaaaaatttagcccggtatggtggtgcatgattgtagtcctacctacttaggaggttgttgtgggaggatcacttgagctcagaaggtcgaggctgcagtgagcctttaccaaaccactgcactccagcctgggcgacagagcaagaccctgtctcagaagaaaaaataaaggaaaagtagatgttggtaatagcacagccgtgtgaatgtacttaatgcctctgaaatgtacacttaaaaatggttaaggtggtaaaatttatgttacatgtattgtaccataattcttaaaagaataaagtttttttaaaattttaagacagctgctgacagtcctcaacaatggcatttagtagtcatgttagtatgtaggtaaggctgttcctatagaacaggagccaccaactcctgctggccagctgcctgtttatttgctgtgagaaggctaagaatgtgttttacgttttttagttacgttttaaatggttatataagtacctacataacaatagcctttgaccctcaaagcccaaaatgtttactatctggcccttttaaaaaagatacatgttaatctgtgctttaaagtcattgtcatttgaatgcattagttctgccactaatcaaccctatatcccacaaacaaggcacttaaatattctgggcctcattttctcatgtatagaagaggtggtgcttgcctatcgctttggaagaactacataaggatcccaaaatacaggaggtaaaactgaaacacaagtcatatttgctttgctttatagagattgaccattggccttatttggttactctgttcaaagcaagtacctttgcttatcaacttcctgtgcttagttgtgtagagttgtttgagtaaagaaaccctagagacccttaaacttgcaaacacatcaaccaattgggaaaccctggaattaacggaaacagttacaattagaacatggctggtatgtggtaaaaggccacccttgagtaaagatgctatgtgataagtacaaacaccaatgtttagtgt

SEQ ID NO: 60806 - DNA, 1050 bp, Homo sapiens
acctaatgccaaatagaaatttagatgtcttgtcggggctgattaacagaaaaagtaattatcaatcagttcacaggaaattatcattagctgtcttactgatactggttctctgtgagcgatcctctttataatttgtagagatgatttatttctaaaggaatggcaatgtgaataaaggtttctatatgttttagttgagaagagccctagagatcagctgtgtgtctcttgttttataattgtgaaaattgaggctcttggaaggcacatgatttgcccagggtcagtggcaagccaagattagagagtggctcttctctttttctggtgaactttctactgcatttgacattccttgttttgtgattaacagaagtcagcatccggtattgtagctgtccctttcagcgaatggctccttggaagcaaacctgccagtggttatcaagctccttacatacccagcaccgacccccaggactggcttacccaaaagcagaccttggagaacagtcaggtctgttgctgcttttattgtttctacagtagacacagcagtaggtggagttagttactaatcagtagtactatgtgtcattgttaactttttggttgcagtctggaaacatatttattaatagtctcttcatcatagaaagtttagaaaataaggaactctttatcatagaaaattttaaaaataaagaattttatattaaaaaagcccacaaacccataatctcaacacaaagagaaaaacactgtaacaataaaagtgaagtatttatatacttcagttttctatacatacatattttaaaagaaccattctgtaagtcctgtttcggtaggtagattttttttttcaccaggataacattaacatatttctctgtcatttaatttcttctgtaaagtatttagtagtatataattgattggctgtaatttaaattcaagtttttctggatataaaaaaggattccctaaacatccaggagccaattatttgtgtgcattcttgattagttccttaggagtacattt

SEQ ID NO: 60807 - DNA, 1030 bp, Homo sapiens
ggtgtggtggatcacgcctgtaatcccagcagtttaggagaccaagacgggcagatcgcttaagctcaggagttcagagaccagcccaggccaaaaccccatctctaccaaaaatacaaaaaattagccaggcatggtggtgcacacctatggtcccagctactcaggaggctgtagtgcgggcagggggatggctggagcctcggaaggggaggttgcaatgagctgagatcgcaccactgcactccagcctgagtgacagagaccccatctcaaaataaatgaataaataaataaaactcaaaccagtgctattttgatgtttatgctcacctgggccttctttcgaagcagccacttgtcttctccagaagataactggctgaggttgcccatcttctttcctggcaggacccagtcagctgtgttaaaggaacaccaggaagtattcatggggcttttaaacttctgtttgccagctctgtcttcagtaccaggcacttccttgggacttccttctttgtatgggggcctgataagccactccgacaaggggctgttctttatgacttggaaggaatcagcaattctagaaggagtcattgcctttggtgctttagtttgttctattacttcttttctaggacagagccacatattcagggaatctttatgcttctcaggctcaggtttgggttccacaggcatcccatttttatcctttccttctttcttcagaagccacttatacagagcctccttctcacaattctcatcacacacacactctgcaaagcttgtgcagggctcattggctctgcacacctcctctaccttacatgggtcctgatggttctggacaagccaatcctctgtaaccatgctgggggtggacaatggtttcttggcctccaagtggtcattcaggcacttcagattgcccaggttttcaatctccacacctttgggctggtttccctgacagttggtacaggagtcagtcttgacaagccaatcattcacattatag

SEQ ID NO: 60808 - DNA, 1058 bp, Homo sapiens
ttcatctgttcactggagtagcacctctagtttttttcaagaacttttcagccagagaatgagaagctgaaaaacaacaaaaaactttgcttttgtgctcacagcttggctggtccaaaaggcctgcccagctttcagcctctcgtggccttcaacatgactttctcgctaagtttaatcatttctggcttttgatttaaagaagagtgagagatggggactattccttttagttgaacacttagatgcaattgtagggttaataattggcctaatttcaatcttgttttgtctcagggaacagggaggcctgaggagagagaagagaaatagggaaaggctgtttggtgggcattcaggacatttattgatgaaaagtttaccatctttaatgggcatagttcatgacacaaatgcttaatttgtaaaaaatacaatgtaacaagggtatacctgtattgggaaatgagtcggagctttaaggcagggaaaatttgcttttattcttcattgaagtaacttatcatctgtgggtgtctctttacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaatta

SEQ ID NO: 60809 - DNA, 1123 bp, Homo sapiens
taataactgagcgatagcaatgctgttgcagatacctttagcatttattctcctgtgcctcatggcttattttttccacattaggaatttggtctagttcactttcagctctgcagctttttactgatttactaggcagagacatgaggtcgatccttattaaactgaacagattattttgagtatacactattttccaattagtacaatttttcaaccacattgaatacagttggaagtttaattgctgtgcctacagtctgaatatggcaagttcacaaagagatgatgtgaacttcaaggagatacctcatgttatacttttagtggggtttttttgggtttcttaaaaatgtttttggtccccctacatgacagctgtttatagataatgtctgcagtttctgtttgagagagataattatgacacttagcattggaaaactaagaagaacgtaagcaggtcagctatcagaagtcttcagactggagagattcctggagggggagtggccctttaatccatcagctgaagccatctggtaggacgctcgttgcagaaatggttagttctgaaatgttgtaactcagcaacatcactgaatgtcacagaattgacaggcacggagctaaaagggcctctagccacccccacaactccgctctacctctgtctccctaacacatgacttggaacaaatacactctaggtacaaagatggctacctgaagtttatgatccctactcatggagctgcttgaggacttcacattttttaaaaagctgctttgggcacccccattcctgaggagttttgtagcttggtttctctttgccacattacgtttgtaagactaacattttataaccataagcagttaggcctttttattttgagaaatttatctgtagcttccttttatttacacttggggactatttttaagtaaccgattgaaatatttttgtttctccattgcaagtgaaatccttgttgctaatcttttgccacatgtaaaattgttcacttgttatcaagcaggtagttcaatatctgtaattcttgagttcttttcaactagcatgatgctaggtgtcactcactgttttttaattgtggga

SEQ ID NO: 60810 - DNA, 1037 bp, Homo sapiens
cttttattttgattaagattaaaaaacaaagacaaaaaagcacataactatgctaaccatctgtaatctcaaggttgtactcatcaaaccaatacaacagagcttaatattcaagtatcactacatcagatggttacaagagacttactgtacatttcttggtttggaccaggccatgttctgggtttccttcaatcctagccgaagaccattcattgcaccaaacgcagcccctggtaaatcataacaattcacccagataaagacagctttatattaaaaaaacaaactcaaatctgcataactacacttctgattctttttcatttttatttaatagaaaaagacaaatgtaaatattaaaaaaaaaaccctgaaaccaacattctaattgcttttgattttacgcaccctcaactacttgaactgagcactcttgagaaaaaagtatgtaacactcacctgtcatgcaacatcctccaatcgtaaagaaggccagctcaaatctgccccgggttttattagctccggtaggtaaaataaactcatctgtatcctaaaaggataataatgaaaaccaagctgagtgtccctcaagacacaaatcttgtaaagttgcctttttaacatttcaaagtagtttttcacagaaaataaaccttaaattaactcaaacctatacttaaacaaaaataaaactttctgcagcagtaacacctaaatcaaagtgaaatgaaatacgaaacatagttcttagaagggagtctcattaaagactttgtttccttcaaaacgtaaatctgatagatttgtgcaaaagtgtttagaaaggacagctctagagaaaggaacactgaaagctatgagaagaacagaacagacaatcagtctggaagaaacaaataactttcattctgtagcagctatttattgtgcatttttctatgtataaagccaaatgttcacaaacatgagcaaaaactaataaagtacaacagtttggatcaattatgcaagggcaaatgaccccctttaat

SEQ ID NO: 60811 - DNA, 1047 bp, Homo sapiens
tcactgccactcttttgatgagctttcttagtgttttccaatgtcacttggttttagtacttgtcaaaccagcattccagccgggcacagtggctcacacctgtaatcctagcactttgggaggccgaggtgggcgaatcacgaggtcaggagttcgagaccagcctggccaacatggtgaaaccccgtctctactaaaaatacacaaaattagttgggcgttgtggcgggcacctgtaattccagctactcgggaggctgaggcaggagaatcgcttgaacgcgggaggtgcagtgagccgagatggcgccattgtactccagcccaggcaacagagtgaaactctctcaaaaaaaaaaaaagcatttctttcacattctaacactcaaaggtgaaaggaaatgggttcttttttgatgtgacatgcagaatagttacatgtaacattgatactactgtatgtttattttttaaaatagctactacagtttctacaggaattctcacagcaaactatctctaggacccatgaaatcaagaaacaagtggacggactaattcgggaaaccaaagccacagattgtcgcctgcataatgtcttcaatgacttccttatgctctctaatacccagttcattgagaatgtgagttatttagttatattatcattccttttttgggagtaggagatattgtaattttaaataacttactgttaggttccctcctaaattttggtggaagtgtggttcttggtaattgtagcttttttctctgggattaatacctcttttttatttgtaaagttttaagtccttttttccaagcctctaaaaaagtctaatgataacattttcttatacttcggtgcttccatcttttgtcgttttgagagtagtcagcaattgtgctgaattttgtggcactcacactgcctttgttgtggcgtgatctgtaaggacagctgtttacctggttagaccctctggacaccagcatatggtttcacttgttgattggggtcattctgttctgataaattatat

SEQ ID NO: 60812 - DNA, 1013 bp, Homo sapiens
ccagcactttgggaggccaagacgggtggatcacctgaggttgggagttcgagaccagcctgaccaacatggagaaaccccgtctctactaaaaaaatacaaaattagccgggcatggtggcgcatgcctgtaatcccagctacttgggaaggctgaggcaggagaatcgcttgaacctgggaggcggaggttgcggtgagccgagatcctgccattgtactccagcctgggcaataagagcgaaactccgtctcaaaaaaaaaaaaaaagtattcaagtaaaatcagtagttttctgattgtttacacagaatgtccatgcttggtcctgactatctcactggaaaagtcagggactctagactcaacttctctggtgtgcacagccccataatgttttcatcaagattaatttggtgtccttttaagcactcctgttcttttcattctgtacttttcttgctggatcaggtagtcagcacttctctgcagtcagtgctgcagcaccagagtcccaaaggatttgggaagtttctttttttttttgagatggagtctcactctgtcacccaggctggagtgcagtggtgcgatctccgctcactgcaagctccgcctcccgggttcacgccattctcctgcctcagccttccaagtagctgggactacaggcgcgtgccaccacgcctggctaattttttgtatttttagaagagacggggtttcaccgagttagccaggatgatctcgatctcctgacctcgtgatccgcccacctcggcctcccaaagtgctgggattacaggcctgagccacggcgcccggcaagggaagtttactttgtacccagtgtgcttgtaccagattggtactagattggtaccagatcaatacttcagtgggaagaaatggggaacatcatacaatttttctcaatcacagtcttaggtcttatcttttctccagctcttttctagccaagttttcgtagattctgagttttccatgttgta

SEQ ID NO: 60813 - DNA, 1352 bp, Homo sapiens
atctcggctcactgcaacatccgcctcccgtgttcaagcaattctcctgcccacacctcccatgtagttgggattacaggctcccgccaccaggcctggctaattttttttctatttttagtagagatggggtttcaccatgttggtgagtctgcttttgaacttctgacctcaagcgatctgcccattgcaacctccgcctcccgggttcaagcagttatcctacttcagcctcccaaagtgctaggattacaggcgcgagccactgcgctcggcccttagtgttaagtcttgatgccccttcgccttccagtctgcagccagaactcttctccggatgtgctggttgccgctgccaaatcttaattacttcccagaccttctataaggccacatgctataggtttttttaatttgtggcaaagcatgataatactgagaaaacagctaatgcttaataaaactctgaaaaaatatagttgctgatatatatttgtaagtgatctggctttttttttttttttttttttttgagacggagtctcactctgtcgcccagactggagtgcagtggtgcaatctcagcccactgcaagctctacctcccgggttcacgccattctcctgactcagcctcctgagtagctgggatgacaggcacccgccaccacacctggctaattttttttgcatttttagtagagatggggtttcaccgtgttagccaggatggtctcgatctcctgacctcatgatccacccgccttggcctcccaagtgctgggattacaggtgtgagccaccatacccggcaatctggctttttaatgttttattttcaatccctgacatcagtacttaggtgttacaattccagcttgaattatggtgccatttggtttcatggtaatttatcagaaacattcaaagtcagataggtttctgggtcttattaattagcctcaggggcagccacaaagttgcaaactatattataaagttagtgaaacaatccagactttctagggcgagaacagtcaggactttttagggcaagagaaattaataccattagtaaaggctcaagaggggacttggagggagaagaaatactaattaacattggccagtgttctagtgtctaattagaaggcaacacaattctaaagccttaattatctgttaatttaggaattggatcctgaaatagcaagtgccatagttaatgactttagtttgttaaatgaactggtgagggaggattttttctttttaaagtcaattgtttccaaatcttagctttgtaaaattaaaaaaaaaattccagaatgaaacaaattaacctgtttatg

SEQ ID NO: 60814 - DNA, 1097 bp, Homo sapiens
aatggcacacttgtgtctgcggggactgccattgagaactgctgttgcaggaagaagacacctgagggagattctcagcctgttggtgatatgaacaaaccttttttcttgagtggggcattgttgtagggtatacacagaatagaccggagatgaaaatgacccccttttgatgtagaacagatttataaaataattgtaattgtccagtattttttttttgtctctttaaactgtaattgaaaaatgagacctctgtgaccttccttctaagtcttaacacctaaaattacccaagggataaccagggctcgtgggatagtcatggtgagtctgagagtctaggccctccagcagtggggaaacagcatgtattcattgttgggatacttctccacacactagttgtacctctgcttttgtagacgatgacccttgagctctggaaccttaggtagtttgatgcatgtccagaaaggggcaaacttgggatttaaaacttgcagtcttactccaaagtctgtgtcaaggcattcagcagaatttgacttttttaacatttttaataagtttttttggagcttgaggctaggctttagagaacattcacagtattcttttggggcagtatcagtatattggagacccatactgcatggtatttattttgtaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggtgaagacattcaacttaaatatttattgcacaactattatgtttgggctactttaattgggcacacgattagtaagtcatggacttaacctctgggaagtgagtatgtcacttagtagtctcacattgactccaccagaaagactcgctttacctgagcactgatggagtacttgtgaggcgcaaggcaacatgtcaagttggggtgcaaagatgcagagcatggcctctactctcgaggtgtgtgttg

SEQ ID NO: 60815 - DNA, 1049 bp, Homo sapiens
gagtgcagtagtgcaatctcagctcactgcaacactgtttcctgggttcaagtgattctcctgcctcagccgcccgagtagctaggatgacagttacccgccaccatgtcccgctaatttttttggatttttagtagagacggggtttcaccacgttggtcaggctggtctcaaactcctgacctcaagtgatccacccgccttggcttcccaaagtgctaggattacaggcgtgagccatggtgcccggccttaccttgacatctttacctaggatttgacttttaaaaaaatcagtgaaaaaaagaattttttttttaacttttagtcctgctgtgtttcttattctccactttcgttatgtagcttgtttgggatagtcagatggaacagggtatcaggtggcacatgtaagtttgttttcaactgaaatgtttgacagcctattcctttcatgatgtacaggatctatacattgatcgtcctttaccatatctcattgggtcaaagctgttcatggaacaagaagatgtaggtcttggagagctgtccagtgaaggtacttttcttcaccaaataattttgttccttaacatttcttttttattttaaaataatttcaaattttacattaaagtttcaagaatagttcaaagaactctcatatacccttcacctgggtttaccagttaacatttcaccacatttgttagattgttctctacatatacgtaatattttgtcttgagcctatttgggagacatcatgctcatgccctgttacttctaaatgtttctctgtgtgttttctttttttcttttctttgtctttttctttttttgagacagagtctcgctctgtggcccaggctggagtgcagtggtgcgatctcagctcactgcaacctccgcctcccggatttaagcgatttttctgcctcagcctcctgagtagctgggaccacaggcgtgcaccaccacacctggccaatttttgtatttttagtagagacggggtttcaccatattgtccaggctggtctcgaatt

SEQ ID NO: 60816 - DNA, 1026 bp, Homo sapiens
ttacaggtgcccaccaccacacctggctaatttttgtatttttagtagagatggggttttaccatgttgggcaggttggtctcgaacgcctgacctcaggtgatcctctgtgtgtgttttctaagaacaaggacatctcttgtataatcacagtagaattacaaagccaggatattttcctggacataagggtattatccaatctgctgctatgttcacattttgccgtttgtcccagtgacaccctttacagtctctctcttttgttctgtggtccgggactcaatccaggaccagccaccacatttggttgtcaaatcttcagttatcttttaatctgatgccatttctcagcctttctttgctttttatgaccctgacatctttaaagagtacaagcaattttttttttatttgtaatgaataatttttggggggagagatacttcaagactacataaatatgtaattcctcaccataatgacactttcaattccagtaagtgggtatagatggttttatcaagatctctgtgatgctgttgtatggtggtttgtgattttgagctaaggacattttcttgtgaatattggtgtggtgacccttatctctcttctcaacagaaggctctgtaggcagtgatcgtggcagtattgtggacactgaggaagagaaagaagaggaggtaagggctgtttggtatgaccaggtcacggtgggcagcaagcttaatttaagatgggcctagcaggctaagtaaatagcataactgtgaattcgtaatctgcttccataaagcttttaacagtgatagaagccacattctgagttttttttcccaagggttagatttcctttttgccttatgtacaataatagggaaagctgctttcatctcttccactattatcctctctcccaccttgccaccaaatatctctttcacccaatatatttttgagaagggcagcttagatgttttggtggaatctctgcctgggatatagtctttgagtatattctgt

SEQ ID NO: 60817 - DNA, 1060 bp, Homo sapiens
tcaattcccacctatgagtgagaatatgcggtgtttggttttttgttcttgcgatagtttactgagaatgatggtttccagtttcatccatgtccctacaaaggacatgaactcatcattttttatggctgcatagtattccatggtgtatatgtgccacattttcttaatccagtctattattgttggacatttgggttggttccaagtctttgctattgtgaataatgcaaggaaatagagacagtatagtccaaaatgtaaaataacacaaactgactttcagtaatttagttagttaaatgtgcaactctttaaatccaaaggcaagagttgaaagtgcaggtgatgtgaacaaattgttagaggcatttaagtgaaccacaaaaattacatgttaactggaacaacccttcacaatattgccagctatccagcttatctgcaccttgatacttaaggtgaccagtagtcagtacaaagagactgagtgtcagagctttttctccacttgacatagaatcagcctgccccagagacttagacctgcaatcatttctgtgcttctaagtaaagcccatttaacaacaaagccttttcttccccacaaaggagtcagatgaagattttgcccatcatagtgacaatgaacaaaaccgggtaaggctcatatattgaaatgactttgtttttacattttaattgaagcatagtatatatactaatattactttggaatgatttatgaccaagtgaggattttttcttgtatacaatttattttcctttaagcatttcatgtatttaggctaactacctcctttgtatatattttttccaattttgctttatagtttatttttcttagaaaagaagtttcaaagaagtgaaaaacacaattggaaaacagagcctctaaaagaagactcagttacccaaactgaactactttgcatgagtccctcttctgttttaaaattggagacaatctagcagtaacattattgagtattcacaagatgaaaacttcttaccctactgtcttagcacggttatctta

SEQ ID NO: 60818 - DNA, 1031 bp, Homo sapiens
cccatgttttataatctaaattgccattggacttttttttctttttttgagacagagtctcgctctgtcccccaggctggagtgcagtggcacgatctccgttcactgcaagctctgcctcctgggttcactccattctcctgcctcagcctcccgagtagctgggactacaggctcccgccaccacgcccggctaattttcttgtatttttagtagagacggggtttcaccatgttagcaaggatggtcttgatctgctgatctcgtgattcacccgcctcggcctcccaaagtgctgggattataggtatgagccactgcgcctggcctggagttttaatatatattttatgttttaaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacaggtgagatagtcattggaaggagtccctcactccgttaccgtggtaacaagaaaaggaatctgatgcacaatctagttcatcgggtgattgctaatcatggatcacatagtgattgtgccagtgagaatgtctttgcttttcaatggcaccatcttttccctcagtacccggaaatgtttgtctttgtggatccttatctgatttcttccccaatcattattttttaaccatattctttttctttgtttgtcagggatttgagtatcttttgtttgtgatttttctctgggctactctaaagtatgtcaggtttggtcaggattacttaaaagttactttaggccaggcacgttggctcatgcctgtaatcccagcactttgggaggccgaggtgggcggatcacgatgtcaggagttcaagaccagcctggccaatatggtgaaaccctgtctctactaaaaaaatataaaaattagccgggtgtggtggcacgcgcctg

SEQ ID NO: 60819 - DNA, 1016 bp, Homo sapiens
ggtgaattttatggaatgtaaattatgtctcaataacgctactaaaaaaaagaaatagaagccaggcacagggtcatttcccagtgctgatcctggccctgtgatctctcttggcaaccgtcttcatgacaattctggaaataggcctgtccgctttgattctttttgtgctataggaagtgggagagaatgttctgcttgggaaggctcaggcatcgtgtgccttgcagcggtaacagctgatgaacctgcactggatagtaacaggaaaggggcaacctgaggcaggagggacagaggctggtgatttgttggagtcagatttcatctatttcaaaggtctttcctgtttgctttcaactgtgtaaggtcaactaatggcttgggtgtttgggtggtaggtggattcctgtaggtgcagtctagaagaaatattgttgttatggtttttgtttttttcatcacacttttccttaatttgaccttttgtttgtttgtgtagccaaaagaagacccagagagtgtcactcctctttgaagacgatgttgatagcggaggctctctgtttggctctcctcccacatctgttcctcctgcaacaaaggtattcttcatctcttagtcccaggaaatgtccttgagtttatgctgcatcagtagtggtacttccccgaatcagctcttcatacctaaccttggaggctgagtcttatggaagaccttatttgcctggtttcagaaagagatcttctgattaatagtattctagagaagaagcacacgtgcaaaaccatcattcagtgtcaggtgtaggaacaaggaactgggtctcagaagaggcttgggccccattgtcatggaattctgctaacattagactaggccagttaaggcaaaatcattccttttatgagtgtgtgtcgagtactaacactggtcctggtttatattagccagtcagtaaaaaggaaggaaattctcacatgtgctacaaaatgcatgaaccttgaggccg

SEQ ID NO: 60820 - DNA, 1602 bp, Homo sapiens
aattctcttcctagtggctgtgtgtggaccccagtcctatcccagtcctggtccacacttgactctgactggttgctgtactgccctctccctgagtgtaagccccttgcggactaggcccagtttgttttgctcaccatcatatctgtagtactggcatattaccttgcacacagtaggcactatgttataaactttgtatttctttaaagaagcatttttttaatagtttgagtactctgaaatcgggatgtacctcataatcaatggtatcttacctgaaatgtgccatttgttgaatgaataaatactgcattttagaattatttcagagattcttcttcaattgcctatacagtgtaagccttttacaatttgagggtctgattttcctgattagatttcccccttggggcttatgtattagttaaatgctacgaattcatggtccactcccaatgattggcacttgtattggttatctttgacacttagaagttcttcctagttcatgagcaaccagtgtgcatcaggattatagccatcctatcacttgataggagagagggacccatggtcttaatgcttggaaaagttatctttggctacggatgattgtacaagactgtctcttggagcagccaatcaagaattgacctcagtgttttgttacttgggcacagatgtgattcactgtgccctgagtcatgcaaatgtggcagttactgaattaacgagaagcttggcaggctccatgataggatttgtatttccaggtgttacttattttttccccctattattttcattttcaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaaggtaagcaaaaagcaatagtggttcaagtctctggatgagataaaagactctcatctcatggttgtcattctgtcatgtgagtttctgaaggaatcttaaccttcaatgtagtgtgttaatgattctgtgcagtcatttagatatttgggaatcttaatcaggaactcttacctcaagtagcagtgttaggataggggattagaatttcaccccccctcttctgggatttacagaccttgttgttccttctagcaaaactttgccccttggccagttgtgggatgtaaacagcaggaaagggaagttaggctggagttgtacagttaagtatttctaacattcagtttaagaaaaagtgttgtagatgaacctttcatactgatcaggtgtcagcaaactatttctataaaggaccatataatgactattctagcttttgcagcctatttgggctctgtcataactgcctagctctgccattggcagcatgaaaacagccctaggaaacatgaagatggatgggcatgactgtgttccagtaagttttattaataaaaataggtgatggtcagctgggcatggtggctcacacctgtaatcccag

SEQ ID NO: 60821 - DNA, 2398 bp, Homo sapiens
gtcgtgctgcttcctactaaatgaatggcaaataacatgctgaggggagcgtgtgtggaggatgcaatgcttagtttctgttgttcctcattttatgttccctatactaacattaaaacattaataatccaggctctctgactgtactgcacatctgtgtgatgtttaaatggttgattgaaagaccattgcatacactggggtgactaaatattcgtgcctttcaggtgcaaagttttgagtctgagttttagcctttctatgtcattttctcccccagccccagtaggtttttgtaagtactctgttttctttttatcatagagaggactcctgtgacagccacagtcttcagaatgctatttctgaaatgctacctttgagttggttcagccctcatttgagaaagtatttttaagactcagaagccaggattgttttttgcattatgatttttccttaaaatttctaagatatttgatggctttttggtattttttttcttttgaaggtacaagagaaaaagagagtagtgaaaaaagaccactctgttgactctttcaaaaaccagaaacatcctgaatccattcaaggtagtaaagaaaaaggcatatggaagccggaaacacctcaggttagaaatcctctttaaggattttcagctcttgtttgcatcccagtacagagaaattccattatgcagacccacagttattcagacttgtctgcattaaggaggaaacagcaaccagggctaccgctttgtcttcactgcactccccccaagtcatctcccctctcctcgctccacacgccagagtttcatgaatctatactttaatagttagtgttttttgatgccatgccagatttaactctgaagtggagttaaggtaggatgaagaatcttcttcccactaaagaatttatttctccctctggatttccttggaatagaattaaaatagaaataaatataaattacatctgatttcctgcctgctctcagtgttgcctctcccaaggtcattgctgttgggccgtactctgcagcagtcttcccagaacgctgtggagctcctcctgggaacagcccaggactggagagcgagtgccagttccacgtgcaggtgtcccagggtgtctcactgaagccttagtgtcctgagccgtaaacctgaggcacttggacgaacacatcaccactgacccttcctggggctcagatcttttgcttttagagccagtgcattaggctatggttgaatttttgtgtgctccttgaaatttctatttgataaccaacatggtaattttgcctgctggtcagttttaggtgctctgataaactgtgactcttgggaatcttactcatcttgtattccttgactccatatctgatctggcagctttccacttacgtgacagaggaggaggcatacgtgaagtagtgctagtgaaacatcaggccccaggagagatttgaatgcctttcccattaaagagctacagaaagtgacagttttgctccatcacagatttatttacaggcataagaaacacttgtctttctgtttcccaaatggatttttaactggatgtaattttacacaggactcatcaggtctcgctccatttaaaaccaaagaaccatccactcggatcgggaagatacaagtaattaaaacactggaatcttcattgcctgccctgtggcatctataaacttttttgggtttcctacttttgtcagctgctgccaagcatcttctcatctcttcccccgcctcccctcccctgcacctagttgttgtctcctgtgtgctgcgtctttaacatctattttttgagcccagtggtgggcataggtgtaagacgctctgttttaattctgagactagatcgggcgattttcctacgtttctctactcctctcgtattatacattatgtgcaccgaatcttgtcatgtgtcacaataaagataatagactgctgtgttgaagaacaaatacagagtttcatttttcttctttaggcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaaggtgatgaaaccatctttgcttccttgctctcttcttttaaccagaacatgcatatgcttctttctagtttatcagttgcatacacagcagtctttgactctccttttgaaggaggtgcctcatccttccttcagccactccccactcc

SEQ ID NO: 60822 - DNA, 2502 bp, Homo sapiens
gtaccagaattccccgattctttcttgttttgaaagatacccacgtttctattgagggtagagtaggggccaagggaggggttgtgagacagagagccaacatacctactttccaggtttccagcaacagataaaactttttgtgtgaaactgaactgaaactgccctgagaagattaaaaaatggagaactctaaaggattaagaatgacttagtcttggagtactaggagctattaaactccttccttggaaatcattaagaaataacctcttctatgttcttagataatatcttcattgaagtagaccagataaccttacaatattttgagtcactgattctttgccatggtagctttgaacactttattttatcgtcagatcaatgtgtgtttttttgccattgcagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagatagcagagaatcctgccaacccaccagtgggtggtaaagcaaagagccccatgtttcctgctctaggtgaggccagcagtgatgatgatctctttcagtctgctaaaccaaaaccagcaaagaaaacaaatccctttcctctcctggaagatgaggatgacctctttacagatcagaaagtcaagaagaatgagacaaaatccaatagtcagcaggatgtcatattaacaacacaagatatttttgaggtaataggacttaacacgtttttgtgtctgttctaagttaaggaaggtatctgattggcttatttgagccatagattatgtctagcttgttgcgtgcataccccatagccacttgcttagtaattataattaggctcttttattaataagtttaacattgattcagaagtggttttttgttttgttgcatgtagattgtatttcttggctggccatgatcattgatactggtcttggtttctctagtttttacagtttttttatttttatagaatattgtaatcagcttcctgggcatgccactcggtgacatggcatacagctccactggtccagcttgggagtttaacctctggttctggggacattggccctggctggagctgacaatgtagtgcatgcaggcaataagactttcagtggcatttgctcagcagatgtttattgagcacctggggactgcaggcacgaggtgaactcagagaagtgctaggctcctcagagctctctgggaagataatcaaatacaaacagggcaatggataattaagatgttttcaaatagtactaagtgtcatgaagaaaataacctggggcagagtggtgggtagggctgggaggtgctcctttaggcaggactggtagagaaggtgtcactgcagtgccggcatttgagccggggtgagatgggcgggccaagctgtgcagagatctggggtagtgcatcccaggcagagtgggcagtctcgaggctgttccacacaccctggccaattgtatttccatagctcgttgttgtgtttgagcttaaaaagaaaaattgatttaacattattttgtatgtatttttggcttaacaaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatgggtaagtttggttttctacatctgacctagagaattcttacctttctgtcacttggtatttttcttgctaccttttcttggcccttttctggaaaatgcaccccagcgggttcacttcagtgtaatcctgagttaggctgaagataggtaagagatggactaattattttagtgaagtaactctttcctatgatagtcatcaaagaatttgaaggcacccagagtttgacgtttaagtataatttaactttgatctcagtgcacctcaccaatcatctgtgacacaccccggtgttatgaaaggaggtttgatcagaaatgacctcacgtgctaaagtaggctgaggggactgccttgggtgtgatgtggttggttgagtcagagctccagatagacagggagtgtccatggttctgtgcgagaagagagca

SEQ ID NO: 60823 - DNA, 1104 bp, Homo sapiens
gttccagagagacagcttatcagagtgtctatgccatactcaaggtaaacattgctaacaattgctttgggtttgacacttttgctggatttttttttctttgattaatgtttgtgtgtacatggtacatatagttatggggtacatgagatgttttgatacaggcatgcaatgcctaatagttacatcatggaaaatggggtacccatcccttcaagcatttatcctttgtgttacatactgctgggtcattttttaattatctttcacaaaaaagacacaatgataccaaactttagattgcagcttattaaagcataatcagcaacaaatactcagcaacatcaccagtattctgtctggtgttttcttgatgtgtatgcaccatatgaagacattagtcatgcatttggatgttcattgatcaactcattcactaaacatttactgagtctctttgtattagttgtctattgctgtacaacaaatcgcctaaaaatttagtggcttaaaacaacaataataaatgttgttcaaggcttctgtgtgtcaggattcccagagtggcttggttagacgattctgacttgttttagaacaagtcatatgtaatcacttctgtgtcatgatgtggcactcagatgctggctagggccgcagttttctgatggcttgaccaaggtggaagaaattacttctaaggttgctcactcagatggctagcaagttagtgctgacaggatgcttcctatccacttaggcttctccacaggattattagggtgtccttgcatcacagtggatggcatcctctagaccaacaagtctaagagttcgtttcaaggcacactgaattcttcatttgggaaatgaggtactagagtagcttaaaacctttgcagtttctgctcactatgcctgagttgcttttcccccagatattgcacagccgacttgctttcttcatctcagcctctgctaaaagagagcccctcattagaagatctttcctcactaacacccactactttctttttccttatgcaacaatgtttttcttcatagcatctatcactctatgatataatatttaatatttatttg

SEQ ID NO: 60824 - DNA, 1583 bp, Homo sapiens
gggaaaacatacttttcatatctcttgccccaaagattgggctgtaagccattttctagcaaatgtctctatgaaggtttctaagtacctgaatggggtttgattctgaaatctttctacctgttgcaccgatattcaaataaaaatgatagacacagaaaggtttggtaactttgggttttgtaaaatcagcaaaggcagtgtttcaaaaagtgcaaaaaaaaagattctgttataaagtgattttctaagtatttcctaactttatttttcaaaatgatgttatgaacaccaaatttaaagatttttaacatgtcagagagaagagagttaaaatttaaaaatgcatcttgggagagaaatttgtctatgtttctagtgcctttcttgtcttgattgtatggtcagtaggcaatcttaaatgtttttatttaaaataaagtattccttgaaaatataaatatatgtatacactactaaattttgcatttatagctaaattgaatcagaagactgcttatggttttaaaattgcaatgacttaaataatgaggttgttaattagagtcagagcctgttcacatattgtgatcaggtagcaatgacatgtaccacttaaattattttatcgtcgatttggtagttcaattttaactactcaatgaaaacagccatgaatatcttttcttaaagagagttttgaaaatgatcacttacctaaaacttgaaagctatgaattagttatccatactctcatgacaattttgttggtgaacaacaaaaaagagatctatttctttaaaagatatttgtgcagaaactgcatgtaactctaagttttactcctaacatacatatgtttggggaagtattctattctatacttgccaatgtggagaacaaaatagttttttaagaatgaagaagtatatatatccattctgtattttacgtgcagcagaattatcttccgtaggatttttttgtgtattcacaaggtgatatttgtattgtaaaacaataatggtgaaggaaataaaaaggcttttaaaattttgtttgttttaaatctttgtaaagttattattccagagagtatactggtatcttacagcttacctagatcataaattaatcaaaatgcactttttaataaaaactgatacttaaaataaatggctgttatttctactgtgttcacattcttcacagaagtcataaatggagccattaaagcaagatagaaaatcagtttcagaatttcttcatggagtgtttctgcttgacatgggacttttaataattatctggatttttttccttgggattccttaaaatatattctaatctttagtaaattctagagagttttttaatatataaaaagagtcacatgtaagttaaattcaaactttagaacaatgtttactaacattttgaattctctaattctcaaccaaattgttttttttcctatatctggcagtaatatagcttctccagtgtagatggaaaggaaaagtaaatccaaagtgagaaatagagtaatagtactatgataaaccagtggtaatggaaaata

SEQ ID NO: 60825 - DNA, 1703 bp, Homo sapiens
cagtacagttaaatcagttatgactgcttagtccttgtattaggctctgtgggccaaaaggtattgatttttgtgtagagcatcaaccccaaattagctagaggtaaatttaaatgtcaatggacagtttttaaaaacgaaacatgatgcattaacctgtccttatttgattagcctcatcttttaaactctatttatgattgtatgaatcaagtaagaaccaaatatgaattactatcactagtataatcacatcataaaaagctgtttctgttctaaccttggttacagataaatgacagcccttagattcactagatctgttttcagaagggaagactcaaggtaattggattcagaagcattagtagaggcatagttgggtgcccttaatgtcatttgaataatgggactattgcaaatctctccccctttcagattcccctcggcgactctggtggtatcactggatttgctggcttctcagcgtagttggaatcttctgtattctcttagcgcatgaccactacactgtggacgtggtggtggcatattacatcaccacgagactcttctggtggtatcacactatggccaatcagcaagtgagtttccccgcttttgattttagcttctgttgtttctggcttgatgttgctggcttggacagggtgcaaagaacctgtggatgtctgaagtttctctttcttaagtagtaatcaactaagattgtattgtttttttgtgacattgattctcttcagaattaagaataaaaagtttattaatataatgatgtgaggaattacttccttctagaataaggaacgcactttcattgtccttgaaaaatgaaaaatattttctaagcttgtgtccctccttgcttgatttgctttcctatcctcttctccctacccggggcacatcacaagcttaatatttaacatttaattaagtgttaacatttttagcatagaagaggaatacctaaaaagctaactgaggtgtttatttataagcaagagatgagtgagccataagttctccttgccctcccagaattggcgttgtttttctactgggatgtggctcagtttgtagatgaatgtggagtgtagaatggtgatgagagagagaagctgggatatgtgggtggacacgcagggcaggtatggagtcctttgggaattttagcgtggcaagtatttgaacttaaagtgaaagattgtaagaaatgtgtttatgtttctttgttatcctaggtgctaaaggaagcttcccagatgaacctcctggccagggtgtggtggtacaggccatttcagtactttgaaaagaatgtccaaggaattgtacctcgatcttaccattggcctttcccctggccagtagtccacctcagtaggcaagttaaatacagccggctggtgaatgacacataacagctgtacaaagtggggaaaagacaaattgtccgaagtgctaagaactccatgagagaagatgccataaaataaacacctccctaatcctattatctttcaatggttaccttgacttaacctattgagttacctggtcagcactgtgatctttttttctctccaaaggacctgcgttggacaacaataaagaaaaatttaacctatcatgcactgtacacatttcctgttcataagtttgggatttacataacccgc

SEQ ID NO: 60826 - DNA, 1053 bp, Homo sapiens
atttaattcagataacccttttagaaaggaaatgaaatgttaatatatgattaaaaccttttcattcctttcctatatcatttccatccatttttttggacttgtgtattattgttttgtggttttttaaatttatatacataaatggcatactgccatttatattcttctgccactatttaccctcaaattatgtttttgagatatgagattttggtccattcactttaattgctattaatattacagtgctagaaatgaactacacatatttattcatttctctacttatggaaaattttattatgctcaatatcacattgttagaaacagtctgataagcattatacaggggggtttccatgaagagcaatgagtagaaccaggctgctgtggtatcacagaggagggagatgctttgccttctggaggtgtcttgggagcatgtggtactctctggaagtttaagtgggtggaattcagagtaggggtaataataagaatggacaggtaagtgggaaccagatcacagggggtgcttaagccacaagaagagggtctgaactctcagctgatgtagatcgggtgcccattgaggggttgtaaccagtggggcagtgtcatttgtctttgaagagagaaaaatcactcttgcagcagcttgcaggatggactggatgggggaccaaactggagaccgggagaaaagttaggagattgctgcagtaacaaaggaaactagcctgatggcatcagggatggagagaagtgacagacactttaagacattaataaagagagtcagcagataacaggatggattatggggtagagaaaacaggtagtggactgggtcgaaacctagttttgttcttgaaaaactaagataaggaaatacaggaagggaagagagatgcacttcagggcactgagatagaaaagggagaatagatgttccagtgcttatacttagtacgtgagcagatatagtgagttctagcaagatctgttcagaattgtcagggcataatctagcctttggactggaatgta

SEQ ID NO: 60827 - DNA, 2012 bp, Homo sapiens
aatgggcaattggtttgtgaaagaattccacagaaatgatttttataggccgggcaagttggctcacgcctgtaatcctagcactttgggaggcccaaggcggtggacattgcctgagctcaggagtttgagaccagcctgggcaacacagtgaaaccctgtctctactaaaatacaaaaaattagccgggtgtggcggcatgcacctataatcccagctacttgggaggctgaggcaggagaattgcttgaacccaggaggtggaggttgcagtgagccgagattgtgccattgcactccagccggggctctcaagagagtgagactgtctaaaaaaaaaaaaaaaaaagaaagaaataacttttatagagacaggggagcttgatttaaataaaaactaagcttacgaaaaatagttagtgaatagtgaataaatgttgttttagctattcaatcgtgtattaataaatgacatatttaaaattggttaaatttcattagaacaacaacaagaacaacaaaaagtaaacctggagaaattgtccagccttgggtattgtccttgttatttggaaaggtgtttgcaacaatagcaggtgttttccagggacctaaaggcaagattgtttagctcagaggtaagacatttgggctctgaacccaactgagtcactctgtgtgacctcatgtactggtcggtaagccactcttttaaatgggcatagtaacaactacgctcaccaactgacaagcttgtgaagatacagtgagataactgatgggaaaacactgctaaaatgttggaatctgtgtacaaacaaaagatattgttttattttgtaaaactaccctgtaagtcatgtttttactgaccaacagtaaaataaggccggagaaattgtaagaggcagctttgagcctcttcattgctgctttgaaatctaaagcattcatcacactttcaaacacattaccttcctggtggggactacaaagtcaggctaaaggacatttcataacttacaataattctgctgcttgattcctttatcagatctggtctttgatttgagtgtttaagagcagcatttttggcatttcatggatgaaatgaattttctgttcatgagcacatggtgttagcattgaaaaatacttggggaaacctcttttttcatagccaaaagctcactagttctaagtgtcacggttaggagggctgttacatgccagttgaaattggggaagtggcatagttttgctgttttgggccacttgggaagttgatgttgagggacaccacagtgtgtaaggtgtgtttctcagttgcaggctgctgaagatgcagattgatgaggattctaccattcctcctcctgatcctgttacttgattcgtgtattggatttggtctttggtctgagtgttttaacagcagcctttttagcattttgtggatgataatgaattttctattctggaggaagactgctctttgggaacagaacaaaataatttaccttaataggagggagagagggactttgagaaaatgtctggctgttcatggtagttggaatagtataatattacttctgcaaggtacctaggctgctgaaggaaaagttcctttgtatgtatcaagttcctggtttatccaagcttgtgagggccaagctgtgcacaaggcagcatatagttttgtaaatagcacatttaaatagtcagaggacttggattctaggctcggctccaacactggagacctacagcagatagggtctgccttgctgactttcctgggctgctctaggctgcagcattagcgattgtcaatgcttattttaaatcgcatttctgctccttagtactcactttcagctcttcaacaaagctataccaaagctgtcaaagctatgaaagccattaatttgtgcagcattatttgatgggttttagttctaggttacccccttcctcctaatggggctgaagtacagtcagtgcccct

SEQ ID NO: 60828 - DNA, 1007 bp, Homo sapiens
cactcttcacctcctaacctttaccttggaagaatttttaactagggtgatcgttggaactctgtgaaataattagcagattttattgttaaaatatttatgtacattaaagctctttaatgaatttttaaaagaggctaatttctctccttgatttttggtgggagaaaatatagtatactctgatgtatttgagatcatttctttgcattatacctgtgtgggtgaaacagccaaacactttcagtctcattgctttgtacttttgttcctccagaagagatgttctctttgatagaatctttggaaagagagctgaaaaattcactctggatttttaatttgatcatatgaaattttggatctctttaatttgtatgtctcctgtggctcttttctttgctaaacttacatatgtgcctacagagatagctcatttcttacttaactttttgctttttttaattttttaatttttttaattttttttattttttgctacacactacttccttacctctggaagagctgtcatacaaaagcaatgttctcaacattccactcttctctatcagccatcctgcctccctgcactctccttcttgcagtttctttcgcccttccaaagaagccagcttcacatcgtttttattgtctgtaaaagctctcaagcactcacctgtagctcctgggttatagggaatatcttgttgtcattgaaaatccaaggatatggactcttgctgggagcctggcttgataagcagcatgttctcagcagtaaactgacagtttaggatattcacctaagtttaattcagctccttaaaaaagtctgtgcattgggaaattttgctaccaaggggtaggtagatgtaggttctggccaagcacatgttgaagatggatccagtattgaggggccgtaccatgtagcctttctccctactctggttctaaacttgtttcttcttgaggactactgtagctccgccagttgctggcaa

SEQ ID NO: 60829 - DNA, 1068 bp, Homo sapiens
gcatattttgggcactgaaggctcttcattatacatccagtctataaatttcctggtattataggcatctgtcctttggagatgtatttttttttaacagatttagtgttgtagatgccacgtgcataggacagaataaaaacaaatgagttcagttttttaattatatattttatgtgttgggttccatctgggagacgtgcatgtgtttcaggatggatctgccaactttgatagccgtccatttttgcagttccccatagactgtagaaaatgcccttagctctgtcctagctctggaaccttctaagtgtggaatgggccctactcactactaatctgataaagcttcctttgctaccaacttcagtcacgtttctgcacttaagaccactgactaggcatgcccaaccttattcttttactttctgtttctagtacgttttctctcttcccttgattctgacctattatctatctaggctcagagcctgagctgagatcccattttctttcctttcctggggaccttctctgacccttctcttcccagatcatctggatctcctagcctcttgcaggcctcgctgtgcctcctctgtcttctttttgtttaccgagggcagtttttttggagtggggaaggacactctaaaggctagatgatggattcagtcccagattgtgcctcacctttcattctcatgttggtgaactggtggtcttctttgcttctaccttttctaatttacaattttaggtctcatgacctaaataatggactgagccataggaattatagggaaattgtagatttttctctaaagttagtaatcccagcaatttgacttgtaggcagattagaagataaggataaacaaaaagacaaaccaaattatcatctcaccagagataaatgatgctcatatttgggttcatataacttttgatatttttctgcatgtgctcataaatgagtactctgtgtacatgtgtatttctaaatggtatcattttggccttctcttttacagcatgcccagggattgtctatttccctcctctcaa

SEQ ID NO: 60830 - DNA, 1495 bp, Homo sapiens
gagcctctggagcatttcacaggccaggacttgatcaacctaacccaagaggatttcaaaaaaccccccttgtgccgagtctcctctgacaatgggcagcggctcctggacatgatagaaaccctgaaaatggagcaccatttggaagcacacaagaacggccatgccaatgggcacctcaacattggcgtagacatccccacccccgacggcagcttcagcatcaagattaaacccaacgggatgccaaatgggtataggaaagagatgataaagatccccatgccagaactggagcgctctcagtaccccatggagtggggcaagacttttctggcctttctttatgcactttcctgtttcgttctcaccacagtgatgatctcggtcgtccacgaacgagtacctcctaaggaggtgcagcctccactaccggacacattttttgaccattttaaccgggtgcagtgggccttttctatttgtgaaattaatggcatgatccttgtaggactctggttaattcagtggctgctcttaaaatacaagtaagtcaagtaaaagctctaagattcaatgattatgggatttgcactccaaacatctacttattatttataaatgaaatttatcaacttgttgggatcaaaacatactatttttttttcttttttaaacacataccctgttggactaacttactgtctggaagctttaaaagaaaatgttgtttgttgcctgttttatgcaagattcatacaggatgatgaataagatggttagagatgatgctctgttttcacttaataagaaagaaaactctcagacatcttcagacagtacaggctattgaacaacagatcaaccacctagtcttggttggtgttactaacccattaaataaatcgacagttggcctaagcactataaattggctgcatagcttttcccacacagagtcagacatctagagccttagcaatatgtatttaaagatgtttcacacagaattcagaacacctgttccagagtggcttgggttgttgggaaaacaataccaaagggtatgcctttgggtaggtgggaagtggatggacctgaatggattcccaccttctactactactacttaaaacaatatgtgactgttgcattcaaatttctcagagttttaagtaggcaactcccacttagttccaggtgtatccaaggtggctttcatatctgaagctctaaactcaacatggaccccctcagactggctgtttactggggttgcctacattgtcccttcactgatgtttgattttctccttagttaaaggaacgccttatggtttccatgaatgagggttggaaattggtttgttaaagagctgagtttctctccagtggagtgtgtttcatgatccaccatgtggttaaatattaaggaattcatcttacagcaagaaaacaaaatgcacactgagagttcatgctgaatgttctttga

SEQ ID NO: 60831 - DNA, 1334 bp, Homo sapiens
aacctgtttatgtgacaaagctataaatatgtattactatagatatggaaatacagtacagtctgtggcagaggcttggtattctgttgtacaatatatttaatcaatttctactctagagcttttagattctttttctagtttttttttttttgccataatgaatgattgtttagatttcttgatcactaaatatttacatatattctgtcacaaaatgactcaattggaggcttggggaaggggaggcagaattagctgatgttgctggtgccaggactctccatgaaatgtataaaacagtattatatttcatatcctcagtgaacaactataaacatgtccatggtatacagtggacatggctgatttattgtcattgtgtcatatctgttttgtctccccaaattctctcttttcttctacaacactgaggctactacgatggaatgggtcattttgggagaggtggggaaaaggggggaaactatcaattgcataagttatagggcagctactgagagaaatatatttcagatgttgtgaaatctaagtattaaacattattgaataaacacagtgtggaggagaccaaaagatgtcattaagtaaggctcttctaacagcctaaagtctaccagccaaagtggacaaaaaggcaaaatacatacactccagcaagcccttcttcttgtatcttagcaaagtaggtcagcacacacttacttagttcaaggggccatttcataggggatgattttatttgctaaccagagttggactgtggaattctgagcacagcatgtaatagcaatttaaaataagggacaatttaaaggttaaggcatcaaaagtaatcttctaaaattttctcaacagtagactgaaataaatgtgtaggtccttcagctgaaactatgtggctgttactttaaccatttttgttcttcaaatctataccattttatgaactcttctatttaactcttcaaatgctaaataacaaatctataccttattagatttgtttggagtaaagctatccaaattgaattagagaataattgaacacctatctcatgagtatttcagtgggctacattgccttaaaagatctgttaggttattatttactttttttgagacaaagtcttgctctgttgctcaggctggaggctggagtgcagtgacaggatctcggcttactgcagcctctgcctcccaggttctagcaattctcatgcctcagcttcctgagtatctgggattgcaggcatgagctaccacgcccagttaagttttgtatttttagtagacacaggttttgcccaggc

SEQ ID NO: 60832 - DNA, 1049 bp, Homo sapiens
tgatcaagaatttgtaactactactgggtagcagaaacatgctaagagagaagtcatttagaaactgaaatattgcatcctctaggacattttgatggtgtatgagagaagggaaaaatatgtttgaaatctgaattgccttagaaaagctggagggaacgattattttacataacatgtatgtaaagtttatggtgttattgttctcatcacttctttagtgttaaggaggcactattgcccattacaaggttgtgattggaagtacaatcaaaactctacttttggatatcaggaacattgtccttgtgctttaggtcctcagtagctcttctggttagggacaaaagtcctaataaggaaggtcaaggatggagactagcccttctggttggggtgagatggagggaagtacaaccagaaagtgaaaagcaggatggggctggagcattcttcaagatcttcttatcctttttaaaaaaattaattagtgtggaatggtaataacagaaagtgtactttcagccattgtttttggacatttgatgaactttcagtctgccaactcatgtctcctttagttctgataatttttttaaattttctctttttagatttaaaatatttctaaatctttgtttgtttttttcttggattttcttgaactcctgctattcagatcttgggcttctagattgcttttttattattctcttctctcaattttccatctttcattttgtttcacatctgaaattttttttcaactttttctattgttcctattgaattgttcatattgactaggaatttacaggagctctctttttaaaattctctctcctttttgtggtaccatcttgttcttttttgataccttatgtctttgaaaatgttagtaatagtttttcatagtctgttttccaagttcttttagtttgtttgttttttatcttcatctctggcttttatatttattagagagtttcttcagatacctggtgattttttttcatattttaaagtaggcacaaataaaactgtttgga

SEQ ID NO: 60833 - DNA, 1078 bp, Homo sapiens
agggagccaaactttggtgcttttaaccagcagttagttaatagagaagctcagtgaaagtgggacctggaagtttgggaaattagcacatcttagttagaagcaagaagtcacagtcagcggtgagtggaaaggatgtaatgaattgattgatggatatttgttttcaaagaattaacgtaattgctgtcaggaaaagaaaaccttaatgcattaagggtagggactggtgtggagatctaggtagagatctacatgtgcttttcttaaaatcttttgattctttttttacctccaggagaccagcagaaggagacagggagaaccatatatgggagcaaagaacatggtgggcacgcaagtggtgctgtcatggcgaggaatgctcaaaggatatacatttaagcgccatgaatttagaatttatccctttgcatgttctctagtctgaaaatagtttgatcttttgtagctatctaaataagtattagaaatttattttgggaggtagacttgaacttgatttctcctatctgggcctgtgagttgttgctaattttgaaacttgatgttagtccctagggttgtgttccttaaattaggctttttacctcagtcactccaatttatttttataagcatactttggtagactttttctcagtgaaatggaaaaccattggttacccagctaatgagaatttataatcctcagtggactgcaaaacttaacttcattctgactggcatgagatggtatctcattatggttttggtttgcatttctccaatgatcagtgatgttgagctttttttcatatgtttattggctgcatagatatcttcttttgagaagtgtctgttcatatcctttgcccacttttttaaaaattatacttcaagatctgggttacatgtgcagaacgtgcagttttgttacataggtatgtatacacatgtcatggtggtttgctgcacccatcaacccatcacctacattagatatttctcctaatgttatccctcccctagccccccaccctccaacaggctccggtgtgtgatgttcccctccctg

SEQ ID NO: 60834 - DNA, 1074 bp, Homo sapiens
gattgacctatttgtaatttttatttttattttactttttcagacagagtctcactctgtcacccagaatagagtgcagtggcacaaacatggctcactgcagcctcaacttcccaggctcaagggatcctcctgcctcagcctaccaagtagctgggaccataagcatgtgccatcacactgggccaatttttaaattttttgtagagacagggtcttgccatgttgcccaggctggtcttgaactcgtaggctcaaacaatactcctgctttggccacccaaagtgttgagattacagatgtgagccactgcacctgacctgtaatctttgtgtaaagtctttttcttatcagatttttaagaaaatatctgctcttcatatttacagtgtatgatggattttttaaatattctgtcccctgttgtcatttatcttttaggcttgtttatggagtattttgtctacaggtttttaatcataatttattgaaagctatggttcatatgtttgatgttatatatacgttaatgttggagacttcataaatgcttgtgaacttgtgaacacttttatgtataacttattttgaaccttggttctttaagtgtaacattccacagtaatatataatcaaggctttctaagagtaaagtatttatttgacctaatgcaaaatagccttggccgtgtttgttcaaatcttttatctattttacaaattgttttataatgcctttggttaactaatttgaaaacttacataatttatataatttctttacagttcagtggtcattgattaattgcaaggctctagttttgttatgttgaattatagttatggaagtgagagaagaaagctcattaaaatttagtattggctgggtgcagtggctcacgcctgtaatcccaacactttgggaggccaaggagggcagatcacctgaggtcaggagttcaagaccagcctggccagcatggtgaaaccctgtctctacaaaaatacaaaaattagctgggcatgatggcaggtgccagtaatcccagctactcgggaggctgagtcaggag

SEQ ID NO: 60835 - DNA, 1042 bp, Homo sapiens
cagctgggagtctttgccagagcaaatgacagaatggaattgcaatttactaagctgaagaaggcatgcaggaggagttggcttggaggagaagagcaggaatttggttttggacgttttaacctagttaggcagcaaccatggtgtatgtttctttgtggttcactgaatgcccaggacaatgctttgtgcatagtaggtgcttagtaaatgtttgattttattttgattcagtgatttggcttttgtaaatatatattaatataatcagtcattagctgcttagtgctggcctgctttgtgccaaagagaaaagctcattaggtttataaatagaagataaatttcagctgtgtcttcagtgcaattgatgtggctatgcctttgccagagtgctttcataatctgttctctgaatgctgatcaaattcttataatgaacaggatgtctatataatgtgtacttagcttcttaatattatgtggatagtttgactcctctaccataggagtagcacatggtcaagatgtggaatagatacctatgggactgctaatggttattttatggtaagaaagtagtttccagaaataattttagaagccattgttgggtatttctaggtgctagatttttacctcttgtactgacagaatctttttctcccaatgtggtattaatacataattgccgctcttagtcatttttccagtttttatctttatgactgacgttttgttcttttacaaattaaatccgtatttttccttgttccttatttgtcttttatactgaagtaacctgtgacatttgaaagttaaattgtttgatcttacagtttacatctttagatcatttgacaaaatcttgaaaagcttttaatgagccatgccactgtctcaggttatgatcacataatgctctcatcatatatgaaactgacttttcatcaaatggtttgggtattaatgcatccagaattttgaaaaattgaacattccatgatcagggcgttaagacaacttaggacagtgatgcctg

SEQ ID NO: 60836 - DNA, 1653 bp, Homo sapiens
agggaggatttttaaaagtctatatttcagcctgtcccattttttgattcagatcttagatagaaaaaggaagttttattttggtgaccgagatataggtcctggttgggtgagtctttctgaataatgctcagtctgctggtaattttgtcacttactcaagcttcaggccttgagatgggcaaaagagctctgttctcttctgtttttctttcctgttgctcttgccagaactgccgttgccaggaagtttggggcaggtcccaagcaacatgggttcccaaagaggggtgggagtagaaatctctagaaaatatgactgcaagagaaggtgaattccatgactgcctggccttggtggctgtgtcacaattgctgcatatattttaaaatgtatatgtaagtcctggacttgagaattcttaggaaacccttcttcttttctctctttttggtctttcctcctactctctctgtaatctttagttttttgaaagcatagaatgatatgtaattattatttataaatcatgtataaacaattgaaattccctgaccctctccaattctctatccctgtccctccgtagcctctgtatgtatatgtttctagatgttttatgcttacatacacgtgcacatatatatatatatatataaatgtatatgcccacatatatgtgaatgataaatacatttttcaattaatatgtatttctacgtcacagatatgttggtatgtacagatataccacattctttgaaatgaccacatggtattctgttgtgaggaggcatcaaatttatttatccaaaccacagtgaaggatatttaggtgcttttggaaattgtgttacataaatagggctgcacttttgaacacacatcttgactcatttttaatatatctgtaagtaagagatggaattcctggggcttaaagtatattatacattttggtaaataatgtcacattgccctatgactgtcataaaggttatgacagtcttaactaatttttgctcttatttaatctgagcatatgttatttgtacttgtctactatttcatacttttggcatattttattccatatattctgccttagcctgtgctcctttttcccctacactatcaggaatacatagtgctttaatagtagatgttcaatacgatatgggttttaggaagaaaaaacctccctactcatttgagaataatgtagtaaccccaagctcagtgcattgtcctgtcatttttgtggacactgttttgatattccttaaaaatggatagtaaacatcaggtaggtactaagatatcaattaagagaaagtactcctattcactagacactagtagtgattaatcccacttaaaaaatccacttattcattcagcaaatattttttcaaagcctattctgtgctaagtgctatactaatccaccgaaggttttatatcttactatatatatatgagtttggggtacttgaatagaagttacaaattagtgtatgaataatgcctttgagtggttctgaaaacattttaaattttactgctgtagttggctgtgaatgaagaaactttgcctaggacagactttaggactcatttgtctcagtctctgtttatgatctgctgaagaa

SEQ ID NO: 60837 - DNA, 1053 bp, Homo sapiens
ctgtcttctcactgtactctcatgtggcagaagggttgaagaagtcctctagggtctcctttataagggcactgatcccattcatgatggctctgctatcatgatctaattatccccaaaaggtctatattcagtgtatagcaccacattaactgctatgctttatagctacctcgttttaaatattactaaacatagccctagccctgagccaaagcccctttctattacatagtctttattttatactgaaaaaatggcatctttgtgcctattgaagaaaagcaatggatatatcttaataatataggatatatagattatatgtgtgtgtgtaaatagagcaatatttatagagaattaaggcaatttaaaacaacacatgagaaagtatacaaatcaaagttttttgtttaaccaaggaaaatgaaactagtcattattaagtgttgtaattaaaaaaaaatttctacatcctgggtctccagattataaaggtcatgtttatctctttttctgctgcccaccttttccaaactttcctgtacaagcgatgcttatactgtttaattcaaaagataagaaagccatctttttgttttatattattaaaagattgatagtttgaaaagatatgtagattgttttcagactttaaacccaaaagaagaatacacgtttaaaagaaaatcctgcagtatttttaaatactgataaaatataattacaatggaaatctttttaaacttgaagaaacggatctttcggctctattcatctgtaaacaatttaatgataaattctgcataattcttctatgtgatatcattagaaatgtagtacaaagatctaatttaaaatcacttactttctgagcctccatgtcttcatctgtaaaataggtacaatacactaacccaaaatttttgccgagataatttgataatcttataaagtcttttcaattaaaagacttcagtatacgtttcttcctttaaaaaaacttttttacttcttcttaagactctattgtagagtttatgactcctgaag

SEQ ID NO: 60838 - DNA, 1178 bp, Homo sapiens
gtggccccagtaaatgttggtgtatgtgtgagacttggtgggaagagctgcttgctgtaaatagtggctcctctgctcagcagttttgtgaagtcagttgacttattctttaatttcatcccaccacccaacataaattttttggttcattaaaaaaaaaaaactttctggatgctttatgtttgtattattttttaaccaaattgggttcataccagattaaatttcaagttaaagataatttattatggcagtttaaaaaaacacagaatgtaaagtgaatagtagaatgaactccatatccgtatctcccagcattaacaatcaactttctggattcttgttctctctctccctttcccctacttagttctggggaaagaggggcagtattttaagacaaatcccagacatcataccatttcactcccatactttgttgtcatgttcgtttttcaattatttaccttttgtctgttgacttttctttctcttgtttctgaaataacacttggactgtgccctggtgatgttatgaaggtacactttctggtagtgttgtcctttgcatggcgcttgctgggctggtcttcatggatcctgaggaagacagctctgctggtatgcagttcacgtctcagtagaacctagtcaccagtagaacccagaggtatcactgctacctcgcgaccttgtacagttaggtgaaagactgtgcacttgtatactatgtttagaagaaatggactcaaatctaagtcatgatgatgtttattattttttaaacccataaagaaaccatggctttgattaagactctctaaatggatatagctagattctattttgtttttctaattacatagacagaaaacttttgacattacaaattaatcatttataagtttgccatcttttgagtacagtaataatttatttgtgcaacatttcagtttttttttttttaacttttactttaggttcagagtacatgtgcaggtttgttatataggtaaattgcgtgtcatggggatttggcgtacagaccatttcatcaaccaggtaataagtatagtactcgacaggtagtttttcaagcctgaccttcctcccaccctccaccctcaagtaggccctggtgtctgttgttcccttctttctgtccgtgtgtactcagt

SEQ ID NO: 60839 - DNA, 1539 bp, Homo sapiens
tggaaataacagctcactttctttccagactccagtttcattgattactcaatatttatttaaattatgtaataatggaaacaagcaggtttggagacaaatacagtgagtcttggtaagcattgcatattgactaatgggagcagagttgccaagcttaggttggctaatactaatgacagcgggcagttgcttaatcatccacatgcatcagtatgtctgagtgaggggtaactaatccagtgtgagagtcaagtagaattgtttaagagcactttaactgtagtcaaatgctacacctgctccttaatagcttgaaggagctatttattacagggatcccaacaactcgtgtgatttgatttttactatgagttgcacctagaattgtaaacattcaatatactaatcataacagcgaccatgaaggtgttttttttcttggggaggtgtctaatcacacacacacaaaatcagtatgatcagagagggcaggaaattgatttatcaccctcaggggcttgatgttgctcttgttaaagggacaagcttgttagatgtgagctcacgcaaagtattgccagagatctcctgccaagctcttcctgttatgtaaaagcaaaaaggagtgggcagattatgaaattattctgtatatgatgattagttcgtgatggtatagtgatttgttaatctggttcattactttaaaaagcttaatcatagtcatcaacttccatatttttactttttagataggcagaaagaattcagaccagttattagttgctaaacaatttgttgttgaatgaaaagcaaaatcctggaaaaaaacaacttagagtattagggtctaacagcctgaaagtcattgtaaacttgacttgtttttctgcccctgaaattaagttagatgaattaaaacaaaaggcaaaggcagttatttaaaaaacttgtttttgctattgcatatttatttcatataacctcagatttattttgatttccatttcttggtgcctggcaccagaatttgtgcagatctatttcaaaaccacacattgtaaaatcaacactattgacagttatgggtaattgaatggcaaatggggtttccaactgggtgctccaactgggactcttaaacaaggcttgacaaattctgctttgtcaggtgtcataaaatatggttcagaacgcatctgtagtgtcaagggaaaatcacttatgccattccctgtattaccacttctgactcttgtccgtcctgaagtaggaattcacatggcttatgatggagtctttgttttaggaaacacgacacaaacgctaagactcttcagatatcatcactgaatctttaagttcaatccagttgctagatttggcctgtaacatttggctcagggattcctggtggccaaaggaaaacatcacaagagtcacattatctgtaagataggaacagactagttgttttaaagaaaacttctcttaaaactcaaagcagaaagatgtcagaatgggatttaagtaatt

SEQ ID NO: 60840 - DNA, 1097 bp, Homo sapiens
ccatctggctccagaatcttttgacaactgtactaaccttcctctccattagaaagtatagacagttatactgaatatatatgaaaagaacatgaacaaccatgtaaaacccatctaaccagtgaaaaccattcctagcacctcacgcacgtacttccagattccttccttgaactctttttttttttttttgagaaggagtctcactgtgtcgcccaggctggagtgcagtggcgcgatcccggctcactgcaagctctgcctcctaggttcatgccattttcctgcctcagcctcccgagtggctgggactacaggcgcccaccaccatgcctggctaatttttttatatttttagtagagacagggtttcaccgtgttagccagaatggtctcgatctcctgacctcgtgatccgcctgcctcggcctcccaaagtgctgggattacaggtgtgagccgccgtgcctggcctccttccttgaactctgatgggaagttctctccccctgacccttttctacttccaagagctaagcataatgaacaatctggtatatatcttcccaaatatagatgcagttattcacattgtacatatataggtaattcatacacattctcatatatcctcctgtgtgcattgttctgctaagcactttttctcactcagtatgtcctggaaatatttctgtatgtgtcattgtatataatttaacacattcttaaactgactgcttatatggactgcaccacttctgtaggatgggtgtactataatttcagtgcaccactttcattgatggacatttacattgttgtcatattttttctatattattttcaatagttgcatattctatattattttcaatagttgcataccttttattgtatgaaagtactataatctcctgttttgaaattcagattattagaaggtacagggatgaatattctcaaaacttggaatttgagcacatccttccttagttacctcccagtcccaattaaaatgctaagtccaaatgatcaccttgtcatttaaaaaaccaacttactgcggtatattttctatataattcagtgattttcag

SEQ ID NO: 60841 - DNA, 1062 bp, Homo sapiens
aaatcctagaaaaatagttgactagttctttgtttaattaaacatctccagagaaggtttttaaagatttcctcacaattcaaataatctatatacttattcatacatatggaaagtcttttaatgatatcctatgaagggcaatactgtgcagtattttcttggcttggcatgtaatgttataccctgaaaatgtcaataaatcttaatttccagtaggatcgtggcccctttttcttgccatttgacctgagatgtctaatggttttgtttattcttcatagttttatggaggcaattgactccattaatttgaatttactgaaataaaagccaacaataggaagatagattaatttttgaaaaagctaatgctaagctttgacttctgttactgttcagtggcattcaatgcaaaaataattgaacctcagaacattagagaaatagtcattgttgttttgagtgatcatgatgcttattacgcatccatttcaatgcggactgatgcagtaattgatggatgatgccattaattaggcttttgaccagacaaatttattgtagtttggtaattttttaggcagaatattgaaatgaaaggtaaatggagatttttttaacaaaatgaagatgtttaaaatgtcaacagaaagctcacaaataatttcttgggtacaacagttttgtaccactttggtccatcttttgcatctttagcttaatcttaaaaaatcaaggtgactaagtaaggtgacagaaattcatttgtgaatttgtctttgacattttgtgcaggagcataaatgaatacgacaagggaatctactttgaaaaatgagtgtttgaaagtaggtgtttcttggatttttttagcctcagtgaggacagatctgtgggtgagaccttggtgctttgttgaaaaccagttggcattgaagaaggcaaatgaaaaatagaagcctaatgttgattgtgacaaatgtaaaacatgtatcccttaagaaaatttcaggagcttttggtggggggtatttctggttggttggtgtaaagttttgg

SEQ ID NO: 60842 - DNA, 1428 bp, Homo sapiens
aatggggaaatggtaaattcgaaaactttagattcataacttacgttggtgtctagcagaattgtagatcacattttttaaaagattggtcagaatcacttacaaaaataaaagtgatgatcagtatgtagcgtatgtttgctaagaattattcatgtccaattaacctcatttgttttttaataatgttactggacaagtatatcagggcattgccatagatatgcaatgtctgcttcatcagaacatttcgttttgttatgttttgagacggagtctcgctctgtcacccaggctggagtgcagtggcgcgatctcagctcactgcaagctccgcctcccgggttgacgccattctcctgcctcagcctcctgaatagctgggactacaggcgccggcatcagagcatttaataacgtgctacgtgtgttctttactcaagatggaaaaatatggattggatagcggtatagatgaatgagtttaggtcttttacccaaagagggatgatcagtggcgtaatgtcagacttgagcaaggtgtcgatagtgtcgcttgagaaaggcatatggtacagctggtgggaaaaacttcacacagtacaagagatagggtatttggaaccaaggagatgataattgcgtcgttctttgaagcactgtagatagtggttacgaatagagactccaaagccagactctgggcaagttatttgagttctttatgcctctatttcttcattcataaaatacaaataatagtaataatacctaccttagagggctgttgaagatgttgaaggattaaattatataatccatgtaaagtgcttaaagcagaatcggatagtaaattgtatatattagatcctagtcttctgttgttgctgctgttaactactgtcactactactacttcaggcaatattatgcacatttctgggtttgtgtttaaacacatatccagaatgtggtaaataggttagttgttgttttttcaggcagagtcttgctctgttgcccaggctggagtgcagcatcatgatctcgactcactgcaacctcaagcagtcttcccacctcagcctgctgagtagctgagactacaggtgtgccaccatgcctggctaattttttaatattttgcagagacaaggtctcactgtgttgcctaggttggtctcgaactcaaacttgtggactcaagcaatgcttctacctcagcctctcaaagtgctgggatgacaggtgtgaaccactgtgcctggctgtaattaggttttggagagtgtctagtaactgttatttgaacagtggtccaaaaacaataggcgtcttcaccttagtgtaaaagctgagagactttcaatcagatgaggtccacagaaaaaaaattaaaaaattaaaaacttttaagctgagaaatga

SEQ ID NO: 60843 - DNA, 1050 bp, Homo sapiens
gatcaaataggcactagctatttacacctgagaaggttcagtgcagttgctgaagcagtgggtcaggatatgggtaggatcagtcaacaaatgctctttatattgcgtgatgctaactgccgtggcatgagaaccaagggtagggggtggtttctgtttggggttatcaagtcttcctaatggcagtttttgagagaacgggattgtgtctacagattggttattaagttttggggaagtactcactttctcaaactccagtccctgtacgaaacagcccttttggcaactcctttggttggttggaagctggcttgtgaatgagcttggtactaagtgccacaaggatgcacgtgcccctgtgttttggactgagtgtgtttactccataactgtgctttctatttagtgtggccaggtaatcgctcttgtggaatttgtcaataaatacatggagaagaatgcatgacatttattttattttattttattttattttattttatttttgtgtttgttttgtgtagttataccaaaataggaaatctggagacctaaattctgttaccctgaatgctacaaatatttatcataacatttttatccaattgagttaccgcttttaaatttatgtagaaataagtccagtgagccacttaaaaaacccgcttttctacataagaaattagtgcagttgtatgatgccaagtaacttattttcttgcaagagtttggggaagtaggggacagggaaagtggaatcctgtgacgactgaggatatacacaatgcaacagggaagttatcatgatcagaaacactgactgcgtacaggaaagacaggttaaagacgtcccagtaacataaaggatggtgggaagacttgtaaactgaattatgaagttatgaatatgaatgagcaagtcacgaatagcatcattacacatgcatttatgaagatagagactgtgatgaggttaaaagatagactgtcatggagagaggaagaaaattctttgcagctggctttttttagcgagagaaagaaaat

SEQ ID NO: 60844 - DNA, 1674 bp, Homo sapiens
aattggtaggtttaaagcaagcaggtgctagttccaggaggtcctgttgtgactgagaggtggtcagtttaaatttgcaagcaaatgtctgaacggtctgtttaaggaagtggtgggaaagtgaggagcccagcctgctaggcaggacttgggtctcttcagttttatttcctgccaccagtgggagccattcaggtggggaatggaatttgaaactgtcaagggtgactgagccctgattctgagaaagttaaacctatatttaaagtggatgtcaaggcaacataaaatggtaagcactcactatccctaggtatggtggtagtaatgtgccctcagctttaggggaacaaggagtggaccagcgggttatttggcagagggtttttaagatcggggttgcagaggtagaggcaaggctttgagtgcctataaatgtcatggcactggacccgtagtttcaccgtcacttttttttgataactatatgttgagaatccgtgtactttaaattttaattttagacaacaaaggcatcctagaaccagttatcctgttctcttgtgggaatgttctaaccacattggtcattgtgttgttcttatttctgaagcataaggattattggaaacatctttcaagtgctttgagttatgattgcagccaaacatatttatgaagccttccttcttcctggagagaacacctactctgaatgttaagcttggctggatcctaaacaatactaacaaactagatcatctctctttcctgtctgtgctgcctttccctttctccatcatagatctcaaagtatctctctgtgtccacacacacacaaacacaattgtattttttagactgcagtgttaagtttatggagttgttcatatacacttaagctttatgtagtcttctcatgtaaaagagctgctgtccttgatataatagccaacatattatcagttcagccagtatagctcattgtaacaattacataaatataaaatatcagtgctcttaaaaatacacattaatttacatgaatgtttgaggaaagctgcccgtaaagcaaattgtgttccttttgatctctactataaaattatttaattgactgagaggaaaaggtttatgacatgatggcatgctcgactttgacatttgtcatgtgatgatgatgatgatgtgttgagaggcatagagggaggggcccgcctgctggaacagcggctagaagacactcaacctcagtgactcaggcagaggggacgaatgcctgaaccaggaatggaaaaaatggtccagatatgaaagaagccttcatgttacgcctattggtagtgaaccattaagagagaaaagagggagctcagatgattccagaatttaacttgaagtgtctaggagagtaacattacctttatgaggaatatgagagtcaagagagatttgacagcttcatcatctaggagacaggcccaacttaagtacctgttgctaaggataaatgtgaggctataggccgatcttgcttctgctcttttgaccatagtttggtttccaactggaaacactcttagagatcctcagagagagatgaagcagtcagttcaccctgtcacttactggcagagctgagactaggaagggagctcttggctttttgtgcag

SEQ ID NO: 60845 - DNA, 1029 bp, Homo sapiens
ttaacaaccagcttgctaaaaattttgagaatttaacaattggttctagtggcctggtataagttggctctaatacaccactaattgtaggtttcctgttgtgaagacatttctaagccacaattctttaattatctgcctcagccgtggtggtaagagtttcatttgatgaataaaaacaaggtttggttttgagtcagtgcttgctgtaactcaagttgtcatgctcatattgtttctggaattgaaaatagatgccaaaaccaatttagaatttagaacagtttcttgagttgttgactcagcttcataactgacccctggcatcgcttgcctattctggctgttaaactgatctccaagtgctagtattggcgatcagtcattctgctcactgcctattgaacttccttctctcccttccccatattccttcaaatcttaaattccttcaggtagtggtgctacagagacaagtagtcaggattcctcccaactaagcattccatgcagctttgcttttgattcaaaattaagttttaatggaaacccaattgcctctagggagagagtaaaaacaaaacaaaacctgggcagtttaaggttcatcttggcttgattaaaatcttagggagtgaaatggaggaaaaaaacgaaaccagatcagacatctcaatgtttcttctagaagcaacttcttcagttttctaacttgccctttagaaggaagcaatcgaaccctgaaattgctaagtaacagctaagattgtgtttgttgtttttactttaaatctcacccacctagttctcaaaacacattttttattgaaccttacaaaaatgccttggatatttcaaaacatttgcttgtgtcagttctttgaatcagacttacataattgtaaaacattcatttccccgatttcctcttaaaacaaaaggtatttatagttcccgctgagtcagggatggacttggattactgcaaaagtaatctgtgttcatttcaagaggaagctcgtggttaaa

SEQ ID NO: 60846 - DNA, 1022 bp, Homo sapiens
gtccatagttctggtataatgcctttgttggatcaaagcgtgtgtgactggagggaggcctttgttgcctggctcagagcagggccaagaaatcatttggtgtctcgtttagtccttccaggcaaattaatccttcacttttgaggagaggtaagaaggggttagggaggagagatggagagagaaggtgggttactctaatactgttgccgcctgggaaacagactaggtatctcttcctgaaaacataatggagggcaaaattttaagggttcaccaccccaatccttcatagtggaaatactgctcttaaaattttttttctcttaaggtaattttctgtgttgctattttctctttcctttttgtttttggtaaaaaagagaagagatgactggacttttctatgtcttgtgtgtgaagaagagactaactagtggaaatcaagaaatggcctttctgagacatgtaactaattagattctttctgcttatgacaggtgatggaactgtactggaacaatgggagaagctggtagcttataggaagccaagatgaccagaatgtttttaaataatccgtaagttaatgttcttggccttttggaattcttttaactactgggtaaattttctttaaggaaccatggtaaaaggatagcacaatcaactaacttgagtgcaaaagagaaactattttataaagtaaatatccaaacacgtcaaacaattgatgctaactttgataaatcttattttgcgtacttctttcttgatagggtgtgtcattttaagttgagtgtgtcaatttggtggacagagcataagtatttgaagaattaagagaattccctgcacatggtcagcatttaaattaagcttggaataacccttaggatatgcagatatttttggtcctagtggtttccttgggctccatttctcactcacgtatttttttctgtgggcatattttgaagtaaatatgaacaaatttggtgaatatgattaaaattgagttc

SEQ ID NO: 60847 - DNA, 1045 bp, Homo sapiens
tctccaacatgtctcttggaacatgttttattcagtgtttaagtccaatctatcacattttaaatattcctttgtttaaattattgtatgccatatagggtcttaatatagctcatataatggtcacagttctcttactgttctaaacgtgtcatgtttcgcatgttgagtagcttttgcaggccagccagggaacctgatcgccatttatacgattgctatttccttggctaatatgtttcattatatcctccaaatgacaagaataggatggagtgttaagggaggaaactgagtctgagttggagagaactgaattggagggtgtgtgctaatgtagaggcagaattgctcaccctggctcttggggcttcctctttctcccctctcctctctcagaaggacatgtggtgacatcagggacatgaacttcacctcccttttgtagtagttatctatagctacataacaatctagcacaaacttagcagcttaatcaatcacaaaattatctcacagtttctgtgggtcgggagtctgggaatgacttagcaaggtacttagcaaggccacagtcaagcatcagctatggctgctgtcttacctgaggctggatgggaggaggatttgttcccaagcccgtgtgattggcaggattcagtttctcatgggctctctaactagagccttggtttcttgctgtcagctggaggttgtcctcatggggctctctcagtaggcagcccacaaaatggcagcctgcactttcaaaaccaagagagaaacttgtagcagagtagatgttacaatcttatgtaatgtacccacatacatcctgtcatttttgccttattctattggctacaagcaagtcacagaacctgtcctgaaagggcgagggaattaggcaaggcctagataggaagagacagagatcaagggggccactttagagtctgacacatctgagactggccaagaatatggcttctctttatccttactctcctctctgtccattctcctacttaatagcagcgtgttt

SEQ ID NO: 60848 - DNA, 1026 bp, Homo sapiens
gatggggagtgtaagtctaattggggcatgtgtgtacacacacacacacacacacacacgtgcacacactatttgtagagaagccaggaagccctcattgagaaggcaacatctaagtaaggacatgaagaaagtggaggggtgagcctgctgtatcggggcaagaccatcctaggaaagagtagttcagggttaagtacagagcccttgatactttttttattttgcaggaaagtggagctcagccttgtctaagactacatagttcataagcactggacctcttgttcagactcagatctgtcataatcaaagccctgcactccctccaccaccccaggttactctaaaaggaaatcattgttcatcttaggaagctttccaattcctagcagaatgtgttatacattgtgaacactgaggatttaaccatatctgttctcaagcaaaaataatacataggcaggtaggtagatggattagttttctgtgctcaactaacggaacctcaaaattattacctggttttccagagctcttaagtttaagaaataaattttaagagctacactttctgctttttattttctttctctttttaaaacatattgcttgctttaaaaattcctctgttctcattttatatgtgagatttaaagacctaaaaaaatttcaataggtatgtagtggtatgtcatgttgtcttaatttgcgtttccctgatgatatattatgtggagcccttttcatatgcttatttttatccataagtcttctttggtgatttctccattaaggtcttcagcccatttttaaatcaagttaattgttttcttattgttaagttttaagagttctttgaatattttggataacaagtctttatcagtatgtcttttgcaaatattttctcctagtgtgtatatgtcttttcattctttttttttttttttttttggcggagtttcactcttgttgctcaggctggagtacaatggcaccatgttggctcaccacaacctccgc

SEQ ID NO: 60849 - DNA, 1342 bp, Homo sapiens
actttgacctgcttgtctctttgacccctattaaatgtttacctcattttcttgtttttttagcctttaatttttatctcctcaacaatgtatcatcaagatcaggggcacccattatttcatatcctgtgacctttggtggatgtctggctttggatgcactggctctctttgtaaggcacagcctgtgttattgtcatatgtcaccgtgatcctttaggatttttgtagtctttttttttttccatctaccaatgaagaacactacaaatgtaccttgtgctgagtaatttatgtgtctttgtcacaccatcatgaaagcattaagcaagtcccattttgcagatgaggaaataaggttccaagtggttaaacaacttgcctgctattcccagagagtaagtggcaggaatgggattcagcactgagtctgtcttgaattgtgtaccatagaaatagtatgccctgctgtattccctttttgaagcagagttttaaaaatattcttattcagctgggcgtggtggctcacgcctgtaatcccagcactttgggagaccaaggcgggcagatcacctgaggtcaggagtttgagaccagcctggccaacatggtgaaaccccctctctactaaaaatacaaaaattagccgggcatggtggcgggtgcctgtagtcccagctacttgggaggctgaggcaggagaatcacttgaacccgggaggcggaggttgcagtgagctgagatcttgccactgcactccagcctgggcaacaagagtgaaactccgtctaaaaaaaaaattcttattcttgtggaattttagtcttctctacttttttcagcttttgctactttccccccattttgtggcattttatttggtttataattataacacttaatttgaaccattaaaaataagtattttcaacttttattatttttataatatcactgagaatatattattggtatgagacattattaaaatatgccctctttctcacataggctctgatgtcttcactgattctgttttctgagttgattatgagtctagcatgggagacgggagtggacttttatatttctaatatggtcctactagtacagagttattgaagatgacatagaagaatgataagattttgccagaaatattcttccatagttcacaaagttgttttagaacctgaattctttaaaatatagaacatctattcaagtacttagttttggctcagtgaccactttcaatgtgtatagccaggaagttgcactatatagaaggatataggttttaagtttaagtaagtttaagagtatatgttatctgat

SEQ ID NO: 60850 - DNA, 1019 bp, Homo sapiens
atacacttatgtatgtggtctgtggttgttccacttaacttgctattgattgcattttggtaaaaatgaaaatttatcccagggtggtaattattatggtttgaaaaatacgctttcttgcttctttatcttttttatattgtcagttagcagttatttacctaaattgagaggagataatttataaaggtccatggttttaaaactcatgttataccatcagatgcatttggtgtgcagtttttttattggcattggatttgcatgcttgtttctgcttggcgttgtctaatagaagtgtactctgaataccatgacagccagaaattagttgggaattggtgaaataatgctttttttttcctatgtatacgtaacaagaagtgaataatagttaacttggattttagttttttttcttataagcagctcattgcacaaagaatgcactttaatttacttattacttcttctagattggaaagaagactgatgaagaaaaataacagcatgattcaggtaaactgatttttaaattatttaccttttatgcttaatttgtattttctgtgttctcccaatgagaggatctaaacaaacaatttttgtgggcaattggaatatataaggaatatcttggggatatagatgaaatagtcaaatacatattaccatttaattaatttagttatgtacatattttgaacaagtatgtatttatacaaaatgggatattataactaatgcttttttcctaccccagaataattttcttccaactctttacatacatatctgacatcagtgtcttcattatttgagtcacattttttaagcattcaatattattttccacagcctgttatcattttaggtgtttgcagtacagcacttttggagtctatgtatggcactctatttggaaattttatcccaagccacaagtaatcatttgcataatgttaggacagttgctgttttcattctttctgtgtagatgaacattgaagatctctact

SEQ ID NO: 60851 - DNA, 1029 bp, Homo sapiens
tgccataaaaccagttaacgtgtcagaaaattatcccttatgaaatttagtttcttttgaaacttctttgatgtacaaaaagataacgtgggcttactttacaagtgacaaaactatttcactttctggtaattcagaagacttctcaggtcctgaataacttgattcttttcctttaaatgatttatgggcagggacaaaacagcatattctgtatctaattataaggcttcattttcatgaatctctctctttttgttgatggcaaatctagccctgcattcaagctgtaaagaggaatagctttatttcacccactaactgtttacatcagacaccatattggtgatttgagactcagtattggtatctgtcaactggggatagcaaaacaggcttcataggaattggaagattaagcgagatcatgcattagtaatttcatctagcttctagcacagactagcttgtttactatctttataggtatttctgtacctatagaaagaaggccaccgtccctccccactcccttctctcccctctgctcctgccttctcccatcttattcccagaagtccattcctcctggacaacaggaaggcccttccccttctgtttctatcataaactgcttctctgtcctttggtctctggagaactggcagattgacctcatacaatcaactaatcagccaaaactttttcctcagacatgttaacatctttctgaaataataccactttgcagtcagccactacttgctcccctttccttaaagcattttatttttgtccagatacagggattcttagactcccagacagatccctaaataattatacctagcccaacaggcaaaactaatgtgtgctatttgaaggcagggcagtgttgactttttgggagagtggtgttcactttaagaaaatttattaagccacccaagatttctgggcttactaattttttaaaaaataggctttttcccctttctgcatgtaccctaattcatgtgtatattttac

SEQ ID NO: 60852 - DNA, 1044 bp, Homo sapiens
aggcaaatttgagaaactgaaaccacccccaggaatgctgaaataaatgtatcaatatgtaacaaaattggttaatatccatagagcaataaaatgtaatgtttggggttatcttttcttccaggtagatatcaatcatatctctaccggacaacatttatttacattgctatggacaagaattatttgtaattactgacagtgaaatggaaagttagtcaaaagtgcatagccttattgacttggatattctggaaacatacccaggaatctctttttcccatttctcagtcttggacagtttttctgatatttaaaaaaatgcttttggagcagttttattcattgaatactcacagtttcagactctgagataaatgctcttttaatttatgttaaagcctgaataataagaatatttatatatccaatatcttattttgttatcatgccccctgctccccaaagtgcagtattgaaaatgtatggttaaggttgtagcatcatttctgatctaagtatttcctctaatgactaaatggatagcactctctctgcttcttagtttttgttttgttttgttttgttttgttctgttttgtttttaagggagaggcagggcattgagtataagtaaatattttaaatgaaaaatagaacaatcaacagtatgaaaaattctaatattctgtgtacctatgcctaaaatgagatagcctatgaactgactcatcttaagaatttttatagaaaaatttgttagttctaattatgaatttaatagaatgagaattcatcatgtgacagccaaggtaatgaagaatgttttccaccactgtccaaacactgcccacagagaggcttcctttgtctcagggtgcctgtactgagattataaaccatgcaagagaacttagagagagggtctaataaacagacctcaccttataggtgaagaaccagaattccagaggagacaagttgaaaataataaaactcctttaaaaacaaaacaaacaaaaaacctgacttcagatttcttac

SEQ ID NO: 60853 - DNA, 1049 bp, Homo sapiens
tatatataaaaaatatatatacatcagtgaatcaaagattttcccttggtggtgtgctaaaagagaccagtaagaaatgtttcaaaatgtaagtgcttttgaccaagggcaaattacaaattatttgtaatttttgttgcctgtgtgtgtctttattttctaaatatttgtcaatgaaatctattacttttgcaaacatgggaaaagtaagaaaaaaatataatgcggttcagaaagattttcacttactaaaggagaatataaaaaatttagctcagaaagtcacttttctgttaactcgacagttaatctccaatatattgttcaatatccaagagttttgctagatttctgttttgccttgggactcctaagggacacaatgcttggtagcccatagttgttactactttaatcatgcaaatctaggacattagggcagtgagttagtgcatgaatgattcttgggcaccttagatcatacttgctagtaaggtcctctttgtctctgcatattgctggcctggatggacacttatcttttggctgaagaatacatccaatggagagaacccaagagccaagctaagtgaatcagtttcactaggacattaatttctaagatgtagtccttggagttctggagagcaaaagatggtgcattactggaaattcactatactcattaacatatttaaggctggagaaattctggagcaaagaaccaaaggtaactgcagacaaagaagggtttttaatggaatgtgactggcatctaggaactggttggggggtggatggcccctgaaaagaaaggttggaaactgaatgggagaaagaggggactgatcttactgatcaaggtggttcctgtaccttgtatgggagtaacatgaaatctttaattccccaaatctaagtacactatgtggttacaacaggggcaattttacatttgtgtgaagcttgaaatggtttcctaattgaatcgattgttgtagctttgaaaaattgtgtttaaatgacatttttgtaaaatacaaaaataa

SEQ ID NO: 60854 - DNA, 1062 bp, Homo sapiens
aaggatatgtatatttcaatgctaaagagacctttttgtgacttaacttttagtggtataccagcaataatgagactttcctcctccttatcatcatctgtctttctttaagtgcttcttaggagccagagagcatgctaagtgctttgtacaatttcgtaagtgaattctcccaagaactttaagaaatggatattcatagctccatttcaccaatgagaaaaccaaggcttagggaaggtactttgcttcagaagtagctgtttcatatttgaatacaggatggttttgtgtccaaagctttatttttaaaatttaatctcagctgctattattaaaattacctctcagaaagtgaatagtagcatactcatgaaaatcaggttttctaatattcttagccaattgcatagatgggacaaaagtttaattctattagccagtttaaaaataaaaatacttaaagaattaccagtaggatggctactattaaaaaacccagaaaataacaaatgttggccaggatatgaagaaattggaacactcgtgcactattggtgggaatgtaaaatggtacagatgctatggaaaacaatatgacagttcctgaaaaaaattaaaaatagaactaccatataatccagcaattccacttctgggtttagacctgaaagtgttgaaagcaggttcttgaagatatgtttgtacaccccggtttatagcagcattattcataataaccaaggagaggaaacaacctaaatacccattgatggatgaatgggtaaacaaaataggatgtttgcatacaatggaatattattcagccctaaaaaggaaggaaattctgacacttgctacaacatggatgaaccttgaggacattatagtaagtgaaatcagctagtcacaaaaggaaaaatactatatgcttctacatatatgaggtacctagtgtattcataaagacagaaagtagaatggtggtttccaggggctgagaggggagttactgtttaataggtacagaatttctctttgggatgttgaaaacactctgga

SEQ ID NO: 60855 - DNA, 1011 bp, Homo sapiens
gctgacttccatagcagctgttgcaaatacttgcttctttttgagctcctggtctcccatagccctgctcttggcaaatgtccatataaacaaagtcatgaagacagagagagagccctttctctctctcctttctgcttcagggtatgtctggttttttttctctgacaggtgctagcttggttctgagtgctatcatgtatggagaagtcttgtttcctactccctcacaccatctccttctgtcctgcgtctgccctctctcaggtgcccaagtaccctgttgccatattcagctactctgtggtatgcttcttgaaccggatagccttccccatgcctttgattggtatctttcctattatgacccatctgtttcacaatccactccctcaaagccctactatggacattgtaatctgaaatcataccttgtatgtgaacattcactgaatgtttattgacatctactgtgtgcgtgggagctgagggtacagatgccaggagatacggagatgagtcagacttctgagattattagtatagaatggagagagagacatgggacaaatagcattagagattaatgacaaaattatgtacaggttagaagggaagaggggcagtttaccttgaagaattttataagtgtggatccctcagacaagaggagagggtcatgccagagccaaaagccagtgatggattactgtgtccccactttctgataagatttcattgtgactcatctagagcagagggagacctctgtaactacaagatctctagtagtagcgtttggctcactgtggcaggtggttgcaaagaaccttttaaggcagaaataggcctatgggtgtcctaaggtaacatcacatggataattgccaactctgtatatcttttgggctggactctgacttaaggagaagttaagaagtcttcagtgaatttcttaagccctgagcatctttgtattctgctttaagaacttgttggtttctgtgtttc

SEQ ID NO: 60856 - DNA, 1042 bp, Homo sapiens
gcacatgaaaaaagtatttcaaagtggatgtcaagtgaggttgctgatttaacagtttttttttaattattattccttctgcagcagaataattaccaatagacaaccatatgtttttagaggctacacagatctgacaagtgtgtgtgtggattttgtgatgaaagtaatacattaggcatgtctctaatttgcagtctctttgctttgtagattacaggtaggatatttgtaatactagtctaattataggaaagacaggcactgaaaacatttctaggaaatgccgagctctgcgatgagagattctttgaggaattgcctggtattggctctatactttcatttgaaaaataaaaatatcagaaaattgtgtagcttttccttgctttgatagcaaattctaatgggtagtaacttccaactgtgtccttgtattcttgggtttttcttggcggtcagttcagtcactgctgctagtttttgctttccaaatggttggaaagctgagcactccagaagcttcacctggggagctggggaggtgatggagtagtactggagatgcttgtcagggatggccagtgcttcctgagtgagctttgcctagccttctgtgccagtggagccatcaggctctatggcacactgctcaggcaaagggaaagacatctcattgccactgctccagttctgttgtcctgggccggggacttgatttggcaaagcagtaactggccctttgaacttgtcagttctctgtaaatgggtccctttgaaggttatgagttgcatgattagcatgatttttaacagaattcacctgagtgctgtttcttttccacagtgaagttggattctggtcgtatcaaaacaatgcagagacacagcccaagagtgctgtctttcataggtttatgtcagttagggtgctaaaaggtgaggcttgacagtcattgtcaagacaagtgaccaggctctgatgtatgacccagagcagtgttcctgtgtctccagtactttagtcacaatcgtgttcctc

SEQ ID NO: 60857 - DNA, 1105 bp, Homo sapiens
gagggggactcacatttgccctggtttcctgcttgaacactttccccgctgtgatatagggaggtgaaccctagcagagcatggtggtctcatagcattgagaaagcagagactggagtttaaggctgctgaagtggctgagatttgtatggcagggtactggagaggagggagctacttgaggggtgaggccctgcagagagcagctgctactaggctaagaacagaatggcggtaccagaggtcatgtattactgagaaagattgggtttctggcctagccaaggtgaagagaccttgctgaataccttagccattctaccgagacatcacatagccattctgttgagacatcacatcctaggaataaagaccatccataccttacagtaagggccataagcttggactaaggacataagtgaaatagactcatcttaaccaagtgtaaaatgaagcttggcaggatcaagaggacccaccagtaatttagctgccaccagagccaaactgaacaccctccaattgtttaccttataatggaaagaagcatgcaaagtaacaggggattgtgactcatattcaaaataataatcaataggtatgaacaatgactataaaagtgggtaataccagattttggtctctaacagcattctccttggaaaggaaccagtgctttttggagaattgacaggatccaggttagagacagggtagatacaagatgagcccataacattttttttttaatatcagaaagtaagggaataaaagtaagaaaatatttttaaaagatggagtatgtcacagggataaaggagccagcttgaagggcttcccactggctaagtctgagacagctggagcaccaaaatacttaagtacaaggataaattataagtcactgaaaaaataggacttcatgtatctcaggtgatcataaatagatatattggtaaacaatgtataatgctgagtaatgaatggtaatatggagggattgctggagttggaaaagtcagcatgttgcagccatcacagtataaagtttttatcaggcagacatcactaatggatactaaatctagggggaaattttgat

SEQ ID NO: 60858 - DNA, 1039 bp, Homo sapiens
gggaatagctacaagtttttcactagtgatggagcataaagtgttaggagacgaaatggtaagggggactgggagcagttcatggaggtcttgttttatcaagcccagaggctcagactgcatttctgggaaatgggttgcacagaagaatttgtacctcattagggtgctggacacatgcagacttgaggaaacagaattcaacaagatctacaggagacattgtgatctgtgaaaagactgttctaagagccccaagaatattaggaatgcctggacagtgaggggtacaaaaggacaataaagcattttgtttacatcagatgctcacttttaagatctaggggacctgaagtagaaccaaagaaaggtataacttgtcatgcattgattccttttgagaaaatgaattagatgagctgaaatgtggatttctaatatgaagaaattctgcccaagaagtagcaagagggtgtcccacatttcagtctgcaaactgtgtttggaatgctgcgtgtgtgtgtgcgcatgtgcacacgtgtgccttgagcacaaatctactggcttgtgcagggaaagacttgttctccattttcctgtgattacaaaatcatcttttctcacagtatttgataaaatattattcttctttgctaatattgattagctttgtatctggggttgcaagttttatttttgactgtttattttctaattattttctcaacagtggttataagtagacatggaaatacaccagaaaatgatttatatgaaaaggattcttttctccatccctaagaatatgcacataaacaagagaaattaagaagagcaactaactttcattacttagggtaggctctactgttttgttatgccagtaggaggaagagttatggaaataaatgtaaatgcatgttagggtgatagccagctggctatctgaagtgagctttttggaagaaacagggacatttccttgtcatttgtttgcaattgccccactaatagagaacatttttcttgctacagtgtt

SEQ ID NO: 60859 - DNA, 1084 bp, Homo sapiens
acaaatgtggtgacttaatcaaggcattggcagggctgtgctccctctgcaggttctaggagagaatctgatctttgcctctaccagtttatggtgcctgtcagcctcccttgatttgtggctgccctactcccatctttgctctggtgttcacactgccttcttctcttctctttggtgtcaggtcactgtctacctccctcttacaaggaaggatacctttgattgcatttagagcccaccaggataatccccccatctcaaggtcattaacctaatcacacctgtaaagtcctttttgccatgtaagataacattcacagattccagggattaggacatggatatcttttggcgggggacggggcactatttagcctactacagtggcaaatattaatagaactttcagtccgccttgtaggagtatgcttaacgtcaacaatttcctaactgttttgcaggacacagatgttaaaaatgtgaaagaattctgttgtcaaacagacttgagagtcattgtgtaatatatccctctttaaggagattcccaatgcacaatgaaggctttgagaattcctgtggcaatgaaagctgcttaaccttgtcaaacccaggattcctcagacttagttgattacaaaacacttctttttaaagggtatgtctacttacatatcaaaaaatacttgaagatgccttaggaagcatgagttgagttacttgttgcctgttagtcttttgaaggcatagagtgtgttttaactgactttttgttacttaatatcttaaacatgcttggaattgattggacagaataaaaccaagataaatatacaaaattaaatgattcagggataatgtgggttatgccttgcgtgcctgtctgaggagtttggacttgattctctagaccaaggattggcacactgtaacttgtgggccaaatccagccttctgcctgtttttataaataaagttttattggaacacagccacatcaatttgtttgcatattgcgtgtgactgttttggtgctataatagcagagtaggggataggcttgcagggcttaaaaaatctg

SEQ ID NO: 60860 - DNA, 1034 bp, Homo sapiens
ctgatttttctagggattctgcaaaacctataaatttccaactaaattctggaaaggagttactacacagaaacactgttctcatttcactccagacaaacttctcagttgttgctgcgtctgtgcgggcctacggggtctctctgatcttacctctgatgattgttcccttggctcattgtgctccattcactctggcctccttgctctcctgagatacacctggcacatgttcctgtggtacacctgtttccgctttccctggaatgtgcttcccctgacatgtttgctcactccccttcctctaggacatgctcacatgtcccctttggaatgaggcctttggtgaccactctagacaaaataacccagcccccaagcactctctggccctctgcctgctttctgtttcctccatggcacttagcacttgtctgacactactgtggggtggtcctgagggcagtggttgtgtatactgctttatcttcagtgctgcaacactgcctgttgcatagtagaggctctgtagttatttgttaaatgaatgaatgaggttactcttacagttttgtatggaacagctaggagacaggtaagattggtgaccgagagttgtattaggaggctgttgtcatggaccccctgggatttggtaagaatccaaaccaaagggttggagaagtgaaacagtcaagagacagggtgggtaggtgtggtggtgatgcatctcctttgggaatggaggagaggggaaaatgagagcattctggaatattccctgtttttagcctggcaattagatggtctttccgttgagctaagataaagaatactggaaaaagactaagcatttcttttacaaagcaaattgtgtgtattagtagagaacaacatatttctgaaattggtgtttttatgaaatatagtttctcaaaggctctaagtaacccttgctgaaatgctgattttagtttgaggtcaagtttcctaaaatgttttaaaagctagccatgcaggaaggctttggcctc

SEQ ID NO: 60861 - DNA, 1032 bp, Homo sapiens
gaagtgtcctagaaaatttcatatgggaggtaagacttttgtgttgttatatatctgagactgtcacattcacgtttaatttacagtgtggctggggatagaattctagattagaaatcactgagcttcagaatggtgaaggcattgctcattatcttttagtatctagtgttgattgtgagaaggctaagactgtctcccagtcctttgtaggtgacttcatttttcttacttttttctctcgggtttttcattcttttctttattttcagtgttctgaaatttcataatattccttggtggggtctattttcatttcttggaaacttgcatccttcatttttagaaattttcttgaagtgtatcattgttgaattcccccctctgttttctctgttctctctgttctttctggaattctgttagatattgacttactgtcttatgacagccttaccttttcttctgctttccgcatctgctttttagctgtattcttaggatatttcctacgtttaccttctaacccttctattcaatttttcatgtttgttataatgtttttttaaaattttttgacagtttttttattctctgattgcttttattgtatagaatcctactatttcatgacagcattttcctttagttctctgaggaggttaatgataactttttaagctttttttgcatagtttttatttccttcaagttgcttttttcctctgtttctgtctttcatgttagatattttctttatgatctttgaatgtccattcatgattaagaatggggctttacaaactggaagatttggcttattgggcctaagttagttgctgtcatctatcagatttccagctttaaaaagcttaacattttaatctttgtcctattatctttgtccttgtagatttatgcatttaaaaagaaataattttgtggtgttggggttttaggagggagagaagctgaatatgtgtgttcatccactgtctttaactggaaatcaatatagaagtcttaaaaaaa

SEQ ID NO: 60862 - DNA, 1020 bp, Homo sapiens
tggatcatggctttgtctttttctcaatttcttttgacaagaaattgtttaccatgtagatgtcttcaagaacttcacctgtgagtcctgcattacttctgtctggacacatcacattgtttttgttgtttctttagatggaggatgtggtgtctgagtattgatccccacacctggctttacaatggtgtttttattccaaagaacaacacctattcagagagtaaagggattagctacttattctagaaaaatgaccctaagtttgccaaatatttgtgggaattataataggttcttagatgtaatcccatttattttgttcttagctccttaggagtcttttgccttgctgcatagtcagggattgaatattaatagttccttcgttgcctttaacctgaccccattttacatctgagaaaacaaggtcaaccttatttcctgtaatgtcagcaacaaaagcaacaacattattattcattatgtgataggcaccactctgagttattttgttggttatcctatttcatattctccacaactctgtgatcattattctctagatgaggaaattgaggcataacctgcagcctcaggatatggctgagtggcacaagtctgctcttagcatcacagacgctgtactgccgactggtgtggccagtgtccagtccagggtctctaccactggctgcacattagaatcaccctgagggattttaaaagcactgaatgtgcagttccataactccccgctccttacatacttatttacttggtctggggtctcattggaggttgctgtgcattcaaaactgagaatatttttgaactagagcaatagttcttaaaatttggtccctgggatggcagtatcaggtaacttgttagaagaggaaattctcaggcctcacccagacctactgaattgaaactctgggggtggggtgtggtgatcagtgttttaacaagtcttccaggtgattcttttttataaaacatattgtagtaaaaaca

SEQ ID NO: 60863 - DNA, 1043 bp, Homo sapiens
aactcatttcaaactgtctcaagtgaaaaagtctatggccttaagtaattgcaaatctaaggactggatctgccttcaggaggggctagactaaggatcaaaatgatgtcatgaggattcatcttggctacatgtttttgggctctgaatggagacttctagcagcttcaggtttgcttagttacaaacaaacttcctggtcatgatgagtcatgtgcctcatgctggaccagtggctgtggccaggtatattggcctattcctattggatagccagatcatgtgcttcactccagggcctgaggtcagcacatcttctgcagaaggtgaagcatgaactgatgatagctgggaatggttccctccaagggtgaatcagggcagttaccaagaggattgggggtgctgggaggtacactaattattataatgattattattaatgtatcttttaatggtttgaaaagcattttcagatgtattcttgtttgacctttaggagatattggggaggcaggataaagaagtgattaaaaacatggattctggggctagactaggttcagttattagcttgcatgagcttttgaccaattacttaacctctttgtatctcagttttctcaaatgtgcaatggggataaaggtatttacctaaaagagttctgagaaggatcgaattaatggacatttgcagggcacttagaatagtgcctcatgcacgctagcctctctatccctggttattactgtcaacctttaaagctgtcctgctggcaggggagcaagtgtcctcttcatttgacagataaggaagttcagactcacatgacctgtaagggtcaacactggtttggacctgacttcttccctgtccccacacttgcctctgtgttatgattgtggggcatttgggttagtaataaatcaaggaagcagagagggaaaaagcactagaaagtaggcctggattaaagtacctgtgtggtacaagaaaggcagtgtttctgtatattccacttgaacgttggtctttagcttcc

SEQ ID NO: 60864 - DNA, 1059 bp, Homo sapiens
ataaaagtttgtttcttcttaatagaaaatatagaagtatttttttacattaaggaatttgaaacttgtttttaacatcttttacacctgtgtagcattttcatatgtgcttgtatatatattatgggtggacactggggctgtgagtgactgcccattcaccacccctacactgtcctcagaccaatgtaaaggaagcaagtcaaaccatatcagtgaaccatcttcagccatgatgtctgcatcattgccttctttcagcctgagaggtctttcaggaagtgggaatttgtttggatgttatagttgcagttatttagctatgtgcagtaattcaaagatgtgaaaatgcaggaagccctggtcatacttacacatggatttgggagccatcagacatcaaatgggatgctatttgtcaccttttgaggcagtgatctgggtgacccatagtgctttcctctgaaatcttaggcttctgaagaaaccacagggaaggaatgtgaactggtacaataaatagcttaatgaatgtgatgaaaactccaaactggtttgttttgttgccaaaattaataaagttaaggtgtagttgatcttttttttttttttttttttttgagatggagtctcgcactgtcacccaggctggagtgcagtggcacgatctccgcttactacaacctctgcctcccgggttcaagtgattctcctgcttcagcctcccaagtagctggaattacaggcacccgccaccatgcctggctaattttttgtatttttagtagagacagcgtttcactatgttggccaggctggtcttgaactcctgacctcgtgatcctcccccattggcctcccaaagtgctgggattacaggtgtgagccactgcgcccagccaatcttctttaggaggaagaaatgatctatagccattcatgtcttctactttttgtgtttaaaatgttttaaagaattcagtcatattctttttagtgattctatatggatagttgtttagaggaaaaacaagaattgagaaggctgagaaaataaat

SEQ ID NO: 60865 - DNA, 1012 bp, Homo sapiens
ttctaggagcataaattagttctgcatttgtcttttctttgtgtgtgtgtgtaatatataatgcagattgtactcttttgtgtctggcttctctcattcaacaacatattagattcctgcatattattgcatatagtttagttattgattgctcattttcatttctttagagcattccattgtgggagaatataacaatttatttattttactagatgtgggtaattgtttgggtttacccatctggggcaccctccagaggaaatgagaattaaacaaggttttctcctcatcatggttatagtggaaatagtaccaggttgtgctcagcttctgctgtgatatgagggaggaatctagacagcagcgagaagattgagacacacttgggagaattgggtgtggtttcatcagtcctgtgctgattcctgctgctcttcctgtgactcaccatgtcccttctcacgtcgttccctactggcacatgttttctacgtcctcttctctgccattattactttctctacagcccctccaaggagactgtgcagaacatgtcaaacaacaggcaattgatgaatatttaaagttcattaggtgttgatattaagtgttaggtgaggggcaaagagttgaacgtttgggcttgcccttgaggagcctgtagtatagttatcaattcacaggtatggcagtgggccacatccccggaagccagttgttctgtagagttcagggatgtaaattcagaggcttacatgggccaggctggtaacgtgactgaaatgaatggggttgctcataaggattgatgggcatggtggagagtgagtgtatatcctctgcccaaatatcaacccaacaaactctgtccagctcaatttagcaagtccaccattttccaaactttagagagtagagtcatcattatataataagaaagtgttcctcagaggatttgggtgtttttatggaaaaattctgtttttatacataaagttttattcaaaaa

SEQ ID NO: 60866 - DNA, 1049 bp, Homo sapiens
gaataaacaatggcatgtatttcaagtttaatgttattctacatttttgaaaatttagtaaataataaaatcttaacctgtttatgtatgctctagcttgtcctgcccctctgtctacatgtggaagataaattttgtacactcttcacagtcacaagtgtttaaagatacataacattagaaagtgattttaccaattctttttcttttcacaggtttgttgctgactacaacattaaggtcccttcagaggttaaggctgttcaatttaaaacaatcatgcagtgtttctttgatgactgcagtgtgttgtgcaatttagttttttacccctcaatttttttgttgccttgagttaccatttggaggtacggtttttgatactgtatctcaagactgtgatttcttggattttgtgtgtgtgtgttttttaaatttactgaatttactactagagactgctttctctgtgtaagatccactcctttgtgggagcccagaagtttacgataagtaagagaaggagtatcagatagtgagaggtgtgcatcatggttaaatgaaaacaaaaccaaggtgtttgactctcggcagagagagatttggaagctagctctgttacccacggttcagccctggtggtgcgcagcctgggctccggcctctcaccagcaatggaaccaatggatgttgaggaaattacttaagttgtttgaatcttaacttcctcatctgtaaaaagctcatcctacaggtttattaggggatcatgtttgtaagaccccagcacactgtagatgtagaataaaatggtagtggttattattagggcttcctcttcagaggcaaaaggttttagaatgtggttatgtttttctggtattttattttatcatttaacattgcagaggataaggagttggaaatgaagacagcctagactggctgagaacctcattgtgttgctgaattgaattccattgtctaaactcgttcattttcaccttttctcctgattgttttgtctgctgtggagcatgatgttaaaa

SEQ ID NO: 60867 - DNA, 1050 bp, Homo sapiens
ggtttcacaatacttcagagcagtctcaccagcaaacttggcagcaaccttgagcaagtcctgtcagggttgttggaaaacagccggtgttttcatatcttttgctctgatagctcttacttgtcagtaccttaggagggaaaatctggcagtagtgtttggttccttagttcactctgagctggttaaatgctcactggatatgcagatatgatttatttcagtggtatgcttctctgtgagcctgtctcactgtggcagctctggaatttctgtttatggatgacattctgtttggaagtggggctgaggttctgagctacaggctgtgtttgcacagcaagctcccttgattttaatttgtattttttcccaaatctgggtggtaggggaggcccaatggagaatatagagcagtatgctccccactgactccatgcagtggtccggggttttgtggtgcctgggcatcttgcagtgacatgtctgtaggtgcttttttgtggagatgtaggaaattgaaattagcttccagctttgtagtaacagaagtgaaatgttttgtaccgttataggcctgataaaaatcaaatgtgactaactggtggttttaaacaatgccagtcaaatctgtttgtttacattgctcacattttctaaaggcacatgatctatctgaagatggaggcttatcggtgagtttactgacagcattgtgtattgtgttatatttatatttcttgtatgatctttttagtcatttttttggagtctgtcttggtctttttactgatgggtgtatgtgtagatttatagggataaataatctttcttcttttttgtggagttgatcaatcgaggactttttaagtccttgatttaaataggtgacctctggaacaaagtaaacacacatgtttaatacttagtcatataatttatacatttggcaatcagtcaaatactccattccaaagaataaccttgaaactgtttgaataaattttttatttcagcatgcaagatgtaatcaaagaaatgtgtctctgg

SEQ ID NO: 60868 - DNA, 1079 bp, Homo sapiens
gcatatgataatacagttatgaaggatgtgaaaatgaccttggttgcctcctttgaataccctttgctatttgtcacttgtgtcattcatgctaatcccttcatccctacctttcccaccatcaacatggattgattactggctgataatatgccaagatattaacctgttacctctttctgatgaacgtggtgatgtgctaacaggagcttttgggagaggatatttatttaatttactcagctgagtaatatttctgacaagattttaaggggaggaaggctgaggaagggaaaggaaaatttttaggcagcacggcttgtaaacatccttgtatcttgccagatgtgatttgaagaggacagggcttgagcataagcacttcatacatgctttcagtcaaggctgtacaggaggtggtagtgtcttgattttagtgatgagaaaactgagcaaatcctcgtggaagtgtcctttaaaggatctcggaaataagacctgaaagaaaatttgggttgtttgtttttttattttgcatcggtaccagagttggtgaattgaggtcttcaacttatctgtttaacttgttatttaagacacattgattttgctttggggttagttcaagttccagagtcttgtgcattttccaaatgtatttctaatacaccaggagttcttgttccatttgaattaccaatatatgcacaggttgaaagtttacatttaatcatgtattcactggaaatttgaccctcatgaaactatttctaacagacctgaaaaaacaaaagatgtcgtatctttttcctctttcctgactacggtcctgtttcctagtgccctctcaccataacatgtaagagatgctgagagtgcgttaaaaccttttcttttgataagattttcaggtgatttcatagttgctcagggtatgaataattattttcatttgccattgagaatctgcttatcagagttcaggacccttgttatctaggtttcttgtagctcttggaagttactgtgagctctgagataaaccagggatagcatatcctgtttcacaaaaatgaaag

SEQ ID NO: 60869 - DNA, 1023 bp, Homo sapiens
tataaggatttatagggaaacaaaattgggcttaaaatgtgagacaacttctgtagactgtagttttcttacctgtaattttagaaggaaaaaaaacccttctatgctataatttcaatgccttaattccctataattttggtaacttgtttctttagggttacaaagaacaaatggaataaaccacaaatagatatattaggataaagatagattttctttggtgtatttatctaactaatttagaaaagctttaaatgccaattaaattatacattttgaaacacagttatatttagggataaactatttttaagttaacattattctctgcatttaaaagtagaatttaaatagttctcccacctccacctcaatctaaggtgcacacacatacttttagctttactagagggtttttgttaatgtagtctataacagaaattgaggatttctgttatggtatttctattttactatcataccactgaaaagttaagctttctcttaagaatataagaaaaatttaagagacagcatgagctagttgaatagtcttattagtgaattagttttatataaaataaattatacaatggacattccagttatcatctgaaaatataatttagaaatttatgataatatatttctttctgggtctatttaattcagaaacattctcatacaaggtggttcaaagaatccagatttctgggaatggttttggacttcttgaagatataaaatatttgacaatgcattgttcaatatggaatcgtacttttggaaagaaaatctgccagaacattcatgctacccagagagaagtatcattctccattctcctcaaaattgtatcttctttgctttgattctcatacgcctgctatcagagattttggaaagtttctcttctctttattgtaaaagatctcaggtataattcaaatggttatttcattttatagaaactttactggaaatgtccaagtgccttcagcagtggaaggaggggtcagg

SEQ ID NO: 60870 - DNA, 1030 bp, Homo sapiens
ttcctctctccccctttctccctccctccctttcttccttgtgcttgtatagtattttaacaccattgttcaattactcttccatttaaatttgtatctattctacaaagagtataacaataataaagtaacccaaatcccactagcactgttttccatgttgtgggctagtttctctgattaattctttatcagtgtctcaagagtctgcaaaaaatcttcgtttatatgatttgagcttcaaatcaatggtgcaactacacccacttcccaaatggtattaagcttcatgtggatctttctgtgggaaaagttgctttccttacattagctgggaactactagtctttggttcaagagactaaaagcattagtattcaattagacataagtcaacgcttgcaaatcactactttccaaaagagagtaataatttccactagacaagtggccaacagtgatggttaatttacttcagtagtatgtgtacaccttccagggaatgactgaactgagaaaataagtccaaactaagaagagggagtatagtgacttttttttttttctaaacaagtctgtaatgctgttaccatgcaccgcatgtcagtcaataacgctaagcttgggtgtggtaacagacagtcctaaattctcagtggcctagaactgagtaaagatttatttcttcctcacctgcccattgtgggtttgctggggcgttgctcatgaaccaagctgacagaggctctgtgtagatgcatgctgccatgactgacagggccgggaaaggaagagctcccgcgtcccacaccggcaattaactgcctctgcccagaaacatcacaagtcatggctgctcatttttaacagccaaatagaatcctgtggctgtgctgagtttgagcaggtagggaaatgctattttaccatgtgcctaggaagagagagacttgatatatttgtgaatatctttaataactatctaatacctaaaccacacttaggaatgtgcacaaattaatactctcat

SEQ ID NO: 60871 - DNA, 1832 bp, Homo sapiens
attgaacaactatttaacatagcattgtgactttataattattgctaattcccaaaggttagcactttcatattcaattgattgtgatgttaagcttatgattttatatctagggcctactctgacattctatggagaaagcaaagcaagaacaagggaggggagatgggaaataatatatgtatgttaagaattaagttagtgaaggaattttgcagatggaggtaaatttgcttcttgaactttgtttaaatcttaactttcaaattataaatgatcaggtaggacacaagcattggttaataatcacagaagttattaagtatattaattgaaagcatctgctttcgaaataatgtcaaatggtatgaatagttttctacaagatgtatgtattaagaagcactagtaaagaaggccaactccaaataaagcagtcagcttttggaagagtagctggaactgtggaagaaacaaaaaagaaattgcaaaactgttgatcctgtagacattgccagtgttacataaaagagcactgtaccttgaagacaacatattataagcctaagagtaagaaagaaggtgagattatggtgatttaaaagtgcattgagagagttgaaaaaagtagttggatatcaagacacattatttcctagaaaaaaaaatcagagtgacaggaagaaaacatagttaccatgggccttaaacaggcaaatatgttgttcaaatagggatgtattttttttccataaaagaaaacccattttaaagttaagcctctgatatatttgatttgttacatacagaaaggcttaaactaagcctctgatatgtttgatttattaaatattacacaacaccatcaataaacagaaaagttttcccttttgattcttttccatcagagaggtgtgttttgcattttaaataaataattgttgactgtatttactcctacctttatttattcaacgcaattagccagtatagtgagcgccttcctgttctaggtgttgatgaacaaaatagacataattctttgctttcatagtttacagtctaatgggagatgtatctatctaacaaatatttatgcaaatattagggttagtgttagggttagaatgcgtaatatataattatgcattgtgataaagtgcttttagaagggaaaacattatggggatgattctgaaggattatcagagagagtttttttagggaagaactgaagatttattgaataaatgactcaagagatgagaggcggtaatggggaagtgatagggctaggatttgaaggcagtgaaaggggttgagaataggtcttcacgggcaaaaagagaattcccattggaagctatgaaatgttaagacgtaattgcttaatgcttggagaacttaaagaactaaaggatcactgtaacactttggtaattaattactcatcaaatgctctaccttattttgatcccattgtagtccttccttgaacattttcacaacctaagcaataatcctgtgacccagtctaattttaaagggaggaaattgattatggatcaaatggcaaggctaatccttcctgtaggcaccaaatttgttatatgttcatggttttctgtcatgtcattggctgtggccacaggctgggcaaattgtggtttgaaaggggagatgtgagtagttgacagtactgtttgtgggacgagaactgtgtgttcttgtctcagatattgctgtgtatgtagatagcaataggggatttcacaaatggagaaaatgcttgtactttctattaaattgtctaactgacttttaaagtatta

SEQ ID NO: 60872 - DNA, 1090 bp, Homo sapiens
tattcatttaattgatatacaatagttgtaagtagtcatgtagacatggtggtgttttgatacatagaatgtatagtgaacatatcagggtaattggcatatccatcatctcaaacatttttcattttctttgtgttgggaacattcaatatcctccttgtagctctttggaagtacataatatattatcattgtctgtactcatcctacaatcctacagaatactagaacttaccaatttttttcatgaggtgtttgttaatgataataacttttgttagttaattatatgccatgtactgtttagtcactttctaggtcttaaatttttaattctcataatgacattaagaggtaggcattctgttatctacatgttaataaatggtaaactgatgcctggagaagttaataacttggtcaagactatgcaatcagtatgttgaaatacacgtcttagccttggagtccccatgcctaaggaatgtgcggtgctaacttttgaagtacagattagaagtactgttgttacaagtttattatgtatattcaaacttgaggagcccataaaagatgcatagctttaaaccatgagattaaaaaatgatctgactatttgcaagaaataaaacttgaacagcaatagttcaaaaagaaaaaaaattcaagatatttcctataagtacttcttaggcctctctgcatcctttgaatattaaacttcatactgacctctctgtagatcatctggcatccattcctcttctcttattagttccttttttcttattgaaagaatggctatgatttggcttaattcttggtccacctctgtgtccttatggtttagaattaaattccaccatgtaccttggaggccttattttctatctgcaatcaatagcattgattttgtttttctcacaggtttcatttttatttttattttttaagaaggaacaattctttcaagttattacacaaatgactcttttaatggagcatttgtatactaactctaagtgttatgtgattattcacatctactctcaaaagactagactcatttctgttgttattgaactgagac

SEQ ID NO: 60873 - DNA, 1054 bp, Homo sapiens
aaaacacctgattataagaggttatcacaaataaggagagtcttgaagcactaaatgtgaatattaaaatatgttttagttattgaggcaatggcaaaggaagggatgtgaaatatttagatgccatgtggggtatcgtgttcattttggggtgccatgcttcagaaaggactttaatatacttgagcaagttcaggaggcataaaatgtatttaaaataattgataatatttcatggacagatttaggaagaaaggatgactgtttttaagtgtgaaaacatggtcacatggaggaaaaaagggaagcattctgcataaatctagatggccaaagaagaaatgcaggttatagtgaagtctaaattgaatcaacttgagaatcaacattttgctaattaaaaatggaccaaaagtgaaatgggcagcctgatggtgatggcaagaaccttatctcctgaggcattctagcagtgactacatcgcatctgcttagagaaagtttgtgtgggttgaggagggattccttgtggctgaaccataacatatctcttgtatcttctgcaaactccaagactctgagtctgtgaatctgtgaactaatactctacaagttagcttataagagcctagccctcaaaagatttcttcttggaaatcctttcccttatgtaatgtatgtgtttagttttgaatattcttttacttatataaatctaataattttgcacgtattcttctaccacttgtttttgctcaatattatgttccattgtataacccaatttattgatactttctgctattgatggtatcctgaataattttctgttattttgctctctcaaattgtgcttgtttaaacagtgttaacggtgaatccttataaacatgttcagtaatttctctagtgtatatagatagaagtagaattcctgggtcttaatgtatgtgaaacttcaaatttgttaaataatatcaaattactttccaaagtggttttatctgattatacctgattgcaacttatgcctaagttttctgattgtctctca

SEQ ID NO: 60874 - DNA, 1036 bp, Homo sapiens
tagccctgagctgacacatggatggtgttttattcacttaacaaataattagcatttgaatcttacttgaatgccaaatatacttcttgacactacaactccacaaatgatttgcagtttatttcagggactacatctgctcgtttttaaaaacatatcacatacacaaaactttatttaattcttttcacatctagaattatcttcttataattataataaacaatacagcttttgaaaacatttaagcaggatgttattaagcatctggcttattttgaatattatctacctgttttccctctatgaaatttttattcatttaattgtaaaaactcacacatttagtttgttaaggtttctaaaacttctgttgaagtataataagccagagctttaaaaaattatttgtttgacctaacataatatcacttggaccatgtaaattttcaattaagatcattagagttgggcagtgtgtgtgtgtgtgtatttgtgtgtgtgtgtggtgtgtgtaaattctcaactttttaaagatagtgaggagattcacaaaactatgtgtaaaactgtcatcaatgtggaagtatatgtcattatgctcaagagataatttattgagctaatcttcatcctaaggaaataaaagaaaattagaaaaaactttgaatagaaatgtttagctttcgatgtcttctaatcacttgcctgtaactaaaatgaaacttaaacttttatcatgcatgacaagtgtattccttcaattcctcataccaaatgtatttctttctaaaaaatacccatccatatcataaaattactagatttaaaaggagctaaaaaaataatcaaatttttcttgaggtttgtatttaaaatcaggctgtatgtcataaaaaatttgaaagaactggatttcataaaaccttttactattgagagtgtttttccttatgcttaaactaatacaacctaaaactctatttttaaattaaattatttttattgttaaaaaatagagaactggttacgactt

SEQ ID NO: 60875 - DNA, 1024 bp, Homo sapiens
attccaagggcaaagacctgggccaaattcaggcaaattcaaggctcagaatctccaaaagaactgaaatgaaaaagagcaaaaagaaaatgcaataggatgccaaatcatttatgaaggaagcagagtgtctgcagtttagcttattaagtatctcccttttgtgggagagggttgggctgcactaatgtatcactggaaagtattactctggacccagcccattaagaaagtcataacctattgagggtctcagaataacagtgctatcatgaggtgacaaggccctttaggaaagggaaatttggcatctcaagctcttctttgaggagcatgccgagatccaggaaaaaaactctctttaggaaaagaggatgctcatcttttccaggcccgtatattctttatggtactcatagcaaactgaatttccaggttttaaaaaatatttccttagtcaaaataacttcttgctcttgaaagttttgagttttctgacttctataaaacaaacagaaacatatgttcttattaggaacaaagtaggtatataggtaagaaagacacagggaaccgaattaaagaaacagtaaggtttgtaggcagacatgcaggtattttagccattttgctttatggtactacaaaattcctatgagcaaataaggtggtggagaataaaactagttccctgtggcccatggagctcacccatattttgtttttaatattaaggctctaaaacccatatttataaacacaaaatgcagaagttgcataataaactcctgtgtcccagttgtttgtttattcattcaacaaatatttattgaatgcctattaaacacatggccccatttgaggacatagcctgaatcagatatcatttctgcatagttactaatatatctggaattaaattaaaatattatgaatgtagaattataattaaaaagagaacaagactaattatataaacaataaatgaatatgcatttagagcctaggtgttgaacactgtgct

SEQ ID NO: 60876 - DNA, 1049 bp, Homo sapiens
tggcacttgagttacctccttaattcagttcaaacgtcagttttcaattttttaattcttttgctgtttaaaataatcaaacaaattaaagatgaataattactggctccattcctatagtaacaagtgtcacattctgacaacttcagaaacaaggttggttattttcagctttcattgtttacactcttcaaaaataaggatgagaaatttattttattttctttttattagtcaataagttctacttaggaggcataaagttctctgaacgataagttagggctcagataagattgttttaatactgacttcaatgctaacttaaggaaaacagatgatatcttagctctccatttctttaagacttaagactatggttgttcgggtatacaatttattttatgtctcttagaaaattgtcataagtcttattttacttgaagaagataaatatgatgatagtaacagaacaatcagaagtggttattcttttatactaaatttcaactaatatctattaagtacttatggcatgccagaccctgtgatatgagctggagattccagttttatagagagatacagtgtttgtggatgactttatgtttaagtctgggttgggtagaacacattttccacttgagctgcagcaggattccaactgaaaacatacttcaatcttgtaaattctaagttctagtgtatacttgatgattgaagggaaaagaaagagaagggaggatccttgctataattatggtcaagaagtagaaaggagcaggagggatagtaggaaggagaggctatagattggtctttagtaggacaaggttggtgtttagcattattgcctttgcaggaggttaaaacctttctgtatcccagatgggagttagttttatcaactatgttgaaaactagtatatatgtgtatgtatgtgtgggggagagggaagaattgcatgtatttgaaggcttatatgaattagatttatttttatatacttttacaagtaatatgcacatatacattcaattctactata

SEQ ID NO: 60877 - DNA, 1101 bp, Homo sapiens
cctcactattttcactaatctttatcttaaatctctaagagtgacaaactgttcaatttttccatgggtatgaattaatttaaaactaagtgtattggctcagacttgctaataagtataaaaaatattttaggacaggcatggtggctcatgcctgtaatcccagcactttgggaggccgaggtgggtggatcacctgagatcaggagttctagaccagcctggccaaactccatctcaactacaaatacataagttagccgggcgtggtggcagttgcctgtaatcccagctactcagggggccgaggcaggagaatcacttgaacctgggtggcggaggttgcagtgagccgagattgtgccgtcacactccagcctaggggacaagagtgagactttgactcaaaaaaataaaataaaaattaaagcaggaaaatgtaatatatcaaagccatgtatttttatttgtgtttgttcatttattaacctgtcattagtaaatgctatggaataaatgcctgtgtctctccaaaatttacatgctgaaatctaatctccaatatgatagtgcatagaggtggggtctttgagagctaattgggtcatgggagtggagcccttgtgaatggatttagtgaccttataagaagaggcaggggagccagcttgctctatttctgccatgtgaggatacaacagaagctgtgggtctgcaacctgcaagagtcctcaccagaacccaaccttgctggcaccctgatatcagacttccagcctccacaactgtgagaaataaatgtctgttgtgtataagctatccagtctacagtactttgttataataccccaaactgacagacagcaagtgaacaagtttctatttgtaagaatatactaatgtacttcaaagttatttccttatgtaggcaggtcttttttaacagctactgactgaacatctactgttttctgtgagctattagaggtgttatgagggattctgtagcagatgctattggtgccctccctggaccttctctactaggtgggtacacctgcctcccagctgttgtgggtgttgattgttaaaggttcacac

SEQ ID NO: 60878 - DNA, 1048 bp, Homo sapiens
gattgtggaaactagaggccagcatagagctagcatctgtgcccactttttcttgggaaatagagatattgattcatctttgccttgatcactcttgtgtgactttttcaactcagatcattgttgcttaaattgagagcagctttttcagaaactgaaactcaactgcagttatagctttttggcaggactttactaattgggacagggaggcgatcacttgttacaacataaatagaatcagaaatcaagtgatagtagtgatagtatatcattcatatgatacattcagcctatatatatgtacatgccaggaaagtgtgaaatttcagttttcttattggaaaatgaatcgtatttgttagttttttttaaattgtagtttgcagtttttgagtaatatttttgactggctatttcttggtacattttatgaagaacttactattatatattctctttttggtaagtgaaacaatttctgatttcaattgccagagagcctgaagttgacaagtcaggctgggaattagccagggcatgataactggaagaagggattatgttctacatcattaatatctgcttccaggctttataatattatccaggctgccagttttcttaaaaggaaaaaaattatcttgattaactttcagctgtttcacccttccttacgttcaagactttggtttctctgagaagaagatttcaaaggaccactcttattcactaaatctcttattatgtacctgggtgaatagaatgaaaagacgagagtgtctaagtccttcaccagcatcccatcctgcactggctctgactgtctctcaagacatgcttcagcaaataacatttgtggttacctcgctggtgcctgccttattattatttttttttaattctctcgggcttgtggagttggttttcttatagccattccagagatctactggaatgcattcaactccactcaggcaccaggattcagctctgaaaagtgtacagcttcccattctcacaatatactgcccccatttcctctact

SEQ ID NO: 60879 - DNA, 1111 bp, Homo sapiens
tgcacactgagtagttccatttcaaactagacgttctgttgagctcagaccattctggaattatttggcaacatctgaaacattttttttttttttttacctacaacacttctagatgtgacgttttctggagaattgataaactgatctggtagctgttagtggctaccaagccaagttttacattgcaatctaaatatattgttccttgtcatgtaatgacatttattagagaatctggcaaaagcccaaataaaaatacaggttttcacactgtttaacaatctgaggttttatgtctttttggtgaggtcattgaataccagtctcatttttactgcctctatttttgaaaacagtaaacagtcatatttttattgtcctacgtggttgcacaaactgacacattgccaagtggttctgactgaatgcttttcacttggcaaactaaaggtactaaaaagaggttcacagtggagacttatgcatgtaggggagcaatttctgtgggcatgtgtatgtacaaaataaatctgtgaattccagtagagccagtatccaggactctaaaagtagaacagactgatttatttgtgacaatgtacttcagctgaacctctgtgctagtttgttggcaaaacctaacatatggccttttaatgagagacagattaataattgcagatatgaataataaagcagaaagattggctgtgccatcttttattctaataaggaattagatttggttactgaaggagcagctgtttgccaggtatggtatgctactgtttgagatagacactttgatgcaaaatgggacgcttgatggtgatggacttgaaaaaatggatatgcgatgtgtgtttaaatttctcaagccctataacaataaacattttacaccccaatgattattattctataccgtcattcaaaaacctacaaaaaagacacagtgacaatgttttctgtcttgttgttctttgagagaaaagacctatgatggtacctcagtgcaatggaaaaaaaaattcttgacaaaaggatcaaatagaagtggtggcacagtttctggaatatatgacattatgtttaaaattgagtgcaa

SEQ ID NO: 60880 - DNA, 1046 bp, Homo sapiens
ctcatgatccacccacctcagcctcccaaagtgctgggattacaggtatgagccaccacgctcagccatgaaccaggttctttccagttttgtgagatgccagtataacccatttgaattaattaacctacataaagaagcaacagaggcagtcataaagggtagttagacagtctttatcccagtagagttctggtcacaaggctcttcctgatgtgaagacagatgtggaaggttttggctaaggtaatcagacttcctgttttgctcaggactgttctggttcatgcctgttggggcagaactattaacagtgcccttcttattttcaggactgcacctgctcagataacaaagttcatacactttctaactctaggcagtggacattgaatatttccattcttatgggcaagtcatccctgtaattcaactgtctttgcctgatgacattaaataatgttttaccttaccaaagtatcttgttctgatttcatttttaccaaatgatattctgatctccacattcatattttggtattctcagggcgttggtagctactggcgccaaagagttgctctaaaatgtgtgtagaatgaaagcgcagggctctagggacacatgctccgggaacacacagagatttgctgggaatatccatgggccccagggcacatttgcatatccagtgggatctgtcatttaggaaagattaaaaattttagttatcccttaatgttggaacagatagaccaacttcagtggtctgagagagtatggagctcactcccaaaggaatccttactatgtgtcccagatgacatacacagcattgactggcacccacgctcagagcagtcttctccaaaagataaaggacacatccaaattgaagtccttcgatctttgagaataattaaataactaactaaaggaaaatgttttgataaaatgcttgccacagtacctccctaaatatctataaagacagaagattctgattataaaacacttctgacaaagtgatagtaaatattctcatgta

SEQ ID NO: 60881 - DNA, 1068 bp, Homo sapiens
accttatgtttttccctgctgtggtgtatgtgcaggtgcctacctagttccccatgttcttcctcctccctggactcatcgtctgtacagagacctaaagaaattgttttcccttttctggacatcagccatttttctgtgttgatttgttgcttctgaagaccttcattagatagatctttcctgatgtaatccatcatggcatgggcagtttcattccccatagtgctggtgagcatttggcaaggtctcttttcatatacctgtgaacaaggactatgggcctgatgccaagacttaaatgcacctggaaatgctaattaattggtagatatcagtagatatactcctagagaagcagggctggaaacggaacaattacatttgcaggagagtattacttgacttcttatattgccttctgccattttcctggttaatttctaaagactcttcttactgctttggtaaataaattattcttagaccaatgatgctcagagtgtgcagtaattatccctaacaaatgtaacaaacgagttttgaattttgttctattgtgttgatgttgtcatgttttgtttcttttgcaagcaatagaatctttcttggcccaatgttcaaataacctttttcttatttgagcacatataaacacacaatcaataaaatttcccaagaaggaacaacataaatattttaaaaatatatcatagatactttacataaaatgtaatacctatgggactatttaaaacttattagttatttgattagattttcatttatttatgtggcaaattgaaattaaggaaactaagcatttgaattgagtgtaggaatattccctttcttcctttttttttttttttttaccatttatattgtcaaggtgaatccaagataatgatttgttgcaggtagcctgaaatctcaatatcatttctgaggtcaccctcatgtctagggggatatgtagagtagatcatatttatttatagaacattcagtggttctttctcacacacacacactctgcctcctcctcccaattccccctgctgtgga

SEQ ID NO: 60882 - DNA, 1169 bp, Homo sapiens
agagatttttacagtccctctacaccagttgagtatatttcacttgcaaattctgccctttttaggttttcaattcatcggagagctacagttgtcaatattagtatggcaaagcagggaaactatagaaatcatgaaagtattctcatttagatttgtgcaggaaacagcattatattgctaatgaagataaaaaggcaaatcaatcatttcagaaataattcacctaatcagtccaccattttttggaaaggaagaactacttcaccaaatgttaccagaggttagaaaactacaaatcaagatcagtgttattccttgtaaaccttctgtgctgatgaagttcaaatgtagctgttttataaggttgattttataagattacaagtttcccttccctggcttaatttggggaaaagaactcatctttccccccaatagacatccccttctaccacaaggtatccagtctgattttgagattaaagagttttatttaaactctgagttggatgttacatatttcattcatctccaagccagttatgttcaaattctactttctgaatccgatcagcaagtctcagagaagtcagggttggcaagagaaggggaagaattttgactttcctctgctgtattgtacttcatgttcactttgaaggcttcagaaccattgcttcgacttagtattttatcagcgaggtgcagaggaggccagaacatagaagtgcccatcaggatggaaagactttagaacttttcatccctttaatctttgtaaatgcaaaatgtgttgtgtcaaaggaacgtagatcttatactattatcatcaaaagatttgaagttatttttcttctcaaaaggaatctgtgatatcaacagttgcatattgtttttctgttgtaaatcaaacagcttggaagaaaaatgttgccatgttttttgaaagggcagcacaaactatgatcattatggataaatttgagagttcatcctcatgaacttttaatgtttcaactgagtggcagttgcaaataaaagcgatgtaagatcaaagtgtttaatattatacacacatacacacacactatattcaagattttaccatttgtattggaatagattgtttaaagaaattttatagttgaagcattgattgatttttc

SEQ ID NO: 60883 - DNA, 1015 bp, Homo sapiens
ccatcaaccaacgaatggataaagaaaatatattatgtatacaacatggaatactactcagccataaaatggaatgaaataatggcatttgcagcaacttggatggagttggagaccattattctaagtgaagtaactcagggatggaaagccaaatatcatatattctcacttacaagtggaagctaaactatgagggtacaaaggcataagaatgatataagggactttagggactcaggcggaagtgttggagggggatgaggactaaaagactacgtgttgggtacagtacacactgctagagtgacaggtccaccaaaatctcagaaatcaccactaatgaacttatccatgtaaacagaaaccaactcttccccaaaaactattgaaataaaaaaggaatcaaatgctatctttaaaaagataaatgaataatttattgttagatacaacattttaatgcagtttggatcagggctttccaacatgtttcacttcagtgcacatagaaaaccacagagattgctcacagcttgaggtgaaggaggtcagtattttgactgtctgtaaccaataactacatactcaggctgaggccagattatcaaggttttttattctgtccttggcattcttgtttgttgatagcttatgcttgtagaaggggagactaatttcacagtattaattattaatatatcattacatctagatttgtaaaatgtattcatgccttactttgtatcaaatggacataggttatgattgaaatatttagggtggctaaaatattgatttgttagcctatttaatggcaaaattaatgcactgatttttaaaaggtagattatctttgtgacagcaagctctgatcattcattttggattttttaagagtaatttggtggaggatcatctaaattacttagatttttggacatcttatgccttcaaatacctttccatagttaaataccccctttgaagttattatgcttataaaatttccaag

SEQ ID NO: 60884 - DNA, 1010 bp, Homo sapiens
cctttgaatcttgttcaatattaagtcatgtttatttttaaagtgagagtcattattctaagtggaataggatttggtttttctgcattggccaatagctcaaaatgctattttataattatattggttccttccaactgaccttgtctatagatttgcaaacacatatagacattttacgttttatgtttttcagctatagcaaaatattttccttttctaggtctgcctatgggtgtctacgcaccttatatcaacatttatatctataaacatacacgttttagcacctatactattctatatttttaaattttgtaccaaactcctctgagacttattatggtttacacccaatcccattttatctacttaatgattggagccacttttttattcttatttatttctctaatgaactttggaggattgcaatttgctaagttctagggtacaactgtgctcaagacagacccaatctctgccctcacagtatcttggttggttacatatttgctcttacttctttcttccccccagctttattgaggtatgattgaaaaacgaaaaaattatatatttaaattatacaacttgaagttttgatatacatatacattgtgaaataatcaccacaatcagactaattaacatatccctgtcacctgacagagttaccattttttctttcttttttgtatcaagaacactttaattctacactcttaacatatatcaagtacacaatacattattgttaattaaagcacattataactaactataattacattagctatccatatcatatgcatcttgcataactaaaattttgtatgccctggccaataacacttcatttccccctgttaaccagctcctggcaaccaccattctactctcatctctatgagttcatctatttaagatttcattctattcaaggtgagatcatgcaatagttgtctttctatgtttggcttatttcacttaacttaatgtcctccagg

SEQ ID NO: 60885 - DNA, 1028 bp, Homo sapiens
tgaggcttgagatattgtacaaaaatgagtggatagttaaactttttttgagctgggtgcataaaatgaactcttgactttttatgatagccaagaaatcttcccacacacaatctgcaggccagttgcaagtagctggtgatctccatggtcaggtaagttggtaggtatctgcctacaagatgtaatttaatgggtatgaaaggtcttttattttttccccttcacacctgtcctgcaggtatcacagggactgaaattctgctagccaactgcactttagattcagattcaatttatactttttctaagcaccaactatacacccaactattgctgaattttttatatacatggtttacgtgtttagtttttatgagtgttttcccctcttacaacctacatactatagatattttacaagtcaatcaagagtcacatgtgggcaaaactaatttagtattcaagtgagaaaaatataaagtagtcacaaatatttgattttaagattaaaattagtaacccccaattttactgaaataacaggagctatgtcttattcatcttagttcattgtattcttcctaacacgcacacaaacacccttggctctccttatgtgtaaatgacattaaatacacataatgaatcctaaacagaataaactggtgacatctcaaagtagttgaaagggaaagaagcaactaacataaagaataaaagtgtaaagagcccagagtaatagggaggccaggacaggccagacttcaaggacaaggaagatgaataatgggaaactcatagagaaagtcaaggataacctggggtttattctgaacattgcaactcctgtcaccatgctctcaacagcagttccctgttacttaacaatccatcagtgccttctatttcctatagaataaagtctggattatttagccaggttatgccagggtctccaaaacctgtcccatctgttcctctagcatagctgatttagcctctctaaccacagtctttcctgtaat

SEQ ID NO: 60886 - DNA, 1031 bp, Homo sapiens
tctaagggctgtctttaacctcttgaaattaatggaagataataatgctgctttgggtcaagtcctttgggcaccattatcagagtaaacatatcgtcaactttacacttattatgtgatctgtactctgtattgtaagatgcatacttctttataagcatctcattttaaaaacaacctcaaacaatgctgtggggtaagtattaatatttgtgtcagttaagatgctttaggtagaaagtgtcaaagtgcctatttaaagtgccttgaacagtaaggaaatgaattatactacacatttaaaactccattgttagtgtgggctgctggtgagaggagaacaaagctctggctccattttctcagctccatttccaactgtgtccttctccatgtgtcaactttgcttttccgtttaaccaaaagttagctgccagtgggtctagggtgccatgattcattgttcttatccagtgggagaaaggagaatccaaacatagagtataaatccttccctttagtaggcttaggtaaatttgtgtcatatgcccacacctagaccaaacaccctctctagggaaatgccttgtgctgcttgtcttagttctatgttccttgaccaattcactagcaaagcagatgggcttataatgattggctcaccaataagatctacccctggagctagtgatttgggtttacttcccctgtttcccacagttgtgtgaggatagagaagatccctgaacaacaccaaagtcttgttaggaagaatgaagtcggtgctgaatagacaatagacaaccaaatatcgctactgtcttattatcctgagtttacaggtgtggaagccaagaggttcatcaacttgtccaagatcaggcaagtagaatgaggaggagtagaagaaagagaaggagggaaaacaaaggaaaaaaagatgagggaagaggacaattagaaggcagcaaacacttatattgtactttactgtgtcaggcagtactctaagccctttatatagcaataga

SEQ ID NO: 60887 - DNA, 1038 bp, Homo sapiens
gtgagttttaaaaatttgtttaaaacaacaaaagaattcacatattgtgtaactttggatttagggtaccattgaaattgatttccttagaggtgtgctagaggcaaagtttgctaatctggttggtggaagagtactggtggaatctttctttaggtttctctctatgtttaagttcctgcttgcacctgtgctagtcaatgtatttgttgaggaagatttatggttctattcttttaggagagaatattcacactttggctttgccttttgaggcttacacatattatcactaaagtacattatcatttttcatctggtggtagggaggattttaccaccttctgagttaggtggaatgctctaggcagagaaaggattagggctcatcagagccaatagggccaactttgttccgttgttttcctgccaaaaagaaataggggataatagaaactcatcagttgctatttgcaaaactgtttaatttccctgaatattttgttctcttgttgacatgagcattgactgcttttttgccatagtgggataatttattttatacgaggtggtgttttcaacaaccactatagaatgttctgaatcactgtgaactctatctggataaaaataaatgctcttattttctccaatggatatttttccttgcccatgaaagttatgactggttctgcttattcctcaaaccgattatatgaacttctgataaatgtttgaataaaatgtaagaaatattgtaaataagcaaaaatcccacagaaatcagaggaagtatgttctacctctgctcttctaagtctgaccaacagttaaataaattcttgggttctatgaacagaatttttacatgatgaattttttttttttttaattgatcattcttgggtgtttctcgcagagggggatttggcagggtcataggacaataatggagggagggtcagcagataaacaagtgaacaaaggtctctggttttcctaggcagaggaccctgcggccttccgcagtgtttgtgt

SEQ ID NO: 60888 - DNA, 1002 bp, Homo sapiens
tttcttgtgggggcactatcttctgcattataactgcagccctagcctcaacccactaaatgccagaggaccccctggttgtgacaaccaggaatgtttccagatattaccaaatgtacccttaggggtaaaattgcccccagttgagatctgttacattatattacatactcacccaagcttaatattaaaacataacaaaaataaaaatcacattaagactgcccacaattctgatagtgattgtagtactcttgccattttcctgcctctaagcaattacggaaatagccattcattctttaggctaattgaaggtgctcatgtattatagaaaaaacaatagagcaagaatgtattatacattgctggaattaagcttaatacacttgacttaattaggacaattaaattatatgttcagctctcgtttatttaggggatgattagtctattttcctttcttttttgtgggtgcacactggatctatggcctgtctttagctttcctcattactggaaattgaaatcagtccacaaacacttatctagtgcttgacatgtattttaagtgctaacatttcaaaagataatgcacagaaagcttatggaatcatgatgctggggaaggatgttgtgaagtcctttcagaatcctgttcattgtcagataaatggttgacccatctacaataggtttagtatgttctcttttccttaattatcttcaaggacagaattgctgcaatataagtttctcattccagactttcattctgatggttcagatgattctctatatctaaatattaaaattgcttaaatttcagtctgtttcctcatataagttttctttgtgaatatgtatgtatgcctcatgacttcagaatcagaaacaattctgaagttgagataccttgataagtatattgactctttttttgcataaatgagatttttagttttggatagcttatttatgtttttgattcacaaccaagaa

SEQ ID NO: 60889 - DNA, 1048 bp, Homo sapiens
cccacaaaaatctgcaccataagaagctcccacacatgtaaagcttgagtcagtttttggtgtaatgaatcttcattcattcatttaacaatttgcttagaggcatttttagtatttattcaactgatttgaggaataaaaagtaaactagtaacataggccaatactgtattttctgtaatcatttttcttaaaggaaaccttcctgcctataggtcagggtcaggatgaattcctaatgaatgtttccacagtaacaataagtaataaaagcagataacatttgaagactgtgaacaacacatgaggctcagagctttagggatgggtgttgttgttacccccattttattgcaaaagcaactaagacctaaagcagttaaacaattaggcccatgttcataactagtgagaaggaggaccataagtctgacactactttgctatattgctctactatcacaagcttttaaattttgcctgcaatgtttcattttgcttttaagcaccagtgtatctgtaagactacttctattggtctgaggactccgctttcacaaaaacttatacagcatgttatggtttcgaaaatttttaaatattagcacttggacccatgttaagtacatctgttgtaaaaagatgaattctgtaacataatgatgagaaggtcataagtttaatgccttagagacatacaatgggcaatcagaacctattgcaggatctactttttgtaatgcattgaaacccttatggatgtttcatgagatgaaacttcatggttcagtgtttgagacattactaagtagctacatttttttacataaaatatgttagttaataaatttcttcaaaggaggaattaggaaaatttaaacagcagctaaagacaatgaatgaagactgggaaaaaattattatgttttgttatataacaaaataaaaggataagctgagtcatgacaagtgtgtttgccttcattttccccttcaatttcctctgactactgaggaaatgtaaccttagcacttcgttggtgaatct

SEQ ID NO: 60890 - DNA, 1035 bp, Homo sapiens
ggacatttttaagaaaacaactgagttgataatgtcttcatacattacaacatcaaaatacatttctcactaatgtattaagttcaaccttttgtactcatagtggaaaggtctttggtactttccataggtggccattgacttaattcatagtgtgatccaggtagtcttaggtgggttgcataactctttgctttcaatagttagaagatgaaaagacatccatatatcacagtcattgagaaggaaatgggaagttccttggaattgagacctgtagagatcggaggcctacagtattgaaggatacaggcaaggacgtgagccagtcaatatttgcaggagtcctgaagaattgagttttcactgtgaaggtgacaatagatcctagagaataaatattgacttctcagaaggcaggtaaaaaaagattcaagaagcaatctggggtagctgaacattttcctttaaagctaagtattctttactgcttgttttctctaaaggagaaacagtctgcctcattgataaatactcatgttataccctcataattccttccacttccagaagagcaatactttattgacctgaaagtatggttgtctataaccttctgagtgggatcaaacagcattgtttaaattatcttcctaagtggattatttgttgttgttgttgttgttgctttatttctaaagtaaaatttcatagagtacttctgtttatgaagcttataagaacagacttttctggttacagaataggggaacagcctccaggagctccatccagttgccctaaattcccttgctattcattcgctctcattcctccccctggattaagttcttctctggaatttttgagttcaggtcaggtaaaatagtttgaagaccacttttctagttgaatccagggttactctgagtacctaagtaatgataattctttatcagctgtatactatgtacatgccgcttggctatgtgtagaatctctaacctttacaatagtcctgcactttagggatcg

SEQ ID NO: 60891 - DNA, 1048 bp, Homo sapiens
cataggagaaaggatgctgaactttggagtatttgtcttcattaaatacatgagtgacaggttaggtgatctgcttctgtgccaggttaaataatgaactataatattatagtagtaataataatatctgccttttgtaaaatgctttgtgtactaagcactcggatgagtactttatatactttatcttctttaatctaaattaccatgcatgagacagctgctgttatttacagagaagaaaacccacaacaggaaagttgtggcagaaacttgccagggtcactaagctaggaaatggaggagccaggtttcatacagagcagtttgagcatcagaaaccaaccagaactacagttacctggcattgggtaaaccatgtcattctctgcatttgtttctttaactattaatttatttaaaacgtatgcctccctgatgaggctgttgtattaagtgaaataatgcatataaatgcggacagttctgccaggtgcatggtaggccggttttaccagctagtatggtgtatttctactacaactcattttactggcagcagctcatctgaagctctgattgttttagagcattttgatgttcctttgaatagattaatttagatctgacgataagatgttataactaagactctaattctgatacaatcacccaaactagtatatatatatatatatatgtgtgtgtgtgtttatatatgtatatatatgatataaggatatgtgatatacagagaatatgatggtatgtatgtatatacatacagttgacccttgaatgacacaggagttggatctgtccccccgcacagcccgcacagctgaacatccacgtataactttcaattacactcaaattgaactactagtagcctactgatgaggggaaaccttacctatgacaggaaaattcaatgaacacatattttgtatgctctatgtattatatactgtattcttacaataaattaagctagagaaaaaaattgttattaagaaaataaggaagacgaagtatatttactgtt

SEQ ID NO: 60892 - DNA, 1344 bp, Homo sapiens
gcactagaatgttggatctagtttgtgaaagacttagtaggctctactagcgagttcggcttttaacctatggaactcaggcaactaccaaatgtttcggagcaaaggagtggtatgattagaattaggttttaaataatgaattttagcaggtaaaatttacagtagaaactgtaacggtgtccagtgatgaaaacagaaccagaaaaccgcaatgagaaagggaaagagaagataaatataaaagagattatggggccagattgggcaacactggccagattttgatatgaaaagtgaagatgtagaaagagtcaaaaacaaggcagatgtttttagcttgagcaacgatgtggatgccatggctgtgtgagaaactctaaaagaactcaccaaggccagtttcctgttctatacagtttcacatatgattttcatcttatagcttattccttctattcaatttcacatcaaccttaaagctgtttagaaaacaattttctggctggatgtggtgactcatgactataatcccagcactttgcagattcaaagtaggagtcttgcttcaggtcagtagtttaagagccgcttggacaacatagcaagaccccatctctacaaaaaaagaaaaaaaaaactaaaaaattagctgagtgttgtggcacatgcctgtagtcctacctactctggaggctgaggtgacaggatcacttgagcgcagaagtttgaggttgcagtgagctatgatcaagccactgggaaacagtgagaccctgtctcaaaaaaaaaaaaaaaaaaaaaacacacctgactttttgatattgtctctctcttcttagatatagcaatggaataaactgcagaaacttagagagaattattagatctctaattaggaatcattttttctacttttcaaggaaacattgaaaatatttccagggatgaaaattaaatttttaatttgtaaattttaataatggtttcaaaatttaacatttatgattctttgaataaaataaacaaaagatagaaactgaattttattaatttctactttaaaaattattttgttgagttttgtttttctttagttttatctccctaaaattttgtaaattgaaatagagataagtgttattattaatatttttgagataagctacccagtgggttcattttgctggaatacaatttatattttcttgagtgaagaaatttatctttaagtgaattatgaaattaaaccagaataatttcaggaccactaagaagttcattttattcaatttgacaaacataatttgacagaatatcatcagtattgtggcaaaacctaaa

SEQ ID NO: 60893 - DNA, 1050 bp, Homo sapiens
tatctggactgctaagatggtaatgattatacaaaactcacagggttggactagcaactcaacacaacagccatgaaaatgctttaagcccagtgtttgacaatagactagatgcaaaatgagagtgcatttatttctaagagacttatgttcttgagtatttcaagtgggtagtaagtgataagctgtccatgttaggacagtgtcataagaaaagagattcctgtggaagaacacagatccttattactttttctgaagaaatgtatttttgttttggaaatttggctatgaaaattaattcatgaattgatgggccaaacaacagaaagaaaaatgattattcttcttaagagttgtattattttaggttttgccacaatactgatgatattctgtcaaattatgtttgtcaaattgaataaaatgaacttcttagtggtcctgaaattattctggtttaatttcataattcacttaaagataaatttcttcactcaagaaaatataaattgtattccagcaaaatgaacccactgggtagcttatctcaaaaatattaataataacacttatctctatttcaatttacaaaattttagggagataaaactaaagaaaaacaaaactcaacaaaataatttttaaagtagaaattaataaaattcagtttctatcttttgtttattttattcaaagaatcataaatgttaaattttgaaaccattattaaaatttacaaattaaaaatttaattttcatccctggaaatattttcaatgtttccttgaaaagtagaaaaaatgattcctaattagagatctaataattctctctaagtttctgcagtttattccattgctatatctaagaagagagagacaatatcaaaaagtcaggtgtgttttttttttttttttttttttgagacagggtctcactgtttcccagtggcttgatcatagctcactgcaacctcaaacttctgcgctcaagtgatcctgtcacctcagcctccagagtaggtaggactacaggcatgtgccacaa

SEQ ID NO: 60894 - DNA, 1029 bp, Homo sapiens
aaccacgtctctactaaaaatacaaaaaaaattagccaggcttagtggtaggcacctgtaatcccagctactcaggaggctgaggcgggaaaatcacttgaaccttgaatgtggaggatgcagtgagctgagattgaaccactgcactccagcctgggtgacaaagagagactccatctcaaaaaaataaaaaagaataaataaataaataaataaacttttacaagagttctactgaacacatttaacaattgcttttaaagatttagccaaggaaccatgaaccttgtgcctgatgaaataattaagcaacagctgcatctaccatgtgggtggatttatgatatgaagtattgttctggcaaagctcagaactagcagatatttcacttcaagggtaagtagcatttatggtatattattatactgctgtacttctttgaggggaatagaaggtggtctgtcccaaaagatgctatggagtaaattaagcataatggaataaggaaaaggccacttgtttacatcaaacttgtgtcacaaggattcactcacttttagttctcaaaccactagagaatcttacaaaggaatcattccaatttaattcccagccagtgtcatctgctccttatgtaagtttgcttatattctttcatgtgtcaaaaaccatcaaggggccaacttagtgtcgggcttgtggttggagaggcagccaaagatatacttgatttctattgacatctacattttagcagcagagattgtgccctagcaatgcttgtcagaataaaggggagctagggctggagtcacaggacacataatacggatgtcaccacatttcttccatgtagaatgaaatcttcctgttatatggtacatacaaacataaggtttcatttgtcaacaccttgatttccattaatttctctaaggctattgatcatttaaagctcatttacatttcttttttaataataaatgtgttgctaaaatcacagtttcccaggacattgctttcccttg

SEQ ID NO: 60895 - DNA, 1063 bp, Homo sapiens
gaaatagattctcctcacttctgaatcattgaacattccaatattgatgtagaaagcatagagccttatttcatttgatagtaaagaataaagcaagcaatattgccacaatcagaatcttttatgtgtttttctacacaatcatcgtttataacccctcacatcctgaattttccctaggatgtgtagactaaaataaaatcaccaattcattcatcataatagttgaagatgacagggtgaaacagtgatttgctaatgcttctttaaggcttatcctcttgggcagtacatgttttttgggattatgaaatgatcaactttaatcagtgcctgcccattagtccttgccctaatattactgatgattaataccaaaaatatgttttaatatctgctgacttcctaggatttgggagtatttgataagatataagccaatgtgaatcccagtcaaaagtaggcttatctaagtaagattatgtttggcttttcaactacacttttcagaattttaatggtagaaaaacatttaagaaagaaaaccgttaacgtaatcacggcttgcagagcttcttgtttttccatgctgtgatgggacattagctaagcacacagaacataatttcctatggtgtgtcaggcctttctcttaggtctgatgaggtctaaggataattatgtgcaacaacctactgtggcagagaaactgaattatcagttacatctgagagtcttctcacaaaagaatgtcagtctctcactgctttatattagctaatctctagacggactttcctggttgaagcttacttttttcatcagtctcttatcaagaatgctctggttaagaactaattcatattacggacatcattaatatattgtaagtatccataaatataaattttaatattaaatgttaatagggatattacatgatattggcatactatataatgtgcttatatatatttatttcaaatgttaactgaatcagatctttaaatattttcgtttgtttttatgcaccctgaaacaaaagtttactcctttggttgaa

SEQ ID NO: 60896 - DNA, 1007 bp, Homo sapiens
gatggtgtccatttgctcaaccagacaggagttaacttgtattagaattgttttttctaaagttatgttacctgagaaattaaggactgcacctggtttaatgttgcttcacttatcccaccctacagagaccagcaaggttctgccaggcctcgagcatccaagcatgattttgctgtgacaaatctaaaatcaaccaggctacttaagtctgctctgatgaaacccaataatctctcaataccttcctatttctcaatagtctttaaaccctaaatctgagtcagtaattctcttacatccttcccaaaaatcagtgtctagggactagttgatctggatgagttatacatgatatttgacttttcataagtagtggaaggtttcactaagtaaaactctcagtttcttggtatctggctttcttatacagatggtgtccatttgctccaccagacaggagttaaaaacctttaaagagcatttaacatgccttttagttttcttatttcataatctacttttctatcattaatcatcttaccaggaataatcaaggcccaggtaggtagaagtttttatatagcctgaatactcacttgacttactgctcattttactttttgcatggaatacagccatttagtcctaatatacataccaatgagacaattaaaaattggttggaagatggagcttatcacattgtgctactacgactttattttttcttgaaaataaagccttgaggatgtgaacataaatgttggtatcataaaacaagtagtaataaaagcataaattatcaaatatcaggtgatcttactatggagaagaaaaaccaatatctagttacagatgaaaaaatgtttaatacaaagagctgaaaatgtagaaattgagttatcttccctttgcaaaatttttacactttaaattagtaattctttgtttgcaaggttttcatccctatgctgttgttttctactacctgttttactcttgtt

SEQ ID NO: 60897 - DNA, 1090 bp, Homo sapiens
tgagaatcatggatccagagattgctctgaaaattctgcatcggaagatacatgtcacaccactgatcccaggcaaatctcagtctgtgtctgtctctggccctggccctggccctggccctgggctctgcccaggacctaatgttctgctgaaccagcagaatcctccagctcctcagcctcagcatttggctagaagacctgtgaaggacattcctcctctgatgcagactcctatccagggtggaattccagctccagggccaataccagctgcagttcccggagctggtcctggttccttaactcctggaggagcaatgcagccccaacttggaatgccaggggttggcccagtgcctttagagcggggacaagtgcagatgtcagatcctagagctcctatacctcgcggacccgtgactcctggtggtctgcctcctcgaggactgttaggagatgctccaaatgacccacgtggagggactttgctttcagtcactggagaagtggagcccagaggttatctgggtccaccccatcagggtccccccatgcatcatgcctctggtcatgacactcgtggcccttcctcacatgagatgaggggagggccattaggagatcccagactgctaattggagagcccagaggccccatgatagatcaaaggggtctacctatggatggtagaggtggtagagattctcgagcgatggagactcgtgccatggaaactgaggtcttagagacacgtgtaatggagaggagaggaatggagacctgtgcgatggaaaccagagggatggaagcaaggggcatggatgcaagaggattggagatgaggggccctgtccccagttcaagaggccctatgactggtggaattcagggtcctggtcccattaatataggggcaggtggccctcctcagggacccagacaggtcccaggcatttcaggggtggggaatcctggagctggtatgcagggtacaggcatacaaggaacaggcatgcagggagcaggcatacaaggaggagggatgcagggggcaggcatacaaggagtcagtatacaaggaggagg

SEQ ID NO: 60898 - DNA, 1051 bp, Homo sapiens
atttgcattatgataacatacccctgaggaatgacaaatcgtgaaaatccagaagaatctttcagaatgtcaggtgccattgggggagagaagagggaaagtagaggggagatttggggacagcaaacccttgcaggcaccactctaagatcaccaactaggtcagtctcaggaaggaacatgcacccaatggtgatttgcccaccgaggtcacctgtattcttcttcttatatagcttgtcactctgtgtccacatgataggactgtatgaactccacatgtcacatcgcccgttgtcacattgcttaactaataggatgatacacttaaaatatttcacagcctcagcctttcctacagcctaagtggattttattttggttcattttccagaataaaatctagggtgatgtgaggatattggcaggatggtcacaggaaaacaaatgtgcctttttagaatggtgtcagctgcaattatttgaacttgtctttttttacagagctgttattgactggtgtgcttctcaaaaaatgtgtattaagcaggaaagataaaatctagaggtttagaagaaagagtaacattatattcattcaatttaatgatgtgggttgaattatagcatgccctgaacaagcatgatctaactacaaaataagtacattctcattcgaaaaggagtataccctgagacaacatttgtggtttaaagtcatggaaagagacagttgagacaactcctcatgtttgcctggctttgaaatggtaatagacattcatcctatttcaagtccttatagcaatgatatacagcatgactgactgggatgcccagactgttggttcatccacccaaccagagcttactggttacctgccatatgtgaaccatccagacatctagtatttgggggtttaaaggcaaatatttaaatattatatgcttatttccatctctgttatatggatagtttccagcaataatctgttaagccacaaacttacaaaggttctctttagtaaccttttgactctgctcaaagtaa

SEQ ID NO: 60899 - DNA, 1070 bp, Homo sapiens
ataaacatttataatactattatatactcttcatgaaaatcattttaatagtagctgacaacccaatgaatagaaacttagacttctagactgatttgagttgtagccttgttgattcaatgtattttgcttttaaaggtgagatctcaattaccttttaaggaaaaaaaaaaaagcaccaaacaacaaaaacacctttgaatacattccatctagcgatgcttttcaaactactttgtgtcgtgacattcatagaaaatgagtacagtgttttgcaccaattagttcagctgccctaggctccatccttcagtattgaaggctaaagggattcatacctaagcccttcaatgggaagttctgacaactatatgactatagatatgtaaatgcacttagtttttatctagattgataataaccaatattgctctttattaacttcttctcttgtcaaaatctatgtgaagcctccaaatgagcatggacagatagattttcatctgtaatatcccttggtatacataaagatttaaagactccttgcaatgcctctgtagtccctcatgcaccagcatcacccatattcattcacctcttcatatgctttcatctattcaacagttattttctatgtgcctacaaaatgctgcatataaaacaatgaataaaatagataagtttcttgccttaatggagcttatggtccagtgggggactgaggcatatgttaatctttctgggaagtcttcttaggggaagtgacattttaactagatgtggcctgaattctgaagaattagctggtgctggctaggcaagaattagttggtattagttaagcaaggaggtatggagagcattctagctggcggaacaaatggaaagcattctacatagaggaacagcatggaaaaagccctcaaagtgggaagcaacattatatagtcaaggaattaaagtagcaatatgcctgagacctagaacaaaagagagaaggagatcagaaaggagagaatgacagataccaaatctcacaagactttgtaagccacattaagaaatcagga

SEQ ID NO: 60900 - DNA, 1044 bp, Homo sapiens
tgtttttcccacattttttttttctttctgtggtctcatgttttctaattatttaaagagaagcactcattctttacttggacaaaatattattaatatccccaccatttgggatgatatttttatagggtattataataggtttttatgtatgaatttgactattaaattgaaataatttacactaaatacagatagaaagaataacttatttaatcagaccagatgatatgattaaagccattgttcctgtagacagacagtaggttatgtacttatccagataatttgattactgtaaacagtcaactttgcctgaattatctggataattgcctcacttctccattttacatagcctaaggttctaggtttatttttgcttcccacggaccactttctgcagtgatcagcaatcagagaaaatcagattatcactctgtttaaccttcctgtgccttgggtaattaagtcaacaaattagctaaaggctccaatgcggaaggggattggtagactgtggttaagacacatatttacgaattttcccttaagctgctttttttttttttttaaggaagctttgataagaagcatatgatctcaattatcattaactctttgtggtttcgtgtttgggagcttgaactagactttagaaggcctaggacccccttccatgtgtgcctgagcagtatattggcagaccattcacattttccatctcattatctcacatcgagaaagcagacttaaatcactcttcacacactcattacagactgagggactatacttacttgagcaggctgctttgggattttctttagtgacttttggttatatgcttttgtaatcaactgagcgtctttctttaaggctatttttcaatacgaaattctttaaaatgaaatctcttaaaatctgagggaaaggtatagacataaaaacaattcctatcatatacagataaataagaacttaataaaaatttattgctattgtttcaaaatctaacctttattttttaatgttgttttgtta

SEQ ID NO: 60901 - DNA, 1045 bp, Homo sapiens
tcaaatcatacttttattagtgttgttaattttattttatttctctctgtgtgttttcctctctcatcaatttatctattacctatctcttaatccatccattcatccttccattcaatcttctattacttttaatatttttaaataaactgccttgttgctttgatttgtattaatgtagactggcagaacatgaaatgacagaaagacttttatttgcacggaatcttctgaaatcagctaataattcactatggattctatttactcagattaataactgtgcagaaatgtcattatctgaagagcacaaatctggggatagacagaattttaatcacggactctgtcattgactgactgtgtgattttggttgcttaaataatccagattctagtctcctcaattataaaacaggaataataatggacttaactttattataggttaagcaacataaattgctttgggtattcaaagaagataattaattgccgtggattaggaatctgaaatagaagcttgaattcccaggagtgaaacaaatttaggaatacttgcatgactattggagaaccaggccacttaacaggtatacatatgcccctctgaccacctcctagatgttttctgccatgtcagtagcaggcagaggaccagctggcttagtgtctatattggttacatgtggcagctcaaacaatgtgatgtgaactatggagggagacacttcacacttaacatctgttcttcagattccccaacaggatgcctccaaatatgaaatgaaactcatcaatagcaagctggggaatgagtctaaatggatgacattttggaataacatatttgacacttgtgaggtccaccagttgtggcttaatcaagaaagccagcagatatctacagtattcatctcttaggcaaacacatctaaaaataaacacatccatttgtcttattttaaatccatattttaactttcaaaatatttcaatggatattttgcaacacaattatgctagtttttacaattttctcccc

SEQ ID NO: 60902 - DNA, 1156 bp, Homo sapiens
gcaggaaaataatttaacttattgtattattatattaaaagacattggtggggtagaatataaagattattgcatagtaagttagtgaaggatgactagggcaggaaattaggaaaataatagaaactatgtatcttaatgtctgcaaattcccagtggcctactgagttactgataatagcaagaggagacttggcatctagaagaggtactaaagatatactagaatagggcatatctcaggtggtgtgtattccaaaacaaattacttccattatattttcttcgggtccagtatttacggcattttcatatgttattttaaattcagggattagttatcttgagtcaatagctcataaaggctgttatatgaccttataacatatctggtagaaatgtgactttttttctttttttacatttaaaaagagaggaaaaagtgaaaatattctagtattttgtttgtgctgatgcctagctggggtttagtgaggtggcctttttataggctgtagtaaactttccatgctgtccaagtggattcatgtttctctcaattacaaagggcaattataatatacttatatgtgtgttgaaatctgatgctccataaatataaaatctcgttctttcatgagactgattgaaatctcagtgctgactgagcaagtaacacctagattgccctctcattgcttggatcatatggacaaggcaagccatccatcaacacagactggcacagaggaaaggatattgtttctgatgtgaaggctaccactgcatgccagcgttggcttatgaaattagctaagaataggagtctacaatgaaatacagcagttttttcccctataagacattacagacatttgtttaacgtctgctaaatgatgtttaccccagtctactaaggctcatcattagctcttcacgatgacctagtcaccttccttataaggggaaaatgagaggtaaaatgtacagtgaacatttaaccaccagaagctaggagaggggtatgaaacagattttcctcacacctttcagaaggaaccaaccctgccaattcctcaatcttagaattctaaccttcagaaatgtgagaataaatttctgttgtttaagctacccagtttgtggacttccgtac

SEQ ID NO: 60903 - DNA, 1334 bp, Homo sapiens
tggattctgtacacattaaaggccagttctaaaaatgatagctggtctcttactctgttttttttttaaattttttaattttaattttttattttttatttatttatttttttgagacagagtcttgctctttcacccaggctggaggcacactgcaacatccacctcccaggttcacatgtttcttctgcctcaacctcctgagtagctgagattataggtgtgtgccaccacacctggttaatttttttatttttaatagagacaggtttcactcgttggtcaggctggtctcaaattcttggtcacaagtggtccacctgctttggcctcccaaagtactaggattacagaagtgagccaccaagccccctattctttgatcattcaaaacacatccttatgttgtacttctaattgttggccagtgaggatggatcaaaagttgattgtcgctcaaattttatggaatagtgatatcttgcattaatgttcactttgaaaattgattagcatcactagcttccacagggagttaggataaagcattataaacaggaaagactgtagggaaatcatataccccctactctttttcatttttttgaagcctctcttaatatgtctttggtctcaggaaaaaaaagctcttaacagattacaaatagcaaactagtagaccaacaaagatgaagattaggccattctcgtcatgcagaaaggtagatgctaaattttaattatttcattccatatgtttcctaaacatgataaattatatcttgtacatatattttaccttcatcagactataagattttcaagattagaatccttttctagtacttttaaatatttttctcataaattagcataattttgtacacatacacaattttgttaacagattttagaatgttgaaggttttgataatgcaccaggcaccctttaaagactttcaaattttgaaaatacaattatattcctgcttttacatgaggaaactgagaatcagaaaaattatgtagcattttcaatgttatacagcaagtgaatattgaattcaaaatgtaaagttatgtccatttgactctaaaagtcattctattaatcaatttgatgaagctttgataagcctatttaataaatatttattaattgttacttgatgcattaccaagcacattttaaacttatttttggctcccatgaaagactcaaagatatgattttagaaaattataatttaagtaatacacatgcctgtcagatcaccttacactgaatttcttttcagcatgctgtatcctttaggaatgtatttcgaatgcta

SEQ ID NO: 60904 - DNA, 2254 bp, Homo sapiens
tttaaaaattatggtatttcaggataatcttgacaatacacagagaatactttgtgtcttagctatagtgatgccacctatgtgacagtgtaaacacaatttacaatttacttcagttggccaaattttcttgaaattctgggatttgtgatcatggggatgagggccaagtatataacagttttgtattggatcatttttttcttaaaaatccatatcatgttctatcacaataacataatttgattggcataaaatactgcactgtcagctggagcattctgaatgggtttgtacagagcctgacttgtaggtaatatccattgggtcaataggatttaaagctgttgcattttaatattatatttctaagtaatgctttgttgtaattcatattatcttgattagtaatatataagaattactttttatatcaaattaacttgatacaaaaagtatttattaactcagctatgaaaaaagaactaaagatgtacattagacttttgctttcattactttaaatacctttgtatttaaatattattattgtttcattttttatttgcaatcataggctgataacctaattagaatgtcaaaaatattgtcacaaaactgtaccctctaggtggaatagaactcttctctggtatttaattccaaattcttctttgtcagtactgcatgaattcaggaaaacagctgacaccagataatcaatacttttgatcaagcattctggcaaagagaaatattaaaaggattaatgaaagtactttgttacctcaaaatctgggcctttgtaggacaaatgctaaaatatttcagatactttatgataaactgaatcagtgaactacagatatttagggtattacttctctacattttcttggagtgagatttctcttagaactccagggattgaattcagtcagctaaaaaagagtagaaaagaatacatggagatgaatatattagaagttgtgggtggaatattccaagtctttcatataatttaaacttaagagaaaattgatttgcaagttagactctaaggtatcatttacggttaaattatttttaatacattcagattcttctagggtgggacaaaatctcactgagctggggcatctctattgtatcatcaaaattatacagcaatctcaaatatgcaaagcacattgctttactaagataaattagagtataagatattctgtaagttctgcaaatatgtaggaataagtaggagaaagaagtaaaccaagtggaataagggcctaaggaaacttatggaaatgtggggttaacttttatgacggtagctacaacatctaaagttcaaggaaaaaatggatgtatggggtatgaaattgatttagaaatattacaatatttatttatgtataagaataaagtaattataactaccatattttgaatactcagtatgtgtcagacactgtgagaaatatttggtggatagatctttaacttaaaacaacttactgagttgacagcattatttccagtgcaaagatgaggaacataggacatcatatattgaataacttggcataactgagaagcttcaatttaacatgatggtagaagttgttcaggaagcagagaacagtcaagtcatccattattcctagtaagaagttcatatatagcatgaagccataaggttgcagggcataagggagccagaatccagcaacccacagaattaacctgaaaagaaataggaagaagatgaggatttccactaattatattgaagctataagcatgaattctgtcctaataccgagttagagtgttagacacaaaaacaggggtcatttagtagttaaaaataataatgccagttacattttatgaattactatataagcagaactatgctacacaatttgcattcatgcttgtatacacttagcaaattacttttctaagttacacacacagtgactgtctcaactgggatacagacccaagtttacctgctttcaaagactatttgatttccattatattttatttatttacttctaacagtgaggtataaggccactcatggtccctaaaggttgaggttggttgaaaggaatggcatgagtgacttcaactggcaatgtgattactttatggaatataaggagtattctacacttcaaaaggtgagggaaaatgcttctattcttttgagaagtaaacttttatttttaattattttaat

SEQ ID NO: 60905 - DNA, 1066 bp, Homo sapiens
gacttccaaggctcagaaaagctgctctggggaggaaggggtatggtgtgtctgtgccttacttgcaccacagctgaaggactcctgaaagcagcctgtcctgagttttgtgccctggggtaacatgaaacattaggctaaagtgattaaggatagcttctttctaatgaggactggaacagagtgcaggttattccagccagttcctccctatctcaggattttgcattatttgcacattcagcagttattcttgggaaatacaagtgagaaagagcggggaactaggttgatcaaaatccacccagaaaattatcctgcactatggccgaccctatttgacagaatttatctagtctgtgttttgacattcctccaatacttcacgtggcatcaggtggcatattgaaagtaacaaatatgataggataaaagagctgacaggaagaaacagaatagaatctgttcttaaattaagtcccttgcgactggaggaggtggatgcagttgctctaccctagacaatctcagactgtggctgtcaagcttgtctttcatccttctctagtgatacccttgccttggttgctggcagtggaaatggatgggtcaagtgtatcttttcttgaccttgatgttcaagggttgctaagggaggctagtgagaaatgcacacaaacagctatttagaaagggctctgttgggaagacgacctgctgaacttccagatggaggtcatctctccacatctgcactcatcactgtggaggcagctgctctcactgacatatcacactcctaaagagatgtttgttgttgatagtgaatgttccaattctcaggttcagaaggtcctagaatttaagtactggagtatcttacagacattttatctgatggataaacaaactaagacataaatgtcaaagataataaccttctatcaccacacagttgaatagagacagagctgggaccagtttataccttcagtggcatagatggcctattccttcaagagtcaatctgaatttgtaaagatttacttaagcaagagttgcaaat

SEQ ID NO: 60906 - DNA, 1069 bp, Homo sapiens
tgatatgaaagagtagaagtagtaaaagaaatgttatcacaacaaaaaggaagggctaataaaaattcagataattctaacaatcatcattacgtactgtatatatttgtataggacagactgaaaccatggggttccatgcccctccaggcataccttttgttttatatttaaataatgaaatgatttgggcctttgcattgcattttatgtatctctagaaaacttagtttccaataagaaaggtattaagaaaaacatctttattaaagtactttacgataaaataatactttctgttaaaaatattaatttttatcttgtaaacgtagtataaagctgatgacctggtttggtttatctagctaggcatcttgaagtgtcaaatgcattaaaaatatatatgcatttacacatattctaaactgttgtcaggcatccttctcttcataatttaatttattttgcttttttttaaggagtcatttatttcaattataaagacacctggaagctacaggaaactcatctaacttagttgcagttctgattgctatcagccgtttgctatttttttacctgagtttcctgtttatttgtaaagaatctaaatgacagccttgttcatttttaaattttgtattaggagcagcattcacatttcgtgctgtctttgaattcaagagatgtttgtctcttgggtgtttgtcttagttgaataatattaaagttttgtgaggagaacagtgtccttgttttatttgatctcagttgaagtctatataacatttgttatgtggttatatgaaattatatgaaggtcactgtaataatcgaaatgtgttatcttggaagatagtaccactgagcttttagttcttaaaatttgatgtgcaatagagccacttggaagtggttttttaaacgcaggtttcagtcatctctaggagattgcaattctcaattcctggtttagattttcaaaagttaacaaatacctcaggtgattctgatgtagtggatttagggaccattttctgagaaactttatactatttctcattaaggc

SEQ ID NO: 60907 - DNA, 1053 bp, Homo sapiens
gagtcaggaaagaaaaaaaattatgaaaaataattctattaaaacaatgtttattatattattttcaaagactaagaagcaggatgttttgacagcaccaaggataatctgtaatactaagcaggggaaacataagtgaaataaaggaagtgagagactgatagaatcaggaatgcaagtggccaagcagtttggagcagaggatagaaaggaggaaatgggaatagtgagttcacaagggctttttatctttaccctgatggctatagggattcaaagtcttcaccctgaagccatggaaacctgttgaagttttccttcctactttgtcaaataatcttcaggtgcaatttagtatattgaaatagagctatcaaagaagtcacaccatcgatgagcacatttatgagttctgggcagaattcacatttagaaagcagtgcaaatgcttccatcctctcgaagtaaacacatttccctgagtaaccattgcttattattgggacttgctataatgacagcagctaaagagctgaaatccatttaggcaattagatacactaaagcaacattggagtggcaccagaatggagcttctatttctaaatgcttaaatgcctctacttaaaaataagtcactacttaaaaatacaattaccataattatgaatagctgtacattctagccaccaaaataattcccaaagtagttaaatggcactagtattcctggatggtcacagttagcaatcaaaataaaaacacacctactggaaagtgatgaaccacccatcccacagctcagtgtttttcggtatattaatcactaaagactcatgacttcctaagaacattgggaagcattttcagcaatgcagaatcacttgtgcctgagtaacagcttccttatcaacgtttcagagaccaagaatttaaaatatggagaaaaaaaactcatccatagtgaatttgtattaaatgtttgtattaataaagaataatacaaaatatttgtattaaagaatagtaatctatttcacattaattagcaaa

SEQ ID NO: 60908 - DNA, 1019 bp, Homo sapiens
agttgctaggatcagtttctaaaaaacagcatgagagagaaaacttgttcaaagtaccctcctaaaattattaaggtcttctaaatttatgtgacttattctatcaggtaaatattcttattatcccagatagtgttggcaaagctaatactgcacattctgtctgtacagtttcgaaatttataaaactaaggtttcatttctaatactctcccctgccataacaagatgggcattttccgctgctctttaactcttatagtgctaaacttgtactttttgcagcagtggtgatcagtgagggttttgaatatctctaaaaataaatggctttcttccctgtgctaccagtacatcatacaatactaggcgtatatattttattgaagtattgtttttatgagcttgtttttccaaaagggaataaaatatctacaaagcgttagtgataacatctgagaagtttctgctaactctgaaaatgccgtaactatttacacacaatgttaattttctcctattttagagcctgaggttaatacacctcattcttgtcttacagaatttctataacttgaatgtttatgtctcttctttgagcctctttctctcttttatgtataagttctgagatatgaatagaatgtgaaattaaataattttatttcattatgattcccagtccagtttttcaatgaccctttttatagatagaacattgggctctgaggaacttcctgtttgggtttgtaattcattaattaacaaacatgccccactgataaaatttgctcttgaaaccctgactatcctagattgttttgaggccaatttaaaactgtcataaattcgttatgtcctcaaatttataacttaacaaaattatgaaaaagcaaaaaaccttaatcttcatagacctctgtaatatacagagactggattttggatgccatgtttgtatgcatttctaaattttaaattgtcagacggactttaggaaacacactacccaaggtgtg

SEQ ID NO: 60909 - DNA, 1033 bp, Homo sapiens
aatagtacctggcacatagcaagttaaataagtgttatcacctttgtgccccttccccgcaagaatgcctcaccctagaacagctcattctgatctttccttttctctaggcccctactccaccctgaagtgaatagagtccctcttttcatcattgagcctgagccctgagctgggtgtaggctggaggggttggagggagtttctaagacttcaacatctgatgcataatgtctgcatgctcactcctggcaggagaagcatctgcagcatctggcggaggtttctgcagaggtgagggagcgtaagacagggactcagcaggagcttgacagggtgtttcagaaacttggaaacctgaagcagcaggcagaacaggagcgggacaagctgcagaggtaagttcgggagcatgggctgcagattcaaaatggtccagctgagattcctttccttcacacttacctcctctttgtaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggtaaatgagagatggaacaggtgggcatgggctggcaggtggagacagaagctgggagattggccttacccactgtctatactgtatttctccaaggctgttggtctacaacctgctggagatgtaaatttgccatgacttcctggaggacagcagcatggagaaagatcctagaaaaggtcagacccaactcaggccttggtgtccctggactgcaagtgtggaaggagggaaagcctggtttacctctctctgcatctgagctctgctacccatggagcagatggatggtgggaacaggaaagagcttatgttacacctcattcccatgcttagcccacccagagctaacccctgtcttcttccccaggcctctgacttccctc

SEQ ID NO: 60910 - DNA, 1559 bp, Homo sapiens
gaggttcgaccctgccgtgaagtgatcctcaccgcagtcccgtcttaggttcctgaggtgtctgttgcctgctccaggagtacagcctttgggggaccgttcgccgctccccacatccacataatccacaggatgtgctctaggagacggtttcacttctgtcttcttgtcccaacacgacacattcccagtcacttctcatccccatccctgccccttcgtagattgctccagtccctaataatgaaaaaccctagagtagaccgaggcatccagccctctgccctgagtcctttctcagctattccaagactctgccccaaggctggtgctcagcgccaggagggatcccaaggcccagcattcttccccttccttgcatatctccctggcttccttcacatcttgactcaaatgatttctcttcagtgagacactccctatttaaaatttcagctcttttctcaaactccttatccactagccctgctgattttccttttggcacgtattaccaccgtgtgccctccatgcacgccattcctggttgcaggctgtggacccttcaggcccttgtgtaaactctggtcaaggcaagactctcaatactatatatactgatatacacatccacatttgtttgtgtacacacacgaactgtagaactagcaccacaagaaactgcaatttcctgtgtttccttgcccctccagggtcctggctgaggtggcaggcatcttggaacctgtaggcctgcaggaggaggcagaactgccagccaagatcctggttgagtttgtggtggtatgtacaagatgagagcgagcctttcagaagccagggtctggtcctggctcctcttactgagatacagggcagcactggcagagagcagacttaaggaaacctgtaaggaggtaaggatgttccctgtctctgccctccctctgagcaggactctcagaagaaagacaagctgctctgcagccagcttcaggtagcggatttcctgcagaacatcctggctcaggaggacactgctaagggtctcgaccccttggcttctgaagacacgagccgtgagtaggcaggggattgtagtagcagctgacctgagtggggaaggaaggaggatttcagttaggtctcccatttggctgatgggaaggaggcccagtgttgcagggaggcaggctagcaggccaccctcactcatgtactcattcctggtggctcatctcaggacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaaggtacacccaggggtcttgagtacagggagggaagggcagttagaaaggaagagggaaagagtgagcaagctgagttgtgccagcttgcaatctcccaaaattctagccagaaaaaatagacttctcttggtctttctcccttgcttatc

SEQ ID NO: 60911 - DNA, 1010 bp, Homo sapiens
aaaaacttggctagaacaaagtgagctagctacgaggagaaacgcacagtcaagttgctatgtcacctttggtgagctgtttggcctttttgggtctccatttctccaggaaaatgaaagtgttgggtgagatgaacagttcctagccctgatagtgggttgcttgagtatattgtgattggttgggaagtgttttggaagcaatttgttacagattacatttaatataagtttgggaaatggttttgtattttaagagtgaattcaaagttgttcctataatatcgtctctcttatttgcttgcattaagtatacttaatgcaaggtatactttcatgagtgaaacaggagagaggtgaattactttcctaggcctgcaataacaaagcactatgaaccatatggcttaaaacacagacatttaatctctcacagttatgaagactataagttcagaatcaagatattggcagagtcatgctccctctgaagtctctaggctgtggtttggtgaatcacaaatcctaaataatagcagtaacatcagtagtgagtgaggaactctctagacacttgagagcgattagtcactgcattggcttttatggagacatagatgtctcttgaaaaatcggtaaagccatccaagtagttgaggacattatctcctctgacttccagactgttttttggggagttcttcatttggcctttggggcttaaatctcctagagctgtttagatagtcattacttaaaggattccaggcaactggggtgtaccccatcttacagttttccagacagggcatttccattaagatgccctccaatgctaaaagctcccatttccagtagttttgttctgaatttaatatctaatatggcagacgaaatggattttcttctatttgtgcttagaggagatagtgaactgcattttaaactccgtaagaaataggaggagattaccaagttttcttttaaatgctcaacaaaattaaatgcag

SEQ ID NO: 60912 - DNA, 1047 bp, Homo sapiens
gagttaatacttaaattctcattacttatattaatagcctgtactaagtgaaaatattatttatgcaagtaaacaagtcactataggcttttaagacttttctttaattttagattttgtcatcaaagtttaaattttttacctactgtccacttaaatataatttaacagtttgtaaagtgaaatagttttaagtatgatgtatgatgcacctgcatataaatgaaaatggcgtgcacaaagacactttactatgggaactgtactggaagatttatgaaagcatgtgaaattgcacctaaaattgtgttattagtgactataagcagcaatgctaaatttattgtacttgatgaatgaatgtatttagtcacagttactttggtttaaatgtataaatgtctttagggtttttttttaaatgtgtttgtaatttgtactattgtgggggtatacttggactgcaggggttattgtcaatgtgtgatttgtgtttttattttatagaatcatctaatgtgatataccaatttttataagtgatatttacataattctaataactgtatatttgacaacctattaaaatgttttgcattggaacttttttcattaattgtaacatgctaacgtggtttaaaaataactcattcattcaacagatattgaatgttgtgtatcagaaactataggaatcactggggaatcaaagatgacaaagtgcatcagtggaaagatccatgctttcagacaaattggggaagggattttttttttaagtgtacacattggaaatgataaagtatgtaaaccattttccatggatatttattttttctgtcacataaacaaatctttggaatcaacctagaagggagaagtgggccataggagaaacaaattgatatggctatgaaaatgcagtaacttaagcttaagtaggtaaggtttttttttttttttttttttttttttgcatgtattcgaaatttcagaaattagtgaccaagttattattttcattattagttaaaaaggattcagtac

SEQ ID NO: 60913 - DNA, 1761 bp, Homo sapiens
tcaaaaaagtaaataattgaagttttatttctcctctaaataacttgaatttttttctttaaaaatttatgtatttatatgtccccatttagttaagtggtagtgtaaatgtatgttgttaaaaacagtttctcagaattatagtaagcaatgaaagacaatatctaattaggttgttatcaaaaatactgtgtgtaaattagtccgtaatatagggtttggtgcgtatctatattcatgcttctatttcactcttcctcaaaacagttttatattatgttgaccagtgaaattgtaacttaatttcatggggacaggggcagtgctacagttcctggaaaaattagatttgtattatctttgtttcacacccaccaccttaaaaaaaaatcaactagttatttgtcatttaaaacatttaaaactttgagtcttcaaatacatttgatgttaatgctgccattacttgcacttccattcactaataacatttctaggtagttatcagttttgtcatattcctggaaaatattttggggttgtaaattctttctcctctttttcttctggagttacaaattgaatttttaaatccgagcacctttattgtggtgtggagaaaattatcacaattttatgtttattttaccttctcagccttctctgagggcactttgcaaatacctgagtccaaacagaagtaccaactaaatgctctatgaactctatccttagtaaatctattaaacctgaataatttaaaagatcatgttcattttgtaatagcaaaatttgattttaattttttatttagaattggtgtatttatcatagggacttccaatttttcttcactttttgaatggatattggctatagttttatgttttaacgggaatgaatttcaagtcataataatcagaatttttagttttacttttttcttttacaatatggattttgttgttatttggatagtggttcaataaatcttaagctcagataattaaacactattttgaatcttaacaagatactgaggctttttttgtatgggatgatatcaacctatgtacaatgaatttaataaacttaagtattgtcagattttttgcacattttagctcaataaaatcttaatgttcaagatttttttatctgcatttggaaatacaattttgtaaaatcaatgtcttacctttttgatacaatagatcatgttttgtttttaataaagcaagaagcccttttatctgttgtttttcagggaagggattaacatttaattctgtttgtttacatttgttatcattgttatccaatgctcattttatgttgctttataagtaggcttaggtataacagaataagtatctgtttatctaatctacatgtgactatcttagtctctctcggtcacttaatattatgctgaaatttaccactgtggggatgaatgatcgctattcaccaagtatatttgaacatgtaaatgcttaagaaataagcataatgcggatatagtttgggttaataggattctcatagttttttttcccctatgaaacataagtaatgattttagtgtatttcttatggaatacactcatttaaaaaggactttaagaaattgtggatgtgaataatacctttctctaataaaaatttaaattgtataatagttttataatatttacattaattgatattttaatatggatagacattgcatagattcaaataaattaaaatcaatgataa

SEQ ID NO: 60914 - DNA, 1344 bp, Homo sapiens
aataccctcactttatcattacacattctatgcctgtaaaaaaatatcacatgtgccccataaatatgtacaaatattatctaccaaaaagaaccaactgacatttctgagttttagttggaaatgctgtccctagttattatcagttactcaaggattcctgtatgttttcggggaccgttttatcatttcaatctttgatacatttggaatttatcctgacataagatatcaggtatgaatacaagttacttttttcctgatcactgtttaatcagactaacacaatttaataaataatcttttcccattgatttaaaatcccattatcatatactaaattctcacatatgtttgattctaaaatgtgttttaatatctggtaggatggcaaggttagttctaccttattaatcttattttaacttttcttggctcttatttatttatttatttttaaatatgtgaacttcagagttggcttatggttaaaaaaaattattgaggccgggcgtggtggcttacacctgtaatcccagcactttgagaggctgaggcgggtggatcgtttgacgccaggagtttgagaccagcctggccaacatggtgaaacctcacctctactaaaaatacaaaaattacctggctgtattgtcacgcacctgtaatcccaggtactcgggaggctgaggctcaagaatcacttgaatcccggaggcaggggttgcagtgagctgagatcacgccactgcactccagcctgggcaacagagagagactccgtccctcccccaaccaaaaaaaagttggtatttttattataatctcactttagttgtagattaatttaagtaaaattgatatagtttattatgctgaatcttttttgagaacataggtgtgtgttttaggaatgttttaaagatatcttcttttacatcttttacttatctagcttattttcatgttctttgggggttacattttataaatggggtctttcattacattttctaatgagttatttgtgtttagaaagcttattttctgtttactaatttgtattcaaatgccgtgtcatatattttattatttgtatttgtctttaattttattttccagtgtacaactattatcttcagagtattaactttatctccacctttccaaattattatacctctaatttctttctctctaattgcatttactaggaactccagaatattagatgataataatataaaagacatcatgataaaatatttttgtgaaggcttcttgtattttaaaagaagtgctttttcagttctctcctttaaacttgagactaactcctcgtag

SEQ ID NO: 60915 - DNA, 1336 bp, Homo sapiens
ctgtacttctgttatattactctgtgggaaggatttattcctattactaattttaaatgaatcaatttttaaaaattattaaaatactaagagttctgctgaaacatatggcataaattgtattcacaaggggaatgcattctggaaaagcttttgaaatgatcccattgcctttttaatattgttggaaacctcgtatctgctgtcttttgcttgtggttgaatttatttaattcacctcctgcaagagcttctctgtgatgtttatacttgttataaatttgttgtttaggttttttttttaggtagagttaagaataattattgactttacatttattttaacttttttctctgttttaggattttctcatcttgtttttccctggcaagtacttgagtagtaatatgtttgcctattactaattaatatttttctttaataacagatttatacctaaaactggaagatgtgacccataaatttaataagccctgtataatggatgtaaagatagggcaaaaaagctatgatccttttgcctcatctgagaagattcagcaacaggtcagcaagtacccattaatggaagagattgggttcttggtgcttggcatgagggtaagagtgcttattagtataatatgcacatttctctgtacatgttcttcccttgaaaattatggatgtcattgtagtactaatatatcagaaaataatgtattttggaattgagttgtctgtaactccccaatgtgaaaagtgagggcaaggattaaaaaattttttttttttgttcactgatatatggtcagtttctctggttcgggaacatagtagggtgattgataaataaatggatggatggctgaatctcaggactataattctggtaattttgttttaaagaagtcttaaatttaggtgcaagcaaatattaaatgtaaatgtgatattgtttatgattttcccatgagaaaagtgctaaatatatatattcagtcatttttctgcattttcaaaatataaaagaaatttaaaatgtggtaattgtgtggccgggcacagtggctcatgcctataatcctagcatttcaggaggctgaggtgggtggattgcttgagctcaggagtttgagaccagcttgggcaacatggcaaaaccccatctctacaaaaatgcaaaaaccagctgggtgagaggtagcgtgtgcctatagtccgagctactcgggaggctgaggtgggaggatcacttgagcccaggaggtcaaggctgaagtgagccatgatcatgccactgcactccagcctgggtgacaaagtgagaccctg

SEQ ID NO: 60916 - DNA, 1011 bp, Homo sapiens
aagtatgatggtgttggcaaagggaccacttctgtaggactgaggatagttcttgagctgggcagacatgctaatgacagagtgacattctatctagtcaagtgtttttaaaacttctttgtctaaaaggaaaaaaacaagaaaacactgggcctttagggcatggggggaataaacttctttgtctatgatacgtaataaatacatttttacattgcaactcaatgtttataagacagaccaacccagacaacaatacttagtcttactatctgtgagatagtctcatatattctcttttctctttcatttaggaaacttagttacaacctattaagttgaattcataatccaatgatgggttgtggcctagaaatggaaaaatactgctccactctatacccagaggggcctagccgaaaaggtgtcctttgttaatccagaatttggcattgctttgtaagtgaggctgcctgtagtaaaatgtctttggtcatttaagtaactgagtctcaggattgatctaccttgaattaaactctcttctagggaaagaatttgctaatagcatttttcagggtgaattaataatcagatttatttctattaatgacagcctgtaaatcagtaaaaatctcaatgctcagatcatgccctgtttttctatttacctttttcaaaagcacttgcagtcaagttgtgaaagacatggtatcgcattctttcataagaattctgcatctctaaagcaggttttgatgtttattttttaactcagagggaaagatagaaatgagaatctcaaattcttattttcacttaaaaaaatgtaagattagagaacagaaagaaaacaccaaaccactcttcactaggcttaacttatggttttatttctgaaggcgaataagaaataatttagcagttatttggtaattccaaccatatgaaacataagaaggacctgaaagtaaagtaaagaaaaacacatttggatagtctaacaaaata

SEQ ID NO: 60917 - DNA, 1555 bp, Homo sapiens
ggcacctgtagtcccagctactcaggaggctgaggcagcagaattgcttgaacccaggaggtggaggttgcagtgagccaagatcacaccactgcactccagcctgggcgacagagagagaccctgtttcaaaaataaaataaagagaaaagaaaagaaaaaaaataaaaattagctgggtgtggtgacatgcacctgtagtcccagctactcaggaggctgcagcgagaggatcactttagcccaggagtttgaggttgcagtgagccatgattgtactgctatactccatcctgggtgacagagtaagaccctgtctcaaacaacaataacaacagaaatctatcttatttttagttcattatatttttttggatcagtcttagaacaaatttcttatttgctgtcatcttttttatgttattattgcatcaaagaaaacctagctgtagtaatctttactgtagtaatctttactatctataaccttgactaatctgtagctttttcttcagaatttaaaaaaaaaaaaataggcaagctgagcttatggatgatgggggaaggaaggatgaaatagtagtctcagaggatggaaaagtgaggagatttgggaaacagatcatgatagttgagcaactttaagggcatacttgaggttagtggtcagattgagtgtgttttgcagtcatgacacatgcaaaagagagttactttaacttgaggtgaaatcaatatgtaataagtaggtttattacatataagtattctttttaatataactaaaggctaaggcttgatattagcctgagggttggagaatatccattatcaagtgcataattgagttatgaatacatcttttaattttgtgtgtattatgcttgtctcatctggaagggtaagaatagactccagggaatcatcttctatttttatttatactgaatatcaaagttagacctgtactcattggtgacctaacatggttagcaggttttaatacttatcagtgacttacttgtttaatatttatatatacttagaggtaaaatgaataaatattcagtgagtaccaaatacgtagcagcaattatgctaagtgtaatgcgatttcaactcttcaaaagcagctctatgaaggcaggtttttatctgttttcttcacctgtgtgccttgacagtaattatatatggaatgtatgaaattttattttggaggggatatgggaatgtgtaacctgcatttatgggatgaggactgacactatgctaagtgctttactgtatattatctcatttagtcttcttaatatccctgtggtagagtctgtaattatctgcattttacatataattgaggttttgagaagtgctcctgaggtcacaggctagcaaattatagagttgagatttgagcctcctttttcttcttctaaagcagttgctttaaactttatcatctcagttaagattctttgggcacaagttatggaaatgaacttgaacatgattaagcaacaaggaaaagttcttataaggatatgagggtgtc

SEQ ID NO: 60918 - DNA, 1015 bp, Homo sapiens
aatttcaagcctacagaaaagttgcaagaacaatagaaaagtaacattttgcaaaatttgttttattatctctcaatgcaaataatttttcttaactatttgcaagtaggttgcatacattatgccactttacatgttaatactaaagtgtgtcttccttaagaacaaggatattctcttctgtagccacagcacattgatcaactatgggaaatttaacagggatataatactttaatctatagtccatagtctcactttgtcaactgttccaatactgtaatgtcttttatcacatttgtttttctcagtacaggatctggtccagaatcatttattgcaattagttgttatgtcttttagtgtcctttcatttgtaacatatcctcagcctttccctgtcctttatgacattgtcattttgaagagtacaggccagttattttatgaaatgttctttaatttgggtttctgatagttccttacgatgggattcagatgatacttttccagctggaacattgtgtaagtggaggccaacaatagctgccctttggtagtggattatttctggttgtctgattcaagtgtagtctggcttcttcagtatatcgttttgtttgtttgttttttgagacaggctcttgctgtgtcacctaggctggagtgcagtggcgtgatgtagttcactgcagcctcaaacttcagggctcaagcaatcctcctgcctcagcctcctgagtagccgggagtataggtgcacaccactaggccaggctaattttttttttttttaacggagtcttgctctgttgcccaggctggagaacagtggcgcggtcttgactcactgcaacctccgcctcccaggttcaagtgattctcgtgcctcagcctcttaagtagctaggattacaggagtgcaccaccatgcctggctaatttttgtatttttagtagagacggggttttgccatgttggccaggctggtcttgagctcctggcctcaggtga

SEQ ID NO: 60919 - DNA, 1143 bp, Homo sapiens
ttgtatttttagtagagacagggtttcaccatgttggccaggctggtcttgaactcttgacctcaaatgatccacccacctcaacctcccaaagtgttgagattacaggcatgagccatcgcgcctggccgcaaattgattttaaataaatgaacttaaactcttagaagtaaataggcaatggacatgttcactagaaaggaatgtaactaatatataaacataagaaaggccttcaacactcatcacaatcacactgaaattcaataaatgatgtgtgtattatgcacaagtcaatttcttcatcttactaagtagcatatgtagtttacatatgctgtttaagaaagcctatataagatagccaagaaaatctttatgttatatgaattaagcatcaccttccactctgccgagcataatactgattttgagattagatgtttcacattcattctttctcttcctagttcccattctgtgatggggctcacacaaaacataacgaagagactggagacaatgtgggccctctgatcatcaagaaaaaagaaacttaaatggacacttttgatgctgcaaatcagcttgtcgtgaagttacctgattgtttaattagaatgactaccacctctgtctgattcaccttcgctggattctaaatgtggtatattgcaaactgcagctttcacatttatggcatttgtcttgttgaaacatcgtggtgcacatttgtttaaacaaaaaaaaaaaaaaaaaggaaaaaccaacctgcatggcctgtgggttattttggtcttgtaaggatccatttctttaaaatactgacatatagagttgtaccttatatagaatatagttgtatcttgaagtcaacatattaaattattctcaaaattatgtatttgcagattgtacttgtaagtttcaaagaaaaattaccatcttttcatattgacctggaaactaaataggatgtgattcagctacattaatttcttaatacaatctaggaaagacctgttgtagccttgattttcttgacattggtaatgacactgagaaaatatggcttctgtttttcaccgttttcaatcaaaatgattgataaatgttattctgtttaatttcataagtcaggtc

SEQ ID NO: 60920 - DNA, 1659 bp, Homo sapiens
aggaaagatacctaaaacatgtctgaaaagaggaggacagtttttcacctaggtatctattttctagaagtaatttctaagttgtttcttctatcaatactattttcattacttgaaacactttttttggggaggattattttttaaattacaggtgttaatatcccaataccaaatgttttgaaaactaaagggcaaaaaaaaggaaatcctaaaacagtcattgtcatcatcatagattttatttgataaagaatttgaggtaatgaacatcatactagcattatgtgatgtgatgtgatgtgatgtgataagtttatttacatttttgtcttttgaaaagtgaggcaatagagttccgttttacaaacatagcaactcagagaactattccttagtgtgtaattctggcccccaaatggaacattagttgtttttgttttttaataatcaatgtaatctgaaacatatatagagagacatagattaaaatcaaatttgataaatgtttgagctgctgaatttttttgatttgtagaattttatgttaaactgtttatgtcagtctagaaaactttaggatacttaacccagccctctatggacggagcatcaaatggaagaaggaggtctgagttttttttgtttttagacagggtctcactttgtcacccaggctggaatgcggtggcacaatctcggttttctgtgacctctgcctctgaggctcaagtgaccctcccacctcagcctcctgagtagctgggactacaggcctgcatcaccacacctggctaatttttgtattttcagtagagatgggttttcaccatgttggccaggctagtctcgaactcctgacctcaggtgatccacccgcctcagcctcccaaagtgctgggattacaggcgtgaaccacctcacgcagccaaaggtctggtttttattcctggctgtgtggcttactagcttcgtacaatgaggctagtacatattttccatacatttccatacaatggatatgtatggatatccatacatatgaggctgctgatctcaaaaaccagggtgtttgtaatcgttactctgccttctaagtacttgacatatattaattgacttaattcttagtatacccaagaggtagaaacagtgttatttccattttacagatgatgatactaaggcagggaaatattgagtagtttactcatgatcacattatctagtaagtgacaatgctacgattccaaaacaaacagttggcttcaattccacattcctttttttttttttcagtcttagaatcttttatttaataccttctcatgcccagttaacacaaaaatagttgcagttacatatcgctactgaaagctaccaaactgcctatctgaagagagagtcaaggatccttctcttccacttcttaggagagaatgatagtttttggatgttgaagagagcattcactgagattactgaactcaccagatatactataaagctttctgtctaatgtagccagtagccacatggaaacaaattgggtatgaaaatttagttttcaaccttgagctttatgaaatctaaatatagatcaaatattgctgacgaaaatttagtatccaaattgagatgtgctgaagtgtaaaata

SEQ ID NO: 60921 - DNA, 1051 bp, Homo sapiens
atttattacctccattctctcagagtgggatattttatcttttaaaatgcttaagaacctgaataaaaatctttatttttctttaaaaagttacaaaagtattataaaaaattaaatggtgtagaaaacataaagaagtagcaacccagtagtatctcccagagataactaccattaacaatttgttgtgtatccttttatttatttatttttgcctagaatttatatgtatattatgagatcataatgggcatactgtcctgtaacttgtgtttttcattcaattgtatattacgttcacttaacatttttcaatgtcaatatatatagatctgtttcactgttttaaatagctactcagtatttcataatatggctgtattatttcatgaagccattctcttattgatggacctttaggttatttcagttttcatacttatacaagatgctgcagtaaatatccttatatatgtatctttagctaccagggcagtaatttctatgaggtgaaattgctgggtcagagaccatatccattttctacttttgcagttattaccaaatttccctccaaaagactgtatcaacttatcctccctccaacagtgagtgacatgcttatttcccaacaaagctgtggatggaagtattgtaattgacaatggtttggtccaggtatggtcttgtgggtgcttaactatacattgctcgctctcttttttcctacaaatcattgctttgcttttgtaacacacatatgtagataaaatacttaatgaaaatattgaatgcttttaaatcctttgtctttgagatcttttaatgcagcatgtgataaagacaaaagcatggccatgaagagttcttggcaggaagcctggggggcttatgaaatcgttattgggaggctatttatagggtgcatcttagatttctaggtagtggtggaataggaagaaatattcaagaagtgggaatctggggtatataaattgttctcaagagggacttctattagagtgaggaatgtggagttaagtcctggctc

SEQ ID NO: 60922 - DNA, 1156 bp, Homo sapiens
gtatactggaaaataacattgagcttagaaggagacctgagtttgtacctggctcagtcacccagctcatttatcactttcttaggaaggcctttccctgtcacaccctccttcttgtttgtctctattagagcactgaactcattgccataattaccttattgcagtgattctaaggtggacatctttcacattttaacttttctaaagtgtggatgcattttacaattgatggtgttttaaaataaattggcagcattttttcttaattattggtacttaaaataaggatgtgctgtacagttgatgacatcttagatttgattaagtgcatatttatttttgtgtgttcccacaaaaatgtttacatcattctcatggttttaaatatcagatatatgcaatgattttccaatttctatccttttttaaggtccacccctgtatgttgaaccacattgtttcttcatatcacaaggattacagattcaacatatctactctccaaatcagtttgtcttctattgttctctatctcagtgaatggcatccacattcgtacatttgtggaactaaaacatgagatgatcgcccacctgggtttgaatcccagttccgccctatagtagttactcaagcatgcagtgaagtatgtcaccttaactattcacttgtaaaatggggaacataataacacctatctctgaggattgttagaatgactaagacattgaataaatgttagctgtccctaatcttcatcatacatatctatgacttctctccttcctctgcacatgtaattcatcaactcctgtgatagataggcccttcagagtatctcacatctaccacttctatcttgttgccacttctccaatctaagcccccatttttcttgcctatgcagcaactaatattgtagcttctcctctttcccatgtctaatccagtcacaaccatccattaaatcagaacatgccacttcttaagacctccctcaccccctacctaatgcatttggtataaaacaccacatcattaatgtggtctgtatggttgtctgtttcctgcctggcttctgcccacatttccagcctcatcctctgccactctgcctcccagtatcactcttttcctccaaaagtaactccta

SEQ ID NO: 60923 - DNA, 1052 bp, Homo sapiens
ttacaagatctacaatgcagctgaaaagcaaccaaattattttttgctgaaactagatgtttttacatgagaaatactgtatgtgttgtctaagatgtcagttttataaatctgtattcagatttcattctttgttagctcactttataatttgtatttttttactgtatagactaaatatattctatttacatgtatgtcaactcattacttttttcctgtgaacagtattgaaaaaccccaacggctgataattaagtgaattaactgtgtctcccttgtcttaggatattctgtagattgattgcagatttcttaaatctgaaatgatctttacactgtaattctcagcatactgattatggagaaacacttgttttgattttgttatacttgacttaactttattgcaatgtgaattaattgcactgctaagtaggaagatgtgtaacttttatttgttgctattcacatttgaattttttcctgtataggcaatattatattgacaccttttacagatcttactgtagctttttccatataaataaaatgctttttctactatttgtcttgattacttaaaaaaataaaaatataagtaaggatcaaaactctaaaattttgcatgaaaattacatccaaattgtgaaaatcagatctattttgtttgccattagtcaccattagttatataaattttattgttttaggttagtatctctttactaaattgtcagtctataagataatatatgttgatcccttgctgtagaggagaatttagagtaatttggggtttgtcttggattatatctaaatggattatttgttaaaagtactgaaatgagtataaggcagtatcacccatccaaaagaaaggtctttatagacctgcacagtcactagattaattcattaaaatgcccccaccctgatgtaattgacattacatttcttaacattttaaaatctagaatttctaaaatggaatttaatgccatcacaatttgaaaaactttttttttttttttactatagaagttacaaag

SEQ ID NO: 60924 - DNA, 1062 bp, Homo sapiens
tagtatacagctaacatcttgagattgccttcattatccttgtggtgctgcttttgcttctgttgtttacttttttggtttactctgattcttgtatagcatctttcccagtaaaggtgcatgggagattaaatttttgagttttgcatgtctgaaaatgtctgtatcctcacattcacttgttagactgggcatagaattctagtttggaaaacatatttcttcaaaatgtaaaaattccttttcttctaccttattgtactgcttttgagaaatctaaaactgttttgattattggtcctttaaatgtgatctggtgctttttttttcctcccctttagaactcctgctacatgtatatgcatcttctgagctggtccttattttcttatttttttccgtactgttttcctttagtcttctttcctttttttttgttttgttttgttttgtttttcctgaactgctggatacattttaacttaatctctctgcttttagtatggtaccatttccctcaactgtacctgtacctggttttcacagagtgacactattttactctctagagaggataaatgtcctaaaatttgccatggtagaaatttaacctcttttttttttttgagacaggcagcctgttatacaggctggagtgcggtggcactatctcagctcactgcagcctctgccttccgggctcaagcaattttcccacctcaacctcttgagtagccaggtctacagtcatgtgccaccaagcctggctaattttttgggtattttgtagagacggggtctcatcatattaccccaggctggtcttgaactcctgagctcaggtgatccacccacctcagcctctcaaagtgctgggattacagatgtgagccactgtgcctgacccaacctctctttattttttttgagtcggagtctcactctgtggcccaggctggagtgcagtggcgtgatctcggctcactgcaacctgcgcctcccgggttcaagcgatcctcctgcctcagcctgcctagtagctgggaccacaggcacgtgcca

SEQ ID NO: 60925 - DNA, 1362 bp, Homo sapiens
agggcaaggcttgattcatgtgaagacaaccttgtattactaataatacaagtattctaaaattattttcatattctcagaaccagtttggcatttttctcttggtagtttttgtctgcaaataaaattggtatttgaaaccacagcactcataagcctgagtgtccacttattcagtggcagtgataccctgctgctgcccccttcctgcacctcaagatctgaacttgtaacaatttcattcaaagagataacagtctatctcttacattttcatcatctaacttttatctcatgaaaatatttcttctccagtctgcctttatacatgtagaatggtaatgtaatttctaaagtatatacagaagcattccagaaattaattgctattttaaataatcattttatctcaaaaaataagtaaatcattttaacagttatgctttttctcagttatatattcagcatgctaaagaggacgaaactcgttatcataatgaaatgaagtcttgggaagaacaaatgattgaagttggacgaaaggatcttctacgtcgcacaataaagaaacaacgaaaatatggtgctgaggagtgttaaaagtagaagattgagatgtgttcacaatggataggcacaggaaaccagttaggtctcaatacctgaagctatcgtaaaattaagaaaggataaagttggtaaaccttttatatttagtatctttttattcagctcatggacttctgccagcataatacttgctttggaaaacccagataaaggttcatgcaaactttattttgtgtttaggaactactgaggatcagagtaatccaagcaaatgtgaatcattttacctttgacaaaggtaaatcagactatgaagttttttttatacaggatgatgactatggaaagagtactcttgtttccttatattatggaggcaggagtttcgttttcaaaattgttacaaattgtagaagccacggtgttctgtgatataagtgtgtgtttttcataaagcaggcagaactcatctaggtaaattacagttcctaggtataattcacattgtattcagagttgatggttgtacatataagtgattgctggttttagttgcaactttgtataaaagggactgagaaatttataaacttttttcttactgtcttttttctaaagtaaaaacaaagaaattatgtgccagatttatgcatattattttatgttgcatagaataaaatttttaatctttaattttacatttcctaaatatattttaagacgaaacatttgttctatagcttttccctttttttaagtaaggaattttatttttttctgaattattttctc

SEQ ID NO: 60926 - DNA, 1069 bp, Homo sapiens
ttcttaaattattaacctccaatggtaatataaaaatatactgggtttttttggttttgttttgtttttttttgttttttggtgggtgttattgttgttttacatatcgggacatagggagcttgtatctttttaaaggctgcattgtattccattgtatgactataccataactttttttttttttttttttttttgagacggagtctcgctctgtcgcccaggcggagtgcagtggcgggatctcggctcactgcaagctccgcctcccgggttcacgccattctcctgactcagcctcccaagtagctgggactacaggcgcccgccactatgcccggctaatttttttgtatttttagtagagacggggtttcaccgttttagccgggatggtctcgatctcctgacctcgtgatccgcccgcctcggcctcccaaagtgctgggattacaggcatgagccaccgcgcccggccaaccataactttttaaaaacaggtttccaaacttttggtattatagataatggtgcaacaaataatctttttttaatttttttccttttttaattttttatttttattatactttaagttctaggatatatgtgcagaacgtgcaggtttgttatataggtatacatgtgccatggtggtttgctgcacccatcaacccgtcatctaggttttaagccccgcatgcttaggtatttgccctaatgctctcccttccgttgacccctaccccaccgacaggccccagtttgtgatgttcccctccttgtgcccatgtgttctcattgttcaactcccatttatgagtgagaacatgtggtgtttggttttctgttcctgtactagtttgctgagaatgatggtttctagcttcatccatgtccctgcaaaggacatgacctcattcttttttgtggctgcacagtattccatggagtatatgtgccacattttcttaatccagtctatcattgatcggcatttgggttggttccaagtctttgctattgtgaagagtgtcacaacaaacatacgtctgcatgtgtcctatag

SEQ ID NO: 60927 - DNA, 1109 bp, Homo sapiens
tttttcttcatagctattgttatggtttgtaattgtaactgttttgttgagtagttaagtatctctactctgaatgtaaacatgaaacacacacacacacacacacacacacacacacacacacacacacagtttttcagtattttttctcacctgcgctatgttgacattcccatttctgtgaggtagaatgtagcatatttcttaatgatatctcaaccagattttatagctttcctttatcgtttcagcatttaagactcaatcctctttattttacaccttctgtcttcaaattggggaagggaagaaatgacctctcccatgaattctgttgtcctccaaaggtaaccataccctgtgttctgagccccctttttggactgactgaggtttgggtgaaatgatggttggtggaattagggccggttctggtgcctcctactaaactctgggaggaggtgacttcggcaatatctggtgcgctcctctgactgctctgtgaatgtatattgtgatgtgcttaggtctgggcctttgctataatttcaggatatgaggatcatggctgggatgctattacataatttgtttttgtgattgtcagagaattttccttttcctcattacacagaaaggttcgtgagtacaataatgtatatctatcttttcccttcatttgtttctcagtggagtgtgactagctgttccagtttgtccaacactgaaggggtttccaaagacatgggacttttaatgctgaaactaggaaacacctgggtaaattgggatgagttcattagtgtattgcagtgccttttttttttttcttagcacaatgacagtgactgacaaaatggttatacaacattttttgaaaaaacatgagtgcggaagagttttacaaagactaaccagtcaagttataaatgattataaccaatattaatgattgtgtatttttgttttacttcattaataaaaatttagcataaataaaattagtcattgtgcagcctcagctgtttagtgattaatttccttcactttaggtttctaatttacaattatacctggcaagtggtagggagttgtacaggtagagtatg

SEQ ID NO: 60928 - DNA, 1028 bp, Homo sapiens
tcagtgagtgccccaaattaagttatatctttaaaggagcagtgctctttatataaaaggtatttctgtcaaatctgtcatttaaaatatgtatactgcagcaatactacggtaaaatattagaccatactataccagtgtatggtgaactctctccatatattacatatatactataaagtatatatgtttctttttgctagtcagttaccagcattattcaagaaataatggggttattgacgttaatatgttaggtgaaaaaagtgagtgctgtccttttatgttactgagcttttatcctgcatatcagaatttcctttctctttgtcattggcattaatattgttttcatccctcttacacttctgtgggaagtttgtagacagccaacatgcagaaaggttagcatggcagataaatattttctatttttcttattgatagttacggagaatgctttgttactctatgcctctctaagtaacatgatccttgaatagatgtattaaatatcctagtgttactctctcattttatatgtttaacagttgcggcttgtcccaaactggctctttggcaggtttttttctttctttttttttaaattcattggatgtaaatttcttcctaaaaggagttgtcttttggcattttaagtagtggaaaaataaatttcattatctttcttctttctttttttttgtgaaatcaaaattatcaagaaatgtgtacatatggcttttcttcttagcatttgctacttttgttacttttgtcaccctggattatccagttattcaaattttctgcttctcaatgggcaaagtaccgataagtagggaaggagggaatttagccaaagttgtaactgacaataagcaaaatatagaggcctctgtgtttcctgcttggttctctttcttgagttcatcactaattttatgaaagaagaaaacaaaacagaaaaataaccagcttcaatttccacgtgcctgtttattctggagttaccaggaaaccttaat

SEQ ID NO: 60929 - DNA, 1061 bp, Homo sapiens
gcaggatccctgagctccttcacctggaagtcatccaggtggtttaagattctcaggctattggcaactatgatgtggctcctgccaggttaaggagcattgatgattgatcacaagggaaaggacccagccatatgattgtttctgtcagcttgtactctcctgaaagtcatggttaatgacttgagccaagttaggaaaaatatttccgttactaacaatatagttgttaagtatgctccatggggattctgaaatatttacttgacagtaatgagctttagaatttcattcttttcctatgattcttcatgatcacatttgcatccagatctttgaacactcagcacttgatggagtttaatagactaatggcaagaaaattgctcataagtaaaggaagcagtgaatccatccggtttccatgagcagtcatacctgagttcttcagcaattggaacagatgcgtcactgaaaagatgcctgcactggggtggtcctatccattacattctcttaggaaatgaagccctggctttccttagccctgtgatctattttgaaccttattctagcggagaaggaatagtgtttattgattttttttctcctgttgtctattatttagagattcttaattctactaaaataagttgggagaacacatattgtttgtttagtatttaataaattttggagaatccatataatcactttacagtattctcatcaatcacatgaattaagtaataaaataataaaacatttgaattcttaggaacatgtattttttaatcagaaaatattcacctccgtggttagcaaacctcatatacaggaaaataaaattaggccatgatcacgttagttatctctgagagagcacttttagaaataataatctagaggacaatgatcagaaaaggaagaagtagcaactaatacttaaggatacctacctatgaaagaagatggtaatagatagggtagtttcttggtgcatcagtgggttgaggtgaaataagtttattttatagttttgtttttgtttcctttaagaa

SEQ ID NO: 60930 - DNA, 1053 bp, Homo sapiens
ttttcatagaagaagctgcttttttcaagggaatttgctgccaagctgtctgcagtggcttcagacattacttgaccttttggcatatcaagaaattgtggttttttggtctaaatattaaatacctattttaggaaggctgggtactctatggtatatagtgcaagagcagcagaaagagtcagccttgtgcatttccacatctgcaagcaaatttggtttctgtactgtccatcaagcagatcttacagaatgaattttcatcccctcactagttgccatgcaaattctattaatagttctccaagaaataaatcacagtgacccttctgacaaaggtagacagtgaaaaatagtacaaggatatagtacatccacccttaaccagaagcaaattgtgttttccctttttatactacaaaaagagaaaacaatttacaaaaacagtttcttccacacatgtgttatctatgatgtgatagactgttcttttcatagcccttttctgttttggtgactgcaacggggtattatttggaacatgtagtcttctgtttggacaccatactcgggctgtttttcttctcgcagcctgtgctgctggaaatattcccccgtctcatagccatcataagtaaaggacaccttccactgcgacatgctgcatgctgttaaagcccttcgatgccagccaaatgttacaccgtgccttccaggatatctttaattaaacccttatatatgcatttataaccatctgatgaggggattaatattacttgtgcttaacaaatgtgttaattgagaaaggaaaaagaatacaaaataaacatttttaagtaccttccctatcgtagtcactgggctaagttcacagccaccttgccaggcagaagttaccatccccatttatgattgggaactgaaacttgaggcacttttgggaaactcttcaactgattattcgatcgtgtgaaactgaagcccatgtgcaacatcagctgcctccctgagtttcacagtgaaatgtgaaatatttaagatcctcagtga

SEQ ID NO: 60931 - DNA, 1074 bp, Homo sapiens
aaggaaattcaagtcttttcagagtgaagttaatagttttcttttctttttttttttttttaaagcagatgggttatacatgttttaaaaataaaaatggttactgcaggtttgatttccaaactgtaagtgaagccagactttaaggcagtgttttaatggtttggaaattctagttttcaaatggtttctcctagatggttcccgtgacaacacaacttaagcaggtatcgagtatcatctttgctgtgaaatattcatgccacaaaaattcctttcatttttaattccacgctaatgaactaaggcagaagaagttagcttattcaaggacaaatggacaaatatttcaaaatcattgttgagcttaataaaattgcaattctaagtgagcttttaaaaaattgaatgatgatatcatactttattatattcttaaattgatgttttgttcccttgaaacaagtattatttcaattgctacctggaaaaaatagtattgttttatgatagaaaaatttgaatttcatagttgtagcagaagattgctgttttaataatgcctgttttgtagtgtagttaaaaagctctctcagtgttttggcatatatctttccccactcaatttttcttccaaagaaaaattttattgttaagctaatacttgataaagccattcatttgttaaaagatatgattttttttaaaaaaatagctttcatgcatgcattttaaaactttgttaaaaaattagaatgaggtgccatttaaagaataagcttctaattcattaataaaaattcattaatattttttaattttaaaaagaataattttttcaaaagtgacaattattctttatttgttgtttaatattttattttattagccattgaagaggaagcataaaatcttacattccatgatgaaacttttatgatttgacatctttatccttatcttgagatttgctgatgagaccccctttatcaaattcagatgtctctctctgatattcagtacaatatctgcctctggaccagggttcaaggaaaaggatggatacaggaggtc

SEQ ID NO: 60932 - DNA, 1026 bp, Homo sapiens
gcatctattctacttcacaacacatagttggcatttaaatctttttgcaaatgaactattatccaccagtcagtaggcttctctcttattgtcatgataattatataagtaggtattacctgtattttacagatgaggaagttgaatctcagagaatcagttcacttgccaagtgcccatggttagaaagtggctggttcaagtgctgaatcctgttctaactctactatatcaatcccagctcttcttactacccttgttaattgagtagaacagagatttagacgttgaccaagatgctttaatagatgtggccaaagtgactttaaaatactggaaagaacttcagaagcattgaaggatggaaaaccacagagatacctaagagtttctgtatatatatgcagaagttacccactgactgtcacagaagtatagaatcttggtaggcttagggataggatggctgagtggatgaaaccttctcttcactcctcacaacatgtatttgttgttgttttaaggctaaaggtatttcataaagaaagatgtggtcacaggcccatttctacttgtagatcacaagtccttatgtaaatgactaatccaggggcatatgttgagccttttgagatttggaatatgttgtcactttatgattaataccaggtaatgtacaatagaacagggaaaggaggcattctcctcaagaagacttcatttgaaaattaaatatgctagtttgttcattcatctgctcatttttccattcactcagcaaacatttattcaatacctactatgtgcagaaaaggggaggtcatgacctataaatagtgcttccatgtaagaagttcaagatgtagtacaagaaacagaaagtggcctacaagatagttagagctgtgatagggtagttgcatctgttattcgagcactgaaagtcaatcacgccagtcttagggttgagacaggggactacaagaaagcttccttggcataattgaaatggaagcatagatatgc

SEQ ID NO: 60933 - DNA, 1027 bp, Homo sapiens
tgtggatatgctttttctgtatgccatggtcactactggagaaaataaaagcaacactgaccatcaagacacttacctatgaccctattgtttcttacataagaagaaaggaggctcatgtttgctgcagtgcagtactagcatgaaaactagtgtctctctgatggggaaaggaaggcttagggttggttcttatgagtggcctgaacagatgtcacttgagaggtcctcattcaccaacaaggaaatactttaatgtcaaagaaaccatctctccctcattctgttccacaattggagacccctcccttggatctttaataagttcttatcaaaatgcaattgagaaaaagtgaaaaaaaaagaaaaaagaaaaagaagaagaagaagaagaagaagaccataattcaaagctttccaaattttgttcctcagaaaaaaaaaggtgagatcaataatcaaataagtttggaaataatagttgtaatccattactagaaaatatcctagcagagatcaactgacagcaggtgagaacaagacagatagaagatgaagactctatgataggtccaggttggcccatgggaacagagctgtcccctggcaaagaagggcacccagaaaggaaggacagaggctgaggagaatccagacacctctgaccaatccgctcctatgtcaaaccccagggttcttacccggtatttcttttcttgttcaaatttttcttcaaatttccgaattttccgcttgaggctctggatgtgcttggtgagctgggtgatggtctgtggctccttgccatctccacagctgcagcgtgaagaactccgcggcctgcagtgattacaaggaggaaggagtatcaaaaacagtgggcttccagtaaacagttctgttgatctacaaaccaaaattcctggattgtcagagaagtccagagggaagttcattatttgatgaggccaccatggtagcatctgctcattaatggagactccctatcacaaaactctgttatggg

SEQ ID NO: 60934 - DNA, 1518 bp, Homo sapiens
gaacggaaaatggaatgaggattgtcttttccactgcttatgattttagagtgtggagaaggactgttcatgttccacatgactcagcatagtagcctttgttctgtctgaccaaggatgattgatggtttggagttttagcaaaaactgtcaccagaataactgcacacctattactaaaaataataattccatagcagtactttattatatttttctaaaatcttgatcttcaaattgaactttcaatttgggtaagacactaatgtagtatgtctatttagagtctacaattattctcatgcagaattctgcataatctataggtctcttccaaagttgaagttgacataggtcagagtcaaccagaacctgaccttttcgctcatatttccagacactgtccacttgaccagaagttttcaattaattggaaatgcttatcaaatttacagctgtctgagatccctaccttaaaattaaaaattaaaatataaagatgaggcctaagaatccctacatttgaaaaactcccttgatgattctgaagtgcaagaaggttcagtaatactttatagaacacggtgccactccaggggtgacatgaaatatgttcctgctgcaggtgcgatttagaaatagatttctagaataggaaagcatttcaggtatcctactaggagcatctggttatccataaaacttgatatttcagcctatgtgggggcaaccccagatagtctttgaaagtcagtaagaagagatcttcattcaacctcagaagtgcacagaatttccaaatatcttttagaaacttaattcattatggtgtgtgtgtgtgtgtgtgtgtgtgtatgtgtatgtgacatcgagacttctaaagccttctagagcctttatatatattcaggatgtaccatctaatgctttaactgaaaaatggctactattatggaaagtagtacttcatttatttgtcttaagttggttcctttaaaatagaggttttcaattggggtctattttttgccgccctcgaggacatttggcagtatctagagacacaactggttacaatgagggggtggacattcctggcatctggtgagtagaagccaggaattctgttaaacatcctgaaataaacaggaccacccttctccctcatcaaagaattatctggttcaatagtgctgaatggtcaatagtgctgaggttcagaaacctttgctgtaaaagctcttaagtgaataacatcaacattagctaacaatgacctctttatttgcatcaggcattagtgaatggattgggcattagtggatggattttcttattctgcacaagaactctatgatatagttttcattatcacccccagatgaaagatgaggaaataaacttggagatgtaactggtgatatggtttggctttgtccccacccagatctcatcttgaattcccatgtgttgtgggagggacctggtgggaggtaattgaatcatgggggcaggtct

SEQ ID NO: 60935 - DNA, 1025 bp, Homo sapiens
tttcataagaatacctggatataatatgctgtcacttaaccataaatagcaaacattcaaaggataaattcatgtgacctagtgggtttcaaattcactatagacttgattggctttaacttgggtttatgggttgccaagatcagttccacctagtaagagacttgacatgctcccctgtcctagacaaccagttgtaaactgcatatgcagcaagaacgcatttcatggtacccctggggacactgtattctagatactgttccagaaccttcttacagatcataattaccaggaagcttttccaatgtggagattctctggcatcctctctagacagtctaggatgaaagtcctggaatctgtgtgtttcataaaccctcctgaataatagaaccacactattcaagtggacagtgtcttgaattgggagataatgtcaagttctgtctgactctgctgtacctcaattttgccaacgggaagaggctcacagatcacatgggacttgtaactcagggtctgtggccagttggctccatctgcttacttatttcaggaggagaaagtccaagggttgggagtgagtgggatggggatataggcagatttgaggaatagagggcccttagggaaaaattgatggagaggaaattggctgcaaggcagcttggggccatacaaagggtaaccaactggattggtttgcacaggattgtcctatttttagcactaaatatcccacatgctaggaaatcttcactcccagatattccaggacagttggtcaccctacttgtaggttgcaaaccacaacctgtgagacagaagctgttatagactgagtctttgtgtttccccaacaacttattaaaatatatgttgaagtttggaggtgggaccttgggaaggtgattaagccatgggattagtgcccttataagagtacagaaagctagcttgccctcttccctccatgtgaggctgtaagaagtcagccctctgcaagctggaagagagccctt

SEQ ID NO: 60936 - DNA, 1135 bp, Homo sapiens
gcctgatttgttcattccataatatatcaaaacatcacattgtatcccataaatatatacaaatgtacaattattatttgtcatttaaaaatctaattaaacttaaaaaaaatctctgaaaggacacctagagttagcccaattcaaaacttcctacagagttagaaatgcggaagcaaggtgggaagaaaagattatcatccccttttgaccctcactgttgagtctaccaatttttttctcagtagttttagtttacaaaggaaactaaaagaagttgatgtggtgctctttcatatatagtctgggagttggaaacagtagtttgaggacccaatatggctttttttttttttcagggaaggagagatttattcgttttctttataaatatgttatttttcttaattgggactgaagcaaggaatgtgatctacaagcatacagagagtaaaaacaatcattgttcttcattttatctttcaagtacctttctgatctattgaatgcttatgattacatggactggcagactgactaagaccaaggattaaggtggatgagacactgacagatctcaagtctagaatattttccagtcaggattcaaaagatcctaacccccaaaatctgatgtcttaccgagacagagtcatacagctcaggtgaatgtcagtagggagatttaatcagtttttttctggaaaaaactcctatactctagtcccagagacaacaaaaaatgtggaataaaaaatgcaattcctatcaagagactcaaagtcaaaaactgggagctctaggctggcagaagaaaaatgagactggcaggtgtcaaatctatactcatgccaagtggaaacaagaagttagtgagctcttcggcccactaggaaagtatgagaaacacacacagagacaacatacatggatacgctacaccatgtatcactgtgccaggcagagaagacctcgggtcaagtgccagctctggaatcaagctgagccccatctgtcagtcacagagcaagtggacaaagaagtacaaatagtagaagtgaaataccagatgtaaaatttggggaatgtataaggtacgtaggtagcatcttgtaattattactacgtacaacat

SEQ ID NO: 60937 - DNA, 1075 bp, Homo sapiens
actaatacaagaaggggcttcctgaagttagagtgggctggctccttgctgctccaggggaactggcaggaactgatgggattctgttccaggaggatgtgaggcactaagtagactggcaaggcagagacatatgggcatagggcaatatgactgggatccagtgactacacaatggtatggagtggggacttctaccttggggaagctgaggcaggttgatgactagtcatttagatttagtagttgtatcgaagatggagaattagctacaacatggctggtaaccaggtagaacatatgatcttacggcctgactttctcaaaatcataaatgtagttgacgctttgtgcaggatgttagttttattatcaattttggcacagttagatggcaagatgcagagtttattgaccatcagtccaggttttgaactaatagaatgattcaggaccctctttcttcattcctttaacaaccgacattggagggtgactctgcttgagaggccatggacttctgtagttgtggatgcaaaaagagatgagccctggtgtttgggcttgggacaggcatgttatctgtcctggggaaacagtgagaggaacaggcagtggagtccttagcatgcactggcaagagcactgcctctgttgtcatttttttcattcctgcatcccagtgaagcatctaaggttaacaatctgaaaaatgagggataatatgacccacctattaggttatttgaaagattaaatgagataatccttttaaaatatctactgtaatacatagtacatagtaaaagctcaataaatgttagaatgttagctgttagtatggttattgtatcctaatacattatgacaacagtgagaatgaaaatgaaaagttcaggctgggcatggtgtctcacgcctgtaatcccagcattttgggaggctgaggtgggtggattacctgaggtcaggaattcgagaccaggcgggccaacatggtgaaactctgtctccactaaaaatacaaaaattagacaggcatggtggcaggtgcctgtaatcccagctactcggg

SEQ ID NO: 60938 - DNA, 1051 bp, Homo sapiens
acaaaagaactaagattatgttttcaattatggacgtactttatatgcatttttttcttgatgtattactgatccagtgagcaacttcaaacagtaaaagcaagaaaaccagtacagcttattgactttgaaagcactggaaagctaaaataaaccttgaatagaattccactcccttttcagtgagaggaagacttaggttctgattatggctttgagggctctattcttgcagtgtgtctaaagcatgaattcactgagatcctaaaaattggtcttagttagacaattgttttgacaccttagttcatgttgtattatttctcatgcatgatttagtagctccagtttacatgttttacttcagtttttgattaggtgtgggtttgctggaagatttgttcctggtcaggaagaaaagtggtcctctgggtttatcttccaagttctccttcactcttccaagataaaatggtgaagattcgggggacagggctctgagaaatgcagggtccttgaaagtgagattagctgagtcaaatgtttgggtttactggtttcctgtggtctatcagattctgatcctcctctttgaattaacaagtctattgttaaggcttaatgattaagccgatgaaaaatggtatttttaggagggaacctgggatgtctgtaaaatcactttatcactttgtttttggaaatatacaaatatattcagcttaaatactgacatgaaggaatcttaaaatgaagtgatgtacttagtttgcctgggcaatacatctcagaaatggaaaatcctagtactcagacagaatttgcattcaaaacaatgtaatttatttgagtcttttaagttaaccaatggagaatttgataatttggtattgtagcactcagggccgcattgcataactgatattccatctgtgatggaagttacagaagaatcctccttgaaataataaacacaagcgtatcgatggtgttggttgagtatagcaatggaggatggcaaggactgatctctgcttacatgctgcttgga

SEQ ID NO: 60939 - DNA, 1105 bp, Homo sapiens
cataggtataacacatcattgactaggactgtttaaaactagtcattgccacaataacattttcccctcacctcagtaatatgacccatatcccgtgcttctctgggcatgaccccatagccctcaggaccaaggtgctatatcctgagacacagacatagcaggttctcaggaaatgtttgggtgtggtcttggcctacacggaggagggacttttctcccctctatgttctggatacaagaagagctcctctgcctcctgtccccaccccattcctacatccttctactcacacccacttattttcttcgatgcctgaaatttcacctagagatgatttctttggatgaaggcctctggtagtgacccttattaaattggaaattaaaaagtttgtgcccttgggaagtggattcaaattgtcatgaatactttaatatgaattattttacctaacctattttctaacctgttatggttatggttatgcttggccagctgggagtcctagaagagtcaaggggaaagggaaattgggagggactcaaggacagattttattttcttcttggtttttcccagccctggcactatctatgcagctctagacaaattcaatttctttttccaccccaatgttttcatcacaatggccttggccttttcttccctatctgtggcaccttttcatctaatatttttccatggtcaatcgtgacattgccccagctaacttgctattttaaatgaagcctgcaataattctgattagttatcattcaaaccagtggttctcaaagctaactgatcatcaatatcaactggggaaggggactggagcttgtgaaaattgcagtctcccaggttttatctcaaagtgggaacccagaatgggtgattgtattggtgtcaggacagtgctgttttggggtttggaaacctttaggtcagtgttaaatgtttagaaacatagtagttctataggtaggcagtctgttttaaaaatccacattcctgggctctgccctcagagagttgatgtagtggggctggagacttctgttttgaccaggtacttcaggtagtgctaatgcaaggggccac

SEQ ID NO: 60940 - DNA, 1136 bp, Homo sapiens
tcttattagaaggacactaatcctattagatcaggagtgacctttatgacctcagctaaccttaattacttccttacagccctcatcgctgaatacagctacattggagattaaggcttcaacatatgaatttggtggctggggacatcaacagtcagtacataacagggtgggtcagtgattttctaaggaagacaactgctgctaccagaaaagggaagcagggcttgaatgacgaagcaataaatggcctaagtacttgctgtcaagccctggactatagtcactcaaaatttcttgttagatgtggaaatgtagatgttaacaactgacagagatgcagtggggctaatattctcttatgaaagacatggagactgacaagaatgcatcactcttgcctctgagctgaaagaagacctttgcaccagcaggtggcccctcaacaggttgtttgggttcttatttagtacacacatgaaaaagtaagttgagcctctgctccataccaccaattaatagcgaaaatagttttatactggaaaacctgtaaagcatcagatgtccaccagtgccattaaaattataactgtcaggaaagccagataatatttaaactgtgcactctgatctaccctccaaaatcgatccattgcaaaatatgatacgacgtaattggttaagttaaaacttgccgtatacaagtattggttacaacacaattaaatgttagggcaaatctcattcttccggaatagtatcttcgatattaaaatgttgtttgcatgtgtgtggcagggtcttgctctgtctccaaggctggagggcagtggcacaatcatagctcactgtaacctcaaactcctgggtataagagatcttcctgccccagctcccaagtagcgaggcctacaggcatgggccaccacacccagctaatttttaatttttttgtggagactgggtcccactctattgcccaggctggtctcaaactcctggcctcaagcaatcctcccacctcagcctcccaaagcactggcattatagtatgagccactgtgcccagccttgatattgaaatatttgatctgaatctcttcttttttggcagtaattacaggcctggtttggtt

SEQ ID NO: 60941 - DNA, 1053 bp, Homo sapiens
ggagtctggaaatggaaaacactgataaatattgataaatattggcatttatttaacatttagttcgtgttgtctgtgcaaagcataattgagctcactgtttagctaaatgtctgctttattatatctctgctgttttaaatgtttgggaattggattgaaatcacagtgaaggctctaaggcattttgcttatctagaaactgaatataaaaccacagagatgacaattttttatttcttttggcgttagctcccaagattgtcgtgttctatgcatatagatgacaagtaccttctcccaaggtaaaggataaacttggcaagtggccagtgggttgaaccaacaattcttcctgagttgagctgagatgaggccccaaacactggcataacctgaaatttgatttgagtgatgacttataaagagacagcattaaacaaccaactcaccaagtgagtcatctttgctgagctgtgcactttcattatcctcagaaatctattaagaaatcatcttattgtttgcctaatgcaaatggaaatgcctagcatattgattctactcccagtttatactctggataaagaccagtctacacccgggaagtgttccaggatcctgatggggcaaaattgtgaaataggcagaaattgtcttccagcagctcttctcaagcccccttctagtgtacatttacccctacctctcaaaagccaagcatctcctctcctcctctcctcttccttccttccttccttccttccttccttccttccttccttccttcctccctttctctctctctctttccccctctgtctctctgtctctctcatacacacacacacacacacacgggtcctatggacatggtggctctctcactgggtgacactttctgctcaaaaactttgctccacttccttgctcccttcctctgcacaaaactaatctattatctaagtttctcttccttgggccttggtaaatgtctgaagttattttgacaaagacggatttgagtattgggcagtgtagttaacaagagta

SEQ ID NO: 60942 - DNA, 1013 bp, Homo sapiens
tctggtgaatacccttggcagctacatcagcaaacaagtcatgaagtgattgagcttgagctttagttgtggcggccattaaaaaaacagagggcagtccgggcgcggtggctcacgcctgtaatcccagcactttgggaggccgaggcgggcggatcacgaggtcaggagatcgagaccatcctgactaacatggtgaaacctcgtctctactaaaaatacaaaaaattagccgggtgtggtggtgggcgcctgtagttccagctacttggaaggctgaggcaggagaatggtgtgaacttgggaggcggagcttgcagtgagccgagatcgtgccactgcactccagtctgggcaacagagcaagactccgcctcaaaaaaaaaaaaaaaaaaaaaaagagggcagaagcctgaaacagcaggaaaaaagaattgccagcacttaatcactgagtcactataagagggtgtatacctggaggttgatttgtgtttgtgttacaaggaatagaaattccaatacgattgaatgaaagctgtttattctctcccataacatggagactgaaggtaggtggctgtgaattcacataaagaaactcttcctatgatcttcagcaaaatccagatgggagtatcaggctgctgggagtcagattaatctttttgaaataaaaaagcagcaggtatgaatacaaaataagcaatgtttccctcacaaaaaggaaggggctggcagaatacttttttaaaggaagtttcaggggtttctcaacagtaagtaatacttggctaggtgttcatcatcctttgtatgacattgagagagggcatatcaggcaaggaccaacataaccctctcagcctcagaccactttaaattccttgttgtctattgattgtttctgccactggagttggaaagtgtgaggaataggaaatgtattttgtaatggctatttggtatttattaatatgatgattttgggcaattaccatatctcctttctc

SEQ ID NO: 60943 - DNA, 1029 bp, Homo sapiens
aggtagtcttcaataaatttaatagtttctgaagaaaatacctaaacagagcattctagtatgctggaagtggggaggggagaagcagctgtggagggaagaaagatacaagatttaaggaagcttctagtatagctaaggagattgggcagctaaaataatcaaggccttgtattacaagggtcaaatgcgtggtaaagacaataaatgtggtcacattgtatattaatttggaattgagcaattcaaaaaaatttttttttattatactttaagttttagggtacatgtgcacaacgtgcaggttagttacatatgtatacatgtgccatgttggtgtgctgcacccattaactcgtcatttaacattaggtatatctcctaatgctatacctctcccctcctcccaccccacataacacttatatttttccctccaaattaaaaaaatgtttacaaatttcacaattggctctctgggcaaactgtaaattgtgtttctgtcgagaggaaatgttggtatcactttagctggttatgtagaaataaccaatgttctttcttagaattgcttactactgtttatgtacatatgattttgatgactctcgagctattattttaacactctctattaaaataatctaaaatgtttttctgtaacaaagctaagtgttcattgcatggtagtgctggtgtaagtattaatgctcatgtttaaaaaaatgcttggaaaccaagaacttgggaatagaaaataaaaagatttaataaaacacatgaaagattgtaaaacaatccttattactcaagggtttttgctaaaaattagggataatgttgaaaaaacagattcctagctgcattactctaatttctgcttccattgccacatcatcgccttctcccacattgacccttctgcctcccttttataaagaacctcgtgctggccgggcatggtagctcacgcctgtaatcccagcactttgggaggccgaggcgagcagatcacgaggtcaggagatg

SEQ ID NO: 60944 - DNA, 1033 bp, Homo sapiens
taaaagaaaacaatttggatttttttaactatttggtaaaatacaaaaacaggagaaaaatctagtcaatgatagttttatataataagaccttttatccttctaatgagaataattttattatttttctttctgattatggaaataatacactcactggggaaaaatgcaaaaaaaaagaaaaaggttaaaaaatttaccatctggaaataacaaccattgacattttgctagatagtcttccattttttttcaatggctgttacatgtaaacacttttctgttttttcacaaagatggaatcactttaaaacatacagttttgtaactgccctttttgccctacctgtaattgggtttacataatgatagtgaggcaattatatgccactaattcaccaggaccaatggacatttatggtggcaccacagtgttgctactgcaccttattgctaacaattccttattgaaattgcttgctcttgataggctttccacaaggtgctttcaggcctctgaactgaggatgcccagtggattttagaaattcctgagtgattgtcatatatgttgggcctgggctgctacttatcctggttattaagaaatatctaaattctcaggctccccttctttaggaaggaacaggctgccccttggaaatggggcagtattttttgagaaactgaaattagttttttaggcaaattgaaaaagtgcatatcttgcttcccaccattttgcttcatatcctgcttagcccaaaggatttagaaatccttttacatttatccacatagctcagttacttttcagaaacatcccacttcccagaaataccagataaatatttattgaaacccatgtcacgatgaattttctttctgctaataataatattatcttatgtgccgtaggagtggggcactttaaatttagaaacaaggatttttctgcaggaagacttgccatgtgggttcagcttgtgggttgttcgtcaattatcttttttttttttttggaaataaatcc

SEQ ID NO: 60945 - DNA, 1054 bp, Homo sapiens
tcccttgctaaagatatgaggtgattttttcttggctctttattgtgggaacctggtgaggttcctggaggtaaaatctatctatgaaagttgggtaggcctccctaagacttgagtccccaggttttctcattctcatgctagcctacattcagcctagagcaatttatccaaataactatttaggtagttctactaatgtatgactccagtaacttctgctctgggctagctaatcttggctgtgtttcttcatattctcatctctccagatttcagagtggctgtttatcctgcgacttcaattttctgatggtccaagaaaagttattgattttcagtttgttcagcgtttttttttcttgttctaaagttcggagcgacaatttctaagctcttacttgtcagaactgaacatgaaagtctcttaacattcattttttttgtgtttgaaaacttcttcaaacaagaggcaatgacaaatggtcctctagaaatttaagctacagttattgttaaaattttgtgaatttgatagattgttatcatcttggaaaggatggaaggaatttcagcattttgaagtgtaaaagtagagactgcttctgctgtctgatgggctagctaaagatgtgtttccttctgatctgaggtgaagctaattggtgagatataatgtgtttatcataattaaattttcagtgtagcaacatgagttatttatccccctctggacacttgcagagatagaccattaaaaatcttctaccttttgcaaaatgtacaggaaataaaatagcatttcacctggtactttcctgatctgcaggtatcaaacaaagggatgtgaaaatgggaaatagcagcatatttgaactgtcaggagatacactcaagcttagtggctggaaaattaccacaagtgtgcacatgcagtcttacagaggacattaacaggtggtagggtcaaggcaatttatttcaaagtgtctgcagtcctcagaaagaaataaaatcacaacttgatgtgattagtgagtatctaactaggctg

SEQ ID NO: 60946 - DNA, 1035 bp, Homo sapiens
tcctggaaattgaaatcatttgaggtaaataaaaagcagatcatctttaatacaaaaaatgtggtgactctaatctgcttacgtaggcacagtgattggggggcacagcctcatgctttggagtaattgggctctaggcaatggagtgtgatgttgcacattaggtgaaatctaatcctgagcctgggaactcacactgttagaaaatgggctactctgttgtatgcaatgggtctaaacccttatttttggcacccggtggcagaaagccaagttgttgtctatggtcttctgttctagtcagtacccacttttatggatcctagcaaaatgctttcacactttttctccaggttctttttagctctttaaattaactctcagaaggtgtgagttagcagagatggaaaggatttggttaggtgttaattctttctgtcttgtttggttagagagtctcacatgtatcagaatgagtcagattcatcttaggtcttagaatctccagcagggttgcagagatggctagccatccatcagagatgcatattctgcctctacagtgtagactcgtggctggaaggtgctgccccagtgagggctaaattgtccagctgcccatgcctgcccccccaccaagcccttgtatctacctgtgaccatgtgactagttctcactaatggaatgtgagcagatgtgatttatcacttcgaggttgatgtgattatgaagcagatgtgccttactcatcctctccttcacatctggaccctggaagtgaaggattttgaggccctaaaggaaggtggagccacaagatcaaaaaagcctggttcgtaaatagcttccagcccagcacctgcactgaactgtctcatgagtgagaaatatgttcctattatgtgaggccactagattttggagtttatttgccgcagcatacagcattactttaacaaatatagccatccaagtttattcctggaataaaatagtaggtacccaatcaatatttttgaataaatgaatgattg

SEQ ID NO: 60947 - DNA, 1124 bp, Homo sapiens
gattatatttaccttaagattattaaccttatctgcatacccataaacactgataattagaaatttatgtatacaattaacttgtgggacattcacctgaaagtaaatagtccctcatgaatcaccactatcttcactatcttctatatcaaaacttattaccgataaagaaatcaacacatttgtttcttccaagcatctttaaaactcaacagctttgtccagctgatggtgtttttcttccatcagaacctgtagctcccacctctgcagggacttgaagtactgtttagattttattccacttggggtcagtattgtgctcctgattgctgctgtcttcttgtttttataacttacaaatattaatttgggaatctcagtggaaatatccatccagtgaaaacatgggaagatgcaaaggtgatccagctctggctgctgtcactcccacccctgtcttgatggctagctacattcactttgtagcaaactagggagccaattcattatcactcccttgtttccgtgtcttcttttaatgccatctgaatgttttcatcctcttaaatgctgttgagacatgacttgccatgacagcttagcatctacacaattgtgacaaaggcttagccaaaagggggcctggacgcaatattttagctccagctgtttctccttattgctattagcaaaaaattagtgtttttctttaaaggagaaaggttacaattaattacttgaggaagaaaaaaaaacacaaacagtggtctcattcttggctgcacactgaaattatctagggataataagtaaaatactgatgctccggccataacctagacccgagatgggaatttccgagaaggagagggtgaggggtggggtggtctcaggtataagcattttttaaagatccctagtaatgtggttaggttgagaaccaatgtcctaacaaaatttggagggctgaagctgactataaacacagaagaattccagagctaaggcaggccaaaaacaaaaagccagaaatcaaattggattctgttttcttctgttgattatcagtgtgactttggagaagtcatatcactaccttgggttcttctgtaaatggcata

SEQ ID NO: 60948 - DNA, 4713 bp, Homo sapiens
gccaagtcaggctgtgttaggtagaatgagatccacctgtacctagactgacttgctgttcctgtcccctctgcagaggccttcaccacggagaagcaacagtcctgacaaattcaaacggcccacgccgcctccatctcccaacacacagaccccagtccagccacctccgcctccacctccgccacccatgcagcccacggtcccctcagcagccacctcgcagcctactccttcgcaacattcggcgcacccctcctcccagccttaatgcatgagcttagtctgaatttcaagttgggactcatccaatggagccgtctactcaacgccaaaggcttccttctctggcatatttggatatgacttatttgcactgaggttatctaggcttcactatccattgtgttgtaaatgtttgtcagaaatgcagccagtgttgtgggtctacaacactaaccagacgactttttccatcagtgttttacttgaatcttcatgtacgtccattccctggctggaaccttcgctgtttggtatttggtatttcagcagcagtgtgcaatttttgcttggcccagagcttcattctcctggcttttaggtttgtaaaagaaaaagggatatcttttttatatttttttccatgaatctgcagaaaattactgagctgttgttaccctcctctcattataatagtgtttaccaaacataccaataattcagcactacaattcagacctttgaaaatctggctttcagtgtagaacagaaagttagatgaatcagtgcccaagacatattttctgtttaacagaactttctacagatacattttttacaggttattttcattgtgttattgacatccatgtctctcgtaaaacagatggcccaaagtaatgaatcatgtggctgtaccttctccacataaatgggatggataattatcgtatattaagatgtgattctcttttttatccttaatgttaatctacttaacctggccccctctaacatgagtcgataaatgttgtcctactcaccggtggtttcaatggctaattagaatgtgttatttgatttctgctgcagaaggcagtgtgattgtaacaaaaacaatgcggcttccccctttcgtacttcatttgtgttctcttaaaatagagtttgaacaaatattttaaaggtgcaaaataccattagaaaatactatttgaaatggacattatcgcattatcttggcataatggccagaaaatattgtattgcttggcagaaaagaaaataaggtctaaaggaaagtagcacattagcattgatggctgttcatttcacccagtataagcaagtgcagtgtacaaagaagtatattctgaatacattatttccattcatttagcacaaataaatcatttggtttcactttgcagtggaacactgagtcactcttttcttaacacgtgcaacatcttaatttttgtttttcagcagttgctgttttgtactttggtagtaaagtgatttttaccacctgtgtttgcatatttatatatgctgtggatgaaaataacttactagagaatgtatattttatgacaagaatgtgtatctgttggatataatcagagaactgaaaagtaatttatcagtaatttttaagagtccatgttttgtgacaaccatctctaatagccaactctttattaaacacactcctaaaaataaggaaccatgacattgtagatatttaatattgtacagtatagaaacctccatttttgccttcgaatgcatatttaagagttaacagaatgaaaaaaaaaagtcttgttggataatagtgtttgactagcgttttaagaacttgagagtaaaagcaacaataagattttttcacctcttcctgcttccacccccaaactgagaacatcactcaattgtttggaagaaactgtaggtctatataaattttatttataatgtatgtgtaatatacataatcataatacagttctcagatgcagggaagaagtttggcatttaatcattgaggctttaggtttttgatgtgatcagactgggccatgtcaaacccggaattttcaccaacagttcactcaccctcctggtacattgccattccaaggaattctgagagtaggcaaacaaattttgccttcatggtacagttctcagtttttcttataggagaaatatggtatatgtttataagaatcttttatgagattatagatttcaatgctgtggatagtgtcttgcacccaaacaagaaagtccataatggaatgatcttccctcagcttcctatcgatttagttacctcttgaaagcacaaaaattaaaacattgccatatgttgaatttttaaaaagcacttggagtgagcgaacatttcctgataaatgccttttagagataggttcttgatattcagacatctgcagaaatgttctggttcccaaagtcatttcacttcgaaataaaacacagctccttcaaacagcactttttccacataaatctagttgcctctccctgtggacattcagaactgatagaacaaacactactcttttgaatttgatggttcgtgtcctttaaagtgtttgaggacctatgcagagcctgtaacacttgggtagtacctgctaggacaatttcttggcaattgtcttactactagggatcagtaagatttagattctgagcccataatggcaacagccccctcacctatgggaagctgacttccctcagtcgggcacttctcatgggggctgaacatggttcctgccattctgttacccactctcccaggtgagccctggattggctcccagaaggcctttgtaaaatcagtagccgtcctgcaggcaggtgggagcaacaggggcttcagtagcttcattttcctgtcttgcagacagagacccttggctaccactgtgctgctaataggataagtactctgttgccagattaccatgccttttatacaaaaccaaattaacttacctaatacctgacacctctttgggctctgaactgctttctctcatcaagcatgctagcactctagacagaattctagaaatttggcagatagtggaagcctttaattgaacttactccttcgttgactgaaaggagttttaaattctgagctcctgagatactgactagcaaccatggaatgaatgtgtgaccagaaagtggctttgacaccaagtgctactgtccctttgtaattggcttctaacagaattcaaccagaaataattgataatgtgaatttttgttaattgttcacttgtaggaaaatagaacatgtatcaccctttgttaggtagacatgaacttttcctgcacaaagccttgcttttagagaatgcccaataaggcaagaaaaagcatagtaacttgtgctttgagagctcaatatttgtatcttatcagtacagaagaaatatttctgtgtaacttgatcttctgtctagtacttgtcttataggtaaccaacactgaaaactttgtagtgatgactaccaaagaaatacatagtaaaacaaccttttatttccaaattgttaaagagccagccattgatgctgctacatgagttccatgctcaagagccattgtaagagattaaggggtttctaggtttttggtgattttttgtttgtttttttctttgttttttagggtttttttttcttctttaattttttgattaaaacatacacacagctgttagcataaagtcgtggggggcattttctggaatgctcagcagttctgattaactgccaagcccaggttgcctctcatgaggcaactgaaaaaatcctgtgtcttgatagcatgggtgctgtgtgtgtgcatgtgtgtgtctgcattcatgccttaactcgggttactgcacaactttagttcttgacttagtctgcaccgtcatctagattgtattgtacatctcggtctgaacttcatcctggcaaaaacaaagttgcaggcacaacagtttaagaatgcattcctccagaagagtatctggtcaggttgacccctgagccttctttggacttgatttggaacttagcctggaaagcgaaagtggactgtccaacagaaagatgtcaacaaggaaaagaggagagccaagcgctagcatgccttttgcctctgcatatctgtgcacactgtatgttgttcatgatagcttgtctacaacttgactaggttggagttctggtaatagtggcaatcttgacattcttggtcagagtttagagagatgtaagactttcaattaatgtcttatttactcctttatgttgattagtctttgatacatgtgctgaatcagaaacctaaataaagataattttttaaaatgtacctcttgagccttaaaccctatcttttttcatttcggtttttgggaataaaacattgtttctctgttgcttctgacagacatctaacttaaattgtaaactctaaaggctgccttagaaagtaaatttaaacaactgggtgcagtgacacaagcctgtagtcccagctactcaggagtctggggtgggaggatcacttgagccttgagagttcgaggctgtagtgagctaggattgcgccattgcactccagcctgggtgtcaaaggaagatcccatctccaaaaaaa

SEQ ID NO: 60949 - DNA, 1049 bp, Homo sapiens
gcctatgtcatatccaagaaatcattgctaagatcaatgtcagggagcttttcccctattttccttctaagagttttatagtttaaggtcttatagttaagtctttaatccattttgagttgacttttgtatatagtgtaagagataaggtccagtgtcactcctctgcatgtgaatatccagttttcccaacaccatctgttgaagagactgttctctttccccgttgtgtattcttggtgccctttttgaagatcagttgaccatatacgtgtgagtttatttctgggctctctgttctatcctaggaattaacatttatttcccttgttatccacaccatttagtgagcccatcattcttttcatctgtttgtatttttgtgggtgatagagaactactgcgatttaaaacctcctagatagttgaagacaccagatagttgagcttaaaatgatacttaatttgttgttatattttaggtctatcatatgcaagtcacacggttggtttcacgccaccaacttcactgactagagctggaatgtcttattacaattccccgggtcttcacgtgcagcacatgggaacatcccatggtatcacagtaagtgtccgtggggtaggaagcagcactttactcctgaaagtggtaccgactggtgttctggagaacaggatcggtgcccttagacatttgcccttcttcctgcctcctccatccgttcaccttgaaactgtagagacttaaacagtttgataccaaattctggtattgaaactaaaatccttcccaggagacaaaactttaacttcacttcctatgaaaaattaccctttgtgaaatataatttgaactctggccagtgctttgattgaactctggccagctccttgcattattgttggttgccataatgtctaaagatatttattgtctgcaccttcacagttcactgaccttcagtattcttcctgaagttagccttgtttgtaatgttactcagaattttctctcctcgaattacaaggaagcttaagtgcatctg

SEQ ID NO: 60950 - DNA, 1040 bp, Homo sapiens
tcaccctccaagcttgactgcatctgaacttgaacctctctctcaacagttctcagcaatgtttgaacgttggcatcgcctggccagcttttaatagaccagtggctaggactcatccttggaattctgactgaattggcttggggtatagtctgggcactggtattttctaactgtgaacttggaagggaatgcaagccatgcagatctttggatcatttgggagccacctctttggaatctgtgtggaagtcatccgcagttcacaccatctttgactaaaatacagtaagtccttacttcacatcatccttgggttcttggaaactgagactttaagtgaaacaactttctgtataaccaaaccaattttaccgtaggctaactgatacaaacaagagttaagttcctatggcatacatatgttgtttcacttaaagtcacagtttccaaggatctgtggatgatgttaagtgagggcctactatattgggagatggctgtagacctggggaaatataagctgtggcccctaagtactagggagttctgtgtgcaagaggaaggaggaggactcataggaacaaatctggtcaggtgaggctgtgtgccagcagggggcagccaaggaatgctctggtgacagccttctgtgtgtgagtcagtgacacccagaggtgttggacctggtgccttctctgtgcctctgtcttctaggtcaattgctgaactgccaggaagtcttcccagccgatcactgcaggggacattcttatctatagatatattgtttaaggatccccctgctgagttccccgatgctaaaggattgccattttttctttgaaagacaatgttctctgaagttattgttcttggagcctcactaatgttaattctgcaaaggatttcatggtagtctccagcacccttcctgtaaaaggcattataagagtcctattatggaaaagaaagtcagcttgctctgacagtcacccttctagttctagaaacagcaaatactccaaggggtcaatctt

SEQ ID NO: 60951 - DNA, 1097 bp, Homo sapiens
agggctgactacaggacctgagtatgcacacatattggtatacttgggattcacaggttctgagggacagctgtagtaacacaatgagcacactcatttacacctttctcttttcgcttactatgcattgtagttttctcccctgctgatacatacaaagctgccttcatcccttatttaaaggctgcatagtatttgattgtatgaatatgccataattcaactagtcccataccagtggaccctttttggttgctatgctacaaccgcaatgaacatctctatacacgtgtttgatacctgtgcaggaacaccttcaggatagattccaggaagtggatttgttgggccacatggaatgtgcattttaaaaagttcagtggttcctacctttgttttcgtctctgaagttccttacaaattcttgtgccgtggagcatctgggatggtgtatcagtatcatccttggagcctttgagaaatatggtgtagtactttcctatttctgctattacaaattaccacaaacctagaggctcaaaacaatacaaacttaaccatcttacagttctaagatgggactcactaggctaaaatcagggtgtcatcagggcagccatccttctggaggttgttggggagcctctgtttcctcgccttttccagctctagaggctgcctggattccctggcttgtggccccttccttgcagtcgtaccaccccacctctgcctctgttgttacatcttcttttcactctgattcccctgcctccctttattaggatccttgtgattatgttgggcccactgtgataatctaggataatctacccatctcaagccccttaacttaatcacttctgcaaaggcccttctgtcaagtgaggttagtagcatttataggttttggggattagcatgtggacatctttagggaatcactattctagcaccatacaggtttctgggcttactccatggagtaaaaaaggagcatattaaaaaaatatatatataagtaatcctgatgtggacctcaggttgttaattactatgtgtgtttggtggaaatcaaatgagatatatcaaatagt

SEQ ID NO: 60952 - DNA, 1062 bp, Homo sapiens
ttccttaataggttcaaccagtcttttgttgaatgcccacattttgtgccacccagcatggaaatactgttttccatctggaagattcttggagtaattgataccaatagactttttcaactatgtaattattttaatatggctttctaggatgtttgcttctgcacaggaccttgctaaaaaaaagcctgctaagagaaatcatgctacaagtgtcactcacagacaaatgggtgcattgacctgttcactgtgaaagtgttcagcatttttcacccaaaggccactgagaggctatatacagatcaatttttgttttgtcagagtgctttggctgttatttctgatagtgattggacaatgcttttatgtgcatttcaaagggattttttgatcctgagaacaaaatgagacttgctatagaagagacgtgtcccttcctgtctgctatggccaagttgggtatccaatacctttaaaaaatagaatcaagtttgcttaagatacatgagagtaaatccctttgccctttaaaagatccagtttgggagatggcttaaacacctccatatgtgttcatcctcaccaacaggaaaacacacacaaaagggagcatgcagctcttctcccttgcttttgtgtctatccagtacagacacaaaattgtatctttatctcgtgagaactcttgactgagaagtctacatctttctgagcccaggccatgggattcactacctgattggtgagacattgttccaaaaagaactctcttacttttggtaagttcaacatgaacctacattagagctaaattctactcttgaatgccttgaagagaggttgtgctttaatcgttatttgtaattaaaacctataagaagtgtttgtgagcaaaattatcagaattttatatacaggctgagcgtggtggctcacgcctgtaatctcagcactttgggaggccgaggcaggtggatcactttgatgccaggagttcaagaccagcctggccaacatggcgagaccccatttctactaaaaatacaaaaaatgagttgg

SEQ ID NO: 60953 - DNA, 1021 bp, Homo sapiens
ttcatttctgtagactctgctgaattcctctgttttgcatttcttgggtgtgttggttcacagctaaaaatagagctctatttaaaatgggtaccctttctggaaataagaactatatttcaattagtaaatttcctgtttccttaacatgtgttttgttttgttctttccttttttttttttaaacagcaagccagggctgagcaggaagaagaattcattagtaacactttattcaagaaaattcaggctttgcagaaggagaaagaaacccttgctgtaaattatgagaaagaagaagaattcctcactaatgagctctccagaaaattgatgcaggtaaattatcttttctactccctcatcttccctgcctattttcctttctaggagaaaatgactttgatatagcactttgcttgtaacatttgctgatgaggttgtagcttaagttctttggagattcaaaataccaggtaagggtggcagcggtgtaatagtcaagactgtggttttctagcttatctgcatatgttaggtaagctattttgtaccccgagcatttccaaaaaattgctgatgagcacaagatcttggcatgagatgttgaatgtagcattttggaagtatggggactaatgccaaatgtgaaatttttctccttttatgttgagcctgtaataagtacgtaaactttttggcagtcataggtgggtcttttgcactaaaatatgaggatatgaagtgaaacatctttaggaagtagaaaggtatccatgatagttaaaactacccacaatcaaccgtgttcaaatgggtgagtaatatgttactgaacaaatatcagactgctattaaaactcaacgttgatcacgagtaatatatagaagatgccacacaaaacatataggaaggtttgatttctctacttcagaggctcattctctccccctccttttttttccccctttcaaagcttactggtaaagtacaaggtaaaatttgcttaggggcaatagt

SEQ ID NO: 60954 - DNA, 1054 bp, Homo sapiens
tttaagtctgtatctccttgctttctaaggtcatttaacatttttatatttcattgatatttctgatatatgaaaagcgtgcatgttatagagaatgcttttttaaaaaacagctttattgagatagaattttatataccataaaatttacacgtgtaaaatgtacagttcagtggtttttattatatttacagagttgaactataatctagttttagcactcactatccctctccccaccacccacccttccctgccccaaccctacacaaccacaaatctttctgtctttataaatatgcccattctgggcattttctataagtggggtcatataatatgtggtctttggcattaagcttctatcacgtagcataatatttttgagctttgtattgtaacatctatgaattctaagagggaaaatgatttatccaccaagttatatttataacgttgtttaacattttcattatgtaatattttattcaaacaaaagtggaccatataacacgtgtaagttataaagcatgacaaaatgagcacctggattcctaccactcaagaatggtactgataccattgcatctacctgtgaatttcattcctattctgttcctcccacctcctcatctcataagttatctctaagcaatatatcatttcttctgtttttttagtttattaaaaaatgtattttttttgcagcttctttcacaccatactgtgtttcttagctttattcatattgtatttaatgtatttcttttgatttcattgctttttaattttctgtgtgaatatactgtttttcttctgagtaggtattcggggtgtttccagtattttatttaaggatcaacaacacaatgaatatgttacaactgctttcttctatacatggaagagttttatgtagggcatatacctcgtagtagaattgctacatagtagagtacaaaaatatttagtttttcaaaatatttgtaccaatgtacactgccatatacgttatataagaattcccactgatcttgatacttgtcaacacttg

SEQ ID NO: 60955 - DNA, 1126 bp, Homo sapiens
cacagtctcttatcccatgaggccagatatgttttagaatttaggtttttttggtggtgggagttgggtctgtttgtttcccaaggctgttgtaacaatgtttcacagactgagtggcataaaacaatagaaattaattttctcacagttctggaggggccagaagtccaaaatcaaggtgttggtaagggttgttctcccttggaaacctctggccggggaagatccttctgtgattcttctagtttctagtatctccaggcgttccttggcttgcagctgcagcacttcagttcctgcctctgaagtcatgtggtcatcttctccttgtatgtttctgtctgtattttcccttcttataaggacagcagtcgtattggattggggcccactccagtgatctcatcttagcttgattacatctgcaaagaacctatttccaaataaggtcacattcacaagtatgtggggttaggaattgaacatatctttttcaaggacacagtccatcccataaaagggagtggagctatggaaaggtactgagcacctaccacgtatactgtagcaccgccagaggattgaaacagcagacacatcaaaccacctcagcaaaacatgtgaacaggcatgctaagtttgatgataaagctgcaaagagcctcatgtcaattcagatcaggcttgccaccaagtgaacgcagttgtttggttgcttgccaaatgtagctttcggttttcagtcttctgggttttggaattgtgtttaaaggatcgaggacctgtgctagattttcaccttaattcctaatgacagcttagcaatatttcttagaagttctagcagggaagagttactgcttatgcactttctaatgttgttaccttcccccacccccccatctggaaagttatcctctttgactggatgcagccccaggtatcaaggtggtgagatgtagtttgaccatgaaatccttgtgtccaactagaatagaaacttgatgctgaaagttaaccccttgctagaggttaaaccttccgtccctctttactcactgaaaactagaaaatgttcatacatcaataacctccaactcacaaagccagccttatagttaaagca

SEQ ID NO: 60956 - DNA, 1033 bp, Homo sapiens
gggctgggcagagcttttgtcttcgttagtttacctagttaacttgctttgtaggtcttaaacatcaaattgcatacagaggtctctgtcttaatgtgatgcatgtgttcctgaaaacctttgcattctccagaatcacacactaaaaatattagggttgatggaagaatagcatcggcgcagaccactaactcaaactttgccatgttgtaactagagaattaaacagtttttggttccttaggaggtacaacttggacttgtgatgtagttttcaacagatcagcaactttaagatgaactgctagtgcttgaggtgccaactgtatgcaggactcagcattcacagatagaaacataaaaaaggtctttgtccttgaagctcacctggacaagaacctttgaacttctgtgtccttcaaaccttctttttcctctggtgttcagaaagacttcacctctcccaaatctttcctggttcagtcactgagtaccctgtaacagccaccctagatgagcagatctctaccagactttaaatatattttagtgatgataaataactattttttggacaaaatttggaaaacaggttcattatatagataataggtcatcagtgccatccctcacaaccacctctattctggtttatgtgcttctagtcatttctaacatatctgagggttggtgtgaacctttaaagcaaaatttgggtcatgttgtggttcccaccatgttttttcccaactgaacacgtatcatgacaattttcacttgttcttaatcatggcaacatattatttcattgtcaggatacaccgtcatttattagtgcctatattggtttcctgttgctgctgtaacaaattattacaaatgtagtggcctgaagtaacatagatttatcatctcatagttgtataggttagaagtccaatatgggtctcactgggctaaaatcagagtgtgacagggctgcagtttttctggaagtcccagaggagagtccattttcttgcctctccaactt

SEQ ID NO: 60957 - DNA, 1025 bp, Homo sapiens
ggagtgattctggtgctttattaaatacgttatctgaggaaagctcttagtagatgcctagatggaggatgtttgttttgccatcgtgaatgagcagaattttgtcaaatgttttgcatctgctgagatgattatgcactgcgtaatggcatttaagtctgcgatggactgtgtgtaagacagtcgtcccttaagattaaaatattatatttttactgtaccttttctatgtttagatacataaatactaatcttatgttacaattgcctgcagtattcagtataataacgtgctgtacaggcctcggagcaataggccataccacatagcctaggtgtgtagtaggctataccatctgggtttatgtaagtatactttgatgttcacacaatgatgaaatcacctaacaatgcatgtctcataacataacctgtcattaaccaacacatgactgtattcaaaaaatctcaatgtaatgaaatacaattgtctaatgttgaattatccacttactgctgagataaactctgccagcttgtaattttttttaattttaatacattgctgtgctcatgctgctaatattttattcaagagttctgtatatgtgctgtgtaaaagtggcctttgggttttttgctaggacagtttggaagcagggctacttttggatagcttttttttttttttttttttcccccttaacaggtgtagtttatataacacggcagctatctttatcttaaaagtttggtggaccttgcctagttaagggaaaaaaaagtcacacctgggcctggtatcctttctgggtaagggagccttttcaaaaatgttagaaacttttacggtgacagaatggtgacggcaaataatctatttagtgaggcagctgggcatgtaatgcatcagtgatttttaaaaaaatgatatgtgaggctgggtgcggtggctcacacctgtgatcccagcactgtgggaggccaaggcgggtggatcgcctgaggtcaggagttcgagacta

SEQ ID NO: 60958 - DNA, 1101 bp, Homo sapiens
ctattatggtggaagatgtggatttagtcagaaggcacatggctgaggagactgttgggacctgctgggcggggctgaagggctttggttggggaaggaggagataaagggagtgcagcagggggtcgggcagacaacgctctgctctgccagattatagaaaggtagtcatctctgatcatgtcagaactgatcgttccttcctgagttgcacagaggtggcactgggcagagactggatagcaggacatcagtggtttgaaccaccatcctctgtgcaccaggctaaatacaagcagtaactcacataactctcaaaaggagcctgtgagtataagagttatcctcatttacagatggaagatgtgtctcagagaggttaaggaactggcctaaatagtggacatatgccactttcagagcctcagttaagtggaggctgctctgtgacatgctaccactttatcttttccttttaaaaactttttttggagtataacttatacacatatggtaagtgtacattttgattcattttcacagattgaaggcacatgtgtaacttgcacccagatcacgaaacagaatattactaatacctggactccactgtgcccccttccggccattatccctccaagggtagccactatgtggagtttgaactctgcttaactggaattagacagtgtgtactttttaagtgtttaatgtctttctcccagcattatgtctgtgggatttatctatattgttggtctcttcccgtctgagattgggtcttagaacctagagtgtccagaaaaaccatttgttactatagggcaaaaccatttgttactatagggctgtaaagtcccctgagtgtacagttggtattttcagaacttgtaaaattggaaaatgtggtcctctcggtgtcatcgtggtctgccatgctttgagcattagaagaaaaagctacctggttttcagagttcttggtatagaggattctctgtatattaagaaggaaatgtcttcggtattttttaaagaatggattaaaaatattgatgcactcagagcctctgccagagacattttctcttatagatgtag

SEQ ID NO: 60959 - DNA, 1360 bp, Homo sapiens
aatgacttgctcttgtttttcaattttgagttgcaaaaaaatttcccacctgtcaattgtcttttgacttggcttttggtgttttttggccacagtgaaaatttttatttttatggtttcttgatgtcatttataatctacaggaaatattgctaacattttatggtaaaacctttctgtatatttacttctttggaaaaaagtaggacagactgcttttgtgtttttgtttaaatgatagtgcatttaagacagattcagaagagtgtgtagaagtagcgatgccagatattcttttaaattgcataaacaattgaactcacaactgcacattagatacatctcctggtgtcttttttcctcattcttgtctgtataacactttatatttcatatgagatcttgaattaggataatttcctctgactagttgatcaattactgaattgtttattttggatactattattgtagcctccttcttcctccagaagctgctgcttaaatggattcaagtgtaattggcattatttttctatcctggtccgtttcgggctctgtttatctggtggttttattttactctgcagtattttccatttcccctgcttaaagatagatttaaagctgcagaccttaaatgtaatcttctttcatattggccggtcttctttgttcatctcacagatattacaaataacgtatatattacaaaactttgttcattctgctaatatttctgaggttattctgtatataaggctgttctatgcattgtgctaagaggttttgagacagttcctgcctctggcagctgatattctagttgggggggcggggggcggggttggaaatagacatcagacaactgatttcacagttatagaattgaagctgtgataaatccttcaaaagatgtgtttcttggaggatatgatggggggaaccagaccagtttaaggcagccaacggagcttccctgaagtgacatgtaggctgcaatcccctgtatatcttttttggagttaaccatgaagagaattggtaaaaaaatgttctgggcccagggaagaggctatgcaaaaaatcctgaaagcgacagaactgcagggcaggtttgaggaactgaaagacgagttgtggtcagagtgagatcgggatgtggcctgaagctggaagtaggtggggccaggtctgatagggctctcagtcctgaatcttgaattggacctgcattagaccactcttgaattagacttgaattattccttgaatttaattcaaggggtaatgttggcatatgtgcttttaaattaggagtaggtttttaaattcgggggaccatgccagtctagaactt

SEQ ID NO: 60960 - DNA, 2145 bp, Homo sapiens
gactggagtgcagtggtgcgatctcagttcactgcaacctctgccccccaggttcaagtgattctcatgcctcagcctccctactagctgggactacaggcatgcgccaccatgcccacctagttttgtatttttagtggaggtggtgtttaccatgttgtccaggctggtctcagaactcctggcctaaagtgatccacccacctctgcctcccaaagtgctaggattacaggtgtgagctaccatgcccagccaaaagctgaaattttaaaggtcatgacagtcttttacagtgcttcctatttgctagagatggggaatcattagagaattcacagtatctggtttgtggtgactcttgttcaggaccagagaggctggtctacagcaaaaattgaaggtagccattgcttgcttaaacatattgaatgactccccattgtccttggatccaggtgaaccttctggtggtttaccaggctctgcatgattggaatgccctgcttgcttcacagccacacctcttacatgcgtttagcccagtgtgcattctctaagctctcacatcactcctttactactagcacccagaacttcagtagatttcctctggctcctcaatggtgccgctcgtccccttaaatgttcttctgtattcctcccctcttttctaccttgtcagttgaaatagactgtactgccttctccacctgaaccccttcctggtatgccctgatacttcctctttgtcagccacacaccggggtatgcacctgctactggggtatgcacctacttccgtggttccatagacaccaccccccccaccccacgtcactgacactcgactatcgagatctttcccggttcatgtgtaaatttctttgggggcagaatttgccttgttcatcacattcctcagtgcttggcatgtgagaaacacccagaaatttgttgagctggctccagaggcacgggtatgtatgtacttgtttctttctgtgatgaaggtgccaacactctctctgggaccttgtcttcatagagccactcccctgccacaacagcaaacactttctttaccatagttgatgaaacagaccagatatgtgaatggatgcattgtatactttgggggaccattgcaatcagtgtgcccttgccttctagctttgggtgatgtgggctaccttgcagcatacacctgggtgttcctgataacattttatctgaaaggggacaaagtattttcaggttctcctttctaagtgtttctgagcagggcttggaggaaaaagtagccccattggaagtgttcagatttgctgccttggttttggtgatggtggcagatcattccaggtgtttcctatgactctttaatgttgaaatgcaccactgggaaacaactctggcccattgcagggggatgcagtaatgcaaataaatactggtgacctgtagcagtgatgggggaagcatctgaaaacagggtagggggattgttgaattcttacgtctgctgtgtcttgcagagacacaagtgtcaccacagtgtatttgtgtgtgtgtgttttccttaaatcatgccttgccgaaataattgtgtttacacttcaaaatgctaatccaaactactgaactgcagtcaggctgagtaaggaataatggtaatcttttctgtcctctctgcatactttttttccttagtgggtaggtgttgctttttgttttcaatcacattgtggttgttttcaggtatattgaattgtcaaagttggcagagtaaatgttcacaggttcaatatgttcctgcttggtgatggttgcaattttcttgacagaggaactaatcctctggaaaatatttttaattgtgaggatcttggggtggtgttaacttgcagattcttcctacttctccaaggctgtcaaattttcttatcttttatggctgtgaaatgcacagctgtgaagtctattccaaccctgataccagtaaattgcaaaggtcactttgtgtaggttctctctttagggataagtattcttttaaaaaaggcttaacaatatgattgatggtcatttagaattaaccctcccctttacttattggttcctggatcagacatatggagtgcaat

SEQ ID NO: 60961 - DNA, 1055 bp, Homo sapiens
cagtgttctagattttgaccattccaataggtgtatagtaatatctctgttatgccctttttaaagccaagtccaaaggctaatagaagctcttaaccaatggtctcttctggtatgtaagcggctattctggtcaaactacccatttaatgaacgactagtttcatgggcctgtgttctcagtatctgtataatagtggtaaacatcatctgtgggagacaatcaacagtaagcagtctttcagtcgtgtccacaagcgcccagtgcacctgtgagttatagcctgccctaggccattttatttggggcttaaaagtggaatagaatattttgagtgattattcaattttccccatgaagtcagcaggggaatcaggctactgattacagatcataatttcttttttttggagtaggggaaataaacaaatgcatagtcacctttttgagtagcttttgtatgttaggccagatctgttggtttgtcctatgagtgagaatgtgattgtggattatatgattcagtgtagtgagggttattgtggggtggtggtcttagagaaggtgaggaaatgcaattgtgggcagtaattggatggcttcaaagttctcagctagttgctggcattctccgtgtataagcagggcctcaggtggttctctagggtgtgtacctcttccaggcagtttcagacctttggtatgtgtttggtttggaaatcaaggcctataataaatcactgatatttaagtgtctctctgactgtaaaattaatcctttattgtagaagttaagggaaatacagaagtacaaggtgttttgaagttataatagaaaaatatgttggtctggcatgattagaaaacctggctattttaaacatcaacagtgtaatggtttcattaaccaataaaatctgccatatagttgatgttgtatattttggattatttactctggaagtctaatatgttattttcaatttttaagacttttgtcagactctgaagctacaaatcgatattgcctttataaatgtgacgatgagagtgt

SEQ ID NO: 60962 - DNA, 1047 bp, Homo sapiens
ttgaacaacacttaagtagtttatgtcaaggttaagctgtacaatccctgacatcgctgacttaagcattacccttgctagtggcaggctaggaagtttctgataattaagtgaaggccttgttagatttttcactattttagttaatttgaagggaagatggtaccataattctggtaattgccttcctggctctttttagttctaattatgatattaacgttcatgtccttgggcactaaaggtgattgtggccttctttttccttgagcaagttcaggaagacacattgcctttttgccacaccctggggaagagccgggctctttttttcccccgacttgttttgttttttaatagactttatttttttagagcacttttatcttcacgtaacactgaacataaagtacagagatttcccacgtaacccctgccttcacacgggcacagcctcctccaccatcaacatctttcatcatagtggtccatttgttatagtcagtgaacctacgttgatacatcattatcacccaaagtctagagtttacttggtcttgtatattctatgagtttagacaaatgtataatgacatgtgtccaccattatagtattacgcagagtttttctgccctggaagtcttccacgctctgttcatctttccctccctgcaaactcctggcaaccactgattttttttactctctccttagttttgccttttccagaatgtcatatagttggaatcatacagtatgcagacttttcacttagtaaatgcatttaagtttcttccatgttccccaactcctatatcttgttttctgttcagagttaaatagtatttcattgtttggatgtatcataatttatctcttcacctcctgtagggcatcttggttgtttccaccttttggcaattatgaataaagctgctggaaatattcatatgaagggttttgtctggaaagatatcagttcatttgggtaaattccaaagagcatgattgctgaattatatggtaagagtatgtttagttttata

SEQ ID NO: 60963 - DNA, 1867 bp, Homo sapiens
aaattcaccgagaagtgtgtgtgtgttcgctgcttccacacattaatggcatgattttttttatgcaaaaagaaaagaaaagaaaaccacccacattttaatttagcatgagccaatttacagagcatggaaatcactttcatttccggattggcgcgtgtgcaattagcaatgcagtgtatatacaagaagccatgctgttaacagtttatctcaagtaatttggtgtcatttacaaaaggaagaaattcctgccatcagaagggacagaaggagatggaatgatcaaatcacagagaaacactaaaattactaaatctacaacagctcgccttatttttcttggacccaaactgtcagggtataaacactatttgtttcttttttaaaacatcgatagttttgctgtaaataataacactgtataaattctaacagaaaaatagaataaaatgttgataaggcactgcctcttagaacacaaacagaatattgcaaatgcatttaacaaataggggtctcaagtgacttcaccctagaagaggagggagggattctgggtgggggtgactcttcactgattcttgtatattagcaattataatgtttgtatatgcaaaactgctagcttgattttaaaaaaaaacaaatctttaaaatctgctgcaaatttaaataattcccaaaatgaggaattctgtagttctgtgaaaaatttttttcttcagaatactaatattttgatgcatgtgtatcaccttattttgattaaatcttttccaattttgcaaacactacagtatactgcaacacaaaagattttatctgtaaacacaaagcccttcatctaatatttgttgctattgccaatttttcaatgaaatgacctaaaaacaacaaaaaaaaataacctatacggtagttgctttagggggtggggggatgctatctgttagtgcttaaaagggggtaaatgcttgccgctttagaggtggatggtgctcataaaaggccccagtcgggggtatttaaaaaggactgaacagaaatccttagctagtagaatggcagcacgctgtaaaattattactgtattgtgtactggctataagatgtagacacctttcagtaagccaatcatttgtaaccattctagcagtgtcatattaggttaataaggctgctgtgttttaaagggcatttttatttgggttttggtgaaattctttaatttgttgattatattcacataaaatcagcattcattgacacatagctctaatgacatatgtatgaaaaaccatacactggatgacctagtcgattatttaagcataaaataaattgtgttaaactcttcacctatctgtgctctacagtctccttgtgttttctggcaaaaggtagttgtctaatcccttgtcatatgagtcctggccaatccaccccattggtcctctttgtgcctctgtggtcactgaagagataatctctaacattcatatgtgccctgcaagctcccagcttataaattctgtgcatttcatgggggagccaagaattaaagattaattgacaagtaagctttgcccacatctgttcaggccttcttgaaaagtgaagaattggagatactatagccagcatgtcaaaaagttgactggcacttctaggaaccatcaacatgcagttgcttttagcccacagagcttgtttttgttttgttttattaatttacatttattgtccattcttacaagttgggacatttcacataattaagttgctaacatctcttaaaaagcaagatttggcaacaatggacctcattcccagaaggtaacaacctgctagagccaagttgtcc

SEQ ID NO: 60964 - DNA, 1111 bp, Homo sapiens
tgcaaaaaattagccaggcatggtggtgggcgcctttaatcccagctactcaggaagctgaggcaggggaatcactggagcccgggaggtggaggttgcagtgagccaagatcatgcctttgcattccagcatgggcgacagagcaagactctgtctcaaaaaaaaaaaaaaaaaaccaaaaaacaaaacaaaaaaaaaaacaaaaacagaatttcagacacactgacctactgaatcagaatctatactcaaagactcctgtgtaatgcagattaaactttgagaagcactgttccagaacatttgactggctctcaaattatcgagttttaaaaaatttttgatgctggccccatcccgaaaacttctatataaactggtatgggatgtggcctggatattgttgttgttttaatcttcccaggtaagtctaatgtgcaaccaagtttgagaaccactggagattgcaaaacagcttttcagtgagggacagtgggaattaagcctaaaaaaggttcattgggctggaccagagagcttcagatgccaaactaaagataggagaccctttttaaagctaggcattagggtctaaaatccacaggtatgtccatttgcctataaaaaacaagtcagttctgtaccagagcatgctgctgacttgaagatgtgatgtatgcagtacatatttaactgtaaagtatcagctgccatgaaaatccaatgaattgctgtttccaagtttttttttttttttttttttttttgagactgagtctcgctatgttgtccaggctggagtgtgatggcccgatttcagctcactgcaacctccgcctcctgggttcaagcaattctcctgcctcagcctcctgagtagttgggattataggtgcctgccacctcacccggccaatttttgtatttttagtagaggctgggtttcaccatgttgtccaggctggtcttgaactcctgatctcaggtgatccgcccccctcccctgcccccggcttggcctcccaaagtgctgggattacagacgtgagccaccgtgcgtggccctgttttcgtatattttaaaatgtttcttaaaaatacagtgaaatg

SEQ ID NO: 60965 - DNA, 1023 bp, Homo sapiens
cttacatgtatgtttctgctaactcaggcagttcaaacgtatggtaagttctatccgttcattccatttcccagaggtaaccactcttcacaagcttcagattgtttttacatacatatacaaatatgtgtgtaaaatatgtaggtttcgtactattcatattgcttagtatttgctttttgtaaaatatatcgcatcaatcctatttttggacaattcaagttttaacgtatccatcaaagcaaattggtacatttcatattgtcactcttccattttattcaaaaattctaagagaaataaaagttataaaatgcagtgcttctagcaggagtccagagggaagtacagttaattttcattaataccgtcaccagaggtgaaaatgtaacaccacatgtgctataattttcctttataatggttggggggaagggaagggaggttgccagaaatgatgttgtcaacaagaccacggggacaattttgtttacttaaaaatactaagtgttttcaagaactttaaaaacctcattgaggccgggcgcggtggctcaggcctgtaatcccagcactttgggagcccgaggcgggtggatcacgaggtcaggagatcaaaaccatcctggctaacacggtgaaaccccgtctctcctaaaaaatacaaaaaattagccaggcatggtggcgggcgcctgtagtcccagctactcaggaggctgaggcaggagaatggcatgaacccgggaggcggagcttgcagtgagccaagatcgcgccactgcactccagctggggcaacagagcgagactccatctcaaaaaaaaaaaaaaaattgagattactttctcccattgaagagaggccttagagctctctcttaggtaacatttggtctctaatatagttgacagaattaaagatggataaattttttaaaaatgtattttatgactccctgctgtctttcctatctatttaatcaactcctatctaatctattcctcctattcattttggct

SEQ ID NO: 60966 - DNA, 1030 bp, Homo sapiens
aaaaatcaggtcaaaagtccgggtgcggctcctacacggatgactgcctgctgttataaggtaaaattctgctattttccacctgtttccatgcagcaacccatggcaaagagtactgagaaaattccatttggtttccttgttttcccctttaccaattcctagataattcactaaaaggaatcctgagcctgagattcttcctccattttcactttaaggttagcagagattccagggaaaaagtggaaactgaaacaatgaccaaatggccactttttctttatgtaaggggttggcctcacatgatttttttgtaggattatgctataatcacctctaggtttgttgtttgtgtttgctttaacatagatgctcttctacttttgaattcacccaagtgaaaacctttcctcaacttatgattccatgtacagataattcagattcagttttcccttttgcctcatccaacccattaatcctggaatgctaataattcttttctttcgtcaacacagattccttttacctctttctgacttcttgagcctttgcaaagcttccttccacaatacttaaatcattctaagtctcctaaatttactgtcctttactgaaaaatttaaaataataatagcaaacttagttcaagttcttactccttgtaaggatagtggctatgattttcttttaaaaccatattattcagtggggtggtttgttgaggtgaaatttcctgtaaagtcaaggctgatagtactgtttaacattttaaaatacttgtcaagtttactgttgatgaaaaagatggcctagtttattatctatacaactaacatttcataaagcattttatctaacacctgtacctcctatagcagttttatttttttttttaaacaaatactggaattcatttttccagcggatgttaactaaattctgtctctgggactattagatttgaggtaatgaattaacttcaaagataaagtaccagaattattttcatagttccaccattaaa

SEQ ID NO: 60967 - DNA, 2620 bp, Homo sapiens
tagacgagagcatagctaggcaatttggcaactgagatatgggggatgtctagaagctgtgtagcacctcctgacaccgcacccatgagagccctttacattttatttatttattttgagacagagtctcactctgtcacccaggctgaaatacagtggcacaatctcagctcactgcaacctccacctcccgggttcaagcaatcctcctgcctcaggttcctgagtagctgggattacaggcacgtgccatcacgcctggctaattttagtatttttagtagagatggggttttgccacgttggccaggctggtctcgaactcctgacctcaggtgatctcccgcctcagcctcccaaggtgctgggattacaggcatgagccactgcgcccagctacattttaaatccagtggccacacttttcacacttttctattttatgccttcagaagtaggcaaaagacacagttcttaaaactttagagtttctgcaacctatattcagtcatagtttgccattgtgaatttgcaaattttctgttgcagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaaggtacgtcatctggtcatccggtagcagtcattgaaatggaaagtatcggtgctttacttctttggattgatcttgcagccgggggcccaaggttttttacgatttctaaattataaatgtgtgaaattgtagcactaatggtggaggtaaagaaagtactgagttaaacacataggtaaaaaaaaaagttccaagtaaaatgtatgccatttcgttataccttcattcatggtgcaggaaaagggaataagtatctgtttagccatttttaggagggacaagaaccagagagacgttaagtaactagtttaagacccagtattttatctgggatttaggtttcctaactcccactccgtgttcttccttatgggaggaggataatcattctgatcctttctggctccttggcataaacagtctatagcatctgacccatctaagttctgttctgtatggtctgttgtctgaaagcgtgttttaaaaattaaagagatgaaattccaagcctaaaatgaggtgagttgacagcagttagttagaaatttaaaattagaagtataatttttataatttatataagttgatgatgattgtcttaacatgtatttctaatcactttaaaacctcactgtgatagatttgcttgttctttgtacttttgtggtacaatctaatagatttttttctttgaggtttactctatttttagatattaaaagtattttaaactgaaatgatgactcatacgtggatataagaaaataaaaagcagctctgtttcctacattttttactgctttttactctcccaatttttatgtcttttcatcaattctgcaatagacagagattaatagtagcacttgcagttttcgctgagacatatccagttcactgaagacccactttagtgttttgggaggaaaaaacaagtcttttctgaaataatgagttcaagattgatttgaggtttaggaagacttttagcaaactcaatcgctcaggagctgattctcagcttatcagtaatcacatcctttcctattcccttctgcagacaatatctgactattttcaggcttgttagaagggagagtaagaggaagtttagttctagatcatctatttttttttccctgtaagtaagttgctttgatataagatttggtggtggtaatcagttgcttaaatgatatcctaaaataatctccagctcatttaataactgccttcactaaatttttattaatggttttgttttagttttaagctcttttaagtctttttcaggccttctttaactccgtcctgacaagtgtggttttgaatactgatttctgtctttgacttgacttttagtatatttaagtggtgtgagttttggataagtttccttttaaaatgatcccacaaaatatagagagaagcaataacatagtggtatttttcctgtgaatatttattctgcaaaagcctgttaaagttctaaaggcaaatttctatacaaacacatataaacaccgctgtgtgtgtacatgtgcatatgtatgggccactggaaaatcatattggccattggcataaagacggttgaaaatttagttttaaaccttgagtggaaacttagctgagtttgtcagtaatggaaaataatttaccattagaaaacattttcaggatttcttgtaa

SEQ ID NO: 60968 - DNA, 1636 bp, Homo sapiens
tgttttttcaatccttttcttaacatcgtttaaaatttttttcccagtgccactgctctaaaatctaacaaacaatcatttctttccaaagattaaatccgtttttctgtgctataatttcatgtgaaagaagaactaggttgctttgctcatatgtacagttcttaaaataagttgtaggtaattaatataaaagttgtaggtaattaatgataaaaattggtttcttgtggcttgctgtattcagtccaccacagtatgaacttcgcatgctaaatatagaaagataataagtatctcatgtaatgacaactaactttatattggtctttatataaacttaaatatataaactttatatatttagtctgcatactttggattagtgtgcatatttacttattgtatcataatttccaaaacagaaacaattgatatcttaattagtattctattttattggagtttgcactaggctttttatttcattgtgttacatttaattgaactaaaccgataaatttattgacattaatctgtaattcatcatacatttttcatgcctgatataattttagtcattccatgtgtttttgtttgatgtattctaattcattccagtcagtccaaatgtactgtcttccataggttatccttcccttcaagtggaactggaaacccccacagggttgcactacacaccacctacccctttccagcaagatgattattttagtgatatctctagcatagaatctccccttagaacccctagtagactgagtgatgggctagtgccttcccaggggaacatagagcattccgcagatggacctccagtcgtaactgcagaagacgcttccttagaagacagcaaactggaagactcagtgcctttaacagaaatgcctgaagcagtggatgtagatgagagccagttggagaatgtatgtctgagtgagtatcctcaataccttggaaatttggctgggtccccaaaagatgttaaaccagcagagcctagaaaactaggagtaagctctgagcagcaggagaaaggaaaatctggtcctgatgaggagatgatggaagagaaactcaaatctctatttgaggacattcaacttgaagaaggagtagagtctgaggagatgacagaagaaaaagtacaggctattcttaagcgtgttcagcaagcagaactggaaatgtcttcaattacaggttggcagaatgagacatcaagtggaaacctagagtcctgcgctcaagctcgaagagtaactggtgggttactagatcgactggatgacaggtatggctgtttcaaaaaaaggaaagtgaacacaggttacttgttaatagtttatcttaaatacatgctttttagtggtgacttcttctaaattaccattctagttctgggataaaacctgctttaaagaccagttcattatgctaatctggaaaggaaagtgaatttaaatttaaatttaattctcaaaactgttgaaataaaatacaagaaaatttacatacatgcccaagatttatacgttgtctttactttagaatactattcttttctactttattacttgtatgattcttttcatatagccagtaattattgttc

SEQ ID NO: 60969 - DNA, 1031 bp, Homo sapiens
tgcaccccctgcctcctgggctcaagtgatccaactcagcctcctgagtagctgggaccacaggcatgtgccaccacacctggataatttttgtgttgttgttgttgttgttgttgttgttgttgttgttgctgtgtgtatggagaccggggttttgccatgttgcccaggctggtctcaaatcctgggtgcaagcaatccacctgcctcagcctcctgaagtgctgggattataggtatgggccactgtgcccagcctaagtctaaaaatctttataagatggtctctaaaaaaaatctgattgtaagtcattacctaaggagagttaagtcacagcctgtgtatggtcactactttgctatgaagccaagtatataaaaattaattcctgaggctgtacttgagcttgactataaaattcccttttctttttgtggcaattgagcattacttttatgaaacgtgtgataaaagtagaatatgcaatcttagtaactctctttcttttctacagaactggcaagggaactgaatttttcagtggatgaaatcaatcaaatacgtgtggaaaatccaaattctttaatttctcagagcttcatgttattaaaaaaatgggttaccagagacggaaaaaatgccacaagtatgccgaaattatattattttaactttcaaaactgcataaatgtaatattttagataagccaactgttaggttcatccaagtagtgttgtaattttctgtaatctttaatatagaaaactaagtgatcatgaggtaatagcaagtcttttgaagttatacttgtttaatttagtgttaacagtctaaacttctattcttcagaagctttttggaaagcaagtagcagggaatttttcgcatctggcctgacattctctctgtgaccataaaaactgaaaacataattttagttgttaaatcatgggacacagtcatcagaaacactccgaagttaccactatggctggaggtggatgtgcagagagggaagacaggatcata

SEQ ID NO: 60970 - DNA, 1046 bp, Homo sapiens
ggaaaggattatttgcattatctatgtaaacaagaaaacaatgacagtaagtttaaattttgaattaaaaatttttaaatgtgatttttaaaatatgataaacatgtaaataaatatatttaattcacaaaagttgaattctataaaattcatgcctgtaatcccagtactgtggggaggccaaggcaggtagatcacttaatgtcaggactagcctacccaacatggtgaaaccctgtctctactaaaaatacaaaaattagccaggtgtggtggtgcatgcctgtcgtcctggctacttgggaggctgagacaggagaatcgcttgaacccgggaggcagaggctgcagtgagctgagattgcaccactgcactccagtctgggtaatagcgtgagactccatctcaataaaacaaaataaaataaaagatgatgagatttcatatcaattggacaaattggacaattctgcattgtaattttgagcttaacaggacccttaaaatcctacctcacatgaatctgagaaattttaagttttataggttaagtgtattttttaatgcatggccaaataataaatattcattatcatcacatctaaattcatcctgcataccattagcaacatacattccatacagttatctctatttaatgggagaatatgaaactagataataggaagcagtttcatctaattttttttttcctttgaatgccctcagtccccgtccacccccaccaccactaccccatttcaaaccctcctctcttcatcaacctagtctctgctctcaggtatactgctaatggttgggagctgagtggagttctgaaaagatagataggtggtctgaataatgttttgtaggcagttgagagttaacagtaatttattatgtatacatatttactaatatcaactttatattttaacattggacattgtaatctgaaaatatactggagcaaatgtttgttttgcattattatatgcctagaactgttagattattttccttaagcaaatacagtcagagt

SEQ ID NO: 60971 - DNA, 1050 bp, Homo sapiens
gtgattgcctgtggagtgacttaaccgtagtttctcattatgtcattgtcatctgtatgtgctgtcgtatatactcttctttctgccttttgatcaaactacacggtagacagctagggaagcatgctgaagatattggtgtcattcaagatgaacaaccttcttttttcttttttaatgtgctaatggatatgattctgtcaaagtaaaagcacagatgttgaaatcccatcatggtgttttcaccaacacgacacttctgtaactgtttaaactagctagctcgtcagcatgttcaatcccattacattgagcatccatgtagtctgacatttggcctgatgcaggtgaaaaacaagtgagccatgtgcaaagaagtgttcatgtaggtgactaggacacatttcagtgtacagtgttagcattagtctctctgtaaaatctgcgtactgctaaaagcaattttccagtatcgtatctttcttgatgattattttaattaagaaattgtaaatcgtaggtccacagagtccatgtgaacggacagatatcaggatggcaatagtagccgatcacctgggacttagttggacaggtaagtgcatacactcctgaatggaacaaattagtttcttcatttctttgtcttactcacaagcagttcaatatatatattttaaaaatagaaacaagcagctagtaaaaaacatttttatcaccaataattttatctacccagagataaatactgattgtaccttgtatactgtgtttttccaaagccttttctatgcatatgcactaagaaatagaaatttaaatttattttaccttaaatttaagcattttcttcacaatgtcacttctgtaatataggttaaccttctactgaatagcaaatttatcttgtagcacaaaagaaaacacagctaaggcctatgacttaattaatcaaaattctttcacatggtttatgtccttagggcagttttctaggcaacagttcaattaacccacgcctaggctgcacaaattttagtcattcactgt

SEQ ID NO: 60972 - DNA, 1071 bp, Homo sapiens
ttacaatggcatcttctctctcatcacctgtgaagcagatgcctggacatgcagaggtagcattagtcaatggatctatttcccctctaaaatatccatcatcctcaactttaattaatggatgcaaagccactgccacgttacaggaaaaaatttcttctgctacaaactctgtgagctctgtggtcagtgcagccactgacacagttgagaaagtgttttctaccacgactgcaatgccattttccccactcaggtcatatgtttctgcagcaccatcagcttttcagtctctaagaactccttccgcaagtgcactctatacatcccttgggtcgtcaatatctgcaactacctcatctgtaacttcatcaattataacagtgccagtatactctgtagtcaatgttttgccagaaccagcattaaagaaacttccagactctaattcatttacaaaatcagcagcagccttgctgtcacccattaaaacattgactacggagacacatcctcagcctcacttcagtcgaacttcatctccagttaagtcatctttgttccttgcaccctctgcccttaagttgtctacaccatcttctttatcttccagtcaggagatactaaaagatgtagctgaaatgaaagaggacctaatgcggatgaccgcaatactacagacagatgtgcctgaggagaagccattccaacctgaactcccaaaggaagggagaatagatgatgaagaacctttcaaaattgtagagaaagtaaaggaagacttagtgaaagttagtgaaatccttaaaaaggatgtatgtgtagataataaaggatcacccaaatcaccaaagagtgacaaaggacactctcctgaagatgactggatagaatttagttcggaagaaatccgggaagccagacaacaagctgctgcgagccagtctccatctctgccagagagagtgcaagtaaaagcaaaagccgcctccgaaaaggattataacttgaccaaagttattgattacctaacaaatgatattgggagtagttcactgacaaacttaaaat

SEQ ID NO: 60973 - DNA, 1052 bp, Homo sapiens
gtttttgaatcccacacatcaatagtaataaatagaatcaagtagccttaggatgcagtaatagtacctctggccaggcgtggtggctcacgcctgtaatcctagcactttgggaggccgaggcggggatggggtgggggaatcacctgaggtcaggagttcgacaccagcctagccaacatggcaaaaccctgtctctactaaaaatacaaaaattagctggacgtggtgctgcatgcctgtaatcccatctactcaggaggctgaggcagaattgcttgatcccaggaggcagaggttgcagtgaggcgggatctcaccactgtactccagcctgggctacaagagcaagactccgtccctaccctcctctgcccgccccaccaaaaaaaaagtacttctaacaaaaccattcatctgttttcaatctcctcatctacactttatgcctgttaacatacagaatccccagcagtaattggaataataaactttgtgtgcctttctcccttgaatgtactcacatagagtgagtgtactttgtgatatatgtgctttcaatatgaacagttccaggaaaatttaatgctcagcatcagaagtctctgtaatgcttgtcttttacttgtacttccctgtagtctgctgtgttggtgctcttaaatttgccaaatgatgattttggttaagacatggggggtggggttacaaaatcccagtgggaaattaacatttcctaagaaggaaaataaacaagttatcaacatgccatcctacaaaatgtcttaaaactgaagatgtcacagggaagttggaaatagagttgtctttttttttttccttttcagattgagaaaacagatagacgacagagcttcgcatccttagctttacgtaagcgctacagctacttgactgagcctggaatgagtgagtttcctaacacatttactaatctacgtggattttcataagaagagacattttttctatacaaaccaaattttatcatttggaaactcaatggcaaaagaaaaattgcctgcaggaaa

SEQ ID NO: 60974 - DNA, 1091 bp, Homo sapiens
caaacaatttagagtaatacaatgtgttatttctggttaatgttcagtaatcaaataatggatgaaatgcaaatacagtattcaagtttcattttcatttctggtggagcccagggacgttctagagggatcaccttctctctccaagaacagaaggagagaggaaaattgttttgtcattattatttgctgttactgttgcaaaagctggagctttcagaaaaaaaaactgttagaaggaaaatgcacataactcagactgtactatgaattgtcaggattagatcatcagacacaacaatcctgcgtttaggaatcgggcatctaactcttgctgagttcagatgtgaccaccccggttgctgcataatcgtaatcatcatcttttccctttacctttcctgcctctcatagggcttgataaaacaaccatgcttaactcttatacagttaaaaatcctcagataagtctcattctataaccatcaactaccaaaattcttctagattagagacaccagccaagagccctgtggtcgtctgtcttttctgaaagaaccaaagacaacaaaaggactgcctcaaacagcggtttgcaacttaaatatcactctgccagcacataaaaaggtatcttttaatactgctttaaattgtctttccctggtcttgaagaagtgggcctttggtatgcaattaaggaatgctttgtaacatgaataaagctcttgaaactgaagttgtattagtctcctcgtgtagattgcctaagtcttgttaatgtggtgtcaaattcttatagtttgtatgatggagtcttctctgtttatcgcttttgcttctgctggtagcgcatagatttttatgcttttaaataacgtcatatgttaatttgccatggatgtacagttcttgatattttttgttggctttttttaaaatttgctttgctttctaaatcagcttgcatttgtgctccctactcagtccttttcatatcctgatattcttttccctgctgtccattataatattccttgtctctgcaatgcatcttggaaccaaaaggagacagagtcagatcaagatga

SEQ ID NO: 60975 - DNA, 1107 bp, Homo sapiens
acattttacttgtccatcacctcatctctggtttcccaaggatcatttcttgggaagatcctggtcaagatcctggtctcatgactcatttaaaatttagtgatagcatctttcctgctattaaggttagcattagtagaagtatcattgaatctactggagcatctaggtaatttctagattcaatctaggtaatttcttggtgacctagacagaggtaatggacttagcaacatactttaaactacaaggaaattgggtggactttgggaaaaatacatgtcccacagagcactagtaataggaaattgttcagtacatggttattctcacctactgtactcgccagtgtaatccgagagtttaaacattcagggctcagaagaacacattttgtgataagcacctggaatctagagctcaattcatcctttgattatcctagtccgatttttaactgcaattccaagattattaaagatagattttgtttttgatcttcttttgttctctgaggagtaattttaatggctgatgcccctttttaccctcggtaattaattgtacagaatgccatgtacagaatgagctgtttcttaactttggtagttcttacctttttaaagagtaagaggctgggcgcggtggctcacgcctgtaatcccagcactttgggaagccaaggcggtggatcacctgaggtcaggagttcgagaccagcctggccaacatgatgaaaccccgtctctactaaaaatacaaaacttagctgggcgtggtcgcaggcacctgtaatcccagctactggggaggctgaggcaggagaatcgcttgaacccaggaggcggaggttgcagtgagccgagatcgcaccattgcactccagtcttggcaacaagagcgagactccgtctcaaaaaaaaaaaaaaaaaaaaaagagtaagagacttaattatccatctgaaacaaccaatctttgcacttacaaattgcatttataaaatatacttataaattgtggctgccccaagtttaagccattcattagtacccagacaaaaaacaaggaatttttttttaatttaatatcatcttacaaggaaatca

SEQ ID NO: 60976 - DNA, 1792 bp, Homo sapiens
cttaatcttgaaattattaatactgctaagaacacttgattttgtttctacctattgaagaataaaggcattataaaaattattttttaatctttaatttgaatgaattatgattttgctaaaagcaaaatgaccatatttatcatccccgtttgaagcaaatgcttttctaataaatcgatattcatgtttttatttatattatttgatcattacaactactatccctttttctgctcttacttacttaagcctgtatcttctgttatcacatatacctaaacacataggttaagaaatggggttccatacaacctctgtaggagaataatgatactgtctacttaaatgtcataaaataaagctgcacaatccaactacataaactgtgtgtgattgtggtctgcttacttccattcatctcttttagtatttatcctattttaaaatttaacaaaattatttcccgtggcttgattggctatgttcaatttgcagccattcttttacattcctttgcaaaaggacactgtcaaaaattactgtgtcattatgtgacaatttcaaaccaacaagtacttttacagaaagtgtaagtattcctatgcaggttatattagagccaggaatggaagctacctactaccatttcacaaattgaaaaacacaggaattgtcttaactgtacaggccatgaaaagcatggaatctgcctgttggaggagtcgttaacatattgattgttttcttgctaaggagaaaatatagcaatcatctttcaaactaggaactttatagaatttttttttaaagaaatgactgtgtccttttaaatcattagcatttgtataatatacctattgtgtcttttaaaaatggaccaactttcttatggtctactttaataagtttccattctgattcaaaattcctatttatatgtactgaaaaatttcccccattaaatcctatgcctaacatatggtagtcctccaagaactgtttgtgaatgaatgaatgatggcatgttttcaggcttcgaaaatattctttaattagcaaatgattctgcagctttgaaatcattcccaaccttagtggcacctctgattttcaaatgaatactgttaacgaaacattttttaagtatgatactataaatatatttaatttgataccaaaataatgtggattttttttccagccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaaggtaataatgatggctccttggttctgtaaatgtctgcaggcagaaattaaaggaatgactagattacatgaaacaggacctgaatttcacacatttgtattttaagctaggacccaagttcttcagcttttgttgctgttttctatatcataatgctgaagttccatttaatctaacaaactttattctccgtaatatagaagtataagtattttgatgattccatctttaatcacatacatcaatctttccaataccaaagaaagttttctaagtcaaaaatgagcaagaagagggtgaaataataatggaaagtatgcaaggcatgctgagcattttgaagaaaatatgttcacattttatttttggaattatttctggactctttcagctttttcaagtttctcccagataatttcagtatccttcataa

SEQ ID NO: 60977 - DNA, 1064 bp, Homo sapiens
tctgtgtattttcatacgtggaaactagaatacagggatatatttgtgttcccctgtctgaccttaactcttccacacattgaactcattgatttatgtttacttataactctgtgataacgataactgtgttataactctgtgatgatgatagtgggaccatgcatatgtgatagaagacagtgattccaatatgcttctacccaaaaataacagttaatttctttatagttctatacctattaatacatgcagacagttttttccttattagctttaataaaaggccaatgacagaattatgttatttagagccattttctaaaagtctaagttccacttttttaatcattgtataaaatattcaaatgtaggttatttcagacagcttttaagcccatatttatactgaaaacatttaatctctttccatcaaaatcaccgtagcaaatctagtcatctcctgcttttattcttatattctgcttcatcatagtaaaaattagtgttggtatgattaaaaatacatttattttatgagtcgtaaatatcaagacatactgtggagtttcatcttacttgtaagagaccatatggcagcatatggcaaaaaccacttatagttaaaatgacctttgaatataaagaccacagtttttttgttttaaatgcatgagaatcctgttactagaccgattttactccagttttgaaaccttccttattccttccatttgagcctggtaaagtagttggcttttctatgggggccatgttccaccaaaaacaagttgtgtttcagtttttgcaaagtgcacaagttaaatgcatgtttgatgtgactccactgtattgacttctgatttatctttagaggaaatgatagctacattgtctgtcgctttaaataaacttaaacatttaatttccaaacttgctgtgagcacagtttatttccgtccttgaattggcctctgatcttctcccctcaggtttctggttagctttatggtggacgcgagagggggctccatgagaggaagccgtcatcacgggatgagaat

SEQ ID NO: 60978 - DNA, 1029 bp, Homo sapiens
aaataatgtgcattttcagttgaataatccttgacatcacttccaaaatgaaaagtaatgtgcttattcatattatctttgacatgggaataaaaattattaaaaattccgtgtgaatttttctttaacatagtgttctattaaagccacccagtgctaggtgttgacttcgtattgcctagtttttgaagtctttctaaacctcattttcctcatctgtcaaatggctccattactctcagggctaataggttctgacaactcaaacaaaaaatgaatgtatgggcctaggtcagtccttaccattgaactgatgcacagtaagttgtggtagtgctgttaacaaaggaatgtaaatattttgagtcaataataagacctaggcattgataagatgcattcttgaatggcctccattggtttgataaaagcatcctatgtgtattactataatgccccagtgctgggactggaatatttttatttttgctgttttccaccataaatgatcagattgtgacaaatgagctaatataagtgaaagtcttttgaaaagtatagaaggctttacacatataaggagacattatgataattccatgccaacaccagcactgcattggtgccagactttgacgtatatgttttcttttatctccatatcaaccatccccagtttgaaaatgcagaaactaagactgaaaaaagttgagtaatctgctaatgatcacaaaaccagcaggtgatgctggggcatctctgaaggagctttcaataagtaaagataaggaaaggtcaatgacaaaatatctcctttattcctgatggaggccaggcgaggactggcttagtgtctgagccacgtgggcctgctaactgaatccctgagataggcacactcccctacccaatgactgtggtgctggcccaggccaggcacactctttgcagaagtaggctttggagagaagaggagactgctcactctctgtgcccatagattgaaaactggatctgagcagaaccttc

SEQ ID NO: 60979 - DNA, 1067 bp, Homo sapiens
tgattataggtgcatgtattagtctgttctcacactgctaataaagacatactagagactgggtaatttataaagaaaagaggtttaattgactcacagttccacatggctggggaggcctcacaattattgtggaagagaaagagacatcttacatggtggcaggcaagaagagaatttgtgcagggtaactcccccttataaaaccatcagatcttgtgagacttattcagtatcacgagaacagcacgggaaatacctgcccctatgattcaattacctcccaccaggtccctcccacaacaggtgagaattgtgggagctacaattcaagatgagatttggatggggacacagccaaaccatttcagtgcaatagcatgtcatgggttttaaatgggtattagcactagagaaagcacttgtctcaaataatgaaactaagtcttgggtataaggtgttgccaggaattggttgaaattttctgcttggttggctgtggtcattatttcagtctgtaatcctgctcttttcatattcccaattgaaatgagatggcagtggagatattgataccacttgtaagtataaaaatgcctgttattctctacactctaaggagaccccacaaaacgtaaaatcacaggtgaaaggagactccccaggtatcaatgacactttgctaatgtagaaagcatgtgccagggaatttctgatcaaacctaattgtggcttatatttctgcatattaacttgctatgggtcaagggcccgaaattggaaccaccaccaccatcaccatgaccttaccatcatcactgtcacctccaccactgctaccaccaccactattaccaccatagttactctaccacccaccttctgcacatcaacattgaagtaaaatgcaagtgtttgtggtgctataaaatggcttctgagggttctcacaccattgcctattaaccattaccaagacctacttactcaggtagactgtgggggcagcatttactcagaactaaggatttgtgaacagaaatagaagacaaagagaagttttgag

SEQ ID NO: 60980 - DNA, 1050 bp, Homo sapiens
ctgacagggaccataaataactgaggctcccagtgttcccagctgagaacaaagttgaaagtttgcctggagctccatgccactccccgcctgggccactgctttgttttcttctaatgtttttcctctacctgggttggctgtttcttcattcatatttgagaagaatcacctcctaattaaatgtagcacttcgctctctccctacatgaaggctgtcttggttacccgactaggcaacgcgcattggtatcaaattaccgaaagtctacaccggagcagtcctcatatttacatacaaataactcaggggcttgcatttatgtcaccattctgtcctgctagaggcttgccagaggagtttttaatccaatcagaaggagctttaaaaggatgtctgcgaagtggtcaaaaggatcttaacctcaattaagtggggttttttaaaaagatttttttgggggcctgaaattttgaaaatcttcgaactctgagtggggaaagatgtataattcctcaattgcctacgaggatatcaagatgctgagaggaattcagcggtggtgaagagagtggatacaaaccagggattggtttccttgagctgttttggaggttgattctaaatcactgcttaaggaattcctggaaacatcaggaaaacatttgatcatccaagcctagtggaaatggctttaccgcagagtaagatctttgagttgtacttggtgtgtgctgtttttgtttgagatgcagtgaatgtgcaaatagcccagccgtaaatagttacttaaaataatctcttggtactgggtagcagcagtagaaagttgatctgtttagtttttacatttgcaaaaacagtagttgacagtgtatttttagacttgattggtagtttaaaagctgagctcttgcggtttcctgagtttaaatgaatggaaaatgtaaacagtaccgaatgcaggaattggaaaatatatctgggggaatgaatcacttacctttgagaaaacacaacatgtacacttttgcaatctcttggccagt

SEQ ID NO: 60981 - DNA, 1047 bp, Homo sapiens
tgaggccttctctaatggcatttgccactgtgctcctgggctttgtgtatgcacatcatttaatgcactacagagctaactctaatttattagtgatacattaggcaaccagagtgtgacctctttggtttacctttggaccttgtcatttctcatttttgttttggttacctattacaaaattacagcctccccgaaactcagtgatttaaggtcttattatctaccttggttctgtgagttaatcggggctcagctgagtcttgggatcttttatgagattgcagtcagcagctgaggtggaggaacatgaccagatgtccaagatggtgtcttcattcaaaggtctgacacctcagctaggatggcagcgacagctgagcgttggctgggcatttctctttctctctctctctctctttgactctctttttgtctctctctttccctggttctaagcagcctctccatatggctaccttgagcttctttataacatggtgctatcatcatagtcagatctcttacattgggactggcttcccccaaaccactgtttcaagagacttgaggagtctgcaaggtttctttgaacacaaactcattcattcaaaatcactttgccaaattttactgttcaaaatttcagccaacccagattcaatttaggggtactatgcaagggcatgaatagaaggaaacatagttcattggaggtaagggtgaggcgggcattttaaagatgagctaccaaaatcctctttgcctaaaaatagtcaaattcctctataacacagctcttatttcactgcaccaaataactttagaaaacataaacctacacagctcctttttagtaagtgaaaatatgtgatcttggtaacatttttaagctaaatatatctgatataaaatgcatgtcatctgttaataaattaccttggttggcttatacacacgtgttagaagctgccactagccaaaatgtgtttggattatatagtggattagagaaagttaacaaatcacacaatacaattcatctca

SEQ ID NO: 60982 - DNA, 1137 bp, Homo sapiens
cggaggttgcagtgagccgagatcgtaccactgcacaccagcctgggcgacagagcgagacttcgtctcaaataacaacaaaacaaaataaggggtatgggaatccttggtgacctcagcagctgccatgccatatggaatatcctggatatagacagaagataagagttctagtgtaggtagggaaggtcacagcgagtatatttttttcctccaagaagctatgatagagtgagcagctagagcagcctgtgaaatatttaacagacgccaaggaattgtgtgcttgtttaactgcaaacaacaggctgttgtggttttttttatttgccccaaacaaattgtaattttgaatattttttccccctaaatcaggtctgtcccttccatctacctgaaaagtctgacctgcttcctgtggaaggttgtcctaatgtaaccaccctgtagccctctcattagctcagagaacacaacagtgagaatgaatgagcaaggggaagacaaggtggtgcacagggagctaggagcaagaggagtgagaggagcccaggaaagatgtcccaatggggaggggtgagtcagaaccccagtgagaatgagaactgaggacaggcctcatgtgtctttgccttgtgtgtacacatctctggggtataggttggaagtacaaaacaaaccaataaatggatgtttattgccaggcacaatgataggcaatttgggtgtaagggaaagaaaaggccaaaatcgctgtttatacacgagcctggtacttctttatacctgggaacagtgattaacgtgttcctgtattgtactcatggtccttgtgtgcctaggcaatgaagaggtgagaataatgcagtctggatttggggttgaggctagacaaatagctaaggaagaatgaataggacaaatcagctgtcatgatactgccaccttgaatttagctacctagtttctctgcaagtgagaaccaacatttttgtgcctgattttccagggctagtttgtggctagcaattagttcattgtctagtcttcttcacaagtggcttagattttagataatgagaacagtataagtaatcttttacttctttctacctgcattctgtctttagacttcag

SEQ ID NO: 60983 - DNA, 1335 bp, Homo sapiens
ccttctacacacacacatatggataaggaaggtttattagtaaaggggaaaacaaccttcaagttatttatcaattttttcaaagatctacattaaaagtatgaaataaattctttttcttttttaataggtatgacataagtctttcatagtaacagaatttgctttaggaaaacgatgattatatgtttatatatttaccatatagaatctgtaacataatggtgaatgtcctgatgtcttctaatccgatcattaaactgatttagatgggtggatggatgacaggcaggcaggctcacagacaaaccttttttatgctaagccaacaaaccaccattttcttcttttccccttagtcgggccttaccccaatccatgttgctgccttcatggggcatgtaaatattgtatcacaactaatgcatcatggagcctcaccaaacaccaccaatgtggtaagtattctttgaacaaaggaggtccattgtgagtatttaataaactggcaaaggtggtttttatctactttttttattttttatttttttaagagttggagtatcgctctgtctcccagactggaatacagtggtgcaatcatagctcactgcagccttgaatcctggactcaagtgctcctcccatctcagcctcccaactaactgggactacaggaatgtgctatcatgcctggctaatttttaaatgttttgtagagacgggggcctcactattttgcccaggctggtcttgaactcctggcttcaagcaatcctcctgcgctggcctcctaaattgttgggcttataggcatgagccaccatgcccggccttattgttattataattaattaatatgtaattaatatgactacttaaaagaagaaagttcaagaatacatttgtttcctttacttcaaaggcaagatacactcggtctctagttggccacaaattgttaggacttacgaactacgttcattaaccttacaggtgcattactactggatattatgttttaaaaaataaagtgtggccgggcacggtggctcacgcttgtaatcccagcactttgggaggctgaggcaggccggtcacatgaggttgggagttcgagaccagcctgaccaacatggagaatcccccgtctctactaaaaaatacaaaattagccaggcatggtggcgcatgcctgtaatcctagcaacttgggaggctgaggcaggagaattgcctgaacctgggaggcggaggttgcggtgagctgagattgagccattgcactccagcctggccaataagagtgaaactccatctcaaaaaaaataataa

SEQ ID NO: 60984 - DNA, 1082 bp, Homo sapiens
cccaaagtgctgggatttacaggcatgacccactgcacctagccctactgtagacttttaaacacagactgtgacttgctcattatttgatccccaaaacctggaatataatatgtattcaataaatatttgttaagattttaagcaaaacttcatctttgaagggtacagcctctcataatcatggccttctagttaccagttagtcctaacaagagactattttaaaatatttaaatatttttaaaaatgtttgaaaggaacatgctctaattaactttccattttagtgaccagaatcaggctgtcattttccatgtagaagtttcccagaacagaggatttgtatctgtagttgtgtttatgcaacaatgacaagttgtccttaaggaattctcatgctatctttttggcagcatcacttgcaatggaatttgttgcttatttgtcacatgtcatttctaaggaccttaagtggacatcctatggacagtgtcatccactggggaagtgtattagtgttcaagtatttcgactgtgtggacatagccacttggaaagactctaggagaactaaagcaaggtagcagaaaagcaatgaataggtactgattagagtgatcctgatctgtactttgcaaaaatagtagcactatatttatttagactttgcttcctgctcagtcttgccttttgcttaaatgttctcttcggaggtgttaggcctttgtatcatgaggtcaatcaagaacccctgggtgtccctgagacccttctagagtaccctgaagactggtatccttgacctacttcaaccaaaacaatacgtacattaaagagatttgcagactcgtaaaacaataccattcatctcatcttttttatttgttttggaaaataccgttatgtttcataagataaatattttaagttagcatgtaacaagattgccattgttaatttaaaataaattaatgattaatttttaaattgtcagctttattttctaatgtggtaaataacaatagttataatcctcataatcaaaagctctttggggttcctcaataatagttaggagt

SEQ ID NO: 60985 - DNA, 1052 bp, Homo sapiens
gataattgcattttcatgaatgatcattaatacttcctgctgcttctgttcggcttgtggtttttacagtattgtttagagattttctgtatggaagaactagaactagttttgacataaatgattgatgaaaagttaactttaaagtttaactcttcaataatgctcatgaaaaaaacctagactctaatattgaacaaagcccaaatgtaatccaattttagtgtgcattttagaggtagctaataataagatcattcaacagcaactgatgtgcattaattttaaatcctgtgaagttaccctataatgccaaatagaaaatctttgaatttggatgtttcctatgttatatatatatttttcaatgattgatccagtaataaatacatatttaactgttggaggaatccctcattttattgttgattttcacttaagaaaattgggggcaagtaggatattttatatagtcaaactcaaaaaaagaaatcacaaaacttgtcttttgctgctgagactattatagtgtttgttttgaaatggaaacttttagttatgtagtaaatataatatttacttaccaactaaatttgttctgtgtgacaatataaagatgctacctcaggtcggttataaatttggatgataatcaaatttaagttatctgtaagaccaaaaagaatttacaatataatgagatatcttttcgaagtcattctctttataatgttaagacatttttagtcgcaaagtaaatacgtttgccaattctatcctaatgcaaatgtttattttttaaatgttttatcatgatcctcagaatatattgcaaaacctagtaataaaaattaaactgtgtcttctaattggactgttgataaatatataattagataatataacataaatttcagtgtatttcagggaaatattcatagttactaataatcactcgttaagcataagactctgtaaggaatttaattcttttattttaggagtctctttttacttttgtaagtaagatttttgtaagaatatctttgtag

SEQ ID NO: 60986 - DNA, 1077 bp, Homo sapiens
gtagctgtgtaattttggacaagtgtctccacctctctatgctttgtttgcctcattggtaaattgggcataataatagaatctgctaggtagggttgttacaggattagatgaattaaaaatttacaaatcaattatactattacctcaagaaacaataataaatgatgatatggatgatgtcctgccatacctgcccatttttaaggttagtttttaagtcaagaccgatgagctcattaaaattctgatcactccatctgtagttgctcaaaatcctaagttccaaaattgccttcattgcctgtgtttatatagtttgatgtcttgccctggtttgctattctgcagctgtttgtaaaggctgcaatttaggtgggccaacctgccacattcaccctgccaaacagcaggaatggtccaggcctgacttctcatttgcagaagagaaaattttatagatggtctagaaaagaacaacctcctggttaaagcctaccagaaaaaaattccctctactatgcagagatcatgtgtttacagttttttttttaatgtcccacagtagctttattcctttgagaaaacaaaaactttttttctagctgcttggagattgaatgtgaagtagagcttgtctttaagattcttattagtaaccctcgcttcccttactagccacaacctcattcttgttcttgagcatccaggagtctctactgcaaactcgggaagcattccataccgtggattgtaatcattttttctatttccttaacccccagacatacacacgcatgcacatttttcttaaaatccattttctcaacatggtgtaagttgaaatagaggacctagccccagtgtcaagtgtctccttgaaactagcctaatagtgggaatataaatataaggtcgtataaagccagtacagtgtttcaaacctcttaaaacctgatgaaagtgatagactccaccttccactccagatatacgttaacacccagtaggcacataattgtttgaggttcatgaatctcctgaatttgtcccatggagtccagtttaataataaaa

SEQ ID NO: 60987 - DNA, 1111 bp, Homo sapiens
tacctcccactgatagtcactttttaagctctgttttcaatgttgtatattctaatgaaatcttgttcttggtaaaatatcatagccatatattttgatctaacattttttaagagttttgaagttgtgtacctagtgccaataacaaatatgaaagatattttcaggagggtggtggcaacatttttaagaggagtgttctttataatggcccgtgtgcgtgggaataccttggggatgcagaacgcttttttatacctctttgctgtgcgtctttgtagtgttcctcaaacagagctgttgtctgtattgctcacatctcctgtgaaatctaggcactcccatagcatctttggcatcgggataatctggattagtaactatattattgttttattcttcagttttctacagctataaaagtaccttttcagatcacatttgtcttagcatccaagaaatgtggaatacagaattaagaattaatatggaatatgaaattaggaacattaactaatgtggaatatgcttaagatatagacatgatattagatggcctgaaattagttcacaggtgattttcagtgttctcttttcatttgttacctgttggattttggatgttggaagcaagtgatttaggtgaaaatggcaatggcgggcaggcaaggcctgcttctatgagctggtttagtactaggctgttattagatctgcctctcccttttccccttcacatgttcaaaaaggagtaagcatgctagaaaaatataggcccaggtccatggatgtgcagaactggcacttgccgtagcaagggttctcaaaatgtggtctctggattaactacatcagcatcacttggggacttgttggaactatagattctccagccccgcatcagccagactgaaccaggaatgctcgggtgggtccagcagtgtttccacaagccctccaggtgactgtcatgtatgctggagttcaacacgactcttacaagaacagaaacttcacccacaactgtattctcgctgtcatcacctctctttatgactgcttaatacataaaatccaatttcaaactttagagaaaggtacctctagatct

SEQ ID NO: 60988 - DNA, 1049 bp, Homo sapiens
ttatttgagacggagtcttgctgtgtcacccaggctggatggagtacagtggcgtgatcacagctcactgcacccctccgcctcctgggctcaagcaattctcatgcctcagactcctgagtagctggacttgcaagcacctcaccatgcctgactaatttttggtatttttagaagagacacggtttcaccatgtttgccagactggtctcgaactcccaacttcaggtgtctgcctgtgtcagcctcctgaagagctgggattatcagcatgagccactgcgtgctggccttgctatttattttaatacagaattcaaatgaacatgagaataaatttccattgtgcacttatacttttatagtggtattttttttttcattctaaatgcatttcttggtctttttaatgcattgttatctgaggtacttgttttataatccttattagaaagaaattttaaaagtaacagggaggtgtacctttacattctgggttcttgctgaactgttctctgagaccccgatggcctaagcagtgatcctctgcccatctgtggctgcccagtccccattaaattccctgtgacttgtcttgattgtttcagagtctgaattgtaggtagctgcacttctacctgagcctgtcatacagtttcccaataaagttcaaaatagaacttaacacctttacatggtccggtagtttgtgttttaataaaagaagctggactaaaaaatgcaaatgagtagtcttttatttttcttcttcaaataaggaacttccccaatgctcctgccctgggatggagcagtctgtgatagcactgaagtgaataattctagacttggcagttctatgtcaaagcaagtctcataaacacagcagatgtacgttctgggtgactgccattagcgtgcatctgaggggttattgactggttatgggcagatttgggggtagaagatagtgaaggaaggggaaccaggactttaccccttgttgttttattttctgagtgattgcccccaaagaaaaactttcccag

SEQ ID NO: 60989 - DNA, 1055 bp, Homo sapiens
tccttgcataaaaagagtgtatttagcaagtttccagcttcccctcctaaagtacaggttcttaaatgtcattgagggattgtagtcaagaatgacgtggaagaactgagaaaaagagggaatatttttaacaacttttgcaccttataagcactcgaaattatttgctgaattgatacagtgaatgaagttttactaagagactgtcattcccaaacaaccatttaagtcccacagttagctctttgcaaactttccacagccctcagggaattaaatctgtcattttgagaaatactcctgaagactcatatgttaaatacatttttctattcattaacaatagtactaattagcttatctcagtagctaaatgattgctgaggcaggtattaaagcttaagaaccctatgtacagacagaggaagtatcaaatgattcctttaataaatgaactttattttgcacattcaaacataaatgttgaaaaaggaaaaaaaaagactgcttgggttgaatgaagaaatcttcattatatagtttatgtattgtgattatgtagaaggaacaaaatattacttatacaagataagattcattaccaaccaatttatcccccaatctaggcagtgtccatgatagaggcattgttacagttttgggacagtcggggactgggagaggaatgaataatctgaccaatgtagacttatctgttgtacctggtttctgaacctaaggtggcccagtggctgtcttcctttatcggcggattcccttctccctgcgatctgattgctacttgcaagagcctctaaaattttcaatcacatatagctagttaaccttcacctgaccaaactggcccacttccataactgccacttagaattatcagtgtattcaaacgctcccacttgtcttaaacaaaacagaagaagtgagtctgaaacctggacatctttccttagacattttcatcatagaccctctgtgatttttttattgcaggaaggtctacccagtgatacatccaacagcaaaagtatatgaag

SEQ ID NO: 60990 - DNA, 1193 bp, Homo sapiens
attatccccatcttacagacaaggagactgaggctgagccttgaagctagttgcccaaattttcaccctagtcagacagtggtagagctaagattccaatttggacagtctaactctctagcttgtgctcttaactactgtgccatacaaggtatgtagtatatggcattaatattttcacagctacacatcaaagtgggcttgtttcagaaaatcttctaagtaataagctattttctagacatgtgaaactttaaacgacaggctttatgtctctaattcagtattgtagtgtctgtttttcttaccctctgcagtaaattttaatgttttttcttaagattcttttttaaaattttttggaagttagaaatgaaaattaccaacacaaggatttcaaatcctcagacacattgtgtaatgacaacataacagtgtgttagatgcctgttgtatgtcagcaatgtgcagaggattcccatgggttattcttttttcttccctatgactttcctatgaggcaggcattattttcatctccatttttgtaggtaaaactaaggcttaaaaataccttgtctgaggtcatatagctagtgattggtggacctaggcttgaacttgggtcaaaggactttgggttctgtatttaaccactgggtttattgtaatgagatgctagcagtctcttttaaggtcagccacaatataagggtttgagaacagattttttaaagacatgaactatactgttatttcttgctattgaagctcagtgcttcctgatgttttacaggctttccccattcctaattacctgggtatctctgacaccctaagatgccaggcaagagtaaggttttgtactgcagcagctggacttttatggtagaagattgtgtagatctttatgagatcaaggaaacttgctctgttccctgctgcattgagtatatggactccaggtctccagggagcatggtcaattagcatacttgatattctgtaccataattatgtgtttacatgtctgtcttaccaagagactatgagctccttgaggctggagatggtgtaattatctactacaaccaaactggggcttgctgggtggtgaatgagtgtatgagaggcagtatcatgtaatgattaagagtgtgaactatagagtaaggttgtctgagttcagattc

SEQ ID NO: 60991 - DNA, 1914 bp, Homo sapiens
caaagcatgggcattgatgattccttactgatattccaaggcagggggaaaataggaggaatattctgggtcagtggtgatttattatagcccgtgagtacttagagtgcccttaaatatgactcctaggtactgagctgggagtaagaccccaaagcacttttcctccatgataattaataaaaattgactaaaactctgtgatctgaataggaaaggcaggtcataaagcatttttatgtgtctttgtgaaaattcccaaaggaaagatatccttaatttgagcagtaaggcatgtgctttctaaatgacatgcagattgcatctcccacatgtacccctcttcaggagtgaccatgaatattcctggtacctttgccattttcttcagagttaggatctatagaagactctctgccttttgttgcatagctgactttgagattgaagctggagagctgcagttgtttcactgcaagatgttaaatatagatagttcctactttgatattcttgtaaataaacttcttgaatatattttcataaaaatacaaacttgggttaagaaattgtgtgcaggcgtatttcaaagccttgcacagcacagttgttatgaaattgccatactttgctagattctggtctaattttattgtgtgaggtttctctgtgggtaggtcactaccacttgccccctgtccatacatctctgcctacccccaccgtgataaactagcttctaagaaagatggaaaaggtacatatatttgtatgaagatatggtgtcatattaatattgacactatattttagggttgttaggctagctaggtttatgtacagcagttttcggtagcagtgatgacagatctgttacctttgtgcctgggtccctgtttgacttggaagcaaaatagggaaggggtgaggcagagggagtttctggactcaatgagctgtagcaaatgctttgtggaccaaagtgctttgttaccagtacaacagagtctgtccaatgtaaatctcttagcaaccagaagggaacaaggagaaatatcaatatcgctattgtaaatgtgcaagtggatttaaatgttttgttctcaggacactcacagagtagatcctaaaactggctcatggataacactttcattgctgttgtacttgttaattcttaacatagtaaaataggtatattctgtaagatacagtgtattacagaagatataatattcatagtccaattatttcatatactacttgtaatgtacaaagttaagactgaattattttgaaaacactctagatttccttcagtggcatagccatatatgaccctcattcctctataaagtgaattgttatgactttgagtttctttatccccacctttttctaagatcctgatgaaggcctatgggctacttcgttccatgttgtagacctcatgtcaataaaaaatgctgcttctaaatattttgtgggttattatggggatagttgctcttgttcatatgcagaaatattgtataggatttttttttttttgagatggagtctcactcttgttgcccaggctggagtgcagtggcatgatctcggctcactgcaacctccacctcctggcttcaaatgattctcctgcctcagcctccttagtagctgagattacaggcacccgccaccctgcccggctaatttttgtacttttagtagagatggggtttcgccgtgttggccaggctggtcttaaacacctgatctcaggtgatccacccgcctaggcctcccaaagtgctaggattacaggcgtgagccaccacaccgggccaggagcttttaatcacataaaagtaatagtggatacgctcaaaagcttgggaaaatcctaaagagtatctagtttataaa

SEQ ID NO: 60992 - DNA, 1028 bp, Homo sapiens
cattagcgtctataaagaaagaaaagatgatccaggagccagtgggaaagacgccagctttttagctggctgttctcttcaacttgctgaaaataaaagaaattgtatgaacgtttttcaaaagtataagacgatttatattgggaaaatgcatacgaagttttaatttttactctgccccagctgttactaatacagtaaaatatcttagtagaaaaacactcatttttactacaaagacccaaatacctttcatctgcttttggagctgaattacatttaatcccccaccttcatttttctccatttttgtatggtttcataggcaatggagaaactttccagaactctttcttcatgaagatagtttgtgtggaagtcaagcatgtgagcatcggtgcacatagtaggcccttggtaactctatgaccagcgtggtttccctgtggttcaccgtgaggcctcagagaagtgcgcagtccattggtagtaggaatgggatgccatggtccctgattctttcccttcccatttttatcactgcttcgcagagactataaagcgtcctacaagaggaaaagaggaaagacctttgaaccccaaatctagaagtatggtgagtaaaagttgtttgcaggaactcacacttggcactctttgtgaagcagacaaacaacagctccagagaaccccaaccaaatcctcacatgatgcattggacttggtgctgtgtcctttacacacctacactttcagccctacaaagtcaaatgcaccgaccgccaaagttatggacttttgtatcggaagcacacatgctaacaaagtattttcatcagaacatcttttttttttttctgactcattttcttggtgaaattgttgtttgtgtgtgtgtgtgtgtgtgtgtgtgtgtgtgtgtgttcttttttttactaggtctcatatgttttaggcccagcctgacatttcagcagtttcttgctaaagcgcttactgtgaatactgtgtagtatgtgtgcaaatga

SEQ ID NO: 60993 - DNA, 1040 bp, Homo sapiens
ccttacatattgtctctggttgctttttcacagagtccattaggtgcaatagagaccacctggcctttggagcctgaaatatttactctctggccctttacaaaaatgtttgctgactcatgtcttagaagatacaaaagataagtaggatgaaatctgcctgaatcaacgaatacctcacagtattacaaacaatgctgttcactctcagcccctttttaaaagatattgggaaagaatgaaaaaattgttctcgagttgtattttttgaaaggacctcatcacctttatctccaaaacataggaccttatattccagacagactgttttgaatattcaaactttaatcgttcttgtgattatattggcatgatctaatggaagggcaaggaaaaagttgcaaagttgtggaacatataacatgaaactcaattagtctgattccaatttgccttccaaaacaacatgaaagagaaaacctgctaacacttgccaagttcaaggacaagtaggaagagggtgaatcccaaatctactcaggaaccctgagtgccaatctgtgttactgtctccccaacaagatgatgtcctgtgtttgcgtgttaatgtttttgttctctgtgatgtccgtcttgcttcatagacattgcttattgaaacacactagtaagatagggaagaagcaggtgttatttccactctacagaaggatgaggctataaactctacatgtagccctttccatggcaggaagtcagttcattgctaaatccaagaaaataagatgtctttttgttagacttaaatttctgcatggtggatatgttccacaatatgctaaagaattattatctgagttttagtctgaaatttgactgattttcattatagcatctggagtagtgtttagtttttttttttttttaatcctactataagtatgacctcctaaatcaacgaattaaatgcttcattctctagagataagatcctttgctttcttatatgtgctgctccattcctcctacacagagtcagc

SEQ ID NO: 60994 - DNA, 1079 bp, Homo sapiens
ataatcccagctactggaaaggccgagacaggagaattgcttgaacccagaaggcagaggttgtggtgagtcaagatcgccccactacactccagcctgggcaacagagcaagattccatctcaaaaaaaaaaaaaaaaagtatatgggaggatgtgtatagattatatgcaaatgatacatcattttacatcaggggtgtgagcatccttgaattttggggtctgcagggggtcctgaaaccaatctcgtggttgcagagagacaactgtatttgtttgctcttcagtgcaaaattttaagcaaaatgtgtcttaaaattctgctgagtgaaaaataacccatggctgcagaccatggggaaagagaatatatcccaaattctcttggttagtttatatggcagagaaagttaaaataagcaaattatgataaatacttggaattttaagcttaccatatataaaaatctaggtgtctggtgcttcgctgaaatttatgtacttgtatgaacactagagggaagtgttgtgaatagcaacaaaacaaatgagtaggaattaagtgatcttattgtacttactgtaaatataattttacttattatgccagatataaacattttctacacctttgttgtttaagcatgaaacagattttaataggaattccagccatgtaattgctgttgtgcatgtataggacctacacacagcatttctaagagaaaaattcaagataggagaagtagaaatcaagcttcagaaactttacatattaacaaaatatccagaggaaaaaatgggcttctgataataagagtcagaggttttattatatattagttcattctttgttaataaaagtaatgctttcacctagattttttagaaagtgtattaggataacaatcctagatttctaaatctcaagaaattgcatgttctcaggctatttggcagtttttctcatctctaaaatcaggagtggaatgatattttgataaaaatagtaatgctcattgaaaagtaaatctgaacgatgcaagaggaatgatattataaagaaaatagtctctca

SEQ ID NO: 60995 - DNA, 1145 bp, Homo sapiens
acatttgtgaaatggcacaacagacccgtgattgtgcctgttcctgattcaggccatgtcttctctctactctactacactaccgcccactgcatgtcactgattcgctctcagacttaaatggtttctggcaggatataccacactaggaatagtaaggacccaaggataaggcagacatgaatgaggggttgtttgctttaataagcagagcctagaatcttcgagaatattctctcaaagaaatcaggaggccctaactctaactcttttcctgtcattttcaccttccccatgaggctccatcctttcatgttcctcttccaatactctaaggagacactgatgatcattttatcctatgacttaaagggcgacctgaagggtgaatccccttttttggttccattaacacaacagagaccactggaacttgctaaacaccaagggagagcaaaagggatataaacacaattttagaacatattagcaatctattctataaattccaggcttctgttctacctgacttcatcttctgccagaactggcagagcctttatcttctcctcatttccttcaacatccatacattagcacagtgatcctaatggttttctccattatgagggcaacttttacttacttagtaagagacaacatttattgttcataggaatttgtaggctcctttcaattaccatacccatcatttctacccattcctggtatccacagtttagctctaactttgcacatgtttagcttctttctatggagagggtgatgtattattgccctctgctcaggagctccttctgagtatgacaaaccatggttaaagtcaaggtagagagacttaaggctgtcttacaggcccaacttcctaagaaatatgccccttccttagattgactccaggaatggagacccaccaatgtttgaccttttggccagaagactagaaaagtcccaactatagttgatagttgaagactcgggcaggcaactaagcacatggcccaggctcaagggagagaggagcagtaagaagaatcctattcagtgttagagagcagtcaaacaataaattaaggttaaccagacctagcagcaggaagcaaaaatctagtgttggagattgc

SEQ ID NO: 60996 - DNA, 1033 bp, Homo sapiens
ataaaataaaggctcatatgagatgatctctagggtagttccagctctacttaatatttggtttctactatagccagaaaaagagcttaatttcacaaatagctagacttttcccaatgaaataccctaactcttcatcctaagtcctctttttttgaaaaaaaaaaaaaaaaagaaagaaaaaaaagaaaaagaaaactattcctattaggaattcttacactgctgtaaagcattctgtcaagttttactattgagtttatttcggaaatcatttgagaagatgtccctggcttctaacaaagggaagaatcctgcaatgtttggcctcagtggcagagtgacctagcctttcaatatccctctagtcacactttcttactcatttcactctggtttaatttcctcccaaaactcttcaagaggaatgtctctcctttcttttgaattgtacagtttcctgccctatggatacagacatgatgactgatcaggactatatttatttttgctggtcatttagatgtggacttatgttattccaggcaactggaaatcatacatattgatctgtaattttgtgcaatgtgcatgggaatttttatagttgacgtaggatctaaaaattcctacacaagtctcagtagtaaatgaagaacttctctctcttttattttctgttctttcttttttttttttggtgactaggtctcactctgtcacccaggctggagactggagtgcagtggggcaatcatggctcactgcagcctcaaattctcaggttcaggtgatcctcccacctcagcctcctgagtagctgggactacagtcatgtgtcactaggcccagctaatttttgtggggacagctttcaccatgttgcccaggctggcctcgaactcctgggctcaagtgattgcacctgcctcgtcctcccaaagtgccgagattacaggtgtaagccactgtgcttggagcaggaacttctcatgagaatctggtttatcacagaaacatagttagaaaatag

SEQ ID NO: 60997 - DNA, 1050 bp, Homo sapiens
caatttaatttttacacaaggacttcattttacaaatgaaaggactgaatctccagacggtccattgactggcttaggttgatacagtctatgaaataacagagccagagttttggctgtaaatccaattcatattcagagttttggctgtaaatccaatttatatccagaattttgactgtaaattcagtattctcaccactagagtaaagctacattttggaagttgcccccttaaactttatcaaaaacatatggttagtgcctacatataatttttggcattgcataatgtagtttaaaatagcagagtaggagcttatagttttctatgaagctctttgttagctgaaagaaaatagtttctacctacttttcgttatttcctgatcgttctcttaggtaaccaaggcaaacaagttaaaatcacttaaaaaaggatgttataatgtgctgtgcctacagaaattatattattgtttatcctctatacaatttacatcatcaagtcacatgtgggctgccatatttcgagcatttgatatgtctaaaggctcctccttttgttccttcaactttattaactccttcattatgaacatgattttggagaaaaaatttggaacttcattgttctcttttcctccattaaagtcttcttaaaaatactttatttgttattttattctgagatcccagttaccagattcataacaaacatgtaggtatgacttcatttctcttagctcctggcttcaatgttgaagacaaaatattattaaaacaacaacaataaaacatagaggtttctgctaagtcctgttgttttgatttaaccaagatttctctttcagttgttttcttttttgtacattggttagagatgatctttttgggattataaacccttacttttaaagcgctgctttaggtggagttggaatatatctatcagcatggtgtgtgtctttggtgtatcttggctgcttcagaaccagattttttcgaaagcgactccgtcccatgagaccagtggaaatgtgtccagac

SEQ ID NO: 60998 - DNA, 1006 bp, Homo sapiens
tttcagtatttccttatttagcatcattggtggtgaatgttagcaatactttattattgcttatcttcatttaggatgtgagtttaataaggagggaaatggtatctccagaaagaatgcacatggtatcagaaggtggaagtccaggctccttatcttaactttgttctctaacaatgttagcttaatcaagtcaactagtcactttgcttatctgtatattgtggacagtacctcgacattgttctgtccgactgtcatatcttttgcaagcctattcaagccctttgtgacctaagaataaatagagactctcttcttgccttctcataaggtcttgttcggcggtatagacaagcacgtggagtgtgtagctgacatgggcccatggtgagggctccatgagttcctgggggctggagggggaggtcgagaaaacattcaggcttcgaaatcattgtcattaaaagcgaaagcctaacaaaatatgctctgtgtcattttaaaattgctattacacattgatataaaatcaaagagaaaaaaaatcagttaactttcctaagcatacaaaaagagctgaacagaacccattggatcaaaggtctttgtcatcttatttttaaccatgctgaaaattatctttgaaggaacatgagcctgagtaaagaagaaaatgggcggcaagggttgcaaaacgacaagtagttatttacagacttataccttggtttctatggctatatatttgatgaaaatcccattacatgcaaaaatattttggaagtgttagatattttcattattttggaattaaagtttttaaatagagatattacagatagaagtctctttgcttagtatgaatcatggtatttcatgcttctgtcctccagagatcaggtgttttatgatgattgaatgcctgggccttggactcaaacaggcctttttccaaacaccagctctgccacttaataaccaattcttgggactaacaagatac

SEQ ID NO: 60999 - DNA, 1020 bp, Homo sapiens
aaaagatcaagagaatgtgaagaacagttgttctaatcacagaaggttgaatatacccagtgattcaaagacagaaaggagaaaaaggtctgggggcagcgaggtagaaatgggaaggaaggcttttagaaaaaaccttgtatgagaacagaagatgaggcaatttggagatagagattgtgggtggattgtcaggagtccgacggtgataatggatgttccaacaaaaggtaaacataactgcagataaaacctctaaaaatactttcctttcctaagagatgctgaaagttctgttctctgagatacaggggtaaaatgaaattttgtgggtgatttatagcaaccatattttgtttgtgagtgtgcggtgctttgtatggtgcatctatatctctgtgttatcatctaggacagtacttttcaaactttgtgcatcaaagttgtctgagtagctttttaaaactgcgaaggggatctgagcattatttttaaaatagatggctacagtgccaatcaaatgaacatttttagtctgtaaatactattataaagaataccaagcaaagaatgcttctctttgttccttataagaatcttgagaggcatgtacaggaagtgtgccaaaatgtaataaaaacaaaagcttaataaatcaatcatgtatatgttgaatttcctccagcattttgctttgtgcatttttatggcttatctcacaaactctgaagtacaaagtgtgaatacatgactgcctgggacttcactttgtgtgttttctattgttggcttttggggttaagcatatttaaatgtaattaagcaggtaccagaacaactacaattattctgactatgctattaagaagattgatactaggcacatatttattacaacttacttgggccatttttttctttttttaaagacagggtctcactctgtcacctaggctgaagtgttcactgcagcctcaacctcctgggctccagcaattctccttcctcagcctcctgagt

SEQ ID NO: 61000 - DNA, 1083 bp, Homo sapiens
agtttccactcattgcatttgttatatctctcaagacttaaattttagaacaatttctacttttccctcctctctgtttcttggcattgatattgatgaaatttgaccaggggtcctatagaatgttctgtattctacatttttcttatttcatcctagttgtattttttaatttgttcctccatcccccatacttcatgcaaactagaaattgaatctgagggattctattattttaatattttcaacaagaatacttcatagatgaggttttgatacattctctcagtatcccaaacacatttgtttagtaactaatgtcattttattccactcttcagatggacttcttgctgcaatattcaaaagtaattacattctgggggggaaaaaagccttttcctacccaataagtctttattataatcaaatccttatgggagtaaacttcaattaattgatgcatgaaaaataccagagacaaagtgaaccctttaatttctctaaatttggctatgcataaagaaagctgcacctaccatgcctgtcataaactgtcaatggccagtcagactgaacctgctgccctcacattgcccctgttgtgagcaagtatctccatgctctagtgaactcttactgagatagacctactatttggagctttgatgtccatcaaggttttactcccatctctatattaaagcatcatgtttttaggttttggataaacatccaatgtatgtcttttatgagtaaaacagatcacaagaaattatgatatgtgtttggtttgcttacagaccttgctgtatccatttggttccctcttatacttttgtatttttaactcaacatctccattacttctagtcatagggcttgaaattctcactgttagaatcattctttttggtctttctggaaatgtttattaaagagaaatcaaggtatcacattacttgggaaaaataacgcatatataagactcactgtcacctaaaccgagatgatgatctcagtaggcactatccaaagaatgtcttgaccttggacaaacatctcatcttggaatttttcttg

SEQ ID NO: 61001 - DNA, 1026 bp, Homo sapiens
caaagcaccaagtttcatacaagtttttaaacaaccatttctttctttttagaaaaattgatacataataattgtacgtattttagaaggcacgatgtgatgtttccatatatgtatatatttgtgtaatgataaaatcagggtaattagcatatccatcatcttaaacagctaccatttctttgaacaacccatttctaaatgctggatggatgtgtgaataaatgccattttataatggtggttattttcacaacaaattaatatatttcacatttcataaattagggattatgaattataaataaaatatttttcccacgtagtatttgcaaagtaactgctttcactgctaatgggaaaatgtccttttaaaaaaaatttggatgtaagaactttcaagatgaggccttgagagaactgggcacgaacttcagacctgtgaaatttttagtttacctccttctggaccttgaatcttgtaaattttctttatagtttattcatcagaaattaaaatctcaatcaacattatgctttgacccaataagcatcatactactagtttcaaatatcgtggattttactgggatactcctggtcacacaagtatttaattctgattagaagcagagtcatgtctgcatctgctaaaatccagagcctttaatcctggcaaaactggaggttcttcagaagcccgtgaaacttaaaggtagcttaatatacagtgaattgtgtttatgtttggagtatatggttcacatcataacacatttttgagtccccaaactttggaaagatgccccagccacatctttctctttaatagaagttcggaaatagccaaagttgttattcccaggtaagctttctagagtcactttgggattttcttgagtgattttgtttgcattatgtgtcatttgcatagtcctttaaagggtgctgatgttaactgagttgcttcccttgtaggagcagaatcattttaatagctgttatagaagaacagcacttttttgt

SEQ ID NO: 61002 - DNA, 1001 bp, Homo sapiens
ccagttgccctagaactacattggcaaactcccagcaataactagcaccatttagtcctgtaaagaaagagttgcaactgatccagcaacaatcattagacacttcctgggaaacatcctcaagatcttaagcgattcctggttcaatcacctgttttattgtcttcaacaaactgaagagcaatcaattgtttatgaactcaccataaagaaaatattctacttctgcatctaattaacttgtatctgtcaaagaatttatagattgtaggtgggggaagggaccttctattttcaagcagtgttattaaaggccacacagttatatttgtctttttctttgtcacataatctgctttaagtcaaagctaattagtagagatgtgaagaggtaattgtgccttcatgattagagagatttaaacctctgcttttccttttgtaggtaagtgaacttggcattggccattgcttattatgcttcctgtctggctcttactcatgttgccattttgtggactaaaactcaaggcagttcaaaaatactgatatgcaggtgccatggatgctgttggagtgtgtgtcctaagagagagggtaagtgctggttttccattttaaacatagctcgtgatatcaagttgccccctcccttcattccctgactcccgtcttcctccaaaagcggctctcttggtttagtaagcatctctaccctgcaaagcggaaataatgaaaaatgagattcactttgcaagcttgttgggtgagcttctggagaataatttttaccaaaagcctgaaatcatttggcattgttggtgttttcaatgcatctgcatcacagcacattgcatttcacatctggccagtttggaatgaaacttagaaaatcaccagactatagtgatgtaattgtcatgaagtggtttttgtagcttagagaaaagaaaaacacttggctgaaagaatggtctgaagtcccacccaaagtaaaacat

SEQ ID NO: 61003 - DNA, 1056 bp, Homo sapiens
tcaagggatacttgccttgatatgtagatatatatatgaaagctctgtctacctatcacttacctatgtgtctatgcaataaccttaatgattgcaaatattttgtaaggggagatttgacttttcaaaaataaaaagttatttgatactagatgaaggactacttccactaaataatatggtttttaagtcaaaatcaaaatgttataaagagaccatggccttgtgggattcatataatgtctgaagacagctctaaaaaatgagagatggtaactacaggggagtgagtacactgcttccatgtggggatgctttgaaaggaggtctgatgccattgactatagaaggttatgttatgtgtattatctcatattttatatatcaggtatcagtcctatgaacaatccttaaagaaactttagtgggactggttttagataattcatctaaggacaaataataatttgatactttgcaaactttgatccactgaagcgttttatttctaccaaagactgattgttaatagtttgttctaagggaataatattcactatcttggagaaaatagctataaaaccatactgttatcattttgatttttttgaagtgcacaattgcagactcttcctcaagtctttcaaaaacatgtcaaaatgaatcccatgagggaaagaactttatgtcttaactcatgaatctatgaaatctgagttgacaataatacacaaaatacagacattatatgaatcccacaaagcacacatatctttattctagctttgccattcttgaacatgtggctttcagcaagtttcttaactcttctttttcttccttgtttacaaaaaaaatgaggatactactagtttatgcctcaaataattgtttaaaatattaagtgaatttgtacatgtaaaatgctttggtatttgacacaatatgtgagctcatgcatactagttgtgctagagttagaggagattatgttgacttttttttttgctagttatatgtccttggtgcttcactattttgcatatttcctatgtc

SEQ ID NO: 61004 - DNA, 1062 bp, Homo sapiens
atgtaatagtagcaagaggtagtgtgctgcaaggaatatgagattcagaatcaggtgatgtggaatttcccattgccatttatatgaccacacacaaatatcactgttttctgccatgaatacctagcacctacttcaagttgttacaatcttacaagcttaaattgccacaactgtttgtattttaagacaatatacctgaaaatataaaaatgttcattgagtttactgtgtgacattgaactgaaactcccattttctaatatcagaaatgcggttgaatgagatgatacttgtgacccttatgggttttaagagagtactactctataaaaggtattgaattcatcttttcaaagcaatgggtaataggtggggtttgctgcattgctgtgtgtttgctgaagaaggtgcaaaggcctaggagaacctcttctttgtagttgctgtcttccattcaacatctctaccattacagtgtctctaacaatacagccaccttgtttactaatttgtgttctagtttttgtatttttatcattgagatgcaaagaaaacaagaaacgtttcctaatcttttcaagtagaatttcaattgccatcctatattatatttaataacaacaatgcagtgaagtgttttgaattttaaaatcgtttttaaaagaacaccccgtttaatgtcaaagtagttggacccttttatgtctgggccttttatagaatttccctctggggcattttgtcaattgcttacacgtaggtcatgggcaatttgtcattctttttaaattgtgacaaaatactcataacataaaatttactattgtaataattatatattatattgcaaaatacattggttacaatatatatttaaatatacagtttagtggcattaactatattcatgatgttgagcaactatcaccactctttggttctagaactttcacacccccaacaaaagccctgtactcattaagtccctccaaattcctccctctccccaggctttggcaactactaatctgttttctttctctatgtattttcccattc

SEQ ID NO: 61005 - DNA, 1703 bp, Homo sapiens
gaataaaaactaacttactttatttaaactagtgtttatggtttgtgtttcttctaagggtagacttcgtaactgtatctcattctttctttttctttctaccagaccaccatagctttgccttatgtgtgagagctgtacttgtttcctctctgatgaatctcacattatccaaacatacattcattttttaagggcgagtcaaaggaatgtccatttctaattttcattccctgttcttaatgctgctggaattatattgtattcttatctggtcctggagtctttgattagggtgtcttgaaacacaccatgccctcttactaagttggtggtgtgctggcagaccttgagcacacggcagtttcattgacctataattttcattctcgtgtttggacattgcttaatttgattgctactgctctacaggcaaataaccttttgaagtcttttgttgttgagcaggtgatttgagtaatggtgtactgagcatggtcacgtgttcagtgcattgtttcttctaatgatacactccatatcaagaggcatgttaatccttttccattttactttaaacatcattgttgaatttttttctcttagtcttacatagctataaattttttaaaaaatgttttctgctgggctgttaattttatttttataaatgctatccattttatagtcagtaggcattcaaaatgattcaatgtcttgtgcatacacatccatgaaactgaaattttgactcctccagtacttaatttgaaatgattttttttgaacttagcattggaatttgcttattttagtacaaaaatttttatgttgtctttgcacaaggtgattgtgcacttagaactttctttttgtaaggagagattggatgaacctgggatattacttcttgatatcagaatttcataaaatgttagacctgtagtataatatcaccttttaaaaatcaaacttagtgagatagatttactggagattttcttcaagctttttattataaaaaggatggaaaaaacatgatataaatttattttatatatagtagccttggggcatagactctgagcatggcttcagactgaggtactgaaaatctcttctccataatttcaaaatccaaaatgaaaaactgaaattttttccttaacttctttggcggcaaaatctgacctgacctgagcacatttggtagcaaaacctgatctgacctacgtgaagctatttatagtctttattcatcctacttagtgtgagtattcatatgttttgctgaaaaagtaaaaattctttgcttatgggatgctgccccaagacactgctggggatgttcataatatttatacatacctttctaagatgaaaaagttctgaattccaaagcttggctggctgcaaggatttcagatcatgggttgtgaatctgtattgagttctgagctgggactgggagccagtaaggttagcttggggtgagaggaaaggggcttgtttttgtccttaataaattccagataaagtggtgctctgtaatgccaagcactatagcaaaggtctgtagtgcagttttcagtttggtaggaaaaatatttctagaagcactctaacagaaaactgcttgcttaatcataaatctgaacatttggaccaggtggttttcaagatgatatttataaagcttggtt

SEQ ID NO: 61006 - DNA, 1620 bp, Homo sapiens
atttttaagaagctgctagaatctgaatgcttttgtttttccagtctattaatgggtgtgttctgtcttggaggaaaatcatcacaactcggatacactgctaaaatatttaaacagttaaatacagtcatttagatttcactgacgtggtgtgtttttcatagtgatattcaggattattaagtaaacacgtcctaattatgtgggtgggtgtgtttttttctcctttaaatttcacagaatgctcgttaatcaacagggtataattactaatgaatattattatggtatagatgtttagctttaacatatattttagggaaacttagagaaacctatagttatactttaaaattacagcatggaggtgaactccattttaattattgatcactttatggctgacagatctcaggtttgcattcgaccctgcagtcatacagccatatacccagtttgtctattataatccaaaaaattaattttgttttccatgtaaattgaggaatcatcaatatattaatagatgattatggtaaacctgtagattcattttggttttcttgaatgtgtatatcttcaaaggtgctcctaactttttaattcattttgaaatggggaaaaaagataattctctagatctgtcatttggttttgatccattgtgatttataaattgtcttggttttagggtgtgccaccaatggaaaagacagttgtgcatctgtaacaaagaaaaacaaatatctaaaataggattatagctcatagatatttaaggagaatgtgtgctgtattttaaaatctatagtcaaaatcttcagatataatattttaattactaggactcatatataattttacctctttaaaatgcttccttggcccaatgtaatgtatgctcagacagtggacacatacagaatggtggctatagtagagaagataaagatttcagctactcgtggaatatatcaggcgtttaaaaaaatgttcataatctgtttattattaattaaaaggttaatttgaatatgatgttcttaagggacctactaccagcagactgttctgaggtcatgtctatgtacatgccaacattctagggcagtggttcaatgtcttccagatagtgaatctgtgcagactggttttaagtcagccttgacttcttgtacattgccttggcaagggttgatgatgttgcaaaggtgttagtctgatttcccaagggagcaggtctcagctgcacagcacaaatgatttgtttaatgcctagcatagtggcactggtctcaaaaaaaaaaaaaaaaaacctgtcaggtttgctcatgtttataagatatggctttaagtgtcttgacaggctccaccatgattctgaacatagagtgtcatagagagccgagacagacacatgaaccacgacggtgcaatccatattagagtgagcagtggctggattcgttgtaaatcatcgagcttttatgtggaatcctttaacacgggcttttttttcccctctctctaccttgaaattttcccagctgtgttccatgtctcctcatatgaggttatcctgctcagagcacaatataaagtcaattgctttgagccctt

SEQ ID NO: 61007 - DNA, 1043 bp, Homo sapiens
ggaaggaagcttcaatgggactacgtaaacatgtgacttatcctaatttgcattttagagcatgtggaaaatagatattggttccaggccatctatttttaatgtgtaagtatgtgctttcactgtaaccacttttaagtcaaagcttacaggcatttcattcacagaaacccatgtagataccttcattttcctgtttgtagctttttttgtcagcagaaaaattaatggattaaaacttgagtgaggcaaccatccacttcaccacagttcccttgaacaggagatatttttcttagagccctttcatcaaaattacctttggtacatatttaattttcttgtagtaaatacacatttggcctcctagccttaaaggccctaaaggagatgaataaacattgttcatacttttagaaatattgagaatgtccagaaagcaatagaaacctcaaaggtcatgatttaaaaaaaaattttcctaattatggattaaaatgttttatttgctacatgaaaaagatttggaggctatttgtcctaaagctgccttttattattctatattacctgcccttaagtacttaattctctttatagtgagtcctttgagatcaaggcacgatatcctggggtagaaatccatggataacattttacataaggtaataatttgtatgttttgattaaaacaaatttctttacttcccagctacaggacaggcacagaatgtcttaaaagggttgggggaaaatggtcatcagttccttggatatggaggacctatgataataagagttaattaataggtgcttaaagatccttaagattaattgctgtattcacttaaatatcagttatctttctagccactgctaattatctttaaggtagcccttggcaactctaaaaacttctatgtgatattgatctcaacaaagacattaggggtcattcatgcctcttgactaacagaaattctaagtaggtttcaaaaagagggaagaaaaagggaaagagttttctttctaccccttctctc

SEQ ID NO: 61008 - DNA, 1048 bp, Homo sapiens
gtgttccaaaagaaaatgttcctcaacccaaatttataactgtgtttattatttttctaattcagcatcgaaaaactaagaaatgcatcatttttaaaaatcaggaagtatagggaactgagaagagactgactacctttcatttgtatgttccttttctaattgtcaatattgctactcatcaactgctaacactaaattttctgatggcttaaagtctaataataaagctacatttttatttttttccaagaacttctttatagacagaaataaattaaaatttgccactttcgactgataatttgaagctctagaaattgtcagtaccaatatggcactcctacaacatgactttagaaggcaggaacttttgcatgaagtcataaagagtattcagaagtttgtaaatgctttctgtcactttacttgaaattatttgatttttaaaaatcatccttatgaaatgagcagagaagctcttattaatacaagtttatagataaacaaactgaatctcagcttacatgacttgcacaaagccacatattgacctgcctatgaatacagcacaggcctttgtccattgatttttccatcatcccattatttgactcaactcctttaagagaccacatgctcccattcacatagtttccttgtaagaagcaagcaagctttgttccttggtggcctggactttaaacatgaatggataaaatctgtaactaatggatagaatctataactaagtatagagaaactaaaactagttcataaatgcttatgaatccttctgtgtgtgtctctattttcctttttatttatttatttctttatatttttattttatttttgtagagatgggattttgtcatgttgcctaggccggtctcaaactccctgcctcaagtgatcctccttcctcagcctcccaaagtactgggatttacaggtgtgagccactgcacctggcctgctttcccttctttaagtgcatttgagtctgtagacagatcacatcttgtcatgtgtgtcatttatgtgt

SEQ ID NO: 61009 - DNA, 1043 bp, Homo sapiens
ttgtttacttacttattttctaacattttctgctggaacataagctctatgaatgcagggacctacctacctatctcgttcaccttgctgttgcagcaacaattggtaacatggtaggtacaaaataaataattgtacatccaaataatttataatatgcatggattataaatggatctttataattaactctaatgtcttaaaataaaaatgtaaagaaacattttagtttttttctttagctgtattaatttttttcacagagtgcttttttatatctagcacattttgcagcaaattggtaatgaggaggagggagatatcatgccctttgacagataagaaactgacactcagattaaatgatttatgcaaattcatatgctggtaaatgatagaataggaatcatggagtctttaatgtcctttaaatacaacatcctcctgcaaatgagaacccaaggctttcagaggttacatagctggactcttgaaaagaataggaactaggaaaatgttaaaataaagtaaaatcaaataataaaaaataaaatctaaacaaagtgctattgaattgctttgagggttcacattgcaatgtagcatgcacatcttttgcaactggggaaaggtatatccattttcataaaaaagtatgagtctgtatttaaaaaaatataaattacatattctcacatttattattatattgatgtagattctttaaataccagaggcattctttttttataaaagatttttaatatgtcttttatattttctagctaatattgcctttgaacactgattttgtttattaaatatacaaaagcatccataacatttgtaataaatgttacatgagctatttggtctctagacatcacctctttgactctctgttgctatgggttttcattagtattctgtggagcctgggttgccatagaaaatgtgtggttgtagaggagttactatggcaacaatccgccattatgtatttttcaatatcatctagcttgagatgatagtgaatctgaatg

SEQ ID NO: 61010 - DNA, 1051 bp, Homo sapiens
ctcttaagcagatgtgaggaagtcatagccctggacagagctgactcactgtggtttaatgttatctcctttcagctgagccttgtaacactggtcaaggtagagctgcttgggtggaaacaagagacgaggggcttggggaccctttctattagccagtagcttcaacaaggagccttctcagtggaatctgcctctgccttctccctatgaccactgtataaaaatcagtggccctttccccacaaaatgcttgtagtagtttcttgaatcagaatttcaaacctcctggtggccaagaatgtacaatacgaagtgctttaatggcagcaatctgatgggggaatgtgtgttctttgcatagctagcacattacttttatgtgaattgctcattttgggggactgattttgtgaggcgagttcatggaggagaaaagacttggtattaccatgaactcttaggttgtttgactcatttcctcaagtagtttgctcttcaggacttttgaaggactttatgtaaggcttatttgtatagctcctgaagtcttacacaagtgttctgtaaatttcccagtaaccaaatgaataaaacataaagttctgggatagtttaattgtttatcttaaaggccagtttaatagcagactgtactcttaatatattcatccattcaacagatatcttttgagcaccaacgacatgctagacctggctctagatactcgggataatgtagtgaagaaaacaggctcctgtcctcttgaagcttgcgtttatgtttcagtgtataaaacatagatataaacatttgctagggattgataatggtatttgttctaattaaaacttgcttaagaaatcggtcagtatattttatatgtttcttttaataaatgattcagattacatgttataaagtgacagacaataatgaatgtgtttagaaatatatacacatatttagcagtaggttagattgttaggatttggttctaacaaatcctaagattgttaaggatttggctctagagatcatatagctatt

SEQ ID NO: 61011 - DNA, 1057 bp, Homo sapiens
cactcattttctttcctgtaaggctctttgtattttacctattgtcttaaatactaaggtttgtaaacactcttgatgtctaatagtgacctccatacacacttatttaaaattatcttacctattcttgttcttctgaaaaaattgatatcagtttgtcaatttgcataaaaattcgatttttattttaattggaattgagtttatagatcaattttggagagaactgatctgtgagaaaagttttactaagaacagtttttctgtttatacctagggttgctctattattttgttctgtattttttgttattctatttatatgtttatatattacctcccattcttttgtgtttggagcagatgcacttaattggtgagtttgacattttcattaaaagtcctctgttctttacattttcttctttgcagatcttgctagcattcacagttccaactatcatcttatggaaatgaatcctcagtctctttcatagtttgtctagtcctgctcttaattcccaaggtcttcattctaggtccttgttttccattcccattttcaattacaaatattatccattcttaaatgtattgccaatgttttttagattagctgaagatttgccagccttctcttcatgagcgcgggttatttctgtataataaacctgttgtaaatcttcagcaaaggctaataatttgactgtactttacggctttgtaaatctaaatgatttaaaacacattcttagtccagaactttaatgagcattttctaataactgagggaggggcattaagaaccatgtccacatttttttttttcactctttagagttttatttcactaacttcaggtcaaatttctacaactgtgttctggtcaatttactatccttgcttggcttccccaaatggtagtaccaaaagatttgtgggatagggagaagataccactttaagaagcatgcatttactcatcctctacaaatcaacagagttaggcatctgatcattgaacaatacaaagctttaatagcatccaggagggcag

SEQ ID NO: 61012 - DNA, 1283 bp, Homo sapiens
ttgtgatactaatctttgaaatccttcctgtcttaagaaaatgtctttttggatcatagagtagcagtatccatgatggtggaaccttgcctggcatttagtaggcatttgataaatacttgcttaatgaaggttttctgcttaagggcctccataacttgatcatatcctacatatttttcttttgtttctttttgtttcctgggataaatcttccattagacttagactgatctccttctaggcttacctgtgttaatgatttttgcctccttagttatttatacttagttaaataccctagagtatttctgtctttagaattcttagttcattttggaggatatgccatgtatttcaaaaataattttggatgattaaccaatagaaagttctgctttgtttaacccctcttccagtagttcagtgagaagtgatattatctctaaaattcaacacattgagtgttggccactggttaattgttaattctgaaaattatttaggattagatgagattgtacacttgagggagaagaaaggatgctagaaaaaaaattagttctgaacttaccattaactgtttatgtgactgtattatgcaagtgactaattttcctgagatcacttaaacagtatgccagatgattgtgctactggtttacctactttttgtgtttaatgagagctgaatttacatccaaaaaaatgtagattttaagtatatgaaggttgcctacttttaaggatggctgtgaggattaaatatagtcaattctcctttaatgtagagtaattttggttatcaaaaagttatacattaatccacaatttaatcaaaatagtataaaatgactcatgtcagtttatagttttaaaatgacaccagtatttaagaaaacatagacttttgtatagaggttctgtcaaaaaaattaagcttaagtagcatcaatttgctactgctcaaactgcttaattttttaaccaagcagttggtaatttgttggttgttagccttttttaaaatattgctactttcagagaaactcataaaagctatagaagaggccttcttcctagaacagtgcactctaatcacttttgaagttaaaccaatgccatggaaagcaagctattcaacaaaattttgtgtgtacttaaggggttcaggacctccctaaactccaactcgagtttaaaaagacttatctagggaattcagccacgtatatgacagattttagctagtcttctcccttattgccatttcattccctgta

SEQ ID NO: 61013 - DNA, 2430 bp, Homo sapiens
taagccatacagattgtagttactctcaatttctttttggaagcaatgagggtatgagtaagatacttcccatatggccacaccagacatttctatcatgtgacccttatgggattcaatgatcttgaaatcctttagtttgaccaggtgcggtggctcacgcctgtaatctcagcattttggggcggcgaggcaggtagattgcttgagctcacgagttccagactggcctgggcaacatggtgaaaccccatctctaccaaaaagacaaaaattagccgagtgtggtggcatgtgcctgtagtcccagctacttgggaggctgccgtgggaggatcccctgagcccaggaggaggaggttgtagtgagccttgattgacccactgcactccaacctggacaagaaaacaagaccctgccataaggaaaaaaaaaaagaaaaaaagatctttagtttgtggggtgtgtcacacagcatattatttactttgtttcaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcaggtatgttgtaatatctgaatgtaagccattttctgcatgctatttcaaatataaatttcaacttggaaatctttacatttgctcaatttcttggtctagccttactgagtggactagaaccctatttttggtagttgagaatgccgcacatatgtaaaagagaacaggctgttaaagcaggaacagagttggaggagctgggtgatgtagattaatatttgggcctagaatagcaaggtaaattggccatgggagtaaagccgttttcatagagctttgtcaactctctcctacttggggagctctagttcctgaagaccctttagttagagtcttaagaaaagtagctaggtcaaatgaaaaagattttttttccttaaagtatttgcattgggtgtttttggagacctgtcttcctaacagtccaagttaaaatctaattgtacttggctggggctagagattggaagtagcttttaaggtcagataccactttaaaatttatttgtataattcacttcagtgaaaaaataagctctcagcaattagtagccaacctagatatgttcttttgaatacaggctccttataaataagcacctcctgtacaaggcttaattttaaatagttgccctgagattcctttcttaaatttgagttttgagtctcttccattagggaagctactacgtcttccccagtttttattatagcaactgaaattatggaaggagttttattttgtgaaacagaggtcaaaaatgtttgctggattcttctctcatatattttttttccccagtcttcaggatgtgcttatgcaggattccaggttatatctcatctttgagtttctttccatggatctgaagaaatacttggattctatccctcctggtcagtacatggattcttcacttgttaaggtaaaagcttaactaattttattaatatttatgcactgtggatataaagggactatatatagaagtccctgcattttgtgggaatatgcttggaaaaagtgttagaataagaaaaagtatttcatttttctccctcatggttagtttatacaggttagagatacccatgttattaccagatagtgtttctagtaagtaaaaattagtgcctgagataacatagaactggtaggtattgttggaagctagggtagtctggtctttctttggctgtcagatacatgtaaaacaaagtaatgaaagcctagggcagagtggtggttgtaggtgttttattccagttttgaacatgttttggtcaatttattgtagacatttattatatttcaggtaaattataaaattgtatagttttaagtactgaagtatataaaagtgtcttattcttgcaccagttctaccaaaccactctgcagaggtagcgctgttagttttatttgtaatcttacacttgtatgtatgttcactttgtatgtatataaagatttttttttttacacaaggtggacttatttgcatatgtatatatacatattttcccttttttgtgtaaaacattatcaagacgtagatctacctatgtctatttacatttttgatataattaaaccacttccatattgatgaacatttaaattattttccaacttggttattgttgctcttattaacagtactgcactgaatgtccttatagatatttatcttcgtatgcaactttataggataaatttttagaatgggaatgatggattgaagatgtttatttacattttgatagatattgcc

SEQ ID NO: 61014 - DNA, 1829 bp, Homo sapiens
ggctacgcttagctacgtttggtaggttaggtgtgttcaatgcatttcgacaaggtattttcagcttagaatgagtttaaccagatggatcatccgttttgttttgttttttgaacaccacttgtccctctaagatggagcatctgtattactttccaatttcaaactgtaagtcatttttctgtgtactttgtttttgtaatatccatgctacttcagatgtcaatgacattgtctttggcaacaaatgtcttgtaaagcacttttctctgaactaagcagcattttatgataattttatccattgaaatatataatcataatatctttgccatcacttttagaatctaattttttcaagaaggaaatgaatatgtaaaaatgaaagatagaaaaggccaactgtattgaagatacaaaatagagttggtagcggtatatagaagaaaaatcaagaggcttctgtgtagaaaaccaatttgtaatttaaggatcggggaccaaaaatgtttaaagactaaatgtgttcacattactatagatatgtctataaggtgaagattcttttcttaggtatacaaatgtgatgttgtatataaatgggcttcccacccacaaatgcttattagcctaaaatggcctgaaagctctagtaattaaattatttctctgcgtcctaattttttgtctttgaaacagattatttagaaaatcatgtacttcgcttaagtttctaacttttacttgctttttccagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggcaagtggaatagtggtttttgatggcttttgaatgtgtgtgattgctagattattttctgtatttgtgaaagtcaagaaataactcaataaaagatatctactctgtggcagtatcaatttattgcctctcagctccaaattcattgcatgctatgtgaaaatggaactgaagcctttaagtattttttctttaccagctgctatgttgttaaggtagagggtactagagggacatggcaggaggaaggagttttcctagctacagtttttacattttcattattttttactttatttatttacatcattcccatcctttgttgtactttaattctttatattaaactctccccattcaaatcaccaccttggtttctgtctcctgactgaaccctccctgattatagtcagattgattcaaagacaggttttgttccttaaggtatattatttctgatacatttaggaattgctaactataatttatgtttgatctgtgttatattgctgacttggcatttagtgtttctgaaggaaagggaacattgtataataaaggattattgaaaggctgtcttctgtggagttgtctacccttgacccaaagactgtctccagatcaaaactagtaacagtgctcatctgattagatgtcttggctgcttgttagtctttatcatttttttacatggctatataaataaactaagattattttgttttctttgtcttaaacaaatgctattgacctcattagctttgttctaacaggcaatatttttaccatatgataaatatactaaaatggttggttagttctagatcactaatctgttatttgacttattcacgttttttaaataatttaaaaatcattttttatcgacgcattattatac

SEQ ID NO: 61015 - DNA, 1307 bp, Homo sapiens
ctttatttctttctcatgtttcttattcatgttataatggtactgttagtaccatcttagcaagtaagcagtacctgcactttgttcagtgtcaccccaaatctattatcaatgggtttggtttttcagtggggggaagataaggctgtataactgtcttgatctttagtgatttgaaaagcaaaaaaatatttattatgcttttatctgttttgtcttctaatgaatagaacttagaaatgaaatatttatcttcaattttgtgtacctttaattgacttaaacaatattattggtggcagtcatacaacctttaaaggacagccctaataaaaatataaatgtttaagtgtaggtaattttatgcaccacatttattcattgtaaaaatttgctttttaataggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcaggtagctattaaaaactgagataataaaggtaacatatatgtaacaatgagattacatttatgctttaagaaatttttaatttcctgttttttagagctttgggcactcccaataatgaagtgtggccagaagtggaatctttacaggactataagaatacatttcccaaatggaaaccaggaagcctagcatcccatgtcaaaaacttggatgaaaatggcttggatttgctctcggtaaggagtgcccttgatactgactttcaaattattgatgattctgaatatattcagttctttgttttgcctagaaaataggaagaacactaacatttttgagctaggtgtctgttatgtacattgtattatactagcttcattttagatatcaggaggcactagtggctttgagaggaggatttagcattagtttttgttttttatctgacaggtagctatggatattctgagggagaagccaggattaatacacatttttttttttaagttgctgaattgtagtggctctcctttctagcatttttgtcactattgagccctcttagtttatgctagacgtgtttttcttattggttgatattttaaattattaaagccatcttctgaataagctttattcgcactttgtacctagtttctccatcagaaggatctattgctataccattgtatacattttctcattggtcttcgggttactttcagagtgtaaagactc

SEQ ID NO: 61016 - DNA, 1934 bp, Homo sapiens
tggggggttttggaacttgctggaagctacatcagaaactgccatagttaattgccatttcaagaatgttgtaaataactcaggtggccgtttaattctcaatgtaaatataattaactagacgtctttcctatatttgtgtctcagttttaaagctatttctggatgcttgagtcttaccgtaattgataacaaaaagaggttattgagaatatctatgatttacagagtaagttattctagacctcaagagtgaaatgtaggggaggagacatttgtgtgttaaactaatggaaatgctcatttaatagatattcactgaaagtattagttttggtttattgctagaaaagttgaggttttatggagatttttgtaaaaaatggtttatttcctaaataaatatctctttttcttttttctcccagaaaatgttaatctatgatccagccaaacgaatttctggcaaaatggcactgaatcatccatattttaatgatttggacaatcagattaagaagatgtagctttctgacaaaaagtttccatatgttatatcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgtttaacaaataatgctgctcattgtgattcttacctataagcagcctaatttgaattatttgctgcaatcaagagaagtgtacaatagttttattacttttttagtgtacttctatcctttttccaactatatctcctctatttttcctcctcgttaacaggctagaatgtgcattcctgggttaccgatttttacactcaattggatgtgtaatgagggatctatctaatccatcttgtcttggaaattttgcactctagaagaaagtgtgtcactttcttcagcagcgagaccttttaagattggtggtttggttgtcctgttctgtggtctttggtggaagccagtttgttgtaagagaatgtagagcttattaatgtaagtcatttggggttatattgtggagggttgtttaggattgcatggcaggaattgggtaaatgaaaggtaacactaaagattggagatggtataatggcatatctacaggtctgtgtttccttatctgcgaagtgagacattgaaatagatctgttttgca

SEQ ID NO: 61017 - DNA, 1067 bp, Homo sapiens
aaaaagctaactttatccaacttcagtttaattaaaagcatgtaccagataagatttattgtgatagttaatattgcatatgcataaagtcactggcacagaaacatctaacgtatgtatagcaaaggaaaaaggcaaagagctcaacttcatctcttttatcgttttttcaggagaaatatctcatgcgttaccatgtttggaatatttcctagcatgtgcaaaaagcaaggaataaacaataattcaatgtgcctaatggcataaaataaaaggattattcacaaacagaaaactggacttttgagcagatgtttatttaaatacaaacagcaactcctacttttcctgttatctccaattatgtgatgcaacatttttagcagaagaagtgctttttaaaaacagccttccagggagtgaataaacaatactatatttggctagcagctgcttttggaaaatgagatgtcagcaaagctgaatattgtttaaagaaaactaattatccagctacctttgacttggatcagagtaaataaagcacttcctgatttgcactgaaatgttttgtctagaatttaaatattaggtattagtcagatacttctcttcttccttcgcttgccttgtggacccaatggatttaaataagtaccctttgtgtttggttgtgctgccagtacccctttatgttttctggagtgcctagcatttgttgcttcttttcttatttgccatccactagttattgtgttaggtgtaaagcagtgtgtttatggttacattaaaatctaggtaatctatgataatataggatggttgcatttgtatacatttaattatgcaaatgtaaaatatatattttatgagtaatttttaaattctatttaaaaattatgtgtagaatttgaatgaatgtaaataccctccatttttgaaaattcatttcaaggttagcaagccaaagaagctgcaaactggtttatactattgccacatggcactttggccagtaaagagaaattcctgcagccctttttcagggttgcatgcatcagcctgca

SEQ ID NO: 61018 - DNA, 1078 bp, Homo sapiens
attttacagtgagcaattcatacaacagtatacaacagtgatgatcttgagaaaaataaaaagctgcattaaaatacacatatacaatagttacagatttcaaggaagtgtctccctacttaatactttactgtggaaaaatttgtgttgaattgtgcaagtttttcaagaatatattctctctataaaatctggtatatgatattcatgtaaggagtgttaatagaaaacaattctaagacaagcagaaatttaatggttctataaatgtttgttcatccaatgaatattgagcacctattatgagtcagatactgtgctaggacatgaggacatattaatagttttgaacttaataggtttatacttctttacctccattcatgagagattatatgcaagtgaatacatgtaacaggatcttagaatggaactcttcctgcctcagttttgactaaagacaataaggtaatttccagaattccatatctgatatacatatttataaggaaatggctctaagaacctgtcccactacttgtaggttcaggataagctacataatttgtggggcccagtgcaaaatgaaagtgcagggcctcttgttaaaaaactattaaattccagatagcaacagctgagcattaaaccaagcatagggcccttctaagtgccctgtgtgactgcacaggtcagacatccatgaagtgtcaccctgcttggatccttcagccaaagaaagaaaatgaaaagggcatagagtgaagaagggagatttgggggagggtgatttttggaagctgttacatgcttttagaatgctgccatctaacacatgctcaatggagagggcttcaaagggacctcttgaggagctctgaaacatgcctgtttgaagtctcatttacgctcagactcgcctggggtgtaaagcctacccaaacgatctacaggactgtcaggagaatgccactgtggtagaatgccactgctcgcctagaggtgatgggggcaggggttaattgcctaaccatgttggggccaagagggagagagagttggaaaggggaagtcttgg

SEQ ID NO: 61019 - DNA, 1029 bp, Homo sapiens
tcaataactatacagtgacctcatgtatccatcactcagtttcattattattacatttgaaaccctcaatgtctctctccctgattacatgccccttttgcccttaaaataaagattgatttctttattctttttcagcttttacaatctatctagctatctgtcatcatcatattgcatataaagggtattacactacacattttgaaatttatttgtctggctctgctttgtgagagttctccatgttgataaatgtagctatagttcatttgctttcactgctctagggtatttcactgtgtgactctaccacaattcattgatctattctgtcgatagacacttgtttctcatgttttgcttttaagaacaatgaggctataagttctagtgtatatgtctccattttcttgggcaaggttgtgtttgtttcctttgcagatcaactccttgcccttatgctgctctgctctgtatctcgggaccagacccacatgggttgcatttcccaggcccctgtatctacccggcttgtttttcagtttaggcactggtgggagaggggagagagaagccagagtgcttggctccgtatctgccagtctcagatggcctcattctgcacatctagcacccactggacagacccaccccagttctatccttctctcagaaaagccagttaactcctggtggggctacccttttgtcttagactggggtgccagaggtttcctgaagttgctcactcctggttgcctcgctgactactctttgacttaactctttcaattcccagataacctattctgtggattaaaccccttctgtttcaatacttggaatgattttttgttttcatggttgtaggtatggttgtatacatcttcaactccaaatgactctccacacatgctgatttagacctctgcctgcagtgtgtaagagttctcgttgttataatcttcaccaatattaggtattaccacactttttaggttttactaatctgactggcctgaagca

SEQ ID NO: 61020 - DNA, 1068 bp, Homo sapiens
tctcacctctcactcccctctccagctccttaacattttctttatacaaactcaagcaaatttgaatatatcttgttatacttcccaatttttatacaaaaataacatacaggcagtttttaaaaaaactacagatttaagtgatgtttaattgatagtttttaaactcaggttttaatttttaattagatatttcctgtgaattgactatcatttggataatttttccttatctcctatgacaattttcaagttttcttttaagagtctgtggttagtcaccagtgcaagacaagtaagtctggggtgtctttgtttttattatttcagaatcggaaaagtttatatgtgtttggtaaagaaaatttgaagaaaagagaaaccacaaaaaagagtaatcctactactcagaaatatgtaatgatgactgttattgtgtttaggactctggtactgtataatagatatcttgaatgtcccaataaaacacaaacaaaagtaacatttactttaaactgtaaagtggagaagcattaatttaccatgaaatcacaaatgttcaaaatttccaagttcatgggtgacagcaatgagatgtgtttgtcgatgtgtattaacttgctctctctatattttatttttatctatatatcctctttattttattttattttatttttttttttttgagacagggtcaggctcaggctggagtgccgtgatggctcactgcagcctccatctcctgggctcaagctatccttcctgcctcagcttcctaagtagttgggactactggtgtgcaccaccatgcccggctaatttaaaaattttttgaagagatggtggtctcactttgttgccaaggctggtctcgaactcctgggcttaagtgatcatctcacctcagccgcccaaagttctaagattacaaacaggagccactgtgcccggccttattttatttttaaaaggagtcttaaatagagatacatgttgattatgtgcatagtataaggaatttcatcacccctctattcagtgcaatgtacttcaacaagtatgtat

SEQ ID NO: 61021 - DNA, 1028 bp, Homo sapiens
gtcttttgaaacagttccaggggatggtttataacctgtactctctccagcaagtattcctcctagagaaaaatgtaatgatccagaatttcatattgggaccattcacttgagggaatgatttgcagttgtgtctgtttgttgcactgtgttcccaccttacccccatacacacccactacaaggaaataatatgattattgctaagccctgacaagccttggcaggaagagcttaggatggattctcccatgctcattcattagaccctaacctagtgatgtgctggtaagtgtttaacagtcagcttgagggcaagtgggaccccaatctgttgcgtttgccaatttctatgatataaatactcccatcatggctgatgataacatatgaagtcactaaactcaaagtagggaagaaatgcacacaattggttctctcaagctggaacaaacccacctggcagaacactgccccagccttgttttcagagagaaatctaacagcaagagaagttggaagcaccagctaaaactgtctctgatgtttgggttgtgattttcagtgagtctcttgagtgggtttctgaggtctctggcttttctattggcctcacagtggagatatggggccacagaggaagcatgctgtaggttctagggatccacctgaccaaagaaacatcaagagcgacagacaacagaagggaagtcagagaagggcacagacagaaagtgagggatcgcagcaggcccaccaggtctggggagggaatgggggagtagatagttgatttttgaggatctagtcttttttaatcatagccacctcagctgccaccttcctgagcattgcttagaatggaagggtggagtatctggatctctccaccctgcccataccgcctgctcttcttatgtaaccaaaggagaggtataggacagtcacacattctgcagtctcctctttcggatcttggccccagcaagctgagctctgacatgcgacacgaagtattccattgcgga

SEQ ID NO: 61022 - DNA, 1031 bp, Homo sapiens
atttaatgtaagcaccctgcagttttctgcattgcaagtgattatttttagaaattttatggttgcctgcatatatttgtttgtcttcattgatatgtagggggggaagctcattaatgatttaaaaggaaggtgttttgattcatcgacttgactcttctcattacataaacagtaaaggcaatggcaataaattaacatctaatgaaattgtaagagtttatttctgaatttagctacaagatagtcttgaatccttgggcgtaacttttcttattctttgtatccttttgcctcagtgttttgaaagtcatcattcagcacattttaacctagaatgatggtttataattcctatgaaagattccttttagcagctatttatcaaacaccataattggacaactgttttgtaaaatagttctttgactcctagaatggtaagttattatgtaaaaatggaagacccttatgtcaaaatttactataaagcagtttttcttttccccatatacctgctttgtatctcatgtaacatttgagaaatctgcttccaatattttctcatcttgttagtcatcaatctaattctcgcctagttatatgttaaatattaccttcttgccttacttagtaaagagtcaaaattcctgcaaattcaggatttttcttttcggaaacagataagtggctatgctgtctacatgtgtgcataagtgggaagaagggcagaaatccttctgtgtatttgctgaccctgtacagcaaatacttgttacattttcagtaatgtttaaattgtttgctttatctcattgggatgagtcatcatcacctttatgttttttaaactggtgaaaggtagtttgtattttcttttctcttgaaactatttcttgtgatgaagagaaatagttcagcatgttgtggttccaggactgagacaagtttgggtaatcatctctaccataaaataacttcatcggaaacgtcaatgcatcagcattctgcagtgcaatatggaaatgaac

SEQ ID NO: 61023 - DNA, 1025 bp, Homo sapiens
ctgcatttagaataagatccaaactcctgactatggcctgaaaggctgagtatgatctatccccacctacctttctaaccttccggcttccccacttcctatccctcgggctcttcaggcctgtttcctctcccatctcttgaacgggcccttctcattctccagatggcaggaatgaggcctcttcagacaggtcacccagtctgcccttcaggcttcccatccattattttttctcgacatcctttggtttttttcaaggaccccccaaatttgtgatgatgtatttgtctacctgtttacttgtttctttccacctgactgtgaaccaccgctggcttgcttttcactgtacacctataggcctggcactcattcagtgcttagcatgtaatttttaaattaagactgccttagtgagaaaatttcagcaggtgagttaagggcacgaggaaagggcctttgtgcagaagtaatgacataggcaaattgtcaaaggagaggttccctggtgtatttgtagaagaaagtagacccatgtgtctgaacccagcacacagttcacttatggtggttttgaaatctgccctggaattttcatgcatcttttaaatttttggtttattttttcaagaaataaatgaagtctttattttttcaatgagggcaatgtttattaagaacagcacataaggtagaaaagaaggttggtttctaatcttggttcatctcccccactgatcttgagttttaaaagcatagagagcacgatcttctgtgggtctccactgtcagagagccctggtgagaatcatgagcggatgtagtaaaaagtgcttctttcatatcagcaggtggttctgtagtatttgcatccatagacttctatgcagcatcctttctgttacttactcttttcttttttaatcaaaacagtccattgaaaaaataatgttgattacaacaatgaattctgttgatttaaatggtggaaggcaatgttatcctggagatataattctgtg

SEQ ID NO: 61024 - DNA, 1169 bp, Homo sapiens
cagaattcctcggtttgatcgagttgatagtacttttggcattgctagttcactccctctccccaggatcgaattactcgtcagtggtctatgccggttaattactggagttcgtcgaaacgttcgccctcgaatctgccttttcggaaataagcccctcccacctccccgctcacctcccccctccaccctccccggccagctttggtttttaaatgttcatatttcccgacgtccgcctgcaattttaaaaaggtgttgtttggaaatactgtgaaaaatcctgcaacctaccaacaggttgagctctttccccctcccaaggtctggctcggccccctcccccgacccaactttcctgcgcagctgtcttcctccccctccctctccccctcctgatttcttattatttgcttttcaaatttattacttcaacatggcctgtgatctggaaaagggaaggattaaatatccagaaaagaactggtgcttaacagacttctgactaagtccaggaggaaattattcagtgttttatgggatattttgtggtcactcttttttggggggcggggaattgaaattgggatgttttttaaagaccctgagttgaccccacttggtacagttttaatttttgttggtgtaattaaatggtgaattctgatttaagaataaaggctatatttgccaaacgttgcatctgctagaagtgttgacagtgaatagatatatttttaaatacacgatttctttttaattgttcattatggggaattgaaagggaaccattgtaatgatctgtgcatttcgtcactgctatatgagccatacctgagaaaattaatcttgccatttaaaagtaaactctagggggtttgcggagggagatggctctatttataatcctcagctgcatatacatcgtctaatattatgcatgatttgttttttaatgctaacacggctggtaattagctgtatgattatacttgtatatttcattaggactttggctgatgtcattgtgaattattcagccatattaaaacaattttcaattgagataatgacacgcctcaaaattatgcaaatgcagactgcattgtgcaaaataattatgacaaatgtaaagcaggtagaaagtttcccaatgcagatcggttttc

SEQ ID NO: 61025 - DNA, 1040 bp, Homo sapiens
gaatagtaaaaaaaaaaaacaagaatgttctcacaaatgtgtgtctgccaacaaattaatactccacaaagagaaactctgccccacatggcagcttccaataaatgctctgattcaaatcacaactctttcattttttttttatccccttcccccttgagggagcacatttagacaatatttgaggatgtcatctttctgctttttaaaactctctagagttttcatttaagactcttaatggttgatgactaaaactacagatctggatagtggaaaaactaataatcttaaaaaacacttctgaaatgtggtaaagtgcattcattctcttccctcctctttgtccttttcaaagaaagaaagttcaatatgaaaccaatgcaaattatgactttactcagtgagatattttaccttctttcagactgtttcatactgaagtttataaaaaaaaaagaaaaataactatgttaaaataggagggttaaggaatgtattattcataagcataatgaacacaagaacctgtttttccagaagaattgggttgattaaatcattcaccacacaagcctctagttatttatttttgtctttagaattacagtacttagcttttataataaagtggacttgatacccatatttggtatggcagttgaaagtagtcaaatgaagaattatttcattttacaaaatttttagtaagtaaggaatataaacactatcagttaaacatagcaaacttgcatttttttattccttgggctatagtttgaaaaaaaaatcaaattattttatgtaacactgattcttacagagttcctttaagcgaagtatgaaagctgcagtgtaagctttattggcctataaatatgtcattatagttggactacatttatatgctttggattgttgtttaagccaagaaaatatgtctctacaggttgactttttattgaagccctttgaggcatacaacagaatgtattttaggccaaggttattaaaacagcattttcatttttttgcagcag

SEQ ID NO: 61026 - DNA, 1055 bp, Homo sapiens
gcaacctctgcctcctgggttcaagcaatttccctgcctcagcctcccgagtagctgggactacaggtgcgcgccaccacatccggctaatttttttgtattttagtagagacggggcttcatcgtgttggccaggatggcctcgatctcctgacctcgtgatctgcccaccttggcctaccaaagtgctgggattacaggtgtgagccaccatgcccagctgaggtgatttttttataccatttaactcatttatattgcaggagctcatttttactaagaatcctagagccagaataggagtagattctagagaaaggccccagtgatccattacgcatggccagaactctaaggagctggcttggcatcctccagatacaacatgacattagcaaaactactggactcttctctagagctgtatggccttggcctttttataagtaagagcaaaaagggggaaaatattctgccactacactccctgaagtttaggtacctatttttttgtttgtttttatacacagtaatattaagtgtagactagtatctaatgaacatcgttgttaatatggcagctactgtggctcaatatcaatgttgtgccttttgagcttctgtagttcctgtagttttttactctagcatttaggatagggcttgcccaaactgatttttgcctcagtaacggtctacagttgaagaccagcttggtgtctgagagtctgtttaagctattccaaccaaataatataaaaactgcaagtctttcctaaattttcatatgtgatagtttaatcatgttgttctcttggacttaagctgttcttgtttttgttttgttttgtctattttttctagcagtttgtttttttacagccatatctatgataaaagaccatgatggaggctgggcacggtggctcacgcctataatcccaacactttgggaggccaaggcaggtggatcacttgaggtcaggagtttgagaccagcctgatcaacatggtaaaaccccgtttcctactaaaaatacaaaattagacgggta

SEQ ID NO: 61027 - DNA, 1341 bp, Homo sapiens
tttcagattggagggtttcttttttcatgaatgtgtaggaaggaagggcatgactgtcttatttcatatatttttcttttatattttcaaattataaattttgacaacaggagacaataggtaatattcattctctactgtctggacagcatggaaatactacgtacagtaatgtcttcagtagttactttctctttagaaagctccaaggaagctcacaacagtaggaagtcctactgaaactccttttggtaaagtggagcacgttttgtaatggaaacacattttctatggcttaatttttatatatagggttttcataaaatgagacttgcctaaggattcttttggaagccttttgcctcttttaacagcaatgtgtttattataggaatcagtctcctgctcacttataaaatattctaaatattcacttataaatattctaaatatttataagattatgagttttgtcttttaagtagggagttctgcatattgtttttggccaaaatgtagcctgcctccttgagcatgagttgaagcccaagatgagaagcccttttttttcccctctgaccaagatctcatctgccatttactagattaggctacttgaagggaaggaaatgagggcccccttcttttaatccaggacattgttaggtatatcataggtgctccgtaggtatgttggatgaatggatggatgattagaccttaaatcttgtacttggcagcaacataatgtagtggtaagggactaaaagtctggcagacatagactagcactctggatccccaatctctagctttatgcccttcggcaagttgtagagtatcagttttctcatctgtaaaatgggtataataaatctatctgatagggatactgtaggatttaataacatatagaatcccaggtgcttatggacatttttctggtgccataaagcacttgatacatggtagcattattaaactcttaagccttaaatcaggatatcctagactttagtcatttataaagcaactttatagttcttgccataccaataacactgttttattatttacttaatttttctttaaattaattgctttttaatttaaagaactttaagtaggaaattttatatcatcactgtaaatggaaaacctgtatcacttgctataattaatggtgaaggtaaatatataatccttaaaataaaaaatatgtttatccatgtaccacctaacattgacttgggtaccgctagtgtataccacagttaagtcatttcctttgaggcttttctcttgggcaacagcctaacctaggttatcgatagctttgag

SEQ ID NO: 61028 - DNA, 1075 bp, Homo sapiens
aagtgctgggattacaggcgtgagccatcgcacccggccttctcggcaatttctgaatacagatcttagcagggtgagggaaacggtaattgttattactaccaactggccccaaacagttattgcataacgttgcacaactgagtcctgggtaaaatgagcttcttcagaaattgcctcgccaaaggtgatttgccaaggttgaatccttcggattgtctgcattggaacaacccccttgcccaagcactgagcttaagctagataaaaggaaataaacactgctttaaaagggagtgcactttagcagcacacaaaaaacaaaggtgaaggctcacatctgtgttgcattgcataattgataaaagctgaagcaccattagaaacagcctcatcatccatactcctctcctaatcatttaaatatgtacagcatgttttaggatgcttgttaatgactctacgggcacgttggtagtcagaacattacatgtgggtttgagaaataggcctggatcatttgccagacaatctaattctgacagtgtagtgaaggccatcttcaatttgactgtgctccactctgttatgctgtgaaagaaaaagataattcagctgagcattctgccgttggctagaaacaccgcagttctgaatacaaatattatgcaggtaaatgaatcattaaaagaatagaggcataaaatatctgacagatgaactcctaaagtttggactagaataaattttcccatatatgagcagtaccttcatccatcgactaacagtgttagttatccgttaagtcaccaaaaagcatttatggtcttagagtaaatgattggtaattatgacttacaaggctataaatacatggaggggatttggtgatatcataataaaccacgaaagaaactgcagtggtttttaatgttagtagaaacttaagaaatatttagagccgtgttcgcagccctacagttgttttttttcttttttctgggagtgtgtgattggtgttttgtcaaaatgtgcaactctaccaatggactcaactcaactaatgtaaattagg

SEQ ID NO: 61029 - DNA, 1055 bp, Homo sapiens
accaagtcactcttggcactttctccttgttgcatgggctaccaaagtgaaaacaaggagaaccttaaggtcatcatatggcatagtaaaccaaacccaactcagtgctggtagaggtgtaatggatgtgctccgtgatacatgtaatgattaaaagatggactcagcttctaagagagtaagacaaaagtagagcaagagagaagacctccttgggcagaggcctcagaagctagaatatcatttctcttgggaaaagaattttgtgtgttgctactgtaaattaatttacagtcataatatatggaatggctaagattcgaggatttcttttctgtttttggaacttgaaaggagatttaaaaataactctggacaccttttgtagctgagtgggctcaatgggttattaaaaacaatttgggctcatgggtacaataaacttttgttcacgccgtaagaaatgatttgtgtctatattgactaatatttcacctagcatttcatctagaaaagcgagaaagttatatcccattacattagcaacatcaacatatttctctctagggtgaaactgacatttttatcaattaaaaaacatacatgctgcaggaaagaaccaggtcattgaaaaatcacaagcaaaagtgctggtctggggtagtggtggtggagagagattcagaataagtctatgttcgcttgacttaagcagcctccttgataaatgaagattctctgtaatcccctttattatgtcctgccagggaactagatggatataagttccttgaactgtaggtgaggctgtgtggagatgcttagagcctattacagtgcctgacacatgataggctctcattcattcattcattcattcattcatttaaccagggtttattccacagctattatatgtgaggtgctgttctggtctatgaggacaacagttgtgaacgagacagaaaatttcccacttttatagtatgtggaaaggggagtgacaaaatgtgagataactgtggacctgacctcacaggtattgacctcacagg

SEQ ID NO: 61030 - DNA, 1037 bp, Homo sapiens
catggtgaaaccctgtctctactaaaaatgcaaaaattagccaggtgtggtgacatgccccgtaatcctagctactgaggaggctgaggtgggagaattgcttgaatctgggcatcggagactgcagtgagccaagatcacgtcattgcactccagcctgggcaacagagcgagaccccgtctcgaaaaaaaaaataagtcatggtattttgttttgttctgcttttttttttttcttcaaaaatagaaatttaggaattctgagtcaggccacatattatttggctaattcagctgcagagtaagttattaatgacccccagatgttgtttatagtgattggaaatgtttggttgtgaaataatattttcttttttgtgtgtgcaagtgatatttcttaatatgctctacagcatctgaataaaagtttgatggcagaacagtttgcatgtccaatgtaattgcttctaagtgagctcttcattcttcacatttttagctctaattgctttttttcccatatgtctaaaaataaatatttgcaagttttgtgttctgctactcattgtaatacataaaatatttgtacactgagcaaaattcactgataatgttcacagtgggctatttagagaaagtaaggtttgtgtgtagaggagataaaatacatttttattattcaatagtataaatgccagagaaagccatttatcttactttgaaagaatatttttaaagaagtggccagatatttgacctctgagatgatttaaatagattcagttggaagaaaagatccagtgtcaaaaataatcgggttttctatataatagatattttaaatgatctctgcaaggtggcaattaattttttattatcagggacagaggccccactatgtagattatctaagtccctgacttcctgggcagacctcctctcccttcgtttgagtttattccagctcattagcacctccatccgaaggttggcagagaaaaggagaggaagaaaaaatgaaatcacttctgctgctc

SEQ ID NO: 61031 - DNA, 1054 bp, Homo sapiens
gtgaatcatatacacacgtaaaagtaacagtacgtctattgctttgcactgttttttttctaataaaactgactgaagccagatatgctatcagtaagggtactgctctctccctagcagagctttttcttggtagagatcagtctcacctaaagaacaagagctggtctaattctggagtcttaggatttaggttctgtcagtaagtacatagcactgagctttcaaggagagggcaggtgtaggtccttgcagggtggctggaaggaggtggggctgtctcttacatgagtgaattaaagtccgcagacccatcccactcctgcccaccagcacaccataatgcacctgttttcactcactgacctagcaaatgacagattatgactctagagggacaaagatgtggcctggggaccagaatttttgctgtccccaaagccagtccttcaataccaaaactttacctggagtcttctgaatccaaaaggtctctgattcgattgcagaggcacctacccagtcctttgtgttccattccccccaccccgtactttgaatatttgtgctcttcagggtgtttgtgcattgcatgtggggactagattatagccttactgagataccaaaggcctttggtttcctgtctccattcccagtgcaaactcaagtcaccagtttatgtttccagagcataagcataagtagtaaaggtgaatgcagttttacaagtgcccagtgtgacaagtataccacgtgtgaggttggcgggaccagtctatgaggacaggaaagaacagtatgtgggcatctttatttccattagtcactttttcattcaacaaatacatgttatgcaatgcagccttttgggtgttgtgctgggcagataaaagacacatcccacagggtcttgcccttaaggattctccagtctggtataataatatgccaaaaaccacagctaaagtacaaggagtacagtgatatgttccataagagaaggagggaaaaaaagttcagaggggagagtaggagaggaatttgattttga

SEQ ID NO: 61032 - DNA, 1055 bp, Homo sapiens
cctagcattttggtgaaaagcacttagacctaaaaggcatttatttctagaaaagctttcaaatcccaaaggccttttcgacagaacttgcatcgaacatgctgtttttaaataaaggcaaaggttccgggaactgacaagaagtcatccccaaactgggtttattttctccattctttgagctgttttcagaacccagagaagcacatgtactcccccagcagattctgagaattacaaatttagaacagactagcacctaatattctggtcacacaaacgtaaactctaaatgggatttgatcaagagaaaaagccctttgttcttagtaaggcaagtacttgcgtatttcaggtatggttaggcaaatcctaccagtcattcaggactcaaaatcaaattcctctcctactctcccctctgaactttttttccctccttctcttatggaacatatcactgtactccttgtactttagctgtggtttttggcatattattataccagactggagaatccttaagggcaagaccctgtgggatgtgtcttttatctgcccagcacaacacccaaaaggctgcattgcataacatgtatttgttgaatgaaaaagtgactaatggaaataaagatgcccacatactgttctttcctgtcctcatagactggtcccgccaacctcacacgtggtatacttgtcacactgggcacttgtaaaactgcattcacctttactacttatgcttatgctctggaaacataaactggtgacttgagtttgcactgggaatggagacaggaaaccaaaggcctttggtatctcagtaaggctataatctagtccccacatgcaatgcacaaacaccctgaagagcacaaatattcaaagtacggggtggggggaatggaacacaaaggactgggtaggtgcctctgcaatcgaatcagagaccttttggattcagaagactccaggtaaagttttggtattgaaggactggctttggggacagcaaaaattctggtccccaggccacatctttgtccctctag

SEQ ID NO: 61033 - DNA, 3974 bp, Homo sapiens
gatagtcatagctctcaataaacagcagccttttccccctactttctgtgtagatcttaaaaggaacaagctcagcatcaaggatgaaatagaactttgatttgtatcttgtcttttcaaaagtgtaacccccatggaatcaggctaaccccagtgtaatctttggatgttatattaaataagccttaagatcttcataaaaatatattgaaaaggaaaagacagcatgctgatttaaatgtatctgtcagatttgttgagatttgaaacttgctggttgcagtattgttagtaaatatatgtaataatgttttccagcttgctgttgtgaatgcccctctctctatagctatctctctacttatctgtatggtaatttgagagaatgcccttgtctctgaatattttgtaaaagagatgttttcaaacatttcattactatgataccataagggcaggcatgtcacttaggtttcggaaagcaagatacaaaacaaaaaccaaagattgagctcaaagcctggctcagtttttcagcaccaaatgcttcttgtctaacaacgtggaaggacatttttcttatcatgatcctttagagctaagagcttcgtgttacttctattaattagacatgttaaagctaaatagattagctttgggaaacgtgtacagaaatgtatactctaccaatatgcaagccttcagagagagaagcatgtaataatgagggctgcctgccacagatctgtacatttctctgaacaattagaagggatcactgtagtgagattctgggtctttaataaagaaacccatgcaagtgaaaatgtatatcaattgttttccatttgttttcagcgccaaatcttaaaggcagaccacgcaaaaagaaaccatgcccacaaagaagagattcattcagtggtgttaaggattccaacaacaattccgatggcaaagccgttgccaaggtacggtcattcactccacggtattcatttcgttgcatctttttatttttgctttttctctttatctctctgtgcctgtgtcttggaggcagttttcaattcagcatctgactttggtattcagagcttttgaagctctatgctgtgcctgttcctgccacctcccttcccctggttgccgtgggctgggggaggtaggcattttgattagtcaacagaaagacttcctacctcccagtttggcctgttatgagtaaaggacagatgattaagcacccacgtcattgaggctgagatttcatagtgggtgacacaatgacatagtttactctgcttgtgtcaaaaatagaccagctgaaccgtcctctttctgaatgtgttcatctaaatgtgttttggagattaacagaggatgaaattagaaatagctagaattaatctttttagttatgtatttttcaaagtcacttctaatttacattagactaaaattaaagatacatagcaaaatatttagatgtatacatatgcccacaagcatttatatacttttaaagatctctgttaacatagaatgaaagtaaattctacgctgttgttcaagacccaggtcaattttttacctaagcattctttggaatcttgaaagtgcatgcatgcctgaagtattttgcacgacaaagggtaaagtatcactttatatttttagacttacctttctgacttttgtgggcttgggtcagatttccatggttctgtttactgcatttaggtgttatttttgtgctaaagacagcaatcgtccctttaggattttagttgacgaacagatttcaactgacaccagtttccagatcaaataactaaacttctgaaaatgggaccattttgattagtggtgaatttggaagagtctgatgtagaaaaaaaaaaacatgagttaagttctgtgttgacagtctactgtttctctgccatgtactctacctccttcccagtgtaatgaagtaaatcttagactttcacattctaaaaaatcttatctttaagcatcattgtttcattaggaaattttaaggacttttttgcttagaatttcttcatacttctaagattccaaagggttaagaagagatcaaccagtagaaatgtgtattttccagtttcttgctgaaaacaaatctctttccctaaagttattgttgttttgcacatttaactttctgcgaattaactccacatggatgccatgaatgacattttcttgtaagttggacacctcagccctagaactatctacctaggactttggtttccatcgtcttgaaggatgtcagcaggaacagttcattccctactatgtagtttgcaagatcctgcagaatggcgcaagaaggtttcaagaccataacattcagcagagcttgtactgcccatgccttctgttggtgcccagcccatccttcttggttgacagcatttgtttactccagcatattctgtacctgagcccggcaggataaagctccttcccatgccacttggaatcaccaccaaggtctgcttctgagaattttacagaactcatacaattgatctgaaagagcagacctccaatgtttctttccatggaaggcagctcagaactcactgttgggttcacaaagccgagaagaacaagagcctgctatacagatgggccatatttgatgttcactgacttcttaacaagaaggatagaagtcagtcctgggttttctaagtgacgcctttactccatccccgcaacagtgctgcccgtcagaatctttacaaagagatggatcattcttccaccgttggtgttcaatggtgaacagatgaatgtcatgctgcagtcagctcctagggactggtctaatggcttggctcttttcagagtcttggattacagtcatgccttggctgcttccagtgggtctggcaagaccacttaagcaaaaagatcagtaggtatgaagtgtgacgagcttgtctgttgacaccaacaggcagatgtaaaatccctacagaatgaacaagccacatctgggatgaggacagtcattaaaaagcatgtgtgtcttaacatggtcttttctcatgaaacactgcagtagagattatgagtctgtgaccatctaatcatctgttgaattgaaagcagcatcttagaggacagtgagctgtttgactttgtgaccaagacccatgtgactgtttctttttaaaagtgcctcaaacagaccatttctaactaagcaccaacttcatgcagctccacacagcaaagctcttagagtgggacccactgggtttgttgtgttcatgactggaaaaataagtcaagtgatttgccggtcgccatcaaaacgttgcactccctcaatgagaacatgaaaaccagctttgcaagaccatgttttccaacggagagagaattacatggctccccaaagacagcaagtgtcacgtggggaggaaactaccagttctttgaagatctcatgactgtgttcagcccaaatcctgccatttttttctggaataatcttaaagcagtgaacctgaggcccaggcctttcatagagtgatctataacagaaatcttcatggcataggaccctaataaaaggcctacattgatagaaggcaaattatttttaatatcccgtatgcattttctgaagggcagaagtgtattacaggtggtttatattctaaaaggaacacaaaaaaggaaactgtggtgggaagtgtgttcatttaaaccataaacatactttctatatttcacaaatgtgatactttcattattttcaatatttttcctctcatttggtcctcagaactattcccagggattatcatttttgctttactaaggtagaaactgagggtcacctagcaagttagcaaccaaaccaagattagaactctagctttttgtattgctggttcagcacatcttactgccccagttga

SEQ ID NO: 61034 - DNA, 1064 bp, Homo sapiens
tttctaatacgaaaataataactacctcattcgggttttaagtttgaaataacacataaacagcgttgagaatggagcctggctgcccaggaaacactcaggaaggggtgggaggcaatacaaattaaaactggagtgatgttatgatttcaagaagccattaaattatagatttcatcagaactttagatccaacagcctaaaatttggcagtgaaaaatgatgacaacataaagtttcacgggatgttcgccttcatataatgttagagagtacaaaatctacatgggaaaattgttttagtcccatttccatagccccttaaaagttaaaatcctacctagaagccccattgaatcagtttcagaggaagttttatctttgcaggaccagtcgaaagatattaaactgtatgtgttcacttgagagaataagcaatgaagaactcctgcagagaatgtactttcctttactaaataagcatagtcttttatgttcttaatgcttaggaaggaggagctgcagggaaagaaaaaggttcgaaatcctgtaatggacagcattgtagaatatgtgggacatttttattcgtaacatttccccagcacttgccctcttctctcccgatgtcagttacggagatgtaaagaatattggaatgtacacattccccatgggcacacttgaactcagagtctgaccctttgtacttcccccttttacaattaaaatagctcagcaacttagtgttatatttaacgaccatcaaagtcctcttgtagaacatggcagtgaggagggaaagttaggttagccgctcgatatgccaagttccctgtctgcctacagtgtggaaggaagaacatctggagactttaccgccttttattttttaattatggagctttatactcactcttcttgggtttttagctgacctctactctttcttttgtggcaagttaacatcttattcttagagctgactgataaagcaagaagccctcattaaacagtgagatcttttgtttcctactgagggtgtacccccgcatcactcttgg

SEQ ID NO: 61035 - DNA, 1328 bp, Homo sapiens
tgttgctggctctgtcactagctatgtcttggtaagcatcctggggctgtgcctcgtctgatgtggtatattttcccttttccaggtgaaatgtgaggccaggtcagccttgaccaagccgaagaataaccataactgtaaaaaagtctcaaatgaagaaaaaccaaaggttgccattggtgaagagtgcagggcagatgaacaagccttcttggtggcactttataaatacatgaaagaaaggaaaacgccgatagaacgaataccctatttaggttttaaacagagtgagtatacttgttttcgtttctgaattatcagagctgctcagattctttgaattggaaaaaataattttgactcaggattatgttgaaatcctaatctggggatagtgctctctgtttatactaaatccataaatgttccaggccaagaattttttccctgcctttttccgctacattgttcccttctgggacagttgcagtgagatatttataggcttgaatccactgattatgactggaaatagacatgttgaaagtttctcatttgctgttttgtcaatcttgagtgtctgtgacgcctttcttgtgagataataatatgacgtagctttatcaggcacagatgttgcctgtgaaaaaaacagcttttaaaaggaggacatttaaagatggacaaaacaaccacaaagggaaaacacatttcctaagccccaaatgtgttaaaatataacaaaaatccaacttcagagaaaacaagaaatacacaaattggaacagagggcctaattttgaattactttgacatgtacatttaaatataagtgtcattgtatatttgcaaggagaacaggaaactcatagccaaacagaattccaaatcaaaagagaagaaatccagatcctgccttgattttgcaaccgaatatatattttgcctctgtctggatttagtggtgcacaaagcgatgagcctctggcttgaaatagtattttctccaaatgtatcttcgtagattaaaaccatgtgtcattttgatgaagaatgtcaaaactgtgtgttttacataacaatttacatacctaatagcaattggcactgattgcaggagaacactcgcagccattataaacttatataactacgaatgattacaatgtttgtctgaaaactggttgcttgaaatagaagtaaaattaatgtattatgaacagctttgttgcattatgcattggttcagattaaatcaaggccgaggcagggctcttgatagctctgaagtagtgcaaggttcaatgaggctttgcgaacatgttgtg

SEQ ID NO: 61036 - DNA, 1018 bp, Homo sapiens
ctgcaaagagaaatctgtttgaaaaaaatatatttgcaacatcacacaggccagttaggggactaagtgggttcatgattcaattcctctctgaatgaatgtcttccttcccttttatctgttgtatcactgtggcctccacgtgaaatatttgttttcctactcactgccagccaccacatgttggtgaaatactgtatgaacctttaatatagtgctgccatcagacattctattaagaaggtaatcgtatattaaagtggctgttatttattgattatggagagttcttatatgagagaagctctatatattactgtttaatcaatggcgtctaagggtcgaacaagaccaaccccagttttgagagcccatgctttttcccaaagacatctaatttagcttctcttgctctgctgatgacagtaggactaaaactcttgcctttatcctaaaagtagaaccatttttgtagctttatgactgtttcttaagaaatgttttaagtggtaataatagattctgttgtcaaatgccctttgggcaaattgtttcctaagaacttagctctctggggtactttagtatttctttttttctctttctcgttgaaaaaaaaaatgttttaattgacatttcttggaagtatgttaatgcaatgcttatctaaatacttattgtccctctaacagttaacctttggactatgtttcaagctgctcaaaaactgggaggatatgaaacagtaagtgtttaagcaacttaaatgaaataattttgcaatctaacttttcccctctctttgaccaaaatggagaacatgcaagggcaaaacatcactgactgccttttcaaatggctctacacttttgggggtttattgggccgctttggaaacagtcccaattagttccaggtttggcaaaattgtaaacttgtcgtaaaaactacaagtggaaaacatatgtaactctcccctgtcagggaaattagttgggtctgtaattttttcccatgt

SEQ ID NO: 61037 - DNA, 1766 bp, Homo sapiens
gctgcataaacaggaagttatcaaacttattcggaacaggctctgacactctttatcagctaattctaactgacagcaatgggttatttttagcccacaggaaaatttgatggccacggatttttacagcatgtattttgaaccaatgaaacattacagcaacaaactgagattaaaatctttaaataagaaagagctgcataaatataacccacagagatgacatctgtaatataatcaattgacataggaagatgttgtcattgggaatactttctcctccacacaatgatcagattaagttgtgtagtttcttcttgcaattgaataagaacttattttttcattccctgagaagtaatctgggatatctctgtaccatagtaaaatgacagtaagacacacaaagtcaagaaaatgaaattcattttagcccaaacgtaataaccagtgcttcttgccagataaagcacattgttccacaaactaatataatggtttgatgtgcgggtcttgggatggggaaagaggacaagcattatgtggttcagataatctggtattttctgttgagctatctgctatgaattccgactaaaaattctttcatatgaataatatgtgcttgtaatatgtttcatatatggcgtatgtacacatgtttataaagaaatatagtcacatggactacatataaaatgtgcatttcatattcataaatttacttgaaatatttattttatcaagtgacctatgtaaaaatagtaatttttcacttagtggagtcttttgataggatcaggatatgaactccttgccactgtagctcatagtttatggcaaaatcttgagctaattatagccctcattcatgtaaaaaaaaatggtaacttattcagggttagtctcataaacgtagaagtcaacccaataggctagactttcaagtctagcttttaatgtttagaataggaatatacgtttttatatgaaccatgactgcagatagttatatgatattgaacaatattatgaaacgtcttttcacactctggaactttttgttattcactgatagggagagtgccaacaatttcacagaatcagtttttcctgcttttgtgtcttctgtatcttcacaaagattttttttccatgcaacagcaagttgatgtagaatgtacagaagaaagtttaataaatttcagggcatttgcagtactctttgaacaaatagtatttatccttttgttggatgaatgaatgaccacacaatcagcaaaacacctgaccacatatttactgagtaccttatgtgtatgaggcattgttttagacactgttagatgcaaggtttcagtcaggccagtaatttcagtccttaagttgcttaccatccaagagagccaataatgatcaaacaaggtggaaaaaggtcagtgccctacacaggtaaagtacttactcacgtagagatgagagaaggaaggcttgatggctctgaggccatttgggaagaattctggggaatggataaaatttagacatgaatgatggattatgccttccagaaagagagaatgaatcaaataagggaaaatatatggaggtagaataaggttgggcatggagagtttgaaaaacataaaatagagtgatgaggtggctgggacaagtggccctgaagggaagtttctagagagaaggatggagagaagatggaaccaagtgaggaaagtcctccgatgctagctccctgatgttag

SEQ ID NO: 61038 - DNA, 2866 bp, Homo sapiens
cgtggcataatttaggggtgacatattctgatccccttcactggggctggggaatatggaggatcaaattggcatctgctctccatctggtcatgaacagaattttaaaaggcatttctgcttcatcccttcctcatttccttccttccttcttcctttttctttctttctttttaaatgtttcatgctatagattggccctgcagatacttcagtttgccaccactattctacatttaagcttctgaacctcctataagtacagaatacatttttctcttggcatattttgactaataaaactgtgagatgttcaatgggcattgaattttgaagtcagtccaggagatgtacaaataatatccaaagtctgaaggcttaagctgtcatcacagagttactagaggacacttatctttgacatgatctgatatcagaaacgagtgtagacttgtagtcatttagaactcaaaagagatcttagagtcttctagatcagtggctcctaaaagctactcaagaatagggctcatgtttttaatggggaactttaagtggttgtttagacccccaccccaagatataaactgtggtggggcatgggcctgagaagcagagaatccttttcttttaagctgcccaggtgatgttaattcaaatccagtgataacagtgataagtaacacttagccaagtgtttcccatggctcttagcttcagagtgtgacccctatctaagtcaagtatcaaagatttttcttcatgccattactacagaaacagggtagaatactcatattccttcggctcaagagcagcagagagtttctgacaagtatttttgcatttggtaaaatggtagtctaagttggaactcagtaaactatttttgttttcaatgaggggaagtgtagaactgtagtactctcaaattattttttctcaaattggcctttgtgcaaaaaaaaaaaaaaaaaaaaaaaaagtatgcctgctgtgccccagttcatagcctcattttacaagcgagaaaactgaggcactgggagatgaaatgagttgcatgggatcatcatggctttcttcaaattctgactcactgagaatttggtacacaattgtctcaccctctgtagcgttgctgaaagagatttataaatgattattctttgtggctttccattcctagcaatcactaatctaaaatgcctcctacatatttggggcaatgttttggggaaaggatctgataacctgccttttgtagcatcttttagtctgttttgtagcatcttttagtctcttctttgtatttaacatttgtagcttcttttagtctgttttttgtatctaacatgagctttaccagatgtactaattactagctgagatttttatctgactcttgagaacaaaatgtgtgaattcaggagatgagtcaagaagtatggataatgtaaatattcaataatagtaaaaaactgcaagtataaaagctgtagatgtattgcttctgcggttaacttgtgattggataaagacatctctctggaatcccttctggttataaaaagaggccatcttaattggcttgtttttgtttgtggttataaactattccaaaccttctggtttgaattgcggattatggattatttcatttcagtcctctacaaccatcaaattgaattaaaaaaaaaaaaaagaggagcagaagtttcattgtaagcctttatagcatttgactaatggctatatgcagttctctcagtctcttctgcctttgctggaaatgtatagagtgtttcttcatccttaggttgagagagcataaatatattgaatggatttgatttcctacaaaacaatattctggcattttgattaattgacgaggacccttcctttgcaatgtacccaacttttccttccaaacattagaatgtggatcacctacatttgaagaggtagagctggataaatctttgctgatgaactaaaaaggctttcacttcagtgtctggtgaagcaattaatgctggaagagtagcttggggtattaccaggatgcagcatatggcggtggtttgctaaagtgatttccatttggctaaccacttgatggcaagccagaggcagtatctggagagaaggtagagttgggaaatgggtcttgagtacatcttgtcctcaaggcacagggtgatacacagtggtgccttctaagaatgtcagttagcaaccctttctcctgccaccagtgagacagggccattgttcttcatctggaagaagcctctttccttgctgaaaggattaggctttgacatcaaattctggctttgacatcatttttaagacatcctctgaatctaaccctagttttctgaacaggcaaagcctctcgcttaaattcaaaattctccaggccaaagatgatgtcatgtagttttgaaaggctccagttcctggagtactaccaggaaaagaaagtcatcttccttgaattcagtccaccctcaaggtgtcctgagaaagaagctgtttctcagaacagcccaggcaacattgctttcaggcaaactcttctgttgacttcgtatttcctacacattcttaagccactgaaagagtttaagtctgaaagatttctgatacctatttcctcaccaggctgcaaaaataccagaattatttcattcctgcagcctcaaagatagagaaatcaaggctccaagagcatgtcttgagctaaaatagtgattttccactttttttaagtgacaggatattttcatccaataaaactgtggaagggacagattatttttccactcaccagaccagtcttcttgaccaggtgggc

SEQ ID NO: 61039 - DNA, 1050 bp, Homo sapiens
tgtttgtttttgttttgttttgtttgaggcggagtccctctctgtgttacccaggctggagtgcagtggcatgatcttggctcactgcatcctccgcctcccatattccagtgattcttctgcctcagcctcctgagtagctgggattacaggcacccactgccacgcctggctagtttttgtgtttttagtagagacaaagtttcaccatgttggccaggctggtctcgaactcctgacctcagatgatccacccgtctcagcctcccaaagtgctgggattacaggcgtgagtcaccatgcccgtcctctaaagacggtttgaaacccactatatttgtaagcaatgaaaattttatgaacatagtaggtgtggagtgcttttcacagagtctcttgggtcttacctacactagggagaaataactttcaaatgtcttcaaagtgagattaaatctcacatgcacctagattggtttgttttacctgggtgtagtctgctcagtttttcatcttgcgttatggttaattgtgtgaagttatgcttcccactaaattatgaaccttgaaagcagtaacatctctttcttttcgtgacaccatctcacactctaccctccctcccttccttcctttcacttccatatctctgcacaggcatagtgcccgaaaatggtaagcattggtggatggtgatgtgaatctgtcatctaattgcggaccttgaagaggaggcacagctcaaaagaaataactgtgtggatgaatttggctattttctttaggaaacaaagagccaggccaggcacggtggctcacgcctgtaatcccagcactttgggaggccaagatgggcggatcacgaggtcaggagatcgagaccatcctggctaacacggtgaaatcccgtctctactaaaaatacaaaaaaattagccaggcatggtggcagtcacctgtggtcccagctactcaggaggctgaggcaggaggatagcgtgaacctggaaggcggagcttgtagtgagccgagatcgcgccactgcactc

SEQ ID NO: 61040 - DNA, 2793 bp, Homo sapiens
gctcaccgcaacctctgcctcccggttcaagcaattctcctgcctcagcatcccgagtagctgggattacaggcatgcgccaccaccccggctgattttgtatttttagtagagacggggtttctccatgttggtcaggctggtcttgaactcccaacctcaggtgatccgcccgcctcggcctcccaaagtgctggggttataggcgtgagccaccatgcccggccagaacttctgttctaactagagatacaagtggttagggtggactttatgctttgagagtaaaacctcagagcactgttaattcaacccactaccttaaattgatgctgtcctcttagctagatttccccattgggaaagactcaaagctaaaggttgagaactcacagcagaaacagtgattcccacagttacctgcctcatttgaaggaaaaggctcccagagttctgtgttaccaacttgttacaagcatgggctattctcaggtcattctgatgtggaagctgctttatgcagtgaaaagaagtccactcttgagaccagaagacaaccatatggatcctagttttggtactctgctgctgtgtgtcattgggcaagtgtgcagcctctctgaatctcccttcttctgtgaatgagatttcctataacctgcctcacaggctatgggaggattatatgatgtcatggatgcgaaaatcctttataaaatagacagtgtacacaggagacacaaggatgatcagagtgatggtttcttaagtgattacagggccacacacaggctgttttctaaccctgttgtcacccccagggcccacaggtctcatctgagtgaggggaatctggaggtgtgtttcaaggggtattctagggtctttgaggaatcgtgtaggcacttggaggtatcctgtttcttctcccttgatatgtgggcctcagattagcccaagattatatcatttaaaggttggaggcagattgtaactaaatataaaataattatcaaaatacatattttgagtgttttgaaagggcgttgaaaccatttcttgtaatctaaaacaaactgtaaataaggaggattttattttcagttacacctgctagtagatgtaagaggtggttctgtctagtgagaactattgaaaccgattggtgcaagaatgcttcatgggaaattgaatgatgcacagctaacattgtctcgaggtcctatttgggcctgttgagaagggtttatgaaaatgaaggggttctttctatttgaaatagaaaaggtaccatttaccccataatatttaaccagccacctcctcctcctcagatttacaattacagagccccggttgcaagttgaggttttttaatttttttttttttcatttgattgctgcctttagccccttggtgaactccgctggcagcctcgtgggtatttttcaaaagaagcctcctgcttgactgtattaaattccactggcacctttgccacgccctgtcccctacacattcaaataacagagttttcccgtaaccctgttgagaaatgttcacgagggccgcagaacttgttctgtcttccaaatttcaaggaaatactagacttacttggatgtagtaaatgacatggtttccccaaattaatcatttgccagatcttgcatctgttattttgtaaaatcttaatttttgtacaaaaataaaattaaaggaaaaaattaaacaagaccatagtgtgcagctcagtatattacaagctgtttgtttttattcactcaactcaataatgtacgtagctagcattttaactgtggaatatgttagttttcatatgatttgatcaatatcccattttcttgacctaagtgaataaaaataaacagcttgcaacatatacagtttcagattttggttttgttttggtggttagagaagctggcataaaaatatagcctgaaatgactataaattccacaaccaatttgatcatttaacttaatctgtgtagtaattttatttattttttaaattggcaacacatctcatggatggaaaatcagaagatacaaaagcatgtttggtaaaagactcttttttacctctatacccggttccccatttccacatgcctcaggcaatgttaatgttgattcatctaaactgttgaactaagatatatttcagctaaaacctgattttattttgatgctttatcaaatgacttaaaggaacagggtatgagtatgagtccttgacaaacctacatgaatatccagggaggtgtcttaaatgaaacgcacttaggatgacaaaatacacatccaaaagtagaattccatttttattgtaaagaagagtgctgaaagcgagatctcactatgaaaccataaatcaccccatatactcttttggacttctctgtttctgggtttccagaacagactgttctcttctgactgttgcatatgtattgaagcctggcactatgaatctcttatgatgtaagattgaatttcccattgccattttttcagataacagcccgccgtcagtggaaacatatttatgatgaattaggcggtaatcctgggagcaccagcgctgccacttgtacccgcagacattatgaaaggtaagaaaccatttcatggaattgcttagttaaaagtgtgttaattgaaaggagcttctggtcaaggataagacagaggaagtctaaatgaccttttgggaaactgaaaatttccctctggcattttactttgcataccgccttgtgattt

SEQ ID NO: 61041 - DNA, 1050 bp, Homo sapiens
tagaagatgaagaagtgagtgatctctatgcattatccactgatttatttttcatgcactgtggttcatgtttccagtaaacgttttcattttacaacaagaaaaatgtagccagttcctcagtaaaatgttacttgtatattagttgagcacttttggtttattaatgagtgcaataatgaaagtgtgggttgttgaaaagaatcaatgggtgtttttatttaaggcaaagcagaaatggtacaatgcttgtgaatacatcattgtcactgaaggcctgactcgtacaaacttgcctctgattggtttaaatcaaataggtccaagcacttcataaaaatgtctttgtcagccgggttttgcttccaaatctattcatctctgtcagtttttaatattagtaccaggctcctggccatagtccattagtactgtacttaattgctcatgttacagatgattaccaatataaaaagcattaatgttttcccatcgcaaggctgttgctatgtagatgtctcaaactcagcaaagcttatgaaatgtggttattctggacatttcttgctcaggatttatagatgaagttactgtagcttttgatgcaaagaaaaatacccacctcattctttctaagtggaacattttctttcttgtctaactctttacttaaaagtaaccagttcactttatttttatcagtaaaggaacaaaaaggaaaacgactacttttatggaattctcttagcttgattttctggaatagtaaatcactttaaaggctttgttttcacatgcagatttccctttttaaaaaatgtttttaaagtccatgcagggggaaaaaaatctttactcagaatgctagattactggttttaattttcctgaataaattacatggtctgtttctgtggagcacatgaagttgttattagggattttaaaaggagcattaaagcaaaagtactttatgatgtgcatttttgagtatttagaaaatcaaaatcataaacaaatgtatttgtttgtgagggaaattagcaacta

SEQ ID NO: 61042 - DNA, 1129 bp, Homo sapiens
gcttttaccataagcattccttggacaagattgtcaccctgcatggctgaggcagctttctttgcagggacttaaggtgagctgtacccaagccagatgtacttgggcagatactgggtgatagctggagcttctgccttttttctctgaaggtataaggtagagtgtgggaggcttcatgttttgaataagataagcatgtgctttaagttaaggaccaaaaatatatcaggttctaaggaacccacctaatcataccatggataaaggctggggaaggaaaggtgagttacagttctgtgcacatcaaggacatgattccatgtattcttgctcatttggacacccttggagttaatagatacgcaattcagaaagtcacaggccacatctcagaattgtatatttaagaggacccctagcaactccctagaccagtgctactcaaatgagattttctgacttgtccatgaactgttttctactagcccataacaagctaataagcacagcaattgcgaataagcattgatacacttacgctgaaatttgccagaataacattatgtctgttgaagctaataaaaacttggggcttgtgttttgtatgcctccttttgaattccatttttctagtaattcatttttatggttgtttacaaaagcatcagtcagcatcagatgggaaatttagaaaactcgtctttcacccaggtcagtggagaaggtccgctcctacatcttggccacaaactcagatatttatggaggcaggtagcaaagatgagtgcaggggccacggctggaaagtgtgaaactggcacgcacagcccgggccagagagcccaaagggaccagcccacactgttgctgtaggtagatgccgtctgtgcgcttcctgaccttctatgttttcaagatatttttttaatgtgaaataacctaacttacaaacactggctccaatatttaaaaaaatattttatataagctaaatcaaacatgcccaggggcaaaatatagcctacaggatgccaagttccacaaagactgaaatatgcttgacactaggctctccagcctctgatacagcgccctgcagtgggagggcctagaggaagcttcaggg

SEQ ID NO: 61043 - DNA, 1464 bp, Homo sapiens
cctttgtggaatggctacatatgtattttataggcctgttgcctctgagaaaaggagaatgctcactccagtttctcaggtaactccttaggagctaggaattcacttaacccaggcaggagtgatctttcagtatctcctccgtgttggtatgtctccgtgttgatacatctgtgtatgaagatgcacagccacctttttgagatgaagatagctggactagcagaggcaggcagtttggtggtcgaactcaaaattttgacactaaatagctgtgtgccattgactagtcacttaatcgtttagctctgaacctcagttttgtcatccataaaatgagataaaataatatatctgtagatatttctttctgtaatggttgaaattaaagcatgcagagtgcctggtattaataagaatgtaatgcgtggtggtggctgttaatattgtaatgcctaatcaatatatatgaatgacctgaatgaggtttctctaccttcccaccttgcttctaacacagtcccctgaaatccatgtaactccagttcaggaaagctgtcatccttgagctaactctctcacactgacacatctttatgggagccgagccaccaccttgctgtgtccagtaccacgtacctttctttcttctcttcatttagggtcacacacactccgggaccatggagggaggtatcagaattatcagtgggcctaagaaacaactctcccacccacttccaggggcaaatggagagagcattaaagccttcaaaaagttttcttgtccatctgctgcccattgagtaggtaatgaagcccctgtgagcagatcattttcccagaaaagagaccttttgtggtgacaaatggttatatttcatcgttgttaatagtggactccataccttttaggtgtcttagcatagaatacaggtgatgctagttatacctacctcatttttaaagtatgtaaggcagtttggctttggtagctcttgggcaaactgagtctttcacacagactctgtgttgcactctgccgccattttgttggctcagatgggccccgctataggctcgttcttcatgtcagcgtggcttcttactccgtggtttggtgccccagactttcagttcacatccttgcctgttgggaggtgacactggaggcctctttctcacctgtcttggttatggggagagcttgtcacactcggcacactattttttctgctccactcaagttcacaccataaaatggagatcttctgtggctcacatctctctcagatggagcttagcttttactgtgctcaaccagggttgtgcccgctgaggaaacattctcatttctctgctcatttacatagcacatttgtgtatttggctgttgatttggttccctacccccaaaagctcttcttccacttttatggtcatggtctagcacctgagaggtga

SEQ ID NO: 61044 - DNA, 1063 bp, Homo sapiens
tacttcacagtaaagttatattttaatttctggctgcaaagggaaatgtctggccaagctgtagaaatttatcaaggctggaatcaactcagaggtgtaatgactccatttggggtgagatcaggtctgaagtcccagttgaaccaatatgtcatttcgttgttactacaaaaaaaaagcctaatagtattagaatagtagtgccttttttttttctttttttgagacagagtctcactctgtcacccaggctggagtgcagtggcatgatctcggctcacttcagcttctgccactggggttcaagcaattctcctgcctcagtttcccaagtggctgggattacaggcacgtaccaccatgcctggctaattattgtatttttagtagagatgggctggtctcgaactcctgaccccaagtgatccgactgcctccgcctgccaaagtgctgggattacaggcgtgagctaccacacttggccagtagtggcatctttgacctgacatgcaccaatgttatttccctctgcccctagaaaatattctgctccaaggacaccagcaaacctttaggtctggaatttctcactgatttgataccataaagtgcctatgcagtaactggggtgactttgggattcaaatacaaccctaaaagttcaccacttcttgcccccactctctggattcaatcagttccagacattattgtaataccatttttcaagctctgtaaatagatggattctcgtttttcctattaagcactgtttgctaaatattttggcccaaaagttcagtcattccatgcaagcattaatcaatacaggagacattagtggttactggttcagatgagatttgacattatttttcctctgcttctgaggaagggaggggaatgttgtgtaataaagatgaagggtcttttcttcttttgtacaaaatgcaaatgatgaggacatgtgtgatacacacttctctaatgcaaggctgctggtttttgttgagaaagagaggcaaggccctggaggattttagactttgtaaatataaaatt

SEQ ID NO: 61045 - DNA, 1347 bp, Homo sapiens
ttattcctagggaaaaataaaatctcatgctgctacaaatcttatgcctatggaaagatgttattttttaatacataatggcttacctatttcagatccattaatcgcatcgtaaataagcattttgctaatctgaaatgtgaaatctggataataataaaggcccatttatctgtccagctttcaatccccagactagatgtagatcaggaaggggaaaatctctggattttctaatgaatatattgcttctcttccccattacttccacccacctaaaagccagcccccattcttagagttgcagtccattgaaaatatttctcctgtgtaatgaattcttgggggctggagtgcatgtttgcttttatctgtacagtttagaaactgataaaatctttgctgtgctacaaatatttgagaaataatcaacctcaaggcgcaggcatggtgcattttactaaattctttatataatacaaacctactcagctttctacatagggcaatgttgacctaatctaaggctaacctgtttttaatggtaccacatgtacgttgaacgtttaaatgttcagaaacctataatagcttttgtcctcttgtactgtaaaaacttctaataatcatatgataagatcatatcctgtggggtaattgtgttgtaccatgacaggataactgaaaaaacattcagtgaaaattgcaccaaacggaaatcactatatgaagcagcgattgtgtgccgtgcgagaccgtgccctgttcttcaaagcttagctggtcatatttctacttgcttccttttagcttctgccttgcttgttttattttaggaggcttttttccccaagccactataattatctttcaatgatttagaagggggggaaaaaacactcggttgacctttacacacacacacacactctctcacacactcacacactctcatatactctctctggaagccttgaacaagtagggcttgtgtttggattcagttttaccttagtcatgcctctttccagatacaagaaacatttaattccagatttcctgcttctggctttaggcctttgaccagcaaagtgaaatgtattttttactgctgtcagccagccagctgctgagttgagtgaaggggagaaaaaaaaaaaaaaatgaaagaaaaaatgaaaaaaaaaaaaaaggaaccgaaatgagaatggtgccctactttgtgaacttgcaaaattagaaaaggaaattaaagtctccttagcacccatctagagagccaggttggcccagggctctcagaacccagagtgaggggtccttgggcgtccatggggtgtctctccc

SEQ ID NO: 61046 - DNA, 1046 bp, Homo sapiens
tgtatggttaagcagttgagatccaaataacatagatagaaaccaattttaggatagcaaaccaatatccagaccaaggaagtttttgcctgggaatcttagtttaaaaataatcaggatccccaatatttgaacagacttatgatgtttataagccaagtacattttcttcattgagtcaacttgtcttatttaaaacaaattatgtttgctgtattaaagttcatatttttaaggctgagtcttatattaatcccacagtgagtcattaatcataccaaatgcattataaaaactttaatcactgaagttgaaactgagattgtaatgcaatccatcccttttaattacatcagctatttttccctttcagataaagagctacgtcgcaaagggaaaacagattaaaactagagctgtttgatgtttctctttttagagcaattttatgcagtttgtttaaaaagttatataatttaaatgcttgaaattttcaggcctctggtttttgtggcttgcatagtctgtctgccttccttctcgctggggcggtcttttacttagcacactaaaacagaactcctagtggagtcccctaccccactcagagctgtgggataagactaaactgtctcttggccacgctgtgcttgcctctcattgacctttttatcttagatgtttcatctctatcttgacatgaatgaaaataaaatgttttcagatgggcagcactaggttcagatctcacctctaacaaatggtatgactcaggcaaattgtttaacctttataggcctcaattgcctcatatgttaaaaaagagaataataataatactccatagggatattgtggagtttacataaaataatctttaaatgtacctggcacatgctagtacctactagaatataagcttcatgagctcagaggctttgaatgtttggttcatggctgtgtctcagtgcctagaacactgcctatagtatgtgctcaataaatagttgttgatggactggtaaagcagctagcattattgttgc

SEQ ID NO: 61047 - DNA, 3759 bp, Homo sapiens
ttaacacttatgcattgctaatcttcagtgcatcatattgaatacattgggaagggatttgccctgttaaggaaagcagggagttgcaataggtttgttgtttgtcgttaacatggggttggttggatttttgaaagagaaatgctttaaaaaaatctttctcaggagtatcataaaacacaacatgtaatttaaaacccatttggataattgactgatttgacaagaagacaaccttagaattaaactatatattagaatcaaggagtgatatgattgtataccatcagtacataatactttgctattttgataggtatctcataagggactgaagcgaatatgcatatttcccctaatgtttctgtaatttagatttctttgtttagagccatgattggggagtaataaagctttacagaaacttcacgagctgattgacaagcctgttttcaagtaaaactgctgtgtggaatattttatttcatagcaaaacatgtctgtgtatttggttttcttctgactgtcttttgaaatatgttaccaggtttcatcagagcaagaaaaagaacaagagactttaataagccagaaaagcatccctgagcctctcccagcagcagacatgaagaaaaaaatagaagggtatcaggaattttcagcgaagcccctggcatccagagtagacccagagaaggacaacgaaacagaccaaggttccaacagtgagaaggtggcagaggaggcgggagagaaggggcccacacctccactcccaagtgctcctctggccccagaaaaagattcagccttggtccctggggccagcaaacagccactcacctctcctagtgccctggtggactcaaaacaagaatccaaactgtgctgttttacagagagccctgaaagtgaaccccaagaagcatccttccccagcttccccaccacacagccaccgctggcaaaccagaatgagacggaggatgacaaactgcccgccatggcagattacattgccaactgcaccgtgaaggtggaccagctgggcagtgacgacatccacaatgcgctcaagcagaccccaaaggtccttgtggtccagtcgtttgacatgttcaaagacaaagacctgactgggcccatgaacgagaaccatggacttaattacacgcccctgctctactctaggggcaacccaggcatcatgtccccactggccaagaaaaagcttttgtcccaagtgagtggggccagcctctccagcagctacccttatggctccccaccccctttgatcagcaaaaagaaactgattgctagggatgacttgtgttccagtttgtcccagacccaccatggccaaagcactgaccatatggcggtcagccggccatcagtgattcagcacgtccagagtttcagaagcaagccctcggaagagagaaagaccatcaatgacatctttaagcatgagaaactgagtcgatcagatccccaccgctgcagcttctccaagcatcaccttaacccccttgctgactcctacgtcctgaagcaagaaattcaggagggcaaggataaactcttagagaaaagggccctcccccattcccacatgcctagcttcctggctgacttctactcgtcccctcatctccatagcctctacagacacaccgagcaccatcttcataatgaacagacatccaaatacccttccagggacatgtacagggaatcggaaaacagttcttttccttcccacagacaccaagaaaagctccatgtaaattatctcacgtccctgcacctgcaagacaaaaagtcggcggcagcagaagcccctacggatgatcagcctacagatctgagccttcccaagaacccgcacaaacctaccggcaaggtcctgggcctggctcattccaccacagggccccaggagagcaaaggcatctcccagttccaggtcttaggcagccagagtcgagactgtcaccccaaagcctgtcgggtatcacccatgaccatgtcaggccctaaaaaataccctgaatcgctttcaagatcaggaaaacctcaccatgtgagactggagaatttcaggaagatggaaggcatggtccacccaatcctgcaccggaaaatgagcccgcagaacattggggcggcgcggccgatcaagcgcagcctggaggatttggaccttgtgattgcagggaaaaaggcccgggcagtgtctcccttagacccatccaaggaggtctctgggaaggagaaggcctctgagcaggagagtgaaggcagcaaagcagcgcacggtgggcattccgggggcggatcagaaggccacaagcttcccctctcctcccctatcttcccaggtctgtattccgggagcctgtgtaactcgggcctcaactccaggctcccggctgggtattctcattctctgcagtacttgaaaaaccagactgtgctttctccactcatgcagcccctggctttccactcgcttgtgatgcaaagaggaatttttacatcaccgacaaattctcagcagctgtacagacacttggctgcggctacacctgtaggaagttcatatggggaccttttgcataacagcatttaccctttagctgctataaatcctcaagctgcctttccatcttcccagctgtcatccgtgcaccccagtacaaaactgtaggctcagctctgcccagcagtccaaagcggcatggccaacagagcttcactccttacccaggagtgctggcttatagagttagaagtcagtatttcttctaatctgaggctatgatcagtcccagctgtaggggcccagaggggaggtgaacatgcctgatttttgtgggacaactctagcccacaaactgactggctggtgagtcttgactcccttccaacacagatgcccaggcacctccagatcattcacttcgcacgtgggccttgtgaagggatttgtgaatatccaggaagaacttagaggaccccatctgagttcggatggtcaggaaacaatctgggcaaaaaagaggcaggcatttcaaaggaaggggcaaggaagactggcaaacagatggcaagggatgcccctctttttcataaaactctccaaggttcaatcaatgcaatgtatagtgaaacttcaatagatctttcattttgacactattaaacaatccagagaagtaaacactgttaaattgactgtatatatttgcttcttaaaactacctgtatcactgtttgctcacctaatttatatacaggtagttccattttctcccagttccttctcgtctttttttttttttttttttttttttttattaaatggtattgcttttgtttgcaggtctttttgtttttgttttgtttttgaggctgactgactgtcctagttgttgtgtgtttgtaatttttccacatcttattttgagcagctttgggtggtaaagttattgtttacaaattgaagcaactgattctagtggaacaaatgaaaaagaaacagtcaagcacacaatagtgcaaagaacgttcctttgtagatccgcaacttaaggattttgttcctcataaatggcatagttgaaagagcttatacactgcttacccagccaaatgctttgctttgaagtattgggttctgtgaaaatattgagcattgtacttaccttatctaggctgtgaaactgtcctacataccagagaatcataaaa

SEQ ID NO: 61048 - DNA, 1415 bp, Homo sapiens
tttcttgtcattcccaagaagaatctcccaggccacatctttggggataactgacatactggattagccttttcaaaagaaaagtcatcctatttggttttatggggtgtgagttttgtgtgtacacacacagaaacatgtaaggtggtttgggtcatgtttttaaccacctggcaatacagtccactttctggtttcttttattgtgggaagtaaatggtcaagctgctcaggcagtgaaaagatgtggagaatgtccgttgtcattcttgccactgtattccatttgctaccgagatataacattaaggtggacacattttctaactgtattaattaaaagtcaatggatacagagagtggattttctccccaagtcccatccctgctgaagaccgcttggatgaactccccaacccactgtgcccctcccgcaacactaccagtagactttagaaccatagttaactaagtcttttacctctgagatacttaattctgggaaaattggtgacaattttcaacttctaaataggtaactcgactgcaaaataatcaaaactgataacaatgaaactgcggctcttaaacaaagccatgcatgccgtgcatttgtattgaaatgtctccatgatatgaagccaaatattcaatgtaacatacttaatatccaaaggtggaaacaaaagaatgtagagatccagtgttaagagttccatttgcttcaattaattatttaccttcctgtggaataatatatatatatatatttaatagaaccatagatagactagtagaatttagattataaatgtgtgagtgcagattatcctgctattgcacaagctagaggggggaaaaatctcaattccagctggcaagatgctagccaggacacatataagaaagttgcactagattgaatggtcacagaatcggaggacatggaagaaaaaggaaacttcggtggttctgcagcagacatgggctaggtcatatgtggtttctatgagttcgtgtctcaaaaaaaaaaggagggggggcatctgtccccggtggagctcacctatttggaatatggggcatttgttttttccactgcaatgatttcagtctggtttcatcatgttggaattcgatcacaccattttcaaacaatgttaacatagtccagcttttgtttttctcatctcttctgagaggagactcactgtttctgtctgaggaagctcataccctcggcaaaacatcaggacaaataaagagaaatgggggtacgcattcccaacagaagcagtgtgttatttgttttaaaactctgaacagagatcttggaaatctttcaaaaagaccattgaattcttcattggctgagaacgacgttttaaaatgtcttaaataaggctttgtttgca

SEQ ID NO: 61049 - DNA, 1135 bp, Homo sapiens
tttaatgtttggcaactccacatgataaaaaaataaaaacagcccaaccgagtttcggaattaagtattcttctagtaagtgattcaaacttgtaatatttgccacaggactgacttatttatttactagctagaagctcttaagttcacttgtttatcagggcatatacagaagggtttgttaaaactcgatgttaactttacaactttctgacctggtgcatgaattctcaagtactgtatttcactgtgttggtgtgtctgatggaaatttcgaggtggtcccacaaaaatattttatgtagtgtgccttcaaagagaaccatttatttctcttcacttatcgtcccacaaagtcacatttggtggtggtcagccaagtcgcatctggtctagttttactcttgtcccaattttaaagagaaatgggaatgagtttgccctggtgagacccataccattgcaatgattatcttgagcacttaaagtccagtgttggctgttagtgtatttgatattctgcctgtctcctcatggttgaaatatgtctgaagaatagcagcataatctcttggctgtttatacttttttaaactttcctgtgttgtaaatattgtatacttttggtgattccagctatgtaacctctatgctctgtaaggtgattatttgtatatagcaacatggcccagtgatattatatagtttcccaatggagaggttattgagtaacctttgcattagtttaaacactaccagaagaatgctgagccaactataaacactcaattttgtatgttttccaaattgtacttattactgcttttgatactgtattacgtgccaatagtttcccaatcacatagcaggcaagagatattttgtactttttgatccactgtaatatttaataaaaaatgttactatctgtttccttttgggtgtgagtaatctgtcactcttcctgaggagcctgtggcctccccagaagactttccaccccatctgtccaaattgaatgataacagtaatgatggcaatgtctgtaattcactaaggacctagtgggtgcccatttggcaaatacctcttatcttcacaaccttatgtaaatatggttatacctattttactt

SEQ ID NO: 61050 - DNA, 1424 bp, Homo sapiens
tgcccatcagtggtgggctggatcaagaaaatgtggtacacatacaccatggaatgctctgcagccataaaaatgaactagatcatgtcctttgcaaggacatagatggagctggaggacattatccttagcaaactaacacaggaacagaaaaccaaataccacattttctcacttataagtgagagctaaatgatgagaacacatggacatatagagggtaacaacacactctgaggcctatcggagagtgtggagggtgggaagagggagatcaggaaaaataactaatagttactaggcttaatacctgggtgattaagtaatctttacagtagacccccatgacacaagtttacctatgtaacaaacctgcacttgtacccctgaacttaaaagtttaacaataataataataataatgaatatgttggcttatgctcactcacacctctaactccccacttcaaacacacacacacacacaccatagacaatttatttgctgaagaaattgatcttttatcctgcagggtttttccatagtctggatttttctagttgcatacctgggttgccatttttcttttcttcttctttttttttgagatggagtttcgctcgtgttgcccaggctggagagcagtggagcaatctcggcttattgcaacctctgcctcccaagtttaagcgattctcctgcctcagcctcccgggtagctgggattacaggcatgcgccaccacgcccagctaattttgtatttttagtagagatgggtttctccgcgttggttaggctggtctcgaactcccgacctcaagtgatccacctgcctcttcctcccaaagtgctgggattactggcatgagccaccgcacccagcctgccttttttcttatatttttggatcatattcagatttgttggttggttagtaagaatacattttaggaagggtcatatactttcatcaagaagcatatcatatatctaggtcttccactcatcttaacaaccactgatgagcattgttttagatcctttatttcattaaggattacaaactggtagtatttttacattcgttatagctggaatgcctctacttcatcagctatttggttaccctgaagtacaattcttatagggaagacaggaaaagtgcttggggttttttttgtttttttgtttgtttgtttgcttgtttgttttttcccatttatatgtcagttaccaaaacaatgagatggtttcctaccatctttcacaggtgaccaatgagttcatttttaaatatcgttttgaatttttggatttaaatacatgtcatgtgtctgtccattgccattgctattctagtcaatgttctaatcaatgtccaatgtttgactagtagaagccccttcgagttgactcttgaa

SEQ ID NO: 61051 - DNA, 1013 bp, Homo sapiens
gggtagttgacattttccgatgctctgagaacagtaagggaaaataatattttgaacatacagaattgtttttataattttcctgagtcatttgatgaattgctatagaattctaagcactaatttttaatcgactagcttttctaaaacaccattgatctatggttttatgtgtgtaaaagttaggtggtaatcgttgcctccatttcacttaatgcctttaagaattccaaacttttcttctctgatattaacatactcttggatttggggcaattaaccttttgtatatcaaattaatggataattccatcacattttaaaaattctaaataactaatttaaccttgataagtattttgatgtatttaaagtgataataacttaaaattgatagtctcttgattttttttttttttttttcagcaaatggtagaaggtctgattagttggagaaggttgtattgtgttttgcgaggaggtaaactctattgtttttacagtccagaggaaattgaagctaaagtggaaccagctttggtagtacccattaacaaggtaaaggaaatgctattttgagaaaaaaatatacatcttaggaagtttgtttttgtctgtgcagtttacattgttgttgtcttataaataaaagagaagtactggtaaaaacaggttacttcataaatatgatttaatctgtttctgtttttctattagagcttatctgttataagaaaatgtatatttcctaagaaaacatagtaatggacatctataccagtaaataggttttaaggcagagaatgtaactccacattagcagtatatttaaattttttatgaatttacttaagagattaaacataaattgttagctcatgttattatagtgatgctgtttctagttagcattcaaatgaagccataaaaagacattcttgactatactttctgatttcttatgggattgataggcaattgtccagtcttctgacagaacagaaaagcctgac

SEQ ID NO: 61052 - DNA, 1021 bp, Homo sapiens
atttgctttcaaacttctaaatttacaaatcacaaagttgatttcagatgtattactgaaatacatgcttttacagaattttcatttcatttgctgcctgttttaggaaagataacttttgtttatttgtgtttgcattttggaattgtatgtattatgctcgtgcatttatttttcccagattaagccccttatttctaaaatatagcagctttaaaatgtattaatgaaaaagatttgaatagtctcagaacattgttgtgtactattctatagtagaatcttgggtaggtaaatttaaaactttttggttttactacaaacctttgctgccttgcatgtatatattaactatttttacaaaaaaaattctggggtaattaaaactttttggtgaataatagttacggccagtagctagcgattttgtaggcactaccaacagggcacagccaaaactttaaaaatcatttttatgtgatccagtgtgaactaagggccatatgtttggtttttatttatactctgatgtctagaataaattatttaatgctttcctccatatagataggtagtacacaggtaggtatcttcattaaaggactatcttaatgttttttgaagtaacttttttaaacaatgtcaaacttacagaaaagttgcaagttgaatgtcaagattttttttttttaattagagatgggtatcggtatattacctagtctggcctcaaactcctgggtgcaagcactcctcccaccttggcctctggagtagctgggactacaggcagacaccaccacactcagcttaaatgtcaagatcttttttttctcaaaaaaattatgacagcaagttgcttacatgatagtctgtaccccaaaatgtattaatacatatttcctactatcaggacattcagctacatcatcatcactcttgaagtcaagaaatgaatactaatacattaccaccatataatcctcagagtccattcaagatgttgcccattgtcacaata

SEQ ID NO: 61053 - DNA, 1075 bp, Homo sapiens
tgtcagcctcgagttttctcaagcaggcactttaagaagacatcttagggatgcaggttagagctgctagaaacaatgctagtgtttgttcaggtccttagaggccaaggttgaggcctagttgagtaaaggactcagaggatcatggctagagtttggtcaaaaagacagcctttgtccctgggaaattaatataaatcagaccctatcattccactttttatcaactttcctattacacttagaattaaatccactcctcttccagggctcacagagcctccaggtgagctcatcactccctgtatttccagccttgcgttgcaccatgcttgctgcttgcttgctgtgcactagccacactggttttccttcagccctccctttgcagatactcactctgcttggaatgttttcctgcattctttgcttggctagattcttttatgactggataactgttaactcctcagaaagtccttccccagttcacctacctaccacaggtcctcagttttctcatctcctttgtttctttcatagaaaaagttgcattccaacttgcaaatgctggtatttggtttattcctctgcctactttttttttcattctgcctgcatcagaatgtaatgctggatcttgtttaccattgaatgcccatcacctagcattggacttggcacattttaagtgttcagtaaatatttattaaatgaacggggacccttcagagaaacatttgtgtgaattaaaacaaataatttgcagatttttattgacaaagtatagagataaacttgctaagttaataacttgcatcgttgaaaaatgtcatctattatatctaaattttttcttttttgtagtaaagcattcttgaatatacattcagaggcattaagtacattcatgttgtacaagcatcaccaccctccatctccagaagtttttcatcttctcaagctgaaattctgtacctattgaacactaattcctccttctatcctcctggcagccaccattctagattccatctctatgaatttcactactctaggtacctcttataagtga

SEQ ID NO: 61054 - DNA, 1102 bp, Homo sapiens
ctttgcactcgtactcatgaggaatagatgaagaagcaagagaaaaacagttatacttcctggtctcacttgagatacataatccctaaccttaagtgggttcccagtatgaccgagcaattctactgtttctatagtcttctactttacctctcttcaaggtaagtatttcacatgttctcctctctaactgccaatatcctctctctgcccctcattcatagctgataactttgtttcatatgtcattggtattactgaagtaattggaagagaaaaatatcctccatccaccaaatctgccagcctacccacatctgcctcagtgtttgctgtttcctttcttgtgaactaccttcacctcatctaaggcctgtctacttgtgcgctagagcccacttctcagttactcacagtaggctcctgcatgtttcctccccacctatcctacatcaccaactttagtacggcatcatttctgtatacttataaacatgctgaaataccttcaatttcataactatccttcatggaaaataattttttatttcataactatccttcatggaaaataattttttatattcctatctacttcctcttctgccattctctattgaaccatttcagttggcttacctcatgttacctccatcccatcctacagaaactagtctcgtcaaggtcaacagtgatctaatgttgccacatttgattgtcagttattggagttcctcttcctggaccttttggtattaacacaattgatcactctccttgaaatactatttttatatggcgtctagaataccactttcttgatttttcttccacctcagtaaccatttattcattgcttgtctcctttgttcattgctcttcatttaatggagtgcttgtgtcccagtatttggtccttggacttcacctaactaactttcattaaatttcatgtatatactgataactcccaaatttatatctccaatacctatttctcttctaactccagactcatatatccagttgcctggatgcatctagatactgaaaacaatctcaaataatgcacctagatatcaaaaacagtcttaaacttatt

SEQ ID NO: 61055 - DNA, 1005 bp, Homo sapiens
aattatatttaatctatatttctttttgaagcctagaggaatttttgagaataaattattgtgcattaagttctttttaatagacagccatatagatcttggagtgtctgttttcctgttcagaatttttcattctatttggtttattctgagttcaaacacgaattttctttataaacatttcccccttgaatcttgcgtgccatttgtttatttgataccattaaagtgggtcaaaagatacaataaaaccttttacaacatttcacaaatcatgtccttgtaataccagcattctgttgacactgtagtgtgaacccagagtctactaggttaactcatagcccgggactactcttacctgatgcttccttaactgaccacttcagcaccatggtaggagtttaaaaatcaggatgcataaggggatcaattttgtatatttaagtgatctaggtcaatgcgaagatttctaatacagcttttagtctttaaccaaaatggacacatataaaatgataaaattttccctagtaatatgatatgtgaccaaatatagccgttcttcctgacaagagtgcattttttagactaccatttaagccatttttttttaataacattccccttcctccaaaaaaatgttgtaacaattgccctatttgatagaaaaaaaaatgtagctgattaaacttttgggaactcaaaattagggttggctaaaaggaatgagtgtgatgttttagaaagaaaatgttatcctgacaagaatgttttaaaagtgaggtcactgttggttttggaagcactggcattgtagttagtcatgttttaaaaatgaagcaacttgaaatatcataaagtattgtttgatctgaaagaagacagtgaacatttttggtaatttttagtaagctccctgataagattcatctattcattttattgtggaatttagcttactaaaattcctttagccagattttcccagtgcatctaatagct

SEQ ID NO: 61056 - DNA, 1025 bp, Homo sapiens
atggagttagaacagttatttttataagaagaatatatttttacctcacaaaaatttgacagattaactttttaaaagtacaaactataaacaatgtctagaaaatgtgctgttaaataataacactttattttagctatagtagtcagaattattatggaatgcagaggttcaggtcactgtaaagaataaaacttaccaaaattattacttgtcatttctttttcccttctttatagatattcgaataccactaatgtggaaagactctgatcacttcagcaataaagaacgtatgtatgattttaatttgtaattgaaatgttttctttagtatgtagtgtatctgattattgagaaaaaagactgcttccttgctgaaataaattgatgtcatttgaaagaataagcagcatcttgaactgttttctgatttttaatataaatatgttgcagtcacttgatactaattaatatagtgcatatgtagtgtacttttagttgttgataggaaccagtgctaggacagtaagtaccgggttcagagtgggaacgggggaagggaaatatggaacaaaagaaaatgtttagcgaataaaggtaaagccaacatttcttgtatttgaccagaatctggaagatttttctgccttatttcattacttcaggttatttaacaggatgaaatagggaaagatttttagcttgatctgattttttttccttcaatattttatggttttatacagtctttacaaatccgtgtattgcttaggtcatggaaattaacctcgaatgatttctagctattagaggcaaagcaggaaagatatgataatactttatctttcttgtctattgtgatagctttgttccttgtactttaaaaactgaatcatattaagcacaattagttttatatgaagaatttaaaatcaggttagtatttattattcaattaggaaatataatttactttacaaaggaatacatgtgggaattaagtaaagctttctgattactaa

SEQ ID NO: 61057 - DNA, 1034 bp, Homo sapiens
tttgattctaggtaggagttggcaaactttttctgtaaaggtagtaaatattttagcttttaggagcatagagtctctgtctcagttactcaccactgccattgtggtttacaataaataatacagaaattgatacggcagcagtaaataatgcagaaattgatgtggatggatttggcccatgggctgtaggttttaagtgcaacataaaatattatgtgcaaaagtcacttgaaaccaaaaagcctctgctgtcatggagatgagcagcaatcattttagtagtgtgtttttcagccgacttgtaaactacctatttcccccctcccaggacttttagagtaatgcaacagaaggcttttgaggaaagcagatatccctggcaggagtcctttgagaatgttgctgtgtgcctgccattacgctgcccgaggtgtggagaccataccagatttagaagcttgtcatccttgagggcccatctggagttcagtcacagctacgaagaaagaaccctcttgacaaaatgcagtctctttccatccctcaaagacacagacctagtcacttcctcagaactcctgaaaccgggaaaattgcagagcagtggcaacgtggtaaagcagaaaccgagctatgttaacttgtacagcatttcacatgaacattccaaggacaggaagccatttgaggtggtggcagagaggcctgtgtcctatgtgcagacctacactgccatggacctccatgcagactcgctggatgggacacggtcgggtcctggactgcccacctcagacaccaaagcttctttcgaggcacatgtcagagaaaaattcaatcgaatggttgaggctgtggataggaccattgagaagagaattgataaactcaccaaagagttggcccagaaaactgcggaactgttggaagttcgggcagcttttgtgcagctgactcagaaaaagcaggaagttcagagacgagagcgggccttaaacagacaggtggacgtggccgtggaaatgatagct

SEQ ID NO: 61058 - DNA, 1032 bp, Homo sapiens
agctagacgcgggcggcgggcaacggccgcgggccttgccgcccgagcagcagttcgagccgccgctgcagccccgggagcgagaagccgtgcggccgggcgtgctgcgttcgcgggccgagtacaccgaggccagcggcccctgcatcctcacaccgcaccgggacaacctgcaccagatcgacgccgtggaagggcctgccgccttcctggacatcctggccccgccctacgacccggacgatggccgggactgccactattaccgggtgctggagccggtcaggcccaaggaggcctccagctcggcctgtgacctgcctcgagaggtgtggctcctggagaccccacaggccgatgacttctggtgcgagggagaaccctatccaggtcccaaggtcttcccttgaagccactggcgcccaggagcggtgggccgaagacgtgccctaccctaccacaagggctgtgtctctaccccctagcctgggcgttggatctactggaatgagcagcagccgcttcctcggcagccttgggaagcacgggcgactggacagcagccgccgggcacggttatgggggcggggtgggcggggaggctagattgtttcctggtactgtcactgccactggggctttgatttggaggaatggggcaggggactatctgaagcgcttccatcctaaagccataatgaaaatatcttcctctcttccccattctatacaaaatactaagtggttttcttgctcccactccctaccccttagttaaatagggtttattttccactcatgcccttatgcctttttttcttatagttttttaacttattgactgtgcatgacccagtggtttgaattgtttttagttcaagtcattggtaaaaactaggtttaaggagatgagctactgtttaaagtgagctggcctgcctaattaattccttgtgaaaactaaatgattttttcagtttggggatcattctcacaacataactatgcatgtagaggacaagatttattttc

SEQ ID NO: 61059 - DNA, 2279 bp, Homo sapiens
ggagctgaatgtgttatgcttccaaacaactgaatgtaaaacactcctagccagttgttgcattccctatatttatttacttccaatattttactgtaaaagtagggagaaatattatgttgatagttgtttcatattctctcaggaactttaatgttcccgactcgggtgattccagctgtgttgctggcagtgttgtctcaaccctctccctaaaatgactgagccctgggttcatctaatgtggttttccttaggaagagatagaaggcacagaagatcacagctagagaattgagaattaactatactactagccattttagggcaccaaaacttgggattaaacacttcctacttcccactcccaactcctgaaatgaagtcttgctatctgtgactagttttatttttgtgcttttaatagtccgagcagtcttaccttgtttacacatgtattgacaccatttgcttcaggccatggagcactgtttctccctttttactatttataggattccgttttttcacaagacttttaataaaaagaaattgtagaaataaacacattaaaatttgcccagctgtcgtctaagccctcttgattgacttgcccaagtggcaatagagttctaatatctataataaagggagatttgctattattagtggaatgttgaccccgtatgtagagaaacagtacgtgcctttgcctctttatgcacacagagacccagggtgagggagtatttgttcccagtttttaagatagtataaaaaagcaaatacttggtgagtgatttaaaaataaaaccaaaacaaaacacaaaaagatattccacaggacatgccactttattataaaacctgacacaggcatagtaccaagtatttcctgcattgttgctaaaattgttttattgtagctccacattctggtgtagtttaaaatgcctttgggggcagtttgaagcagttcttcatgccacttagtttgaaaataaaattctagatatgcaaatgattttcttagaaaacttcacaaaataaaagatcttgtttttttttccatagcacagtaatgaatgtggttatcaatcacatacttttttggattatattgtagcaaaaagttgattagcttaccaagattattaatagcaatgtatgtgttataatacaacttagtacattaaagctacgaaaactcatcctggctgtaggatagtaataaaggaagaattatgacttcattatgaaaaaaagaagttttaaagttttcaattacgagcaatttggaagaaaaaacctaaggtgcttttcaaaagagtaactgaaattgttgcaggccaaaacagcaatatgatatctcagatttagttcaataagaacagtgaaacttttggttcactaataaattctgagtaaattagtggtgaagacaaaatataacttgttttagtgagccactgaggaaagaatatgcttattacaaagacaaaatgtggtgcagaaactatcttgcacctgtgtgcataaactgttagtcgtgactgacttggtgtgttgctattgtgtttctatatactccgtccaatatagataatgttttaataacaactgtgggataaaagttatcttccccttggaaagactaatgagcacaatgatattaatcacttttatggtgaataataaatgcaataattgcctcatgggtgagaaattgtctgtctaaatgcttctgaagcttttaaagtatctggttctgtcactggccagttatatcaatgcagagtattgtgtacctacttactattttatgagaattgatttttactaagcctgatttgaatgggttgcatttacaccaactgctatttattaatgaaagtggtagcctgctttttaagtaatatgtgttttggcaacaggagagggttttctgagcttttaacaccagtaaccctgaacttcttccaaaatccacaccttttattcccccttttccttgtctccttctaggtgcctcagtcctggcatctcgggaggactctgccattactcatctgttactgattctgaatcttgtgctctagctctacagcccagtgaagaagcaatatatctttaattcagggcttgcctcttgctttccaactctaacctgagagcagtgctacttttgtaattgcaggtctaaataacttaagcgtatatacagaagccaatcactgatcacttccattgcaatgaggcatctgttgtcaaagaaggaa

SEQ ID NO: 61060 - DNA, 1050 bp, Homo sapiens
gcctccacctcccgggttcaagcagttctctgcctcagcctcctgagtagctgggattacaggcatgcaccaccctgcccggctatgaaaattctgacattcttttatgtcagtgaacacctaacttagtatctagttgactcaagatgagagttctcaatgctataatttgaatgtctttgaaaattccactagtattatacaagctttttctttttctatactcagagagttactaatgcaataagctttgtcaaatgacgtcgtagtgtagtccaaattcattgtataaggacttatcacagtacatggatttgtaatcatgtgtcctcagagcatcctcggaacttagtaaggtgtgttttccagttttacagataaataagcctaagctgagagaattaggtaattacttaggtcagtaacttaaatacattatgaatcacgagttattttgatatcaagacctctttctagcaatgctgccatattgtactcatcatgttcatttcagtatggttctcatctatattgaactgtagattctgtgttagcatttattacctctgctccagtattgattcttttatgttaggtttggcagtaagggccttagaaattcctcacagtgaatttttaagatctggaagagactagtttgaaatattcattttaatatgtaccacagaggtaatggattctaattatctggttattgaagtttgtcaaaagaaaaattgtacttccactgaagaaaaaaatagctagtctttgcactctgaataactttgtttcattagggttttttggtcaatttttctttaagagacagggtcttactctgttgcccacactcaagggatcctcctgcctgagccctccacaatagctgggactacaggtttgcaccaccatgcccagctaattttttcaaaaactttttgtggagatggggtcttgctgtgttgcccaagctggtcttgaactcctggcctcaagcaatcttcctgtctcagcctcccaaagtgttgggattacaggcatgtgcca

SEQ ID NO: 61061 - DNA, 1005 bp, Homo sapiens
caagaaaacctttctaacccttgtcgcaaatattgggaatatgtctcacctgctctgactgtgtcagcttcatggcttcagaaagatatgctgttaagagaaaaaataggcatgttaatatgtgtcttcattttgtaattaacaggtaaaaggaagagttttaataatcttcatatgacaaagagaactggtctgataactctgatacaattggggattttttaaaagaattcttaacttcccccaaaaggatgtcagtggcaataaaatgaaaatattccctaccctatcttgaaggttttgttatttaaaactcctacagattttataattcagaaactgaagatggtctaatcagaaaaataggtttaggaaagataaaaatcaaacaagaacctatccaaaccctattactcatcatactcacaaaaatatcatgagattatcaatgactttttatccgtctgaatacctggaatctatcattttggactcctatagaatcacttttaatgaattgtctctgagttaaaccatcagccttatggttaaaagccctaagaacttgttgacatatttactgcgaggaagttactgaggacagtataatgtcatttatgaagaccttcaataaacttctctctgatcttagatcctcggtgactatttgtttgaattttaatagccaatgtaaaaattattatctttcctctttaggatgactgctagaaaacttaagtcaagttcttaaaaaaatatgcaagaactaatggtacattttgtgaactacactactagtcctttctcattttctctatggatgtccttatctatgtatctttaattacattcgatattttattgtacattcatctgtaagacattttataacctttcgggaacaaggttaggtataaataagttctctattatcaatgaattgtccataatgaatctccatttttatcttgcttgttataaacatttttggcatctctcatacct

SEQ ID NO: 61062 - DNA, 1640 bp, Homo sapiens
cttgtatttcacggtttttcttttggggataggttcagaattttcacagctgtattcaggtaactgaagattttgtgtctccagaacatcttgtagagtcatttcatttaacacaggaactgagacttttgaaggaagaaatcaattatgatgataaactacaggtaagagttgggtgttctaggtcctgttcttcaggctttttatattcagaaatatgatacatgtataacagcttaggcagtcattgcctagttggtcacattagggtgacaaccaaagattaacaccaacatgtatttaattgtatgatttatagtgtcccttttggcttaacactttcaaacatttttcttatatttggctttcctagttccctattatttttttaaatctggaagttgtcattttttaattaatttctgtcgaactgaagtgattagaaatatcaacatctctttcaggttaaaaatattttgtatcatgcagtcaaagaaatggtgagagccttgaagatacacgaggatgaagtagaggatatggaagaaaattaagtgtgatccagtttgatatttttaggttgttgaactgggattacttaaccttgaatgatgatatgtatgcacactgactttaagcttcataaaaccatcagtgccaagaaattctctttgtagtaattacttgttactgacaccacagcagtatagcatatgtcacagctcctgtgattcaatgttataaaacaagcagaattttaaaagcagcactatatagctgttttgtattatagtgtatatgatgtttgtgaaaatgccagatttaaaatgatgtatttatttttggtaaaaaataaaaaattctatgctatattgttgatcaagtgtaaatgtgaccttgtacagtttactaaaattactgatatttttcactacattgagacagttactgtgagaataggacacaaacaccagctattgcctgcatctgggaaattgctgaatcgcacagcagtcatgtcataatcagaaaattactgccaaataattgtaaaatttgtaaagtataaagtatataaagtagatactaaatacagacacttcaatattttgttgaagctattgactgtacaattaaacattttcaaaaggtgtaatttatttaaaattgtctcattttggtaaaatttatgtgaacttttaaagctaaatattaaacttaatatgctatgtaaatatatacatatatacatttaatgatgtatttttttaaaacattggcttgcttttgttaaagtgcaagtgttacatatggctttgtacattaaagttgaaaggggttttacattttccattaaaaggactttatcaaaaattgactttttccagagtactccctctgttgacaagcatgacactgggggcagagaagagcccgaagtcagtcatcctgggtataaatatgagttctgccacttactgtatgaccttagaaagttattttaattaatttgaagtcttggttttaatagctggctgctattgtcggttggttaaggctgacatattcccaaccctttaagttactggaaagatgtagctctccactgacacctgcaggatattgagaggatagccttt

SEQ ID NO: 61063 - DNA, 2154 bp, Homo sapiens
ctgagaagagtgggctgtctgttcaaggaagctgagatatataatcttagcaagctgagggaaagcagcatagccacagccctctttatatgctaagaactattctagaattggagacttacaaatcttaccttggtaactgggactcagtctgtgaaactcctgtacatccctccacagagcaatgaccctgacctccaggatttttgtctcagctgtagtattctgaggtttagagtggcctttacttaaaaacagcaacagttgttttttttttaagttaacacataatctttagtaaaatttgtcgaaaaatactaactttgattgtgtttggtcatttatcatgagtttagaaaattgtaaagttgtaattctctgtatttatatgaccaaaaggacttcttggcaaaatctttccacactaagttctcacaaataactgagtaaatagcaatcacagtgtcaatataataaccttcctactatgaatacaaattatattttcttaacattacctatttataattataactgatgcttttaggcaagtatgaataagacaatgtcaaggaagtgaaatataaatgagtcaaatgtggcaaagaaaagggataatcagaatgagaagctgagttgtgttctgctttaaaactgaaccttggctcttcaaagtaaccctcaagcctttatccaaaatatatcaggtaggggtcattaggaaacctaatagcatcttgtaagcactaataaaggttactgttctaaaagtcattttaaaacaaccataagctggcaaagactgacagaatgaactttttcagaactctggaatctaattgaaaacttacaacagcaaccaagagactgcttaatgaagaaaagggcagctgatttttggcatttaaggaaatctctgttaggtaactggctgaccagtgagatagtggaacagagacttcagtgaccacacccaacaaggaatactgcctttgcaaaaacagtttggaaaagtcactaaacaaatggatgactggagccctcaggaatcaacaacagcaaaccctgaggcagggagagaatatgattacccattgtaatgttcagatgcccagttttcaacagaaaggtataaggcatacacagaaagaggaaagtatggcccattcaaagggagaaaataaattggcaaaaaccttccccgggaagcccagacattggacttactactagacaactgtcttaaatatgctcaaagagccagcagaaatcaggaaaacgatggatgaacaaagtgagaatatcaataaattatataaaaaaagaaccaagtatacattttggagctacaaatgattttaggacatgctagagctagatataccaaaagttctttcatgctaaaactttggaaagacttactctccttaagttcagataaatgaaagacataaggagagagggcatttggagactctgtatgctggtatgagagttaataagcaggactgtaaagcatctgttagacaagacaccgcaggagttgggctcctgttgacttgccatttattggctgatttgtcttgggacaggcgctgaacatctcatccatagtttcctgctctgtgaaatagagcatctgttctacagacacattatgaagagccagtgagactgtacagaaatgctgaaaatgtgaggcatccactatgttcatcctccagaggaaccaacagcctaatgattaaagaaagagaatgtttactttactatgctaccaagttatcaatagaggcacagtgcttgagttaaagaactctgcagacttcagcagctgttcaggtggtcattatgcccagaggaggaattctagcccctctggaattccatcaccctatcatcaattagattttttttccccacagtctccatttcccacttactatctctttcatctcactcctcccaattaaatttattttgcatacttagagtaactttaaatgcttagtttttcaattatttctcctttcccaggaatttttatgatgttttttaatatcactagaagacaatctagaaacaccacaaatcccagattggatcagcttgggccttcctctgttgttttactggcattaatagaaagcagct

SEQ ID NO: 61064 - DNA, 1011 bp, Homo sapiens
atgaaatccatacatatgaatggtttggcttttggtaaaaaaaaaaaaaaaaaaaaaataccctgttcctcatccatgtgctatacttttgaaacagttataaggaaggaaaccagatagatggaaacttcatagtggaaggaggtggtgagaaggaagtagtaaactgttaagagcatttcagcattgctgtattgttttaatattctttggctttccaaattattgcagaatgttattttttaactgaagaagctcattcagttgttccattgattctgagaagaaaagatttgttattacaaataaaattgaaatttaactgaacaggatttaccatttccttacttaaattggagtgtctattttaattcatatttcagatttcaaaagaacaaggccttgaagttctaccagaacatgatccaatacgtgaccaaagttggtatgtgaacaaaaagctccgtcaaaggctgcttgaagaatatggagtcagaacctgtactcttattcagttccttggtgatgctattgttttgccagcgggagcacttcatcaggtatatacaaacttatttctaacatattttttactgactgaaagaactagttttgaaaaaaaaattgctcttagtatagatataaatggaagaagatgcaaataagagaattacctgcaccagtctgcctttattagaatgacatctcagtgcttgcagaaatctcacataatttccttaagattttaaattgttttaacatgagccagatttctatttgtatactgtctccgatttaatagatcgaaatctgatttttaagccctcctggtgacatgtatacctctgaatagtgaggcttaaaagcatggggggacacagtatacagactttttatcaggctttaagcatacctcctacctttcttcagcatgctagcatatcaggggcctgtctaaagaaagatggtatgtaatttatataactgttgatccacaaaacataaaaacta

SEQ ID NO: 61065 - DNA, 1185 bp, Homo sapiens
tgtatccacttatctattcttgtagtcctaaaagttatgaacatataactgtgtttgactcttttttaagagtactgatctggccagggacagtgtctcatgcctgtaatcctagcactttgggaggcccaagcaggtggattgcctgagctcaggagttcaagaccagcctgggcaacatggtgaaaccccacggctactaaaatacaaacaattagtcgggtgtgacagcttgcacctgtagtcccagctacttgagaggctgaggcaagagaattgcttgaacctgggaggcggaagctgcagtgagccaagatcatgccactgcactccagcctgggtgaccaaaaaagaaaaagtactgatcctagtcaggcactctgctgctctgatagatcaactttaggagacttggctttctggtattctttgccgacaatttgaaattatgttcctttgtttcaggaattctcaagaaatttgaggaagaagatttggatgacattttaaggaaaagattgaaggactcaagtgaaatacctggtgctctgtggcatatttatgctgggaaagatgttgacaagataagggaatttcttcaaaaggtataagttagtttgcaaataatatctcttcccctcaagcaaggacttattcattgttgccgtaccttcacttggcattcaacaatataagaccattacataatttttacttcaaagtagatgggagtttttgttgaaagtcaaaaccctgtttctcttgctcctctttgaaagtctgttaacattttgagggttttgaatggtgatttgttcccagttggtagtgtgcctccattccctgttaataaaagactgatctgttcttgagccagatattagttgggtggcgaaaagtagctatctggagtcgcgggatgtaaaaacaaatatttcatggaaacgtctaaagaaggtaggatctttattttctttgaatctgatagatatttttggctgctgacctagggaatgattctactctatcacatctgatactatgatacttactgagtagactcagattttgagtaatcataccttgactgtagttggcatatactctgaaagaaatttatatatcaacctgaaataattggttgaaaccctttgctcaggtactttttaaacttcgtaattatgg

SEQ ID NO: 61066 - DNA, 1038 bp, Homo sapiens
aagagattgagaccaccctggctgacatggtgaaaccccatctctactaaaaatagaaaaattagctgggtgtggtagcgtgtacctgtagtcccagctatcaggaggctgaggcaggagaattgcttgaacccgggaggtggaggttgcagtgagtcgagatcatgccactgcactccagcctggcaacagagcgagactccttctcaaaaaaagaattactgttcctacaaattgtctaatgatttttagtttctactaaatctgttcctttaatccatcgaaacccttttttatatgaagcaacatgttaggaattaacagccaatatatagttaagtacctgcttattgattttttatttatttgatttttaatcatagtacattttattatagaaatgtaattattcaaataatagggtcttttatagattgtggcttttggaacaggtttttgtaataaggaaactaaaactcaaattacaattaaattatgcagatcgagctaatttgggggaatatctgattatgctattacatatatataaatattttgtcaagtaaaattttgttttatatacaggtgtagttgctgctaaagatcatgatataggaacaacaaatctccatattgaagtttctgatgttgtaaatatactagtttatgttggcatagcaaaaggaaatggcattctctcaaaagcaggtaaacttaaaagaataagtagtctttgaaataagagttgaataatcacattcactagtattgtccagaatatcagcttctgagttaacagcgaagatttcaaaaagaattgcaatggatgtaggggcattttagcccttattacttgaagattgaataattttcctatttctttttatgtaagtgaaattttaattttaaaattgaatattttaacttcttttctatcattaagtattgtgttgatgaaaatacaccattaagcgcacttgtaaacatttattgaggctgggcgcagtggctcacacctgtaatctcagtactttggga

SEQ ID NO: 61067 - DNA, 1116 bp, Homo sapiens
acattttataataactgacagcaaggcagattagaagttgagttagaagagaataataccattggcaaggagtctaatcagaaagctttacaggcctggtgctgtggctcttgcctataatcccaacattttgggaggccaaggtgggacgattgatcgcttcagcccaggagttggagaccagcctgggcaacatagtgagaccctgtttctaccaaaaaattttaattagccagacgtggtggttcacaccagtagtcccagctacttgggaggctgaggcaggaagattgctttagcccagtaagtccaggctgtggtgagccatgatcatgccactgcacttcagcctgggcaacaaagtgaaaccctgtctccaaaaaaagtaaaaagatcatggtgatagcctaagatttctgctttgaattattctgatacactaattagcttaacccttatcttttttaaaaaatttacttttaacaagctgctgattaccctaatagcagcaatattattggatagatactaggcactaggaattaatctgtgaattgccagcaagagttaactaatacctggacctatttttaaagtcgtatatattattggctcattgaaaaaatgtttaatggaacattcaaccatgtagtaaaccagaatttagggtgttttttctttttaaagatgtcttttgtaattaaaaaaaaaatctagctagagattattcttttgtggttcctatattttaattatgttacaagtttaagaatactaataatcacttaaattttttgtttgtttgtttctggagacagggttttgctgtgtctcctaggcaagatacaaactcgggctcaagcaatcctcccagctcagccttgggagctgggactacaagaatgcattgctacacccagcctagtaaatatcatttttcagaaacttttaagtcatagcttactgtgttctctatattccagaattctgcttcattagagtacaggaatttgtttaaaacctgagaataatacatcagatgttcttagatatgtttttatatcatttattgtagttttagaagctgtaaatcttccattactggtttctgcgtta

SEQ ID NO: 61068 - DNA, 1497 bp, Homo sapiens
atcctagcactttgggaggctgaggtgggaggattgcttgagcccaggagtttgaaaccagcctgagcaacatagcaagaccctcatctctatttcttataaaatatttaaaaattttaaaaaatgtatatgagggatgccacctacttgtattctctgtcccaggcctataacaatgtaaaagacaggaaggctgtacttctaagtttttcagacctggcagttctcacacaaccagacttctggtttgcattttgtcaggaatataggaactcaaatctaagagaagtgcatattgtggagtgtagggatattgtttaaaaaaaaataagtctgtgggaggaaaatgtatttgatttctctcaaaaacaggttttttttgttttgttttttccttaatagagtagcaaaagtggacggactatgcctaacattcttgatgacataattgcttcagttgttgaaaacaaaattccaccaagtaaaacctccaagataaatgtaaaaccagagcttaaagaagagcctgaagaaagcataatatctgcagtggatgaaaataataaattatacagtgatataccacattcttggatctgtgagaagcatattttatggcttaaggattataagaatagcagtaattggaagcttttcaaagaatgttggaaacaaggacaggtgtgtattttaggctgataaagaacactcttggtggaactgaagcttattaaatagaatggttccctccttaggaatagaaatggaggggggaaaaatagtggttaacacatttgggggacaataagatataaaagtaccgaaaagattgtcagaatgcttgtttctcaattcctgttttttggccagatttaatatgaattaatagggaaacgttgattattttatgttactttttgatctatcagaacagacatgtaataacgccttgaatttacaaaatgcagttcctttctcctctttttagattggtattttagtccagttagtagatccatgtctactattaaaatattaatattggcagcatttttcatgaacctatgtagatgttcttatctgtaatatttatacacagaacatttacttacaaattagttcatcaaatcttgaatgacaaactatattgtttcattctcctctaatataaatgattttgttggacaaaagttttgataatgtttgatatacatttcagatggcaatttactacattaatgcaaaaattatgaacaaattaagtgtttgtatgacagtattctgttaaatttattgttttctggaaaatgtttactttgtttattcaacagttattgagcatctaataagagacgcagtctctgtcataggcagtaagaatatataaaaatgagtaagctatgtaaaaatgagtaagaaccattttagtgcaatgctgcttgatctttttaggttactaatccctttcaaaatctgatgaaagctgaatctttcacc

SEQ ID NO: 61069 - DNA, 1425 bp, Homo sapiens
tcaggtttgtgtttaggtgaataaatcacaatgcttccttcagtttttatctcacagtagaaaatgctggggccagttttgtctgtactttagcaccatgcttaatagaattaaaatttgtaagggctgcgcacaatggctcacgcctgtaatcccagcagtttgggaggccaaggtgggcagatcatttgaggtcaggagttcaagaccagcctgaccaacatgatgaaaccccgtctctactaaaaatacagaaaaattagctgggcctggtggcacatgcctgtagtcccagctacttgggaagctgagacaggagaaccacttgaacctgggaggcagaggttgcagtgagccgaggtcacgccactgcactccagcctgggcgacagaatgagactccgtctcaaaacaaaacaaaacaaaatctgtgaaattttctatttcagaaaacaaagaacttacccttgaaaaccaaattaaagaagaaagagaacaagacaactctgaatctccaaatggcagaacatcacctcttgtgtcccagaataatgaacaaggctcaaccttacgggatttgctgactacaacagctggaaagctacgtgtggggtctacagatgctggcattgcctttgccccagtatattcaatgggagccccagtgagtgatgccagatttttggttttaatgtgggccttaaatagagatgatttggagacttagtttttggctctgaactacccagtatgctgatgaaatcaagtgtaccaaattgctaggcatgtttctatttgcattataactctctttaccttgaaagctggcattttctgtctttttttccaaggtgaaaggtggagggggggtgctcttcgattccagaaggtccctaagatacccctttagaatttggaaactatttgtctagtgaagggaaaaacccacatggaagtgaatgttgtatgttacttaaaataattagaagtcaaattttgctttaattatttaccaggaaaaaagagcagtataatttcttttaaaactatatggggggccgggtgcggcggctcacacctgtaatcccagcactttcggagactgaggcggctggatcacgaggtcaggagttcaagaccagcctggccaagatggtgaaaccttgtctctactaaaaatacaaaagttagccaggtgtggtggcacgtgtctgtaatcccagctacttgggaggctgaggcagagaattgcttaaacccaggaggcggaggttgcaatgagccgagatcacgccactacactccagcctgggcgacagagcgagactccatctcaaaaaaaataaaagtatatgggggctgggtgtggtggcttacgcctgtaatcctagcactttgggaggctgacgtgggcagaccacctga

SEQ ID NO: 61070 - DNA, 1243 bp, Homo sapiens
ctaacacagtgaaaccccgtttctactaaaaatacaaaaaattagccgggcgtggtggcaggtgcctgtagtcccagctacttgggaggctgaggcaggagaatggcatgaacctggggggcggagcttgcagtgagcccagatggcgccactgcactccagcctgggtgacagagcaagactccgtctcaaaaaaaaacaaaaaaacaaaaaaaacataaatttggttgaataatcaaaactgtaatagatggaagagaatggagaaaaatggaagaaatttaaagggcacaagaaaacctccgttattcccaattataatacaaaatattgtaagaaaaaaattttacagcattaacaactagtggtaatctttttattaactaccattttattttgtagttttgacagatcttctagatgccatgcacactcttagggaaaaatatggtattaaatcccattgtcattgtactaacaaacagaatttacaagttggaaattttcctacaatgaatggtgtatctcaagtgagtaaaaatctctggttattcaaataaaatctgtggttaaattagtcaactttgatatttatttgaaatttggtttaggacttatgtatgaattaggtttgctgtgtttctgtgtaaattttttgtatctatactactaattgaattattgaagaaagtgtttaaaaatgtaattgttctacctttgtaggttttacagaatgttcttaatcacagtaataaaatttctctgtgcatgcctgagtctcagcagcaaaatactcctccgaagtctgagaaaaatggtggcagcagcccagagagtgatgtaggcacagataacaagttaactcctccagaatcccagtcaccactgcactggttagcagatcttgcagagcaaaaagccagagaggaaaaaaaaggtaaacataattgattatctaggcatgtgtgagaggagtatagtataactaaccaacaatgtactattgtacaataaagtactgttaatattgaggtaaacaatttactttggtctttttcttgaattatgggttaggttcaatgtaaaacattttgtcttcacttattaggaactagcctgttgtttttttgttgtttttgtttttgtttttttgagactatcacccaggctggagtgcagtggcacaatcgttgctcactgcagccttgacctctcaggcccaggcgatcctcccagttcagcc

SEQ ID NO: 61071 - DNA, 1016 bp, Homo sapiens
tttttttgagatggtgtcttgctctatcacccaggctggagtgcaatggcgcgatctcggcttgctgcaacctgcacctcctggagttcaagtgattctcctgcctcagcctcccaagtagctgggactacaggcatgtgtcaccacacctggctaaatttttatttttagtaaaaatggggtttcaccatgttggccaggctggtcttgaagtcctgacctcaagtgatccgctgccttggcctcccaaaatgctgggattacaggtgtgagccactgtgcctggtctagttctagatttttttatgctgaatttattgaactttgtgacactgaaactcttgtagccacgtcgtaagtagctgtctgtgtcactaaatttgtagagaaggttcttgagatcaaggtatcaaatgcttttattctttatgttatgccctatgctatgccttaattctttacaacttcagggatgaaaccttatttgaagtcagcaatagcagttaatagtaactgtatggtaccagctttttcacatgtctcatgtttctctacatgtctttgaagcataagaggaaaatgaattaacagtcatctcaaactgtgtcagtctgatgtactaggatcaggcataaattctgtttggcacagaaaacagctaagagatagaagattagctacaaagatagaggtcactaataataatgactggtaatttttagaaaggctatcattatatccattttgtgtcagtgtttttataaaatcaggaaatggtggaactgtttttcctgacttgtttcagaaccaaacatctaaagcatatcattgacattttatttcattatttttatttttttctttttctctttggctgtgactctagccaactatgaaacattttatataatcgttaagttctttacactatcaatttataattatgaaaccatgagtgtgatatacaagttttattatcttacagataaagaactatatgcttggatgaagtgtgt

SEQ ID NO: 61072 - DNA, 1044 bp, Homo sapiens
atcagattatgtatttcaatagaaatacgttgaaactaacctgtagtttctaactatataaacctttaatctttacgttcttgctgtggatcttgaaagagctttctcctatgtaaaccaacttttggtatagaaggactgtattttcagttattgatatacacagaatatgaatgattcttatgtttgctattatacatacatgaatgatatttaaagagttcagtcagctggaaaatttagttctgcattttcagtacactgacataagagtggttcatttggttaatagaattggttagtaagtaaatagaaacgctgctgcactttttagtcattaatcagtacctagagctcttaatgtctttgcttctttactaaagtcttaccgtatcatcacaattgtataactgacttgaatttcatctcaaggagtttaactttttacaaagcataatcttgctaaaactttcctactgattttacagctggcattcctcgttcagtattgaaagattggcgtaaagtcaagaagctgaagcaaactggggaatcctttttacaggatgactcctgctgtgagatagggcctaatttacaaaagtgtcgagaatgtagacttattcgcagtaaaaaaggagaagaaccagctcactcaccagtattttgtagattttactactttagacggtaagtgaaaatatgagattgggaaaaaagtaatttattgatttgatattggaaattatatagtgttattctgagtgtcccttttggatgggggagtaagtctttgagtctccatgttttggaaacattataaaagagttattaaatgttttcgtgctaaattttaacaatttctaactataagactaaatacatacattattactcatgttccatatgacctttctgttctgagagatttattcttaatgagaaaatgatttttttcttaacagttgttaacctatatactaacttaatatgaatattaccaaataatattttaaaattaaaaacttaaaggtagacttgcaa

SEQ ID NO: 61073 - DNA, 1050 bp, Homo sapiens
actaagtgtcttaatctcaaacttctaggttttatatattgccagtaaattatatatatatggaattgaaggatgaagttttatttattgtacaaatactatgacagttaaattcataaaaggagttagttgcagtcatgtgtggccttgtctagaagcaaaaattataatatcaaaagctctacgtatgaattgggccttaatgtctttgtactcatttattcttttattgaaaaaaagctctaaatgcctattttgtgtcacataattgagatttgctttgaaatgtctgattctttactatagtactatctgagttgttcacagtggtatggtgatccatactctgaactgttccattatctggaattaaaggcatataataaaaagaaatagactgtatttagtttattctagtgtaataaattgaaaagtaaatagatgattagaagcaagtgttccaaataaaaatttatcagcagtataacaattctatcattcattccaacttgtaaaagctctgaatattttacacagttcataggaaaaatctcttttgcacaatggaggaaataaacattttacataagtcttctggaaatgggtttataccataaccgggagatgtggtgtgtggttatacacatgggtgtttctctagtggattaagccaaatggctccttaccctaagttagagacagagaggggaaagcatgtaattgtaaagaacgaggcagcaattcagaagtgcttaataattggacctgatttcaaatgggtcactctatatggtttatttaaacacagtgctttgtaagtttctgcaagaagtacgtagtctcaggagaatagctgtacctctgatccacacattgggcatgattagaaaacacaagggtaggaaatacagttttattctttcagcatgacagaaatagcaaactatgtaaatctaatatctgacatatagatacattaatatgggtgcaataagacacttacaagttagagccaacaactaattgctgatcctaacatagcttgctttt

SEQ ID NO: 61074 - DNA, 3372 bp, Homo sapiens
tttctgatgaaatgtgttttaggaataatattctgtttttactgttagcaatatacttttgctgttagaatcaggaaatcatataaactaggttctgtatatggcatttatagtaaatttaaggcactgatttcaagatctgtttttagtaagatgacaataaattatttaatactgattatgatatggaaaaatctgtttaattatgttattatttgtctgaatatttctcataagatgtatttagaaaaagttacaagtttcccaaagaaactgctatttgaatgaactaataaaccaccaagatcatacccagttctactgtgacacggtgtttagctttttctagtaactgaaatctaggtgttttttttgttttgttttgttaatagaattctcccagtccttggctacatcagcccacccctgtgacctcagcagatggtattggattacttagtcacattcctgtcagaccttccagtgcagagcctcatcggcctcttaaaattacagcccattccagtccaccattgacaaaaactttagtagatcatcataaggagtaagttcaccagtgcttaaaaattataaataccttgttcataatttttcttaatttgccttttaaatagttaattttaagttaacacatatcttaagattaggctttgttctgttttgatatttcttcaaatttattatagtattagagtacatgcaaagatgtcttttactttcataatagaatgatattgcatagaagctgtctttgtattttgcaggaaaaagtggttacagaaatatttgtgtattttctttacagagaattagaaagaaaagcttttatggaaccattacggtctgttgcatccacatcagccaaaaatgacctggatctaaataggtcacagactggaaaagattgtcacttacataggcattttgtggatccagtattaaatcagttacagaggccaccccaggagactggagagaggttaaacaaatacaaagaggaacaccgtcgaattcttcaagaaagtattgatgttgctccctttacaactaaaatcaagggacttgagggtgagagagagaattattccagagtggcatcatcatcttccagtcctaaaagccatatcatcaaacaagatatggatgtagaacgctcagtatcagatctttataaaatgaagcactcagtgcctcagagtttaccccaaagtaactatttcactacattgtctaatagtgtggtcaatgaaccaccaagatcatacccatccaaagaagtttcaaatatttacggtgataaacagagtaatgcccttgcagcggcagcagctaatcctcaaactctgacttcatttataacatctctttcaaagcctccacctttgattaaacaccaaccagaaagtgaaggtttagtaggcaagataccagaacatcttccacatcagattgcatctcactcagtaacaaccttcagaaatgattgtaggagtcctacccatttgacagtttcttctacaaatacactccgcagtatgcctgcattacatagagcaccagtatttcacccaccaatccatcacagcctggaaagaaaggaaggcagctatagtagtctttcccctccaactttaactccggtgatgccagtaaatgctggtggtaaagttcaagaatcacagaagcctccaactctaatacccgaaccaaaagactcccaggcaaattttaagagttcttcagaacagagtttgacggagatgtggagacctaataataacctcagcaaagagaaaactgaatggcatgtggagaaaagcagcggaaagttacaggctgctatggcatctgtcattgtgcgtccatcttctagtacaaaaactgatagtatgccagcaatgcagttagcttctaaagatcgtgttagtgaaagatcttcagctggggcacataaaacagattgcctcaaactagcagaagccggagaaactggaagaatcattttgccaaatgtgaattcagacagtgttcacacaaaatctgaaaaaaactttcaggctgtctcacagggcagtgttcccagttcagtcatgtctgctgtaaatacgatgtgtaataccaaaacggatgtaatcacatctgctgccgatactaccagtgtttccagctggggtggttcagaagtaatttcctctttatcaaataccattttggcctctacatcatcagaatgtgtatcttcaaaaagtgtcagtcagccagtggctcaaaaacaagaatgcaaggtcagcaccacagcaccagttacattagccagtagtaagacaggaagtgttgttcaacccagttctgggttctcaggcacaactgattttatccatttaaaaaagcacaaggcagcattggctgcagctcagtataaaagtagtaatgccagtgagactgaacctaatgctataaaaaatcagacactttcagcctcccttcctctggatagcactgtaatctgtagtacaattaacaaagcaaactctgtaggaaatgggcaagcttcccagacaagtcaaccaaactaccatactaaactgaaaaaggcctggctcaccagacactcagaagaagataaaaatactaataaaatggaaaattcagggaattctgtatcagaaattattaagccatgttctgtcaacttaatagcctctacatctagtgatatacaaaatagtgtagatagtaagatcatagttgataaatatgtaaaagatgataaagtcaacaggagaaaagccaaaagaacttatgaatctggctctgaaagtggagactcagatgaaagtgaaagcaagtcagagcaaaggactaaaagacaacctaagccaacttacaaaaagaagcaaaatgatttgcaaaagagaaaaggtgaaatagaagaagatttgaaacccaatggagttctcagcaggagtgccaaagaaagaagtaaactgaagttgcaaagcaacagtaatagtaagtcagttactttgttttatctcaggtaaaatgggctgaatgttttagctatactagtgtgctgctttaaagatcagtgagcttaaaggcatcctttgtcttcatttgcgtgccttagctttatgtatatgctcattgatctcatttctacatttcacaagtaagtaccctttaagaggaaatgagagaacacttattcctctatttttaaaagacttgtagaaatatatatcttacctgacagtcattgtaggtaatttgcgtaatttaacgtggaatttagtagttactcgtaattttggccatttctaagaattgtcaaaatgcagttatggc

SEQ ID NO: 61075 - DNA, 1030 bp, Homo sapiens
ataaaaatacttcaaaaataaatggagaagaaggaaaaccccataataatgagaaggcaggagaagagaccctaaaaaatagccagcctccctgggatcaaatacaggaagataaaaaacatgaagaagcagagaagcggaagtctgttgacactcagcttcaagaagatatgattattcattcgtcagaacagtccacagtttctgatcataattctaatgatttacttcctcaggaatgcaatatggataaaacacataccatggaattgctaccaaaggagaagtttgtatccagaccacccacaccaaaatgtgttattgatattacaaatgacactaatttagaaaaggtggctcaggaaaactcaagtacctttggccttcagacacttcagaaaatggatcctaatgttagtgattcaaaacactctattgcaaatgcaaaattcttggaaacagcaaaaaaagattctgaccagagctgggtcagtgatgtagttaaagtggatctaacccaatcaagtgttacaaatgcttcttcaggaaatgatcacttgaacatggaaaaagagaagtatgtctcttacatttctcctttaagtgcagtttctgtcatggaagataagctgcataagcgaagtccacctccagagactataaaatctaaacttaatacttcagtagatactcacaagataaaatccagcccatcacctgaagttgttaaacccaaaataactcattctcctgattctgtaaagtctaaggccacttatgtgaacagccaagctactggtgaaagaagattggcaaataagatagaacatgagctatcaagatgcagttttcatccaattcctactcgaagcagtacattagaaactacaaagagtcctcttatcattgataaaaatgagcattttacagtttacagagatcctgcacttattgggtcagaaacaggagctaatcatatttcacctttcctaagccagcatccttttcctcttcactcctcatctcatag

SEQ ID NO: 61076 - DNA, 1103 bp, Homo sapiens
tggagattatctgatagagcgcctttatacacaattcaaatactttggttaaaatgtagttaaaatgctaagtaagtgttactgtttcattgcatttgattttttccctaaaacagtgacaaacttttacctctcagaaaagcacaaaactgccttgaattgttaaaatagttttaaccacatttttaaaattattcatttgcacaatttttgtctttttctactccctaaagtctacctctgagttttattttacaactgctttttgaaaattactttctatttaaaaataaaaagtaatttaagaattgttggcatctgtattcttgattaatacccttgtttttcaagatgtacttgcagtaaatatatttgctttttaattcttggttagcagttgaaatggtgagtttcagaaggttaaaaaggtaattttgtcttaagtgaataaaacaaattattataacagcatcttataaattagggatcccaagctgatttctaaacatttctactgagtaaagaaattataccaaatatttgattagctcattctatttaatttttgtttttgttttgtatcatggattaggtactagaaccacagaatgtcgatccttctatggttcaaatgacctttctagatgatgttgttcactctttgttaaaaggtgaaaatattggcattacatcacgacgcaggtctcgtgccaatcaaaacgtcaacgctgttcacgtatgtatgttattagggatgaatttctgtaaaatatttttccttaggctagtagaaaccaggtagtaaacaattactgttaattggttatttttagagccattatacacgtgcccaagcaaatagtcccagaccagcaatgaactcccaagctgctgtaccaaaacagaatacacaccagcaacagcaacaaagaagtatccgtccaaataagaggaagggctcagatagcagtataccagatgaagagaagatgaaggaggaaaaatatgattatatatcacgaggaggtaggacccacttttttttttaagggaatgaaaacaaataaaacaaaaatacattttaaaatatgcttatttagtat

SEQ ID NO: 61077 - DNA, 1052 bp, Homo sapiens
tcaacctctcactttcttgatttttgtaaaagggctaacaatacttaggagagagaattaaataagcacttgaaaattttgaaagcactttgtaaattattaaggtacagcagttttttcccttacagttctttgttaaagtatttgataccattttaatacctgtgaattaaagatcgttttcatctcagtatcctcttctgtagagtgacttgttttattaggcatatctgaatatctgcagataaatatgtttaatattttttattattttctaatggatatctatacaagaatatcctttgaaaaagtgagtttagcacaaaagtgtaccatatttcgttaaaaatttttagtgctatatgtatacattcacttagccaatctcttttttaagacttttagcaactttttctggctgtgatagcaaatcaaaatttatagttgtttatggtaaagttttggcaactagaagactcaaacaaacatcaagttgcaagttaatctttctgtttcaaccatgtagtcatctactgcaatcttactaagtagcttcataaccttactgcattctacactactataactttgcattttgaactgttctcttattaactcgtgatcctagaaaccttccttctctcttaaagtattttatttctattgaatcaggaagtatgtgggtctagtgcagtgtatatagtaacttcagaatgattcatttgaaaggatatttacttctaaaacatttttttgaaaactgatagttggatatattactattatacactagctcatgtttcttctaaaaggcagttattaaatgaagatgtctccatttaagatgtttctgtttcttgtgttttttttaaggtccttattccttaaatggatacagagtgagagtatatagacaagactctgccacccagtggtttactggcataattactcatcatgatctcttcacccgcaccatgatcgttatgaatgatcaggtaaatagttccactaatatttttatagagattttaaaagttcaaatcatccat

SEQ ID NO: 61078 - DNA, 1527 bp, Homo sapiens
tatttgtttttggttattcaattgtgtgcaatataaatagaaggcccagtccaatattttgagttatatacatccaggaaaataatagcagagtgataataattttgatagaaagttgataatttcacaagtgtattaactttatttgaactgaatgcctgtcatgaaattacagctacacaggtgttttgttgacagaaaactgcatattatggaattctttaggtgtgtctttcctggagaaggaagcattgtttgcagtagagggttgcccacagccacaattgatttcctttgaagaatgttcttcgtatctggtaaaagtggcctatttcagtgcacctttttcagaaattactagtcttttgtttcctttgtttagtatgttacaacgtgtgaccttcaaaccagtggggtttgacgatttttagcaatttccatttctgtcagtaaaatcatgtattgtaaatacaagctttttggaaattgaatggaaagtgagacaatatggcatgaactgttgttgaatgtctttgtgaatggaattttgttgttaaattcccatatctatctcaaccgtcaacttccatgccattaagtgtcaagagagaatcccaaagctgtttgctttatatgggtatgtacagtagtggatcatctacatatttaattcttcctaggctaaatattctttaaacttttctgtggagaatttcaaacacatacaaaaacagaatatttcagtgaactttcattcacctctctcccagccccaacaactatcaaatcttggctgatcctgtgctatccatacccccttctatcaaatttcagacatcaccctattctatccatttttttgaacaaaacaatgctggaacattattctgaaaaaagtaattgtttttaaatttaaaatactaggtatttcaagttttcatttgtcttataaacgtcgaagattttaacaggtttgatttattttttaaaaatcaagggattcagaaaaggtccacacattgtgattatttggtacatccccattgttgctctttttttccctttccttgcaatttatttgttgaagaaaccaggcaaatttttaaaaaataatattttgtttctgcattgtatccttagaggagaaaagattaaggggcagtatagtccctattcattctatgcagaattgtgtgaggctgactctaagctatgttaagtagtgggaacaaaccagtgtaaactgtttgttaatgggaattgaaaactgatcatatttggagttactctataagcatgtcctatattatttagaaaaaataatatggagtcttattcttcaatagttagaaaagactgaagttcatataatggatatggctactaaacagtgtttacgcatcacctcccttaaattatagccagtcaacatcttcacttttctctagatgaaagtatttaatttacaggtcatatggaatactttctacagttcattgatttatatatatatatttaaagctggca

SEQ ID NO: 61079 - DNA, 1368 bp, Homo sapiens
gcatcagtctttttcatcttaaatgtttctttttctcattataaaagcaaaacatggtcattgcaaaataaaaaacttccagaaaaatacataaaagcatagcaaagtagattattcataactcagctaaagaaattactggtaatatctgttatatatcctggtggtggtgtgtgtgtgtgtgtgtgtgtgtgtgcacgcgcgtgtgtggatatatatatatatataatatgtatatatggagatacatatatatataaaatctttctagttggaaaagtaaaaggaatgtttttatggttctgtttgtgatcatttgagccaagataaaatatttttaaggctgtatcccattgcttaagtagatttcatttgggggatattttaattccaggacataaattctgacgaatataatgaaaacaattatattaaaatacccttgtatttgtcattaattctgttttgtttgcctggtgtgttttaatgtgattataatttgagatttgtttttttgggtgttgttagacatgaagtttaaaatttttttttaagtctaattttatcagtgctaatgttacagacagtgcttttctaagagttaaaatgactatactcttttatccttagggaaatatgcttaagaagtaaatcaggttattaatatgctgtgaagagtttgaaaacagtggtgctcagttgagcatattttagactatgcaggttaattggacacatttttaactataaaggattaactaaaattgtggcaaccttttcagccttgagattccattaaattgtagtgtgtttgcttgtttgtttttgtattgataatttttgtgaaagccttcaggtcagagtcacttttctagatcagaatgtcaaaattaactgagagagaataacttaaaatattcagtggaattagacagcattgtagttttctttttcactttaaatgaagtttgcagtaacatttgagttcccaagaattgtggtttgctaaaaatttgaacagaggaaaaatttaaaagtaaacagaaaatgaactttgaaattaatttaatggtgaatttatatataccaaataatgaaaatgacacaggaatgttatttcatgtaatcatattttaatttgaaaaatcatgagtccatagaaacatcatagaactttgtacataaaatgttaaaatcttgagactttaaaattcagaacccttttaccatttcataatttctcatgacatatacttctcttaaactttatcatttcctccttagtaattaatgatataagtagttgcaagcaatgccaaatggatgttccaaggagagatccctgaaatatctggatatataacagtg

SEQ ID NO: 61080 - DNA, 1051 bp, Homo sapiens
tgctcaccttggtctcccaaagtgctaggattacaggcatgagccactgtgcctggccgcctttttttctttttgtgtaatttaacacatttcttatgtacaggttgagtatccctaatccaaaaatctaaaatctgaaaaaccccagaatctgaaacactcaaaggaagtgctcattggagcattttggatttcagattttctaattatgtgtgctcaactactaagcgtaatgcaaatgttacagaatttttaaaaatctgaaatctgaaacacttctgactccaagcattttggatacaacctgtatttgtaattgctctacaaagacctcagtgaaggaagtggatggactcaaataggtgtcataaaagactaagtcactgggcaagtctagcaagtcttgctgatcattccaatttgtactggattgtattcgttctttctgagaaaatagaagtatggtactatagttcatttatagattcatcatttccatagcactatatgctaaaagtgaaaatcagcccaaaaaacttcgatgtggtattaatttggaagttacattcattgcactgtatattaaaaaaaaatttttagtgagtgtttggcgaggcacagtggctcacgcctgtaatcccagctctttgggaggccaaggcgggcagatcaccggaggtcaggagtttgaggccagcctgggcaacatggtgaaaccctgtctctactaaaaatacagaaattagctgggcatggtggcaggcacctgtaatcccagctactcgggaggctgaggcaggagaatcacttgaacctgggaagcggaggttgcagtgggccgagattgcgccattgcactccagcctgggggacaagagcaagatgtcttaaaaaaacaaaacaaaacaaaacaaaaacagtgtttgttctgtatgaatcaatcattgacacgatgtatatgtatactatttcaatattagttgtttttaaatatatatttagagacagggtctctctgtttcccaggctggtcttgaacacctggcctcaa

SEQ ID NO: 61081 - DNA, 1050 bp, Homo sapiens
cattcatttattgctgtgtgccagtcactttgctctaaatgtgaactcaaagacagataaaatacttgattctctttcaggtcataaatattacagcaacatgccagaagttctgaaatagagctgtatgcatagtattttgtagtatagaatcagctgatgggggaatatcttatggttgcctgtttctttttctttacttctcagaagactagggttctgtagtagtgtttctcagtagagtgctgtattagggttctcctcatacagtaccagtatgggatgtggcaagtggggttgtatatatgtttgtgtatagaaattgagaaagaggagatttttattgattggctcttggaattgtggggactaacaagtccaaattccacatggtagaccagcaggctagtagttcaggcaagacttgctgctgcagtctttgagtctgaaaggcagtatgaaggcagaatccatttttccttgagagaccttagtcttttttcttaaggccttcaactgattggattaaacctatccatgtgttaggggtaatctgctttactcagagtctgctggtttaaatggtaatcacatctaaaaatacttccagagcaacatctggaatgatgtttgaccagaccactaggcaacatttcctagtcaagttgacacttaaaattaacagtcatggctgttattcatatttgattcttagttttgtcatgcatttgtagcatagtaggaatctgtacctctgacttagcaaataaaatgcctttggcaagttctctcattcattaatggatatccctgagccatttcccatcccctttcagcctttatttagagccattgggataggtatagattaagacaattgggaaagtgagagcctttatttattttctttgagacggagtcttgctctgtcaccccaggctggagtgcagtggcacgatcttgtctcaactgcagcctccacctcctgggttcaaacaattcttctgcttcagcctcccgagtagttgggattacaggcacactccacca

SEQ ID NO: 61082 - DNA, 1125 bp, Homo sapiens
gcctgtacaatttcacctagattttgcgtacactggcatcaagctacactccaaatctgtgcattattttcagattcatttgttccctcggcaggtaatccatattaagatgttttctagtctcttttttttcagctgtctagttttgttttgctgttttttgtttgtttgtttgtttgtttttttggttgtgcatatgggtattctgaatacctagatttgctcaaagctaaaattcaaaaataaaatactttaaaatgaagcccttgtcagtctcttgccaaaacagttgtctctaaaattcaagtctttctaggcttcagactaaaaacaaaacagtactggtccttagtcattaaataatctggattgagagtcattaattcatatatttaagggccaggtttgttatgttcagaactacaaataccttcaaagaacctagaatttaatgggggaaacacacatagaaaaacaaatataagcaaaatgtagtaagtagcagagaccagggaggaataaggaattcattctggtcgtagggatgcggaggtattgttagaattagagtaggtgacccctgagttacatcaggatgaatagaaattagctaagccactaggacatcacggttggttaaataccaccgcgcctggtgcagtattacaccatatttttaaaaaatgaggccgggcgcggtggctcacgcctgtaatcccagcacttggggaggctgaagtgggcggatcacctgagttcaggagttcaaaaccagcctagccaacatggtgaaaccccatctctactaaaaatacaaaaaaattagctggacatggtggcgggcgcctgtattcccagctactcgggagtctgaggcaggagaatcgtttgagcccgggaggcagaggttgcagtgagccgagatcgtgcctgtgcactacagcctgggcgacagagcaagacttcgtctcaaaaaaaaaaaaaaggtgtaatataaaggtccagtttcattgttttgcatgtgaatatccagtttccccagcaccactttttgaaaagttgtcctttccacattgagtgctcttcccacccttgaaatcagttgaccatttgtgtaacagttta

SEQ ID NO: 61083 - DNA, 1009 bp, Homo sapiens
caaaagtgacagcttgcaatagtagagctaagctgaagcctcgatagtaggatggacaacaagaaaagaggaaccagcagctaaagcagagtcaatatacttccttgttttttaaaaattatttttaatataaagttgccatatcatgttttaatattcagtaattttgctctgtattctatttaaatattctattacctacctatatgattttatatagctataatttcaaaaatagtaatgaaacatgcttattaaggtcccataaattaccccagtacatatctgttgctatttaaaaaaggagctcttcatttgtaaaaattggttgcgaaacttgatgtgttgaaaatgtatccttggagtttaggaacatgttattttgactgaaatttggcccaagtatgagctattctgcaatattcagattaaaaacatttataagtcactgcagtagttctttcctggtcccaaatctgctgtgatcatatgctgaaaaatctgccagtctccttttaaattttcatagctgctgctatgaatttaaagtatgtgaaattatgcttgtagactctaagccatcactagttaccattgagaaagattttctggtttcttttttccaatcaaaataagatcataggattgatttattctttttcttaattgcataatcttactgaagcatgtcatattatttaaaatctcagaattagagttttattcctcagtataatagtaatattttactagaattagaatttaattttgggaatttgatcattcccaaaatattttcatgtgcattattttatttccaatgttagctttatgaggaaaatagattgtattctcttattttgtgtaatgctttcaggatatatattaatttattaatccacacaactgtttgagaagtctaacttacagatgagaaggaagcaaaaatagaaacgatgtaaagtagattaagttttaaaagggtgtgagtattgtgatgatatagcag

SEQ ID NO: 61084 - DNA, 1053 bp, Homo sapiens
tacatctcaaaaaaaaatagttttttttttgttgttactataatctctgtggtattgttgctttactttggagtatgattatagaagttcaaaaaaactttccattaaattttgataacagttttgatcacattcacataaaaattttgataatgaaatgaaatatttagcttttagcatgattttgaaatcattttatcatggattttggctactggccgtgcacacacctacagttttcaggttggggttgcttcatagagaatgtggaagagattatttcttacctgaaagttgtacatgattcataccaactaacctggcttggtctggcttgttagtccagtatttttaggcatcacattcctctttgcttttaaatgtaataaagaaataaaacaaaggtcactagttaaaaccgttagagatttgatacggaatgtggttgtccaaaattataccgcatgtttatcttacagtatattaaaattcattgtagtaatgaggtgttttccctaaaataaggtagaatcataaatcctagacctgaaggaatgattccattagaagttctggatcccagctactctggaggctgaggcaagagaatcacttgaacccaggaggtggaggttgcagtgagccgagatcacaccattgcactccagcctgggcaataagagtgaaactctgtctcaaaaaaaaagttctgtatcataatgagctgataaagtttggagataagactgttaatactacagttctatcattgtagagtatggacattgaactacagtactttactaaatactaaatacagtactgttgtgctgtgaattgctggttgaagggaatgggtagaacaaacctgagtattttcttagtacctggactaaagattgcttaaagacttaaccagagaagactcacacattgtctagtaaatgaatgtgtctggactgtgccagattgtttatctatttctgtagtctttcaatgatagtttttccagtttgaatccattttaacccatatttctttcatcattgatca

SEQ ID NO: 61085 - DNA, 3326 bp, Homo sapiens
actagatactcttccagaacaaaatagaaatttcagcaaatacttactgacctttaaagccttgttgtggatttctgagatttaaagatactttaaaattctcaagaacaaagtacggtttgtatttttctgcttcctttttcttttgtcttaatttacatttggtttttcttctcagcctgagaaattaaggtcactgccttttataaaagatctggcctcaatgtttttagttttaagaatttttaactttcatttgtttaaaaaggtttattgtgtttgtagtaatttaataactgtaaatgttaaaaaacgagtttaattgtttaaagtattatggcagaagtgcttcaaattaggattttcagactagtgtttcaaggaaagtgggggtatttgttttgtaaggtttttttttggttattcccttccccacccccaacttgttttctaacagtatcgtgtttttcaatagacctgcttgggtgggaatttggactttgttctttcaagtcactccagtcctttttttttttttttttggtagactaaatcttaacttctaaaatgttgcttaggttgttttctgctttagtatttacctttggtgagatttatattagtatttttgcagttaataagcctgtttttttttttaacttggaattgttaactgttaaccggagattgttagaaactaagactgcagacataagctccttgaatttcctgttaaatgtgaaatggtgagctttaacatcgtttgtttgagcagctgagttgtgtttaagagctgtagctgatttattttaaaaatgtttttcggggagggctcatctgttcgcgtcttcctcatgtgaatggaatgtggtgcagcatggagccccaaacaggatacagttgttctaagcattcttcctatagtttggtaggccctactagaaatgcaggctctcaactatatttattttggccgtagactatttttaaaaagtatgtttaacactgataaatgaccttaaaaaaaactctcactctaataaaattgaaaaagcattttgtttcaactgaacatttagtgttagtaattttcattttggttttcaaaggctttttagagcatttgaatgatagtcttttgtgattagggccatattctactgtgactttcatcagatgttagctcattgcttccctttaggctgtggaagttactcatagaatgatatatctttagagtgttgaattagttatgcatgagttctagtttctttacattccagtgcacctagacccatgaactatttactacaaatttcatcataccagctgtaggacccatttgtttttatttaaatatgttttttattatttttaaacttataatgttcctttgaaatgtactagactaatacaaaaattagcaatacttaacatggttgttttgccagttaaaaaaaccggggtgtattttaatatcacttcatatgttgtttgcctttcatttttccttaaagtagagcagtcacacatattcactgtttctcatttaataaatattgaaacatttcttttaacaaatactataaaagtatttatcagcactttttatttgctatttaagaagcatgatatactttggacttccacttgtaaatgattataagtactcatgtccttgtaagagtattcaaatttgatcattgtcagctagttttcttagatttctggtagccaaattttacttggctttcaatgagacatcttaaaacgtgagaatttttttagcttagaaatccttttttcaaattaacttagaataatttaaatcattggtcggcttgttgaaatttacccttagaactctggcctaccttgaaaaggagagctctcttcagaagaatgtttttcatattataaaatgactaggtctcataggaaatgcaagccacctgtattatttgcgtaagaaagaggcactccagaaggagaactttacttctttttcaaatcctacttaattgaattgtatctttagccacttagataataccttttgtggacctttttgttaaccttcatgagttgacctgatatggtactgtttgaaaagaaatagatcatttgataatgttcaaggattaaaagtcctcttgagaagatgccagtgttttctagtttacttaaaaactaaactgacagagatataatatgaaaaaacattttttacagtagggatcagccgaatatccctgtttatgttacatatttcatgtcaattggtcacgtagtggtggacacttttaaagcctaaatacaataaatgctcttgaatttcttacaaactttttgtcacttaagtaaaataataaataggattttatgaaatcctataggattttatgtaattgaaaagtgttaaatgataacagtagaaggaaatagctaaataatgtgaggattttctattttgaaaatgtgatttctcacccaaataatagtaattttgataaataatagagtgcttaaaaggttagcctaggatatgggagagaggatattactgtgactagattttctgatcttaaatatcgaaaataagtgagaatataagagagtttttcctgttttttaattaagaaaatattatttgtaacttcatgatgtagatagcatagaaataagacttgcttaaatttaatattaaatttttaactttgaaacattgttacagattgcagtgagtcaacctgaaattcctcttaggaatttcttaaatatagaaattaactccttaaaagccactccaaaccaaacatcttgaagtttttccctggagtatgtttattgttattaacaaaatgttatatattttttaagacagaataagagaaaggggaaacacaatgattttgaaatgcctggtaatttgtactgtctatgccaaaatctttgttttgtgtggaaatattaacacaaattaccctgtagctagaaagatttctccatgtgatataggtaacttagaaattgagttgattattaattctgttttccgaacttttttccagttaaaaaatttttttatagtaaagcagctgtgtttttaaaatggtggaattttgttttcattttcaagtttttagaacagtaccatgaatataagacacttgtattttatttaatcttcatctactttgaaagtgagtgtgatagtcataaagaaatttatacattgtatccctgtttccttcctcttcctaccctggctctgtccctgtcatccccacccaagatacgagttaaatctcatatgttaaaggtat

SEQ ID NO: 61086 - DNA, 1010 bp, Homo sapiens
tgattagtaactaccatattggacaacatcagacagcagaactctagaatttagatagatgttaagagactatattatataacacatctgagaaatgcattttatgctttcaaattgtatcttagaactatctaggttaagttgttttttgtaatgagtgaaaatggttgaggaatattttcaaatctaccaaaataaatattaccagtttttttttagtaaaatgcctatgagattgttgagatcattgtctaaaaatattttaaattgatttattttgaagtttttaatatttttaaggcaaaatggttatactaataaataaatcgtgcccaaaaacatacaaagtatatttgatgctttatttttaccaacttgagagatagtcacatgttatttcttttctgcactttctcaccttggtaaatctggaaagcaaaaacttagtatttgcatttgctttatgaaggagacagtaaacttgagctttcagtctcgccactagtctgtctttgtctgttgttaaaattatgagccagtctctatggccgcagccaaatgagtaatcactagtaatgtgactcgtgctggaagtgactccatcagcacctgtgacgggggattagttacagtttacagagcaccgcctcttcccttctctcagtgtgccctaagccaagtactcgttctcatttgggtgtctgcactgttggaagctactgcactgtgtttccacgcagacagagtacagtgggaaaggctttctccagctgatggatggctgttctctttatttggagtatcttactggttatgtaagcgacctcgagagaaattatcctgacccagatcggaggatgcagtagtgcttcagctgcaggatttcttagtcgttaacaccacagtgctgatgacaaagagcgagttgtaatcctcatcactgccagggctgagccagagcagacagaaaatcgtcatttgctcgttggagacttgttaggttacagctc

SEQ ID NO: 61087 - DNA, 1301 bp, Homo sapiens
accagaccaattaataccagaccagtcacattaatatatttatattagccagatatggtggcacttacttgtagtcccagctgctcaggagactgaggcaggaggatggcttgagcccaggagtttgaggctgcagtgagctgatagctccactgcactctggcctggacaacagagtgagacccaatctctaaatatatgtatgtcaagcccattttaaatatttaaaaggcattcattattaccaactagttgtaactctgcatcctttgcatcaagaattgattctatagtatttttagtagtggagaagccagtcttattttaattcaaccatgatgtagtgtgaaatactttttaaaaatgaatgtttggtttttcagtattgttaattacattaattttactaaaaattagtacatttgtgttactaagaatgtatgacttttgaggcaattgtatggtttagctaagtgtactttgtgctatatgattctgtaagggactgaagtacttgagaagcaaaaatagctgtttttaagtctatatcatatagtgtagacaaacttgagtttatgcaagattatgagataaatcctgtgaaattttctaatgtacaataaattggggaaatgtactaaagtacttaaaatttgatagtttgttatattaagctgtattaagcatttgctttttttggtttggtaacatgacattgtgagttcttttatttacatagattctttttattttatgtctgattaattatgaatgaattattagggtggttatatgcgatttaatatccacttgacaacattattaaaaacacttcgttctaaagttaccttggctgggagcagtggctcatgcctgtaatcccagcaactttgggaggccgaggcgggtggatcacctgaggtcaggagtttgagaccagcctggtcagcatggtgaaaccctgtctctactaaaaacacaaaattagctgggcgtggtggcgtgcacctgtaatcccagctacttgggaggctgaggcaggagaattgcttgaacccaggaggcagaggttgcagtgagccgagattgtgccattgcactccagcctgggcaaaaaagagcaaaactccatctcaaaaaaataaagttaccttctggatcatgcatgttctacacaatatgttctgtaaaataaagccatactttactcacagtcttaggctaatcattgcccatctctttttcattctttttataagtgcaagttcatcatatactaaattgaaaatatcttttcggta

SEQ ID NO: 61088 - DNA, 1117 bp, Homo sapiens
cttcagaatgaatgacagtaataaacataatgaagcataacaaagctcaatctaattcaccactgtaaaagaaggataaaggaaactccaggtcaggtgtgggtggctcactcctgtaatcccagcactttggtaagatgaggtggatggttcacttgaggtcaggagttctagaccagcctgctcaacatggtgaaaccccatatctactaaaaatacaaaaaattagccaggcgtgttggtgcgcgcctgtatccctgttactcaggaggctgaggcaagagaatagcttgaacctaggaggcagaggttgcagtgagccaagattgcgccactgcactccaacctgagtgacagagcgagactccgtcccccctcccaaaaaacaaaaaaaaaaagaagaaaagaaaacagaaaattctctttttcctagcaaagtacacagacattttaagttgactcttgacaaacctagttcatgaacaattgcttctctatgtagcattttgcttttcttattgtcagagtagaaaaatgcatatttccatgactactttaaatggtttttttttgttttttacactgaattatgtaactttttaagtatacccacatttttccaaggccaagtagaatacagcacaaagttaaaacaaaatattgtttaacctaaatgtgacaggaagcaggaagaatgattctgagaattcctgaaatgaagaagaatggttctattaaaaagctcagaaaggccaggtgcagtggctcacgcctgtaatcccagcccttcgggaggccgaggtgggtgcatcacttgaggtcaggagtcaagaccagcctgaccaacatggtgaaaccccatctctactgaaaataaaaaaaattagctgggtgtggtggcgggcgcctgtaatcccagctacttgggaggctgaggcaggagaatcgttcaaacttgggaagcggaggtcacagtgagccaagatcatgccattgcactccagcctgggtaacagggcaagacttggtctcaaaaaaaaaaaaaaaaaggctcagaaagcaggtggtcaggttgctaatacagggaagctttcagatccccaaagaaaaggcaatt

SEQ ID NO: 61089 - DNA, 1038 bp, Homo sapiens
tcatgtaagttacttaatagattgttaaattttatttactttttaataaagtaaaatacttgtgaaagcacatttatcggcaccagggaaagaaagtgttggcattcataattgaaatcaacgaatcacctacctaactgggttagggccctggctccatctcctttaggaaaaccttctgtggggagtggggcttcgaccctaacccaggtgggctgtaacactgctgtgttttctaaggggcagagttttctactacttttccgctggcccagccttccagatcaccccaaccagtgctcctatataaccatcctgtgctcctatagaactttgttttgtacctctgttttaacaatcagcacattctgctttgtattatacctatttgtttgcatgtctgtcttcccttaatagattgtaagttctttgaggacaggagtcatgtcttagtcatctatgtatggttccttggagtctagcacagtgctttacccatctcagaaagtaaattcttattttaaagtgatgaatgtgctgcaacccagctagtgaaaaagaaccctactgggagttatcacaagttttctgactattaacatatgataatatcaaaggacaggaaagcagaatcacccaattgtggtaaaactgtgagttaccaattttaaacatgtcaatatataataaaaaatactaaaaagcttataatgccaattctcatcaggtacaaatttgattcctgaaatcaccaaggggaaaaatgtaaaattacctgaaatgcgttattttaaagatgttaaaggaagaaacagaagtcctcacaattgacttaaatattcaaatctttgataatttacttgaatttctgaattgagttttaggaaactcagactactttttctcaatgtagcttttccttcatagataggcaattctggttcaaccaggaattgtgatgacatcataaacacgtaaactcttagcaatttatttattttaaaatattctcttagagtgctttttacttactatctg

SEQ ID NO: 61090 - DNA, 1170 bp, Homo sapiens
gttgcaataaacactgatgtgcagctgtctcttcaatataccttcctttcttttggacatttacccagcagtgggattaccagatcctatgatagatctacttatagtgttttgaggaacctccatactgttttccatactggaggtactaatttacattcccaccaacagtgtactagagttcccctttctgcttcctacaattagatagaaggagtaagtgctagtgttcgatagcacagtatggtaaccatagttagcaataatttattgtatttttcaaaatagctagaagaggatttgaaatgtttctaacacaaatgataaatatttgaggtgatggatattctaattaccctgatttgatcattacacattgtgtgcatgtatcacgatatcatatgtaccccataaatatgtacaattattatgcattagtaaaaaaagatataccactcttctattttgctaattgaattttgtgtttttgttttcataggtgtatgtggaatttgatgatcttgaatgggataaacgagagtgggttaaagtttatgaagatttttcaactttcttggtggaataccacttaatctgggccaaaaggaatgaccctagccagactcagggatcaaagagcaaacagattcagtggcctgcattggtaagatctattcctgtttcattaagcattttcatttgttcgtttaaaacaaagaacaacaacaacaaaacaaaggccaggtttggtgactgacacctgtaaaactagcactttgagaggctgaagcaggacaattgcttgaagccaggagttggagatcagcctgggcaaaaaagcgagaccccatctctaccaaaaaaaaaaaaaaaaaatagctggatgtggtggcacatacctgtggtcccagctacttgggaggctgaggtgggaggatcacgtgagcccaagaatccaagtcaatgtgagttactgtcacactgctgcactccagcttgagtaacagagtgagaccccatctcttaacaaaaaaaaaaagaataaatgaaaatttaagactaagaattaaatagaagtttagattcatcttactgatttataaattaatatttttgaagagtctctgatgaatctggcagagattttaaaacactgccttcattttgtta

SEQ ID NO: 61091 - DNA, 2187 bp, Homo sapiens
aggcttataaaaaggggcatattttaaatctttatcatcactttatagccataatatacatactaaaagtttggtagcaatttgagtatttaactacatagggtggtactttgaaggaaaaagcattttaagttgagctttaatttaatttctgcttttaaaaacccaatatagtagtacgtcatctatgtatgtacattgagcatgcttcttaacatatttaacttccaattctttgataaccggttgcattcaattacttgtttaaataattgggcaagtttcctgagttgtaggctgtgaaatattttcaagatggtttgggtaaaaaattttttcaaagtaggtgccgtcagtgactttgatcacagagaaatcagtatgatcctgtgacaagtttagttttaacaatgtaacttcttgtgtaaactcagtcacctagtaatgtgaattagttgcaaagtgattctgtattcttagtgacccactgttagatgttttcagactagtaaatgataaatatttattgttaaaatcatccttaaaattttatttgaacatgcagcactttttgcagtgtgaaattgaaaaatcaattgtttagtttttaccaaaggaaaattagagttttgtatacatatttgatgaatacagtaaacaggttaaaatttagcaaatagaattttgtaagcatttttaaaatgtgtgaattctgtgataagggggtggctttgctacaatttattacaaagctaagttatatttcattacttatgtaaaatagtgttctttgtttagcttcttaaagtggtaggagaattgtataattccattgattggttccatgcagtggaaatctgacctttagcagatgtttgagaaattgccagcacagcatgatcagccaaaaagacagttttccccttgttacttgacaggcctttcatgctttagtaacatgccaaagaaatgtttaaattatttttttataatatcacatgctctctaaaatattaagaatacattgaaaaacatgcataaaatgagatagatttttcctgcaattacggattgcaattcagctgacttttaaatgtttattattaaaaaaaaaaaactaagataaatgctgattgttttgtgaattatgtgttactttgagatttaaaatgtcttcggctatgtagttaattgttattagggtttgatgtgtgttattttttccatgatcatgttttccatgatcatgtataacaatttaaacactgttataagtttctcttattttagtgttatttaatcgcaagtatcgtctttggttggcttttttattttttaatagaggctttttgataggggttaaatgcatcacagagaagttatcctatctggaacttctcgctaagggcaggatactgcatgaatccactttaaagcctcttctctgaaggacagtatttctttagagaatgaaatgggttcagctgtgtagttgtgggggttcagctgtgtagttgtgggagttcagcaaaaacactgtaagctctgttttcttcaacttcatggattgagcgtacaggaaggggaaggagttgccttaatgtttaagaatgaagtgatgaattgatagtatcagcagttgccagactgtatctttttctgcaggtgcttattttctgtagggcattgcagttgtttttcattgtgttaggttatgagacgattttaaggaaaatttaaggaacatgatcttacatagtttcattttacagttttgtaactgttttgtatgtcttaggtttatatactgaattagttcttccagaggattatgattgaaagttttggctgtgtgtacctatcaccttacaaaaataaaaagatttttttaaaggtcatgttcagtatcagtagttctaagaatatgctaaattaaaatttaaaaatcaaacacctataataaagttttgctgaatccacatgaattgaactaatggtttgtaataccagttatattacaagtgagaactagtttcatattttgatatataaaagctttgaaggaagcataattgataactgtttattaatatcacataatagttaatctttcatattggtactttctgataaggttttattagatggagaagggttatataatttagtaaactggcagcttttaaa

SEQ ID NO: 61092 - DNA, 1054 bp, Homo sapiens
cattgaggagatatgaatattatcatcatggtttgtgaatgacgtaattgaattatgagttattcctgatgttacagttaagccattgctgctattttttaaattctcagtatctaaataaataaataactcccttaggccgggcgcggtggcacaagcctgtaatcccagcactttgggaggccaaggcgagcggatcacctgaggttaggagttcgagaccagcctgaccaacatgaagaaacaccatctctactaaaaatacagaattagccgggcatggtagcgctttcctgtaatcccagctactcgggaggctgaggcaggagaatcgcttgaactggggtcgggaggcagaggttgtggtgagcccagatcgcggcattgcactccagcctgggcaacaagagcaaaactctgtctcaaaaaaaaaaaatgataataataaaataaataaatcccttgtttgagatccatgtatataggaaaacagattatttttattttgtgtttataacctatggtaggttgacagtgaagagaagaactcaggacagttaatgaaagcatcaccttttctttactgagatctcctgtgtaaggaaatcattcagttagtcttagaattgtcatgaaagattaagaaatgttcatagcattgtgatcatcatcttaggtattcagtcggtgaatttctgtttttaggtgtaatctaaaagttctgtaaaataaacatcaacaatgttgtatgcttcttatggctgttctaggtctctgtgtttttattatgaacttgtatctgatcttttcaagtttttgtctcatggtattttttcctcaatgccaattaacagtggttaaacaaaatagataaggttttccttctaagtccagaagtagacattccagagttgatgtgatcatttaaggatgccagggctgttgaagactgggctgttgttctcttggtcttttcctcatggtcagttacaatatagctgatactgttgttgtcttccttagttcagctccaggcaggaaggaggaggaagca

SEQ ID NO: 61093 - DNA, 1031 bp, Homo sapiens
ctcaaaataaataaataaataaataaatagaaatgtcctagaattttttgaaatttatctttaattctttgagatgcatcactttttattttgaaaaaatcctagtaaaaccaataaaataaaactctgtaatatgcatatatgaaatcagaaaactcctcagtcacttactgttatgaattgactctcagtaaatgttttgaatgtataaatatcaagtattgattatgtatgtggtcagtgttgtaggctaacatagcatttaagaagtaaacccgttctcaagaaatttctacttctagtggagagagttgatgaatattcagcggttgattcatactactgtatacagttgtatatttagaaacatgtttgttatttgttcccagttcctggcacagagcttctgatacccttggactctcccgagtgataggggtgatagaagtgtcatttcttctatgaggcaacccttggtggacttctagataacttcagggtatggtctggtcaccaaaaagaccagaccttgaatagaagcttggaacactctcatctccatgacctaacctctggggagtggggagtgactggagatagagtaaattaccagtggcatatgtaaccaaacctctataaaaggtttgcatatgtaaccagacctctataaaaacctgtcaaaaggctgggagcagtggctcacgcctgtaatcccagtactttgggaggccaagttgggtgggtgcctttgagctcaggagtttgagaccagcctgggcaacatagcaaaaccctgtttctacaaccattacaaaaattagcggggtgcggtggctcacacctgtagtcccagctactcgggaggctgaggctggagaatcacttgactcaggaagaagaggttgcagtgagccaagatgctgccactgcatcccagcgtgggtgacagagtcagaccctgtgtcaaaagaagaaaaagcaaaacaaaacaaaaaaaacaaaaccctgtaaatgatgggatttggagagct

SEQ ID NO: 61094 - DNA, 1363 bp, Homo sapiens
tcatcctggactcctttctctcacatcccatatccaaactgtcaagaaagtcttgttggttctatctataaaacatattcagatcccaggcggggcgtggtggctcaacgcctgtaatctcagcactcggggaggccaaggcgggtacattgcttgagtctaggagttcaagaccagcctgggcaacatggcaaaactctgtctactaaaaatacaaaaaattagctaggcgtggtggcacgcacctgtagacccagctacttgggaggctgaggtgggagaatcgcctgagcctgggaggttgaggctgcagtgagcccagatcacaccactgcactccagcctaggtaaccagagtgagactctgtctggaaaaaaaaaaaaaaaaaaaaaaaaaaaaattcagatcccagcacatgtcattttttctattagcattatactagttcaaacctacattatcttttgcctagattttcctcttaagagtctgttgagtctatttctagtagtcacttaactagttacttgtaactagatatctaactgcctcctaactagttcttacccataaaagtctatagtgcctatagcaaacagtcagattatgttacttttatggtcagatgcctccaaaggcttctaaactgattaagaataaaagatgaaggccttataatgggctgagagactctacatgatatcctgctttccagtcattccacatcgacattatcttctattaccctcttacttggcctttttgctgttccttgaacatgtcaggtctggtctccccttatggcctttgcacttgtttctctgtctagaattttttccccaaagatacccacatgactccatcacttctttctggtaagtatgttcaaatgttaacatgcttgctcattttggtcttctttgaagactaccttatctaaaattgacctcttccctcctctgtcaacattttctatcatctatcaccaaatatcactctacttgctttgtctcttatttcttttttaaaataaaaatcatttaaagactggctcttgttctgtcacccaggttggagtacgatggcgtggtcatagcttactgcaatctcaaattcctgggctcaggtgatccacccaagtagctgggactacagatgtgtaccaccacacccagctaattttttttaattgtttttttgtagagactgggtatcactatgttgcccaggctggtcttgaactcctggcctcaagcgatcctttcacctcagcttcccaaagtgatgggattacaggtgggagccactgcatctggcccttgtctcttatttctgtcatactaaacattgtacttctttttc

SEQ ID NO: 61095 - DNA, 1121 bp, Homo sapiens
cttccttataattttggtttctaacctattagcagtggttgtgtttctccacttcaaattgcccagcttgagtgttctagagaaaacagataaaagccttatagttattttaaacattcagattactactgtaaactctgttaactttttttttttaaatagaggttcaggaaaatctcaagaaactgaaatttagaatattggactacctataaaaaagcagtataaagggtgcctgaaatcgaactgctcactgacatttgtagggaggtttgatttataacaaataagttgatcaaagaagagtgattgttccaagttagagatctttgtgtgggttagggagtccgattgtaattggatgggaaataaatattttttttcttgaattgtgattggctaaaatccttttctttccatggtattttctaataactgaatctggggattttctctgcttttattatctgaccagtgtgtttgagctgtgtaccagtactaaaagtactaagactgtcgcagacacggtttgtgaaatttcaggacgttgacaagggcccgccacggagcatttgctgttcttataataaagcagtgacgaatttaaatctgtgaatagcttaaacatgtaattagtatcaccacaaatgagaagaatgaaaggatcacattttccccctcgttttcccttgaagtcatgaacggttggttctgctgtgactttggggcttagttttcagtagaagtgttgtcctgctctgctgctgttactgcgggactgctaattcaggctaactcaggcggcgggcgctgtgtgctctgaacatcaaaccgcgggtgaggcgtcaacccaggagtttattttgtgatcagagtggaaccactacacttcactttcccctcacctccacctctgagggagcaacgaatacaaaggtagacccccaaaagctttgaatagctgtcgcctactttcccgcggccctcttcattttttcgtctcccgctgccgccgccgccgccgcctctggatctggacggacccagtggccgctgccgcctccgcagggccgggcactactttccgtctgcggtggttccgccgaccctcccgcggctgc

SEQ ID NO: 61096 - DNA, 1341 bp, Homo sapiens
tctgctaaggtgttagcgtggagggttgaattagtcttgcttggagttgatgagaatttgccttttattgctctgattaccttcagtgcattatcaactttatatatataattatttatatatatataataaataaatatatgtatatatttgtttatttttagacaaaatctcattctgtcgcccaggctggagtgcggtggtgcaatctcggctcactgcaacctcttcctcccaggctcaaggaattctcctgcctcagcctctcgagtagctgggattacaggcacctgccaccatgcctggctaattttttgtatttttagtagatacagggtttcaccatgttggccaggctggtctcaaattcctgaccttaaatgatccacccacttcagcctcccaaagtgctgggattacaggtgtgagccactgctaccagcccattatcaactttaaatctattatcacctagtacttaagatggggattgatttgctgcaaagttttgaccaatgtttttacttcatgtttacctgttagccttatctgcgcacctgaacttcagagagggtctctctctgttcttttgctacttctctagtagtcgaatgctcttacttaggtgttacttggagctagtttgtgttgttgtggtgggcatggggccttggatgctgtttagctttgtggtggtaggaattgagctttctcttttgttctagaccagtattagtcttaggcaggctctgttttcctctattcttgataatcctccttctccccagtagtaggagacctctattgttttggtcttaggttactttcttgtctgtccttcagaagtacatacagtatcatctaattttgcaggaatttattaggaagtgttttcacatcctgtattaaaaggaatatatttggaagccatttttgacaagtacccgaactttttaaggtagcgctaactattttcatggaattagatcttccttactaagtaaaacatagttttcagtggtgataatgtagaccaaattgaaggctatttctattccctctaggaagtatgtattcagatggattatttttttaaaagcataaaacaaaattgtaaaatggggagtatccttagctgtccagggttcataaatgcagtcctaatcgaactgagcatttgagagagacataatgactctacatatgttgcaagtaataatgatgtaattatttattataactgtaaaggaaaggataattatgtttagaatcatgaacatctgcaaattttcatgatttatctttacattttatactcgcttaaccatcactatatgatga

SEQ ID NO: 61097 - DNA, 1295 bp, Homo sapiens
tggcatgggcctgtagtcccagctgcttccggggctgaggcgggaggatcccttgagcccaggaggtcgagggtgcagagagccgagatcacgctttactccagcctgggtgacaaagtctcgaaagagagagagagaaagaagaaagaaaaagttataatttactctatatgttgtttaaaggaaaagtttctctgtaaggaaaaggaatttctgctaggttgcattccccccgctctgcccctcttagtttagaatgaattctgttttgtgctgacaaatagctgtttctgaagttggcaagaaaatttcctcttgggactccactagaagtgttgtagtagctatctgattcaactgcttagaaagctctctgaaagttgccttgtttgtctggaaagagtgaggagcccaaacctgctttttccctggaggggggttgtagctataagctgttatgggaagaactaggagggattgtgtcataacagtatgaaattgagcaataccaaggcataattaaaatttcatactccaaagcaaattttcagacacaataaagaagggctcttaaagataggcttgggtagtattttatactcttatccaccttcttaggagatagaaaggaaagaggaggaagattttccttttcttcattttctttttatttaaaacagtccacaagtaagctgactgccttatgcgagtcattatgcaagaaaggaagggggatcaagagttactggtgcagattccatcttactataaaataaaattgtgggtctttatgtaatatcttattgaatactaattgttttatattaaaatattacatgtaaatattaagataccccatgaaattattttgaatcagatcaagtggcaaggagaaaagagtcagtagttaagaataactgggggagggggtgatgaaaaagaaaagttataatagtaaaatgagatgaggaaggtaatagaaaagttggaagcagagaagttaagtaaaataactatttctgttttctccatctgccatcttcattctttgccaacttttaggccaccttgaagagattaccttgattatcttgcccacacactaaattgtgtgaccacagggcaagatacaacaattcgtcatctcagttttcttatttctaaggttagtaaactagtacttagcacatagagttgttgcatggattaaatgagctatctatagattgctcattagcgtgcttcgtgcatggtaggtgctcagtaaatgttaactgttatttttgtcatcacta

SEQ ID NO: 61098 - DNA, 1033 bp, Homo sapiens
cctgcctcagcttcccaagtagctgggattacaggcatgtgccaccttgcccggctaacttttgtatttttagtagagatggggtttctccgtgttggtcaggctggtctcgatctcctgacctcaggtgatccgcccgcctcggccttccaaagtgctgggattataggcatgagccaccaggcccaactttccaaactttgaaaagtattctgagtcaggctacatagaaatcatataccctacttcctgccagctacgggaagaaaagactccatggtttctctctctctttgtttttatttttttccttctttttaaaaaatgtgatcagagatctggattggaaagaaaacattcttagagttatttgagagctttgttattttcccagttcctttctaactttatatgagtttattccctccatttgtaaagtggctactcatctgctctgtgaaaatggctaatccctaaattaatttatgttcaaaaagagaacatttatgcttctgttttaggtgctgttgaatttattatctaataatatgtactttcaaaaattaggaattagccgggtgtggtggctcacgcctgtaattaacagatttaaaattttattataaaaatatgaattaggctgggggtggtggctcacgcctgtaatcccagcactttgggaggccaagtcaggcggttcacctgaggtcaggagtttgagactagcctagacaacatggtgaaaccctgtctctattaaaaatacaaaaattagcagggcgtggtggctgacgcctataatcgcagctactcatgaggcggaggcaggagtcatgaggcagaggcaggagaatcgcttgaaccaaggaggtggaggtttcagtgagcctagatcatgccactgcactccagcctgggcaacaagagtgaaactccatctcaaaaaaaaaaaaaaaaaaaaaaaaaaaaagaaataacagttttgttcccatctacttaaaaatagcctgtgattcttacatatatgttgatt

SEQ ID NO: 61099 - DNA, 3249 bp, Homo sapiens
tgcctaggcctcccaaagtgctggggttataggcgtgagccactgtgcccagctgaggaagcttttttaaatggagataagaccttgctgtgtcactcatgctggagtacagtggtatgatcatagctcacctcaaactcctgggctcagttgatcctgtctcagcctcccgagtagctgggactgcaggcttgtgccaccaagctcggctaacattttatttttattttttgtagagacagggtcttgttttgttgcctggggtggtgttgaactcctggcctcaagtgtgctgggattatagatgtgagccacctctgtgtctggccccctatttctattattgacctgtttcaatctgcatagcaagcagagtggcctttttagtgcacaaatgagagaacctcttaaaactccctccagtggctttccttgcacttggattaaatttcatgtttgcccacaaagccttgtgtgagctggtccctgcttgcctttccaaattcatcttattatcattatcctcctggcccactaagcttcagtcctattggcctttcttctgtttctgtaaacatgtcagcctcctttttccttagggtcgttgattctgctgttccctgcttcagaatgagcaactgtctcacctgcattggcttcttaatgctattcagattccgtggtgactccttcatttattacccaatctcacctaaccacctaatcactcctgggtcatcctgttgcagttctctgcattgtacttaaccactggctgctgttgttgttttctgtttcctcctccaattagaatgtgagctctgttagagcaggaatgttgtctgccctgttttattgtagtagtctcagtacctatatatctcctatataacatcctctaggaatttgggtggttatctatagccagaaaagtacagaaacaagtaatgactttatacattaggtttattatactttttgtccatagggcacccataacattttatgtagtatacctcaaccaaaatcagccataacagaatgatcagtttaagggtgtcatggcagagtgtggcttgtagcagctcaagtggaatgagcaaggaagcagaatagggaaaactgcccatgaaacacaagcatgtggaccctggtggttggagatactgcttaatctatcaaaatgatccacatcccagaggaggctaggatggagactcaatgatcatactctaagcagtcaccaggagattttaggagttgaaggggcagaactacgaaagttgtcaaaggcaaattaatcaacaagtatccaggagaatctgaaagtaatgggaagaaaccagataaatgggaagaaaaattgctctggattcacagcaaagaataatgttgagtcaactttagctttttcagctcgtgctggtgagagccaatctcagtttattaggcttgcccgtaggaataaaaagcagctggtcggttgtgagtgtggtattcagagggagggagtaagggacaggagtaagggtggggcaggcacattactggtatagaaacctttagcagaaactcacatgttagatccatcatagatcatgcaggtcttttagtccattgtctcccaaacttttcatagaaaggatctcttaaattgttttttccactattaatttcacactacgaaaatgtttttgctcagaacgcttaattattaataatttgtctcccagtttttagcaaaagattctaattagggcaacatattagtatctatactgaattgacctaagttgaactaaaagcccccccaaaaacccctaaaaaacctacaattttagttagggaatttcacatttaaatgattgtttcatttagattttggaagtattaaaaatggcctgtggcctttaggttgagagcttttggaacttggtcattaaaggcctaagcatatttctcaggccctttgtctttaaatatatctttgtgtgtcacttaagggctaagcttttttacatggatcatttagctttaagactcagtttccccatctgcaaaatgggtataataatagtatctacttccaggagttattttgaagatcatttgaagcacttggcatattgggtgatacatagtatgtgctcagtaattgttacccattattctgtttttattgctgttatctacagctgtgcagctcatgtttctcggaatagtcttgtagattttggattcaaagtttgatctttttatccgtaagaattgattccaagttagagtgagaccctgtatcaaaaaaataaaataaaaataattgattccctttcttttagctccaagaaatacagagttgaacaaagaatatattatattggcagttgtgggtggaaggagagttgaagagctggcagctggcaggtttttttttttttttttttttttgagacaaagtctcgctctgtcacccaggctggagtgcagtggcgcaacttggctcactgcaagctccgcctcgcgggttcacaccatgctcctgcctcagcctcccgagtagctgggactgtagatgcccgccaccatgcccggctaatttttgtatgtttattagagacgggggtttcactatgttggtcaggctggtcttgaactcctgacctcttgatccacctgcctcggcctcccaaagtgctgggattacaggcatgagccacggtgcctggccgccggcaggtttttaaagctaacattttatacaaaaaacagcttttctagtttcagtgagcacaaacaagctttaacttcagtggtaagtgggttactgatgtgcagctgctggtgatgttttaggggtaaccttacttgggagaaaggagatagaagtgaaatctgcaaactggcaaaatttgtaaaactgattctgaccttaattgtctctcatgcattccattttcttgcaacatgtttcacaataggaatcaatatagaaatgaatgtacataaataagtatatttccttggtagccatttggcatattatttcaacacaggaaggaaaatatttcccttataaattatcagtcttatttactacctttagaaaaatgataaatttggccgtattttaaataccaaaatgaagtctttaccctgtccctgcctcctttcttctcgccttctttttctttcttaggaccattatcagtttgttcataggtgatgattttgctggagaattaataaagc

SEQ ID NO: 61100 - DNA, 1025 bp, Homo sapiens
tggtgcaagttcagaactggggcttgttcaagaagcatagtttaaaaccagaaggaattaaaaaggaattctatttgtcttcaaagagtgtattaaagggaacttaattcataaccacattaatattttttacaagttccttttctcttttccttgcttcctgctgcccaggaacttctcactggtcaaactctaaagctttcttcctaaatcccaaccaacaaggtttcttctcatcaacatttccttctttattcctttattatattgatcaacttagttccagcaaatcttcctttttaggaagggcagaatgagtagaggaggaagactgagtacactcacatgttaataaattttggcatgtcacactaagaaagtgtttttggtctcactgattattaaagaaatccagataaaaattttcttacctgccaaattagcagctattaaatagaaggatactgctgtattgttgagaatgtgtggataccagtaagttcttattggagagaagaaagactaaattttggcagggggagaaattgtacacgtttgccttctcatggatgtcaggcttcgattctgaatcccacctgtaagactttatctcaggcctgtttcaggttatgtgtgtgttgatggggggtgggtactgtggggggaggagggctatctagtatgtgtttaaaagctctatttgcatccctgtttgttttacattctcaaaagtgactctacactatttatcttgaaattgtttgtacagcctatgctcaaatcttctgtgatgcttcttgaacaaacattctcagttcctaccccagaccaactaaatcagaatctctgggtaggacccagtaatttttttaaaagcccaccataattaaatatataattagctatatggttaaataatcagagccattataacagactctaaagttgtgaacttctgctctgctatgaagcttccaatcccattcagctgaaaccctgaaaatacttgtccatctctaaaatct

SEQ ID NO: 61101 - DNA, 1037 bp, Homo sapiens
aagcattggtttctcttttaaatattagttttcctaggagatatgtggaatgtgcatcttctgcatgttaaaagagttcatttattagcagagcaacagagactaagaaagtacctaggagagcaggtagtgagagcagaattagagggtacaaagataatgtctgatcgctgtaattattaatgagaatgctaatgagactgaatactaggtcaccttcgcatttctattaagagagcattttcagtggctaaaaaatatatttatttggagaaaggctaaaattactaaatgagtctgtctttcatagttgtttagaaaatagggggagagagaggatcttaagaagactgacataacagaagaaagctgttctttttctgtctgctgctagatggatacctcttttctctcaggcagtcgcttatggaattatggttacaacagaggttcagtttggcttcagagattgaatgataatgaaatgatactgaaaatacaatgatcagatagcaatagaataaaaagattaggttctgattaagtattcactataggtattggtagaaaaagatggtgactagctgacaacacaaaaagtaaaatacatctgtgatggctggatctgggaagcacacacagtaagaaattgacattatctgagattcttacacatttccagtagtagccttaactataacaattaaggatttagacagaagcttttgtttttccttcatggtaaaatatggttttgtgtttgaccatgttaagtggcagagaaacatctagtttaagataattgaggtacttttactatttatttaaaatagaatagattaaatcagggttttaagctcaagatagacttatgatttcaggtattcaggtgcatatggggttgtggtataatttgccaaatctgaaatatttgataatgacatcatgtctagtaagcagaatttcaacagatttctgttgatgtcttgagtgataattcaaagcacgtggaataaatttaaaagggaacagtgaaa

SEQ ID NO: 61102 - DNA, 2984 bp, Homo sapiens
tctccattatttccctgaggcctgccagatgttcaaagtaaaggctgggtctaggattcctgacctgtcttaagatttacaactatattacagctgtaagatttacaactgtattttttggaggttgggttactgcttacaccttgctgttcttgcaaatatcatttcaagggcagacttttaaaactgttttttttttttttttgtgacagtaccaaattgagaaaatgatgttaaagtttagatatttttattttttccagttaagacgatagtaaaagataattctagtattcagatggtgcgaagaataaaagatgaaatgtaggcttggagcctttaattaaagtcctagaaaatatgatggcttttgtgaccatactgtaattttgtcttcttgttcctcagtttccctgtgataaaaagggggtaataatactgtagtctgtctcttgcctttcaagggtgatatgaggcactgctaaataatatgtttaggaaatactctgacttgcatggaagacaatcaaaggacacaacagattatcctaaattattttcagttctcagtcaataaattgggtaatatttcattatttaagaaacaagctcagaagctactttctactcttgggttaggttcttttcgcttattaattcatgtcaagactttttatttcaggaatttgagtaataatttgcatttaactctgaatcttttatttttggccattattcagcattatttgaggatcaggtgtgctgcataagcaccagttttttggcgaactctcttgttcaataaaactcaaatgaatttgaatatcattcagatcccttcatgaaaggtcctgaaatagctttacagcctttacttttactactttcacccccaactcctaatgtacccgttccctacctctcttctttcagccaacctgtattttcatgctcagtgcttttgcccagatttcgtttttcccttaacactttgctccccattctgtacctatcagaactctcatttttcagtggcctgtgccatgaagacatccttggttttcctcagggacaattattcctaattttgtctgtgctctcataatttattacttgaatttctatttcttatctgtgtcattctgcctctaccatgtctaatgtactgaatggtaaaatgtttgagaacagacatggtgtattagatttctttgtgttttccaactatctagcctcagatagggtaaacgtccaataaaaatttgaataatgtttgtgaaatacagtcactctttaggcatcagatttaaaaaatttcagccacgtacattggaagtctcttaaaaatgtctttcttgcctttttactttggaggtcatcattgtgaatattaattatttcagctaatcctagtacattaatgccttcaggggttgctgaaggcaacctaggtaggatggctggctgctctctgaaatgtccctagactgctgtgcgttaagtttcattttgtatgcttattatatcttctgcctcttccacatttagattactttttgctgctttctttctatttacctggaacagtgccttttttcacatctcaataggccatgggttggaaaccacctactatgtgctatacacgtgtcattgagtcattctgacaacttaaaaagccatatagcgtttattcccttttggtaccatggaaagtgaggtttagagaagttaactcaactggcgggtgatcacataggtcattggtaacagaactggagatctaattcatgcttcccaagcttgtttacattatactgggatagatagcggaactgtgtttaaggcggtgggtccagcttggtgttgccctccaaggggaaactggaaggcattttttagattgttgtaatgattggagctaacaacttgcatttgttgagtgaaggctagagaggtgtgggacagtcctgaacaaagtgtccccatgtcttgcatgatttaagaatatctgcctgactttcatgtagtatttgtaattatcaaagcctggaacctccatcttgcatcatgattttaactgagactgaattttaactgagtctgtttccacatgcaacggttatgtgaattgaaggaagattgttttgttcacaacttgaccaagaattgtttacagttttggaaaattgtatcacaaacagctctgcattcatagatatattcagctactagttacttctttaagtcttctagtgtagttttgccccacgtcgaaatatatgttattataaatcattttcatgtctcttttccactcttatttagggtatatggatttgtttgaaattgtaggaatattgttattttgtttcagggtggtaaagcagaagttggaaaatattttatgcaaggggcacattgaatctgatgtggttgagaactgttgatctaaagtaagagtaacttcatctgagaagagtctctcatgaaaagtgcccagattttagtggagggtgtttataatttctgtgtattggactgtgtctcagatacacagaaatctgccaaatttattagcagatagttgagatttgctaagaaataagtggccattatgctgggtgcggtggctcatgcctgtaatcccagcactttgggaggccgacaagggcagatcacttgaggccaagagttcgaggccatcctggccaatgtggcaagacctcatctctactaaaaatacaaaaattagctgggcatgatggtgcacacctgtaatcccagctacttggcaggctgaggcaggagaatcacctgaacctgggaggcggaggttgcactgagctgagattgcaccactgcactccagcttgggtgacagagtgagactctgtctcaaaaaaaaaaaaaaaaaaaaaaaagtggccattagataagtacttcactgtataagataaggtgctaggggcactgggagaaaa

SEQ ID NO: 61103 - DNA, 1069 bp, Homo sapiens
gtgagccgtgatcgtgccactgcactccagcctgggccacagagtgagactgtgcctcagaaaaaaaacaaaaaagaatggacagaatctaggcagccaaagatgaaaaaggaaaggattccagatatagggaccggcgtgagccaaagcccagaggaggaaaagcccagattagttacagtgggcgtgagggactcgggtggggaaaaagcaagctggaaaggtagcctggggcctgttttcaagaaagaaggggtaaatgttataaggcagcaacagctttgctttggaagattctctgcccttctgtgaaatgattggcaatggagacctggaagacaaggagactccttaggaggctccctaactggagagaggggattaaagcctctctccagttaaagtacttgagctacagaatgtaaggtttgaggctaacgacagggagcaataatgtgaggaagaaaatgtcatgaaaagaaatgtatttctcaagtgtcaggaactgttattttgtgagccgtgaacacattagcacattagaaagcacacttgtagagaatataaacatcattctatttttcctctttactcagtttctctctctaaacatgaaagagcaatcacaggatctacacaaacttggaaacctttttcacaccaggaggtagaatttacttgattctttctaacccactgagacaaccacctcctcctgagcaagatcagacccttctctcaacatgaacctctggtagcatgggcagggaacctccataaccaaagcaccctgtatgtagaagcactttgtcccaagatcctgcactttaacaccagagaaattagccctggacaccactcttttttttttcttttttgagacagagtctctctctgtcgcccacgctggagtgcggtggtgtgatctcaactcactgcaacctccacctcccaattcaagcaattctcatgtctcatgactcaacctcccaagtagctgggactataggtgcacgccaccacacccggctaatttttttgtatttttagtagagacagggtttcacca

SEQ ID NO: 61104 - DNA, 1048 bp, Homo sapiens
aaatcctatttagtatcttctgtttgatcaggccagtattattttcttagccattcatctatttgtatttaattttacatttagataatttttaatatttcattattataagtaatgctgaaatgcaattataatgctataatggacattatatatacttcttttgaagtacatacttctttgggataaaaatacaagaggaatatttctgagtcaaacactgaatatttttatgatcattgatatgaattgccagattgctttccaaaagaatattaatattttacatgctagcagcaatgtgtgagtactttctttatcacaatgtagccagaatcggaagttttaattttttaatactttaccaataaatataacatatctcattgttttcttttgtattttatttatcagcacagttgaatgcttgtccagatttttattaattatatatattatgcatacagtatgtatatactttgcccatttatctcttggttacttgataatttacttgttttgtctgagctttttacataataaaggaattaaccttatgtgatatttcatgcaaatgtgtttctcaatctaatttcagttttcttttagatattttattcttggttgcatagagagtttatagttttaatatagttcgccttctttgttttttattttgtgatttcttgatcatttctaaatgtaaaattagatactacagatatttgataagtactactttcctatgtagaagtggattaatttggagacttccttttcaattctatatatcgatatttcccttttttacaatgataatacatttttgttttaccttagtttaattgtctggcagtactcttaaaacccgcaattatttttctctgattctcttcatttatattgggtgctataatggatgtcttcaaaggctaaattatacaccttaaaaaccatacttcagcagctttcccccttcttttcagcttcatctcttttttcttctctactagatctttctcgacagcataccaacatgctattactt

SEQ ID NO: 61105 - DNA, 1051 bp, Homo sapiens
actagctatgtaccatcaaagaaatttggcatatgcatcaaaagacatttgcaaggatatttataggaaaatccttaaagcaaaagtctatgaaaaataatagtttacgtggacagaagaattggtaagtaaacattggtttatgtacaaaatggaatattatacaacaggaactactacttagaagcctcaacttggatgaccgttaggaaagttatagtgtttgtgttttgttttttttaaagcaagccagatatgattacctatggtatgatagcattttaaaggccctaccataggcaaaactgaacaatgtatagtttagtaatgtatacatacacacatatatatatttagcaagtctatttttcagaaaagacaataatgataaattataggataggggttagctctgagagtctgggagaggagagggatctggaacaatgatatttgatattctgcttcttaagttggatgccggattcactgggctcattttactgtgtgtgcttcataacttagaagtgtgtgtcatatattcttttcctttaatcaatgattacattaaaaacatgtttaacacttgcagtgagtcaggaccaagatatctacagtaactaaaggggcgagcttagagaagcagggagcaggtagcaacggaaaggagaggctgatcctgtcccagcccatatgcttcttcctggtgtagaggccagtttcagtgctgagccaggccacagatggaggcagggaaggggctgcacctgtcatgatgagtatgtgaacagaaggccagaacctctatgaaatcgccaggcaggctgtctcttgtcctttctttttctcaaagctggtatgaatccaaagaagaatgtccaatttcttatttacccaagggatttttgaggttctggaggtacatacatagatagccacttaaaagctttcttccccccccgacccccattgatttcttgtctattcagataacagttgttttcttgtctattcatttgatacatgggatattgctataaaaagaaaatgt

SEQ ID NO: 61106 - DNA, 1044 bp, Homo sapiens
aaagatggctattcgcaattatgattgtatgccaattggatatccatcacttgcagaatcatagtcacctatctcagaccaaacacaaaaaataaattccagttggatcacagataaaaataaaacagtaaagcttctcaaagataatatagaaaacttcttcgtgactttttttttttttgagacagagtttcactctttcacccaggctggagtgcagtggtgcaatctcagctcactacaacctccgcctctcagtttcaagcaattctcctgcctcagcctcccaagtagctgggattacaggcgcccgccaccatgcccagctaatttttgtatttttagtagaggcggggtttcaccatgttggccaggctgatctcaaactcctgacctcgtgatctgcctgcctcagcctcccaaagtgctgggattacaggcgtgagccaccatgcctggccaattcttcacgactttaagataaccaaaaacaaccttaaacatgatacagaaaagcattaatcatgaaagaaaaggctgataatgacaaatgggaaaacactaaaattaagcacttctcttcatcaaagacaccattgagagtgaaaaaagaagccaaaatgggagaaaatcacatgtaaatgcaaaaaatggctcatattcaaaatatacaaagaaaaatggacaagatacttcacaccaaaaaaggggtggggtgcatgcaagtagccaagaaacataggaaaaggtgctctcacttcttttcctggagtggtggcaacattatgtaatgctggaccacatttctatcctctttttatatctttggggaaaaaactagagattcctgggcctttatttgtaccatcacacctttaggattgcataggaatcaagattgttcaaatttagcctaaaatgtgaatggttgtacatttaaagagaataaaaatgtattcttgaagatgagattactattttaagaaaagctcttctaccatttgcatcagataatattgggcacactcacactcatgcataacc

SEQ ID NO: 61107 - DNA, 1040 bp, Homo sapiens
tagtttaccagctttgattctgctgggttagggagaatacagtccagtcttaacatttatcccaaaacccagtttctttgtggtatttggttatgacctaaatttcactgctatctacttcaaaattattttcagaaagcaaacattttcggttaatttacttcttcccacccccaactactaccattccccttaagcctgcaaatggtagattgcacctgataaaacagatgctgtgctcaaatcaaaacaaatggaaagtactgtgtattttggcaaccttcctttcttcctttgcctatttttaaaacagagctttcctaggatataatttcctgcatagtgtggctgatatggcctacttaaagactttcagtcttgcagtaattgaaatgtaaacttactgaagaattagtatggttttgcaaattttttcaggctcattccatctcatgacttgaaaatagagtgtttacttccaagtcgtgtgtaattgctgtagcttttctaggaaaccagtgttcttattctaagaatgttggagaaagcagcaatgaaaagattggctaacagcacttacaaatcaaaatcagacatttggttctgagatttactgtgagcaagaacaaagaacaggaaaagctgggagattactctctaaaaggcctagaaatggccctctaaaagtctgctgacttggtttttgaaagtgacctaattttcgactgactatttaggtgatatgaaaatgaacaaatataccacatgccagttctacagatcttattgataatgaaatctgaagttgtctgctaactttagagtggaaatagaaggggaaaaacatactaaagaacttttctttgttctcaagaagtgtttcctaggtatcttttgataattttgataaaaagtattcatttcatttaaaggttttaataatttagaaagtttaaagattagcctactgattatgatgggatttttactgaaaattagttttgtcaggctgcttgcttgtctgtgtattttctattcta

SEQ ID NO: 61108 - DNA, 1039 bp, Homo sapiens
tcgcagatgactccatattcttcaaaagaacttgcctaattataagagcatatttccttggaaaatcaatttcttttgatttttaaatgactttaagattccatttgaggattattttacttatatatttttattttaaatgaaaatattcatcacatttctttagtcacaaaaaatatagtaggtaaagtgctccagtagtgaaaatgattgccatttcattgtgaccactttcaagagaagtttattaccaaataattagaaaaaaaatggaaattataatctcacttgttaagttaacccagttcattcgttctttttttaaaaaattaattttttatggtaggggtagagatggggtcttgctgtgttgcccaggctggtctggaactcctgtgctcaagcaatcctcccacctaaacctcccaaagtgctgggattaaaagcatgagccacgacacccggcttattaattcttttaataagtatttttgagcttctgttttgtgccaggtactgtacaaggcattagatacactcttggcaaagaaaacaaagtaagcaaaataaaacatcaaacatctttgtttatagagttttcctactgacgtttatgcatgttttttttttttttgcattttattcactggcctcccactcagaatatatttacttgaaatattgtgcctatttctaacaagttcatttatctgatttcttggcctattgaaagtagaagaggattgctgctgaaaccatgtagactgaatgcagatgatagctaacaaattcacacagacttcacacttgccaagggatcacaataataatttaaaatggtattcctctagctctgcctctgtctgctgcatgagaacatcaatccttcctacccttcatttctttccaaaatacttccctgaggatatctcaaccacagttgcttaaaatgtggtccccttctccatttctcaatcattgtagcactgtcacgaccagtccgggcattagccctgccacagatggcagctaatagtac

SEQ ID NO: 61109 - DNA, 1092 bp, Homo sapiens
tgaacctcattctttttacttgctcctggtcagtgtctacttacattttgtctgggtctgtttcaaacctttactattctctccttaagctgtctttcccattttgctcttctcctgttcatgtggcacattaggtcctattggatttgcaagaaaaaaaatagaagtcttcatactaaaatatttttaacaaccttcccttatttgcaaacgtcactgtatctgtcttctgatttgaaatactgtaaaaatttcccttcctgtgccccaaagctcattcatttatctgttatatttttggtataggggtttggttgtggggggtctctttgtttttaagtgacagagcacagatccccaaccgtgctacatcgaagtttccaagttctctttttaagacttcatttttttctgattgcaaatgtagcctatatatgttatttaaaaatgaacgatgtagaaaatgtttaacatgaacaactgaatccagaaactcctgtaattgcagtgtggcagagacctctttgttgactacatagtaagtcatcctcactgctctctacctgcccaccttgacagaagaactcaaatttgctcagctatcatttatcctagtgataaatggactacatttatgtggttctcacagacaacaagatactgagcctctcattatatattagtgaacttttgctgtggcaaaaaaacaaccataaaagtacagtggcttagaaaagcaaacttttatttcttgctcaagctacatgagggcaaatggttgactgcatctttgctggggtcaggtcacttttgctgttgtttctgttgttgttttagagacagggtcttgctccattgcccaagctggagtgcaatggcatgatgatagctcaccgcacccttgaactcctgggctgaagcaatcctcccagtttggcctcccaaagtgctgggattacaggcgtgagcacctcacctggcaccttaaaccaaggctgaagaagcagctgttctcatgccagaaggcaaaagcttaaagcaagagtttgagggtaatgggtaatggagtgagggagtcgaagggtgttctaa

SEQ ID NO: 61110 - DNA, 1027 bp, Homo sapiens
gagaatggcgcgaacccgggaggtggagtttgcagtgagccgagattgcacaactgcactccagcctggacaagagagcgagactccatctcaaaaaaaaaaaaaaaagaagcgcctgggctgggtgcagtggctcatgcctgtaatcccaacactttgggaagccaaggtgggaggattgcttgagcccaggagtttgagaccagcctaggcaatatagtgagaccccgtctctacaaaaaaattaaaaattatttggtcatggtggtacacacttattgtcccatgccactgcattccagcctaggcaaaaggaagagaccctctctcaaaaaaaagaaaagaaaagaaagaaatgcctatcaacacatgcttaatgctataaaattaatgaaactattatagggagaatgttctagtttggggcttattaacactatttttaagtaaaactaacatctgtggctttttcccccaggagattgatgattatattgtacaagcaaaggaacgaggctatgaaaccatggtaaactttggacggcaaggtttaaaccttgcagctactgctgctgttactgcagcagtaaaggtaattgttcatttacctttttaatccaatgtcatattaagtcaacaaataaaggtggcttcttatttcaaaccattataaaattgtggcattttgctatatttatttttctaatactggaaaacaagtaaataattttaaagatattttaattttgtgttttccatacttgatattttgaatctcttaattcatcacaaaatgaggtcgttaataaataatacatacctgaaaatgtcatttagtcataattttcccacttaatcaccttaaagtagtttgagtaaatcacctgatgtaaagatgaccattgtttatttctctgtctttggtgttctttctctctctttttttctgtctctttgtcaatggcaatatcttggtaggatttctggcttacttctgcacctctacttcaatcaatttgaggtaacc

SEQ ID NO: 61111 - DNA, 1355 bp, Homo sapiens
tcaaattatatacctaatagcattacattgagggttaaatggaagtttattaactatgcagcactatacatgtaagataactatattattaatgattattaatggtcagcactttaatatagcatagttttcttgttatttggcttttaaaggctttttcttttattaggataggtttataaatgaatacagaaatagcaaagttttcagcttaaaggactatgttttattttagaagttcattttgttttttatttcttgcttagtgaaaatgcattcctgatttccatatctgctaaaaaagattatccaggagataatccagccactgggaattctaaaaagagggaatagatgcaattatcaaagaaataatacaataatatttcccagaactgaaggatatgaatcttcagattgaaaggacccaccaagtacttagcacaatgaatgaaaagaatgactgactctaagtgaagtcattgggtatcccaaaacaccagtgataaggaaagaattcataaagattccaaatataaaaagcatgtcacatttggccaggcacagtggctcacacatgtaatcccagcactttgggaggccgaggcagatggatcacttaaggtcaggaattcagaccagcctggccaacatggtgaaaccccgtctctactaaaaatacaaagattagctgggcgtggtgggggggcgcctgtaatcccagctactcgggaggctgaggcaggagaattgcttgaacccgggaggcggaggctgcactgagccaagatcacaccactatactccagcctgggtgacagagcgagactccatctcaaaaaaaaagcatgtcacatttaaatgatgtagaatcagaatgacattaaatttctaaacagtgacagtgaaagcttgaagacagtaataccatccatgataccatcatgattttcaccctcaagaactattaacagtcaagctctcaattgtgttagcttagaattaagaaatttcttaattctaggcatgcagagtcacaagatttacctactggttatcttttgtccaggcagatatgctccccagagctagggaatggtccacaaaaaagaaaacccatgggatctgggaaacaagtcattcagcacagaaaggagatgacaaaaattcccaaagagaacaccacacagcaagtccaaagtgcagccagccaaaactggatgtggtggatgaaaggtgccaggagggatgtctctggtagacctacaaagccaagaggatttttcgtgctgcacagggatgatactaaaaccagtgagaggctgggcgtggtggctcacacctgtaatcccagc

SEQ ID NO: 61112 - DNA, 1045 bp, Homo sapiens
ccacgagattttgggcaaatcatctgcattgatctaagcattaatttttctcacttgtaaaacgaagaggtgaaacatgatttctaaaaccccttatatctctaaaacagtggttctcaactagaggcaattttgtgcccctacccttaccacgggacattttaggttgtcaccactgagagggggctgctactggtatctagtcggtaaagaatggtcagggatgctgcttaatattctacaaagcacaggacgttccccacaacaaaaaattatctaacaaaaaatagcaagagtgttaaggttgagaaactgctctaaaagtatgatgagtcagaaaaaactaaaagaatatataaatatgtataagtagttttggtggtaggttacaaataatttttacttcctttttaaaatttttctccatgttatcaatgttcttcagtaaatacgtattgctttaaactcactaaaatattttattcacctaatgcaaatgcagtcaattccattctgggcttgatcagattaattgttaaatgtgcatggggaaatgagatttccctaaaaactgggaactaaccttatctgcaattataatgtaacatcagggatcaacaagaaatagagcttagtggctattctttactgaatagtataataagaattattctgtaaaagaatgttttgtgcttgtacgattataaagcattgctggttatatgtttttaaatctgtgatttaaaatgtgaagaaaataaaggttttatacaaaggtgctgataaacaaaataagttcttatttaaaacaaaataactaatgttaatgtagtgtttaaccaggaaatgaagtatttaaacaaagacagcattatttgagtgtaaagaaattggaattactcatacatgcagggcccctttttatggatgccaaccacgtgcttggatacttgagtagacattcagatgtcctagtgcccttggatgtaaatgagctctgtgtggagccagtgtggggagctgcttctcagctgaagaatccctt

SEQ ID NO: 61113 - DNA, 1151 bp, Homo sapiens
agctcactaaggcctcaaactcctggcctcatgtgatcctcccaccttggcctcccaaagtgttggaattgcaggcgtgagccactgcaccaggtccttttctcatttttcttatacttttgtcttaatattatataaattaaatagaagaaaatagatacacaaagcattattaatttaaacaaaaccaatcccttttagcattgttatttacaagtgactataatgttctatttgtggcctcaaaaatagacatttttattttattgatgggaataaagcattagatacaggacacatgagtgagaaatggattggaaattcttatagtatgccacatattgactaattttgtaatattaaagacaatattttaaaaaaggaaaaaagtcacccatcccatctgcctaaacattgtactgttgttagttttgcatttttccatgcctacttatagccatactgcatacttgcaatcatattatgcatgtgctatagaattctggggtagagggaagatatctccacttaccgttaatatagcaaacatagttcctttattactggactttttgtgctgaagatgtaaaaactggaaggaataaggtagtcttcagaagtgattactttgtaattatacccatcctttaaactggttacattggatacatgtaatttacgtaatgttttcaaagtccacaatattgcaccaatttctctcttatattagttttattctggatccataaaaaatatacagtggaaagtccaattttccaaggtaataatggctgttaaagtgttggaggttctcaaagagggctcatattccctttttgcttttccctacagtgcctggctttcctgaaagccttgaagaggttgataatacttgggtattgataatagtagcattggttactcaagagctaaatttaaatccagcctttagatagatcacccagatacctcaaggttgggccttgccttgctcatgtttattctgaacctgaagcaaacccttggtaggtggtgtagtctatccatggagaaacctgtggccatacctgtagtttgctgctgaacctctgcaaaaaacctacagtgtttacattaaaacatgctgccatctatggagaagtctttaacag

SEQ ID NO: 61114 - DNA, 1039 bp, Homo sapiens
agcaaggactgggtttgttgaactgtgctcttatgctacatttgtggccttagagaaattgtttatcacagttacttcctttctgactttttccttgattcctcattctgttttaccatattaggatcaggaatactatataagcaaacatcaataggaaaaaaaatctagaaatgacaacctaaacctgaagcctggtttatttttctcaattataaaataaacattttttaaaaataagaatttggcaagtaaaaaaagaaaaaatgaaaaaatttaaaatcacctgaaagctcacttccatgagatataatcctttcatttatgtttttcctttgtttgtttctatatgtacattttttttttccacacttaatattgcttcaggagcttttttccaggaccactgatccatccccttccttgccacactggcctccttgcagttcttccaagcaatccccaagccctagctactctcctcactgcctctgtgcatgctgtttcttccacccggaacacacacacttccttggaccactgcaagaaaacaaaggatcttggcctaaataaggactgattccacttccaaatctcctctgacttctagcctagaagtctaagaacataaaattatacctgactaatatacaatgcaagttgcttatgttattatgagagtaacaagcttattaacaactctttgtagtttgcttagtgtttctcaaattattcgtgtcttagaagagcagaccaataaacatgtattcaatttttttaatatgtatattttttgaaacaggctataatgcagtggcatgatcacagctcactgcagccttgacttcccaggctcaggtgatcctcctacctcagcctttggaggagctgggactacaggtgcacaacaccatacccggctaatttttgtattttttgtagagaaaaggttttaccatgttgcccaggctgatctcaaactcctaagcttaagcgaaccacctgccttgacctcccaaagtgctggcattacaggcat

SEQ ID NO: 61115 - DNA, 1068 bp, Homo sapiens
tttttacggttcaggataaatcagcctttgtgatgtactgtgtttacctccttttgtgttgtatctggtaattaaataggcctcagattcagcagtgacataacaaggacataatgtaagataataaagtaggttttatatattctttaaatttttacttatataatactttctagtttttccaccatcagctgaaagtttttgaaacaaatatttgaaaaccaggtatccacacatagcacttttattcctgactagttttgcacacttgaaaattgtttacttattttacaactgttttactgatgctatctttattgtttttgccgtattctgacatgtcaaatctatgccttgaattatatcatctcttttcctgtgggtttcatttgttaaattcattggattttaataatataaaagtatagctaattgttcagttttaactatttttaattatcttcttaacaaataagaagttgctttaaacattaaccaattttctatatttagctatacagagtaattgaacttaacatgtttttgtcaacaccaattacattttcagcttttaaaaatggtagcttttgtgaaatagaatcagtgaccagtatagcacttagatcccttctaactcatataatttttctcagccaatccattcacaagcttggcattgacatgtgctgctagtttataaactggcattgacgaaaatcatttgaatctcttctggctgagataatttgccaatgcaaaatacagttgtcattaatcctgcacattagaaattattagaaacatattactttttaactttaaatctcaaagagattttgagttattgaattcttaaggctttcttagcttgaactgataactatgcattatgaaccctaagtcaatatatttttggtggttttagtgatcagtaatcaaatttgtacttattatgcttgttcaggtaatttacttgactgttctatttgtttgtccaaaagataaaatgatgagagagattcgagaggtctttgatctgtctcccttttaagaaatgaagccagctgg

SEQ ID NO: 61116 - DNA, 1031 bp, Homo sapiens
aattttaacctgattttccttggctgtgagtgctgcaaagctgaagagggggtggcagacactgacttgacaggcctggaaacattttagttatgtgattcaagagaaaaaaaaaataccgtaaaaccacagagaacacagttggagcttccatcacggaaagcacagtccccaaccaaccccttgttgctagtccagctctgccatgtgatgttgggaaaggcatttcatctctctgagtcttggtttttccatctgcaaaataagggtgtttagactgaatgatctctccagtcaacccttcctgctgtaaattctatcattcttcagtatttctttttcggtattgagggatttggttttttattcttttctatttttacagaagataactcatacaaggagaagcgtggtggtgacatgatcctggaaaaaaaatcaatgtattttctgaatctttttttcccatataaattctatatttctgtgtgtttcttgctcccccttctgtccaaactttggtttactctgaatattttcacattttgaaggtcattgtacagacttggagctttactgtttggaacctttgccattattgtcattgctgatatttcctgtttcacttttaaaaattgagttggaattcacataactagaaaattagccatttcaagtgtacaattcagtgacatttagcacgtccagagtattgtggaactaacagctctatctagttccaaaatattttcctcatcccaaagtgaaaccctgtacccattaatcagctactccctactctcttttcctttcagttctggcaaccatcattctggtatctgtatttatagatttatcttttctgatatttcatgtgaatgaaatcatacaaaatgtgacctcgtgtgtctggtttccttcacttagcattgtgttcttgaggttcatcacgttgtagcatgtgtcaatacttcattcgttttaatggctaaataattttccatttcattatatgtgcatatcacattgtc

SEQ ID NO: 61117 - DNA, 1004 bp, Homo sapiens
gcagaaaccacttcacctcatcccagccatgatggaagttcatttaagtcaccagacacagtgtgtttaagcagaggaaaattattagttgaaaaagctatcaaggaccatgattttattccttcatatagtatattatcaaatgccttgtcatggggagtaaaaattcttcatattgatgacattagatactacattgaacaaaagaaaaaagttgcattcactcaagaaatcaagtacttcagtaagagatgggggcaaaagagttggtagtggtgcacaaaaaacaagaacaggaagactcaaaaagccttttgtaaaggtggaagatatgagccaactttataggccattttatcttcagctgaccaatatgccttttataaattattctattcagaagccctgcagtccatttgatgtagacaagccatctagtatgcaaaagcaaactcaggttaaactaagaatccaaacagatggcgataagtatggtggaaactcaattcaactccagttgaaagagaagaagaaaaaaggatattgtgaatgttgcttgcagaaatatgaagatctagaaactaataaaatacagtgttggatccctttctcctgtttctgcaagtgtcctgaaaaagactgaacgaaaggaaaaagtggaattgcaacatatttctcagaaagattgccgggaagatgatataacggtgatagagcagaatttcctgtataaagagacccaggaaactgaaaaaaacttctgtttatttcagagcccatcccccacccttcaaatgacttgagagggcttaacaagaaaatgagtaataaatgttccatgttaagtacagctgaagatgacataagacagaattttacacagctacctctacataaaaacaaacaggaatgcattcttgacatttccgaacacacattaagtgaaaatgacttacaagaactaaggatagataactataaatgtaacatacaggcatctgttc

SEQ ID NO: 61118 - DNA, 1005 bp, Homo sapiens
ttacaggcatgcgccaccatgcccggctaatttttgtattattagtagagacgagatttctccatgttggtcaggctggtctcgaattctcaacctcaggtgatccgcctgcctcggcctcccaaagctctggaattagaggcgtgagccaccgctcccggctatcttttctgttttttaagtagacttaatttatttttagattttggctgaaactgagtgagcagaattcctaaagatgaagaaactgttccaatgaacagtgcaagctgaccccataggcatgctttacacacgccgtgtaaatgttaaatgctgtactcgatgaaaatgattgctctataaccgttcatacattttaggtgcatgttgttttgatagccttgactgacttggtttcttttgcagataaccttctgttcggtgatgaaattatcactaatggttttcattcctgtgaaagtgatgaggaggatagagcctcacatgcaagctctagtgactggactccaaggccacggataggtatggctcagagctgttaattttagagagtaaatgtacggtttttggtttgtttgttttgagacagagtttcgctcttgttgcggaggctggagtgcaatggcgcgatctcggctcaccgtaccctccgccttccaggttcaagcgattctcctgcctcagcctccccagcagctgggattacatgcatatgccactacgcccggctaattttgaatttttagtagagacggggtttctccatgttggtcaggctggtcttgaactcccgacctcaggtgatccgtccgcctgggcctcccaaagtgctgggattacaggcatgtgccaccttgccccacctcacttgtcccctttttgtgtagtgttcttcatccggttagaatatcttcctccctcacttcatattccttgttttttcactttattgtacacttaccacttcttgaaaagctctgtatcttactttttaaattgtgt

SEQ ID NO: 61119 - DNA, 1092 bp, Homo sapiens
ggactggtacgatttttctatgtcgtagaacccttttgtaaatacttttggtattatggtgtgtgtttctagatattaaccataagaacttaattctggttgttaattaattagactcttgaaatatatacttacagctgaagggggtcttcccaactcttcattagatcttcctaatctcattgggatatagcattaattctgagtgtaccgagaatgaaataccattaaattgcattttcttactttgcaaaaaaccctcacagaatgctaactcattacttcagaaaataaatgagattttgaattacttgataagttgactttaagccttttcccccttattgtaggtccatatacttttgttcagcaacatcttatgattggcacagatcctcgaacaattcttaaagatttattgccggaaacaatacctccacctgagttggatgatatgacactgtggcagattgttattaatatcctttcagaaccaccaaaaaggaaaaaaagaaaagatattaatacaattgaagatgctgtgaaattactgcaagagtgcaaaaaaattatagttctaactggagctggggtatgtaagactagtacatggggaggtcgtatatgtattttcttatgccttttccaagtaggaaacatttttctggtttagaaggatttatccttacatgataatggatgtttgggaactgccaaaaactgagtgcagcagcagttgctaaattagttcagatttttaaaacctctccagccttaaaaaaatatttgcttctgcttatttatagcacagtgggtaaatggagttaaggcaagatttctacctacattatatcatagctcctaaaggagatgcagggaattgaaactctgcttttgttaagggatgtcagtctgatggagaaattgggtatttgttagatctttatgagaaactggaaacctaattggtattcacaagtgaaaagcttagtgttgggaagagtaacagattcctaccttccctccatattaattaagatgatgtgattgtggcgacttgacattttctatttgatctaccttagggttgca

SEQ ID NO: 61120 - DNA, 1503 bp, Homo sapiens
cacctgcattcccagctaatcagtaggctaaggcaggagaatggtgtgaacccaggaggcggagcttacagtgagccgagatcgcaccactgcactccagactgggcgacagtgtgagactctgtctcaaaaaaaaaaaaaacaaaaaaaaaaagaaaaaattcttccctacttaaaataatttgttgaaatggtttattttcttctcaagttgcatttgctttaatttgttggctaaatgcttaaaaggcttaaaattggcctgacttaaaaattccttatctgtgttaaagatggaatatgaggtatgtttaattttactcagttatttgggagttttatttctgaaataagggtagggttgtatttttatttcttaaaagaagtttcagactaaaattttctttctcaactcttacctaattatatggtaagagagctagctagttcctataaaggtagaagatttaattttacaaattatgccatgcacattttaggtgtctgtttcatgtggaatacctgacttcaggtcaagggatggtatttatgctcgccttgctgtagacttcccagatcttccagatcctcaagcgatgtttgatattgaatatttcagaaaagatccaagaccattcttcaagtttgcaaaggtactatgaactcttctggttgtttctttggccttctctcatgaaaaagtattttgttcacatacagccaccttaaggttatcgttcattgtttagtaaagtgaatgctgctactgtggcggagtaagatcactcattatggctagaattcctttattcctagaggaggactattatctacttcattttaggagtgagcttattttcaaagagatagttcatatttttaaaatttgcactgcagcgatggtcgttattctgcctgggcttttttaagaggtttgcacaccatataaaagtaacataacttgtgatttttaatattttattagagattgtaaaggttataacatcactttggtgtttcgtagtcaagttttaacataaggatgtgcctgaaaaatcatttgtaattagagaatgggaagattcttgggttgcatttttgtcagcaaattgcagaggatcattattctgctctagagttgcaccgtccagttcagaagccactagccacatgtggctgttgagtacttgaaatgtattgatatgtgcaataagtgtagaagacatattggattttagagatccagtatggaaaatacaaagtatttcattagttttattcatcaaatattaaacaaatattggtttttatatggaaaaaatacttaaaattaattttgaattcttttgaaatacttttgatattgggttaaataaaatgtattttgggctgtgcgtgttgcctcatgcctgtaatttcagcactttgggaggccaaggtgggaggatcagttgagcccaggagtttgagaccagcctgagcaacataatgagactccatctc

SEQ ID NO: 61121 - DNA, 1016 bp, Homo sapiens
tcttgttgtgttgcccaggctggattcgaactcctgggctcaagtgatcctcctgcctcagccccttgagtagctaggattacaggcacgagcctccacatctggctgaactgtttttttaggtggcattgttcattgagactggtgaatctgacattttgatggggggtggagggttgtcaaaacgcaagtaatgttggtggctcgtgcctgtaatctcagcactttgggaggccgaggtaggtggatcgcttgagggcagcagtttgagaccagcctggccaacatggtgaaaccctgtctctactaaaaatacaaaaattagctgggcatagtggtgtgcacatgtagtcccagctacttgggaggttggggcatgagaatcgcttgaactcaggaggcagaggttgcaatgagccgagaatgtgccactgcactccagcctgggtgacagagtgggactctgtctcaaaaaatcaaaaacaaacccagaagtaatgctaaactctacttctaatttatgtgaaaaattaagacaaaggtagagttcaacttagactttttggtggaatgtgtttttaatgttgcaagggttagcatcaattaatttatgaaatggtcctttatccttatattttttgattacagttttgatctttcaaatttaattgatttcacatttaataaattcaaatgtatagtttggtagaagtgtaacataccatgtaagatggaatttgggggctcagaatgattggttcattcttgtagtaacagccatgccataacggtgatatgtcgatatagtttacccaaaagggtgtgtatataaaagtgttcacataaaatttaaatccttattactctcaggaaaatttctttgtcatatatattctcatactgtctgtttcctcctctagtttagaatcagaggaggagagagagagatttcagttgcatcagatgtgtcctttcataagtgagggaaagaggagaggaaaaatattaaatcccta

SEQ ID NO: 61122 - DNA, 1047 bp, Homo sapiens
ataggagcagaacttgagcgttttataaaagacacttaactgcccatctgcttgcttgatgaaatgtaatggcttggttaagtatttagtgcatgggtcttttttgggaatttggagctcaagcccttgttggatttttgcataatgtatctgttgtggttttattagcttacttcctcctccctttttctaactcttatttttcaccctattttaggttccataccccatgaagtgcctcagatattaattaatagagaacctttgcctcatctgcattttgatgtagagcttcttggagactgtgatgtcataattaatgaattgtgtcataggttaggtggtgaatatgccaaactttgctgtaaccctgtaaagctttcagaaattactgaaaaacctccacgaacacaaaaagaattggcttatttgtcagagttgccacccacacctcttcatgtttcagaagactcaagttcaccagaaagaacttcaccaccagattcttcagtgattgtcacacttttagaccaagcagctaagagtaatgatgatttagatgtgtctgaatcaaaaggttgtatggaagaaaaaccacaggaagtacaaacttctaggaatgttgaaagtattgctgaacagatggaaaatccggatttgaagaatgttggttctagtactggggagaaaaatgaaagaacttcagtggctggaacagtgagaaaatgctggcctaatagagtggcaaaggagcagattagtaggcggcttgatggtaagaaaggcagtcggaccattttgaaagtataaatgtcataacagtatttccaaaaaattagctatttcggcaggttaatcgatagggtagctttatgtagttgattctgtttagagaaactgtacagttcgtaatcagaaaggtaaatcttctggtatcttaacatgatatggagaaggaagtgtttaatagtgctctgtatgttgtgtttctctaggggatggaaaaataagaatgggttattagctggcagaaatgatgacagattt

SEQ ID NO: 61123 - DNA, 2866 bp, Homo sapiens
gaactaagatttgaacccaggactaagtgtattgcttgtatttatttaattaattaatttttaagagacagggcctcactctgttgcctaggctggcccttgaactcctgggctcaagcagtccacctgcctcagcctcctgagtagctgggactgcaggcacaccatgcctcccagttgtttttaaacactaatagtagtctttcataaggacacttataataaaggcagagctggaacccacacttcattccagactgctcagactgagttagtgttagaaaactgaaagtaacatttttattactgtatttcaggtaatcagtatctgtttttgccaccaaatcgttacattttccatggcgctgaggtatattcagactctgaagatgacgtcttatcctctagttcttgtggcagtaacagtgatagtgggacatgccagagtccaagtttagaagaacccatggaggatgaaagtgaaattgaagaattctacaatggcttagaagatgagcctgatgttccagagagagctggaggagctggatttgggactgatggagatgatcaagaggcaattaatgaagctatatctgtgaaacaggaagtaacagacatgaactatccatcaaacaaatcatagtgtaataattgtgcaggtacaggaattgttccaccagcattaggaactttagcatgtcaaaatgaatgtttacttgtgaactcgatagagcaaggaaaccagaaaggtgtaatatttataggttggtaaaatagattgtttttcatggataatttttaacttcattatttctgtacttgtacaaactcaacactaacttttttttttttaaaaaaaaaaaggtactaagtatcttcaatcagctgttggtcaagactaactttcttttaaaggttcatttgtatgataaattcatatgtgtatatataattttttttgttttgtctagtgagtttcaacatttttaaagttttcaaaaagccatcggaatgttaaattaatgtaaagggaacagctaatctagaccaaagaatggtattttcacttttctttgtaacattgaatggtttgaagtactcaaaatctgttacgctaaacttttgattctttaacacaattatttttaaacactggcattttccaaaactgtggcagctaactttttaaaatctcaaatgacatgcagtgtgagtagaaggaagtcaacaatatgtggggagagcactcggttgtctttacttttaaaagtaatacttggtgctaagaatttcaggattattgtatttacgttcaaatgaagatggcttttgtacttcctgtggacatgtagcaatgtctatattggctcataaaactaacctgaaaaacaaataaatgctttggaaatgtttcagttgctttagaaacattagtgcctgcctggatccccttagttttgaaatatttgccattgttgtttaaatacctatcactgtggtagagcttgcattgatcttttccacaagtattaaactgccaaaatgtgaatatgcaaagcctttctgaatctataataatggtacttctactggggagagtgtaatattttggactgctgttttccattaatgaggagagcaacaggcccctgattatacagttccaaagtaataagatgttaattgtaattcagccagaaagtacatgtctcccattgggaggatttggtgttaaataccaaactgctagccctagtattatggagatgaacatgatgatgtaacttgtaatagcagaatagttaatgaatgaaactagttcttataatttatctttatttaaaagcttagcctgccttaaaactagagatcaactttctcagctgcaaaagcttctagtctttcaagaagttcatactttatgaaattgcacagtaagcatttatttttcagaccatttttgaacatcactcctaaattaataaagtattcctctgttgctttagtatttattacaataaaaagggtttgaaatatagctgttctttatgcataaaacacccagctaggaccattactgccagagaaaaaaatcgtattgaatggccatttccctacttataagatgtctcaatctgaatttatttggctacactaaagaatgcagtatatttagttttccatttgcatgatgtttgtgtgctatagatgatattttaaattgaaaagtttgttttaaattatttttacagtgaagactgttttcagctctttttatattgtacatagtcttttatgtaatttactggcatatgttttgtagactgtttaatgactggatatcttccttcaacttttgaaatacaaaaccagtgttttttacttgtacactgttttaaagtctattaaaattgtcatttgacttttttctgttaacttacattgtttaaggtatataatttttaagtcttacagaatttgtacagcttcgaatgctatagtattagatgctttctttctcatactacatttcttcatttggtttattacattagtctcaccagaccagtacttgcaaaaccctgatggtgctgatcgtagcaggtgatgcatcaccaccaagcatttcaaaaactatttcagccattctaggctagaggcctgagcaagtaaaacatggagaaaaggcagggcagggcctaagaaggatgtgacatgtcctatgataaaggaccaggagtttgggatttgagagagaacaggaagtggtggatagtgaaaatccatctgatgcaaaggctgggttaactgaaaatctgttctgggatgctaggtctttcaagtctgaagactgcagaccaca

SEQ ID NO: 61124 - DNA, 1308 bp, Homo sapiens
aaaaaaaataacagaaacgaagcaaatagaaaaagaaatcataatcaaaactgcattttgtatttggtttgtcaactagttctgaatggcttttccaaaaaagggctctcaaaatgttttggcaatggcaaaatactcacttatcaaacatttattaagcacttcctttgtgccagtattaagattatacttttaaagaaaaaatattgtgtggatgagcaattagaatgtgtctcaaaaaacttgtcttccacaaattaggaagtaagataacacgttagagcagatgttaaagtgaagctctgctgtagcgactgtaccaaatattacttgctactgtatctttttgttttgaagtggttgactgaatgatttctttcttggcagtatttttgacaggtagtgatcgcattcctattcttggtatgaagagtctgaaactagtcatccagtccacaggaggtggtgaggagtatctcccagtttcccatacttgttttaatcttctggatcttccaaaatatacagaaaaagaaactctacgctctaaactgatccaagctattgatcacaatgaaggcttcagtttaatataactttggagttataactattcagtttagtgcaaaagcattaaactatttgtgtttttcttgtggtgatgaattcagcaaggtgacagaggtactattataattcttacttgcagaatgttcaatctacgagtgttcatggaagccaaaaaatattaaaggaaaatgaacaaactgttaatattattgtacagaaccatggattttttttgaccatcttctaataaacatagcaagtattatgaatacattaaagttttactaacatgaattttaagagtttgcatatttcagaaatgatctggtgtgagtgcatggaaatattgcttaatttttcttcaatcattgagtgaaaaacctttaactttggcctgcaatagtcatttgattattttttcattttgtaaataatgttaagttttgtaataaaatagttatgttctgataccagtacagtttctatggttgtaattgaacttgaacagacttttaaaggttaaaaattatgatttaaatcttactctgagactctataaaaagaaaaaaaaggtagcatggtggaaacactatcttttcttttttgctagaataagtgtctttgtgcaaacctaaatcacagatagggaatatactacataacctgcagttcttttctttgtgaatcctgacacactgatagatgggggattgtcgatcagagaacttattaatattt

SEQ ID NO: 61125 - DNA, 1139 bp, Homo sapiens
gtaaaagaaataaaaggtttcaaaataactgcctatctttataaaccaaattagtacataactggaaaaactgtctgtgataaagtttacaacaagggtgatagaggaaccctggagtagcagttgtcatgtgggaagaatgcatggttttctaagctgaatagcattctcatacttggattttatcactcgtctaaggaaaacatcctgtctaatattttatagtaacaattctaaagttttatgcacaacaaatgcttagtttccttattaacttaccaaacttggtaatttgtaattaatcatggtaggatttcaaactagagagtaccaaatttctagttctggctttaagtagaattctcagataagctatatggtagcagaattttatctcaaatttagtagttttttttaattaaatgagagaaaggtagaatataataatagattattataagttttgagtctgacattgactttttttaaaaatttaaattaatagatcacagttgaaaactttggtgcaacagaagtgaaagagctggttctaaatggtgcagacacagctgttaacaaacaaaatcggtaagtgaattttagcagcaacagtgggagtaataagattcagtagacattttcttctgtacgtagaaaacgtgtcacaaccctaagcttttactccaataaaactttaattttgagtggttagtgaggaaataatctgccttttcctcctgaaatcccttgaagacattaaaacaaagagaagggagaagtgacagcagcaaacatttttggaagccaggaaacagtagtaactaacttaagcaaaccagagaaagctacaacatgagatggaaaagaggagtcacgaagccagctggatcacttcacaaaacaaaagtttgggtgctgagaataaaacatacctttagaaaatgcatggtgtttggggaaatgctagaactcttataagaagcagttagaaactagtttcccatgctaacattggatttaaaacaacaacagaagaaattagtttcccttagcacaccaggaatctggcaactgcccctctctggcctgggcaggagattggaaatttaccttctggagaaattgaactaaagagactg

SEQ ID NO: 61126 - DNA, 1050 bp, Homo sapiens
taaatacggtgtattaaaaatatttttctgagcttattataggtggaaatacacaaaatatttttaatcattattcctgagtgattggtttacaggtgtttattcattttcttttctatgttttttctttgttttccaaatttcgaatgtgtattactttttaaatcagaaaaaaagttatagtaattatttcacctattaacttaatgtcgaatgacatgaatatgcttatgtctgggagaaaacagttgtaaagtcgtatgtatagtacgatttcagctagatatattttttttaagtctgagaaaatatgctacatggaaatgtacaaaaatactaacagtgatgttatcccagggagacagtaatgaggatgaacttttgttatttattacttttttctctatcttcaaaattgtatatgagcatatttatgtaatcttagaaaatttaatattttaacttggaggacatgtgtttactttttcttatatttttagacatttgaagacagtgatttgttccatttgattggtgttatctgtggcttagcaatttataattgtaccattgtggacctccattttcctttggctttatataagaaactactgaaaaagaagccatccttggatgatttgaaagaactaatgcctgatgttgggaggttagttggaaaaaaaagtcaaaaagtagtagggtttgggaggtaaaaagtggggaaggtacagaaagctttccttctatgaaaaaatatattttgttcttcttgttaaatttctgaagtaaacaaatgcccttctaataaaggaaaatccattatgtttctcagatcaaaattttctattgaaagactaaatttggctggcccagtggcccacacctgtaatcctagcattttgggagaccgaggcaggtggatcacctgaggtcaggagtttgagaccagcgtggaggtcaggagttcgagactagtatgaccaacatggcgaaaccccatctatactaaaatacaaaaattagccaggcgtggtggcccacgcctgtagt

SEQ ID NO: 61127 - DNA, 1646 bp, Homo sapiens
ggtaatttgacattttctgtggtataattgggacttttattcagaagctatgtttaaaattttcctatttgtttttagtgaatcttttaaacttaataaataaaattatatttattttaaactattaattgtagagtattagtaataaataacatgttctagggtctccagaatgtactttcatttctttacagtctatttggtgtttgcattgtgctattttaggttatatttgttggagaagatgctgtggatgcaggaggggtgcgcaaagaatttttcttgctcatcatgagggaattattggatcctaaatacggcatgtttaggtattatgaagattccaggctcatttggttttctgataaggtaaaatgtccaaccatctaaattacttctgtgtatatacccatgtatttatacctgtatgtatcaagttaattcagtaaataaggaattactactggatccctaacatataagatctgctttattacaatttgagaaattataaactttggacttggagttgtcaaaatacatttgatgcttaccacacattttaaattaacaaaataaattaagagatggttagccagaaaataatgttgactattccttctgctgatttcaatttgaggattgaataataatcaccagattaacttttctgttgggaaaaattaatttatcattagggatcattgatttatctaccttgtcatttagagcaggtcagcagactatagcccattaatctcaaagaaaaaaaaagtcacacccactcttttacctattgtccaaggctactttcatgctacaatagcagcggcagagtttaagtaattacaacagtgaccttatgtccaggaaaccccaaaatatttgccatctggttctttatagaaagtttgctgacccaatttagtgatcataagtgaaaaggatggatcagtttagtagaactcctgacttgaaagaaatttagatagaatagctattggttgtaaaaacctcaatgtaatatttaatcattctgcctggaggttggctgtcttgtgtaatgttagcagcttagtgcctagactctaattcatcaggggttgcaaaatggtgtgctactctaatatttctttttcatttattagcttggatacttctgtatagagaaatttcctcacgttttctgattccttagtagtgcaattcataggaaaggattctatttagttaccaatttttcaaaagaatgaattggttcattagcatagtccactggtaataattcattttttgtgttttgctttcaagtatcattaggtattcataggtttaaacatacttgatgtttttcaattcactgcagttattgtcttcattgatgctcatattgtcccatctttgttcaaggagagctcttaaggttggtgcccaagtccttttgaaacaacctatatactttttggtaccttccttgctaccttgtgtacttactatgacagaatgttccagacttatcttacacatttactgcctaacagtaccaacattaccaccaatattatgattactaaaatgttttaaattgtttttcagttctttttgtacaaagagtataccctaatatagatagacagccagataat

SEQ ID NO: 61128 - DNA, 1519 bp, Homo sapiens
ttttgcttaccaaccctttttccctgtcctgtactttctattttaaattaattcagttttaaagaatgcttaatgtaagataccttatgttttactgtttttttttctgtcaaataaaaacaatttatggcttattttttcttactttgtgtccatatggcattttaatctactaaacactgtcagacattttgctgagattttaaagtcttaaagtctgaggaatgttttttccattttttttaagtagaaaaactgagccataaatttttttttttaagaccaagccaggcataggattagttttcttattctgcctaaattctgcaaatgggggtgtttaattgctgaaaacaaatttcattatgttcaagcctcaatcattttatgatcacaaggtacctgaaacaaagatcttacattagtagatatataagatgcttgtgtagggggtgtatttgattgtagatgtattttctacctcattacttcaatattctgctgtagcaaaatatatgaaatgctaccttgaatagaaatagttaaatttggacactaatattgctctttcctcgttattgttatattctgcactgctgtcttaggatgtcaaccatggattaactgaggtaagtttggtgtaataaagctcatgtttagagtaaaatatactccattttctcctgagtaatagaagagccaaagattcgtttttttggtgtggttaaaaaatgtaaataaatagatatatatgtatcattttttaaaatacagtctgtagagattatcttgtataacatttcagaagttttctgaagaaaatgaaattctgttaacattacacctatatgatgcctcaacaatatttgctttagaatagtttctgtcctcctcaagtcttccagtataaaatgtaatgtgtcctcagaatataaaaaagcaaacttttattttaaaatttagcaaatgcctacctaatgtggctgaaaacattttatattagagaagtaaaacaaacttcatttttaaaattgattaattgatactcagaatggtcacaaagttaaactttttgtatgattatctttctcacttctaatatataaagttctagcactttggtttaagtaatcaacaaccctagactacccttttaacacttgggaacattataatactttctttatccgttatagatgtcaggttttgctttgatttgcattttgttggttgctatgtttttcccagcacttgaaccaatgaagcattttgagttagctttaaattatagctctaatattgtttgcttcctcattgtcaaatagaattagcacataaaattatgaaaacatagagttttgaagccaaagggtgctttggagatatctaaatctttttgaatttcagagaagtaaaattagtttttatgatcattagctaggcagtgccacaaatataggatggaggtaaaccttgtcacatgaaaaatactgaagagtgaatgtttagaatgtaataa

SEQ ID NO: 61129 - DNA, 1093 bp, Homo sapiens
agattgtgccactgcactccagcctggttgacagagtgagactccgtctcaaaaaataaaaaaaatttgtctgtcttgagtactggttaaatttaatgtcaattacattttcttttgtaggtaaatgagaaaatgggacagattatacagtatgataaattttatatacatgaagtacaagaattgatagacataagaaatgattatatcaactgggtccaacagcaggcctatggaatggtaggttttctgtgcaatttgtgatttcatttttatgtatatgtatctaataaaaaaagaaacaattgcttggttttgaaatgagaaagttttttcagaacttttatccagaacttactttttaaataataacacattgcaaaggagtgctatatattttacaatatttatatgcaaacattctactcttttaccaaagccaaaccaaagaaatggattacactgtaaaacaaaacaaaacaagacaaaaaaaacctacaagtgtgaaatggatttttaactcttttattttccatgaggttgcctcttatttctccagtgttgaaaatactggcattcttcatactggaactcctaagaatgcattattgttgtgaaattggtgcttcaagactaccaaaagaggactgggtgtggtggctcatgcctgtaatcttagcactttggagcctgaggcaggtggattccctgagctcgggatttcaagaccagcctcggcaacatgacgaaatcccatctctactaaaaatacaaaaaattagccaagtgtggtggcacatgcctgtaatcccagctactcagaaggctgaggcatgagaatcacttgaacctgggagatggaggttgcagtgagccgattatgtgtttacttttatttcagatttttaatataaatgtgggtgcgtacatctttttatgcagctaagtctttaataactagacactatcccattaaaatagtaccatggtcttataaaacttgaattaggcacataaaattttaatgcagaaatgggtaagcagttagatacaaaatatttaggtttactactcttatttgctagccatttgt

SEQ ID NO: 61130 - DNA, 1370 bp, Homo sapiens
tgagttttatttatttatttatttatttttagcaggtcttactttgtgccttgtgcattcatggtttagagttagccaaggatgtggggggaatttgcacatagattttggggcttcgtcctctggattcctttctttgatttttttattcctcactgtctggctgtgctggcagcttcagtctgtctattaagactgctgctttctgcttgagctctatcctctacttgtgtccattcctgtttctgcctacttttggtggatctccagtgtttttaagtacagtagttgttctttaatgtattgtctagagtttataattgttagtgccaggaagagtagtctgatacaaagtattctgccatatttagtaccagaattcctctagtctcttttaatttagaatagctcctttttttttcaatccctgctaccttgactttttgaagattcttggccagttttcttataaaagtttcataatcaggatttgtctgattgtttcctcattgtgatgtttatttaacttgttcctctatcccttgtatttcctataaactaaaatttagattaggagacttgattggatttgggttaaactatttttacttcatagatcatttgtatgcttcttgttgagctatatcaccaagaacataatatttcattgttccagtattggtgatgattagttagatcacttgatgaagatggtgctctccactgtaaagatttgtttttatctttgtaattaataggtaatctctagggtggtaatttgcatcctcttcatttttcacatcgtgtccagatatcaccttctaaagtttattctaatcagatgccagcacagagcaacacttaacaagcattagctgctattattattaaggtcccatttcccaaccataagtctttatagtatctagtttatatataccgtatacagtttaatcattacatatctcatactgtgttgtagttataaagacatgtcttttctagattttggggtactgaatgcagatatcacatcttacaaatctttgtgtctcccatagcacttaactagcattttgcatatagtaggcactcagtaattattttttgtaggaagaaaaaaatagctaagaaaatccccaaagcatttttttctttagatattttaaatttctctgtcttggccaggcgtggtggctcacgcctgtaatcccaacactttgggaggccaaggtggacagatcacaaggtcaggagatcgagaccatcctggctaacacgatgaaactccgtctctactaaaaatacaaaaaattagccggtcatgatggcgggtgcttgtagtcccagctactcaggaggctgaggca

SEQ ID NO: 61131 - DNA, 1001 bp, Homo sapiens
aaattgttttcagtgctccaaatggcatcataagaaaatacctttggtacctgctgtcaggaatggatgtattatcagctaaatgagtttactggcaaataattgggttatttagtagtttccgagttccacgtagtacattatagacatgctggtatgccaaaagagaagccttacttggtctgtctagcctagtcgctacatatttgtgctgatctaaatcagtgattttcaaactattttatgtagaacccttaaataaaaccaaacagataaaacatactcaccataaccacccttgaactgaggtttttaagcaagaatactaaactttaattaaaatgtgaaataaaagtgttataatcaaacttatataggttttattttgtacatttaggcaataatcctaaacacataagttgttttgaacttctaccgtgtgacttctttttaaaattcattttgcaaatagagtgcctactatgtgcttattattatattagatattagtgatgtagtgataaaagacatgatttctgcccttgttgagcttacaatattgagagattgtctaaactttttggtctttatgttacagcatggtaagtactagattagggaaaatgcagagtgctatgagaacacttgggagggcatgtaactatgaaggactaaggaagacttcctggagaaaatgatggctgattgaaccttatctactatgcgaatatattatttttattctaacattaacatttcttttcaaaaacgtatatatcatatcagcaagatatacaaactgcaaacactggttgcgtttctttaattttttttaattcttaatttttgtgagtacatagtaggtatatctttatggggtacatgagatgtgctatgaaatactaggtttggccgggtgcggtggttcactccagtaatgtaaccccagcactttgcgaggctgaggccggtggatcacttgaggtcaggagttcaagacc

SEQ ID NO: 61132 - DNA, 5383 bp, Homo sapiens
tggtatttgggatgatgggttgtatttgaaaagctgttttgtttctctagcttgttttccaaaactataatttttctgaaaatcccaaaggcatcccagattaggctcactgccaatataaaatgtttaaaatttttttaaattaaaaaactttttacatgaacatacacacttaatttttaaaataccatgttttaaagcagataacattggataaatggatgaaagtaatatttaagaaagtctagaataaacagtaataccttcatcaagtattattttatcagtctttagcaatttatgtaattctgattcatctaattgggtgttagaggagtgctctgtagcattaaacattagattaattattcattttaattcttttttaagaaagggtaaacaattaaatttctgattctatgattaaaaaaacttttttaaattttttagtgagatagatggaacgttttcttcctctggttgcctaaatggaagttttttagctgttaggtaagtggcaattctttaatatgctgaaattttcaaatttattgtcttaaatagtatatcaaattaaaaaatgaaataattttaaatttttattctatttttttttttcttttctgttttttagcaatgatgatcactatagaacaggtaccagattttcaggggttgatatgaatgctgctaggcttttattccacaaacttatacaacctgatcatccgcagatatctcagcaggtctgtttttaaagtattatgtttacagtattatctgttgattttgttttcttttgttttatacgtttatagcctaatttactttgcagtttcacagactcttacgatgtgcttttaaaataagattttattttaaagcatttgtaatttagctgtcaaagatctataaatcttttcagatgtttgaagcagaccctgaattacttaacattaccacgttgcttaagtttgtgtatggttatagaggtagagagtttaaattgagacttgtacacgtgattttttaaattctccaagtaatgcttaggcattaattttcattgtgctccaaagtatattcattgtaagacattgtctttcttttttcttcttcaccatttcatatttgctgtagtgcaaaattttccttttctttcttttcttcctgccttccttttttttttttttctttgaaagtgtattcattttaaatgaagtaggttttactttttgtcaaaatataggtggcagctagtttggaaaagaatcttattcctaaactgactagctccttacctgatgttgaagcattgaggttttatcttactctaccagaatgtcccctgatgagtgattccaacaatttcacaacaatagcaattccctttggtacagctcttgtgaacctagaaaaggcaccactgaaagtacttggtaagaattctaatattttttcttttgaaaccttttctctttaaatgaaaatgcttcataagttcttttgccatttgcagttctgctgccctgcttatttgacactgtcttaggcaaaaatgaacctgtttttccttttcttgcttttgtctagtcttttgattctagttgttggagttgttgaaagaaaaacatgttagatatagaagttcaattaaacataacagcagagacagtattaggaaagttaaaaactgtcacccgtattcctttccctcatcgcctttagtataatcttgctattaaagaagtaaaggaggaggaacaattaaaactgaacaaacatgggctttaaatcttcttggaaccctgatataagccctttatcttgtgtttccttcacttgctaatttcatgatatttgattttatttttctgcctatagactagattttattgctcatctgatcttgcacttctatctcttactgttctggttttttggcataaagttttctcactttaatttttctaattgtctagattttatctctatttcctggcctttatactttttttgctacatttaacccagtgcttttctttctaatggtatttgttagatatgtggagctgagatatatagaagtaataatgtcagtacaagaactttaaggctgagggtaaatggaggaagcaacaagcaaggggtagaatatgggaatctgagggaaaaagagtcaagcagggactgaaaagagtattgctttcctgttgtcagaagtttttgtattctttctgcctgcttcataggattgaagtgtttgtacttagtaactacaaatagtgaatgtggggaaggacccatatgttacactttacattgttcagcttctgtatttgatcttcaggagtaccttgcattttaaaggtagtggttcacaatatttcaaccatatattaaattgaaagataaaagttagaaagatcctttagtattagagcaatacaatttaaaggatgttttgtttaaaaattgaaactgtaattttcaaaacattttttaaaaactggttttaatattaggtatagtggtgagttttttatataacttaggaaaccaagaatataaattcaacaagactttcacactttatttttgcttttgagagcttttcggacaatattgtttaacttggtcggggggaggtttataaaccttacaaatgttacataagatattgtgttatatgcatctttctggggttttctcaggtttaacaactactgtttcagaaaaaaagtcagtatgattttgaaaattgtgattttttaaaaaattcattttatttgcatgttcactttttaataacagaaaactggtggtcagtacttgaacctccactattcctcaagatagtagaactttttaaggaagttgtggtacatcttttgaaactctacaagatcggtattcccccttctgaaagaagaattttcaacagttttcttcatactgcattaaaggttttagaaatactacatagggtatgtccaatcattcctttattttcctctttccccattcctattaacagattgatactgttcattttaacattaatctattaaagatttagattggcaaaaacaatgcatattatagaaatttggaaaagttatctatactttctcttaaaagaagtaataaacctgtcctttggagctctggtcttacctgactttgttaggcatgtatagataacttatccatagttgggcagaacaataacatactaatgagttagaattctccttatatttccttatgaagaatataatttgttagtttgcattatatggtttttgttagctgtaagtggttatcttgtgaaagagattgggtcctagttgtaattatgaacattaaaacttgtgttcttttgctgtagggtactaatggcctcaaagtagaacatttcatttgaaacaaatgactaatttaaaattggaaccgtatgtaattcattaatttgcctattgttcttccctgcccttcttcccagtgtaacaaatagtaccctttacacttgtagcagttcaaagttatatgaagaagtagactctgagctgtttcattaaagatggattttcatccctgacagttggtaggtatacctctgttatgccatttggttttctcaagttgctatttagatgagacatgacctaagggagaagcgtatgtttctaacctatggaatgactaaaaaacccacatgaacctttaatctttagtttcttctccttaacagcttctttgcattttcagaccctcttgcctagtgctaaggtaaataataaagggataaaggagataatccatctgttctttgtctaagaacaaacctttaccggccatttattttcctattttagtgaagctcctgggtatttttctcaactacttaactttctggacttacttttttctttggtatttagtatgtccaagattcctagaaaaacaactcatttctcttcattttgattgatgaaatcatagccatgtatttcctagggaaacaggtcattcttatgtttgcctttacccagaacagggctttcttttagcatatcagggtccaggtctgcagtaaacagttactaagaagattctctaactacatgagatgggtctctacctttctgtgtactgtttgccgaggattcaagagattaattagattgtttcttttctctggacttcatcctactgctttggtgaacaatcccttttcagctggaccctattaccaaataattactcattctgtgctttcattatctgcttatctttattcccccctttaagaaatacttttttttcttagctgtgtcttttacctcgagaaaatggaaggggcagagaagcgggggaaattgaacattttttctttcaaactataggcagaacttaagcaagtaagttaaattacctgcctagctcagtaacttcagtctcaactaaggaagaacttgatagagtttcatcttcaaagacctttttgatggactcattctaaatactagaatcttcacatcttgatagttgaaggggaagggaaaatttattgcttgctaaccactagaacctcctttgtctgtagttcatgtgaatactctagatatatttaactttaaaaccctatatagtcggtattttgccccttttcatagactggaaaaatgaatgtccacatttatatcagcagatatagtagtataatctctttagaagggggcttgattttattttatgcccctagatctagaagttcatattctagatcacatatagtattatattataggcgctggactaggaatcaaaaagatcatatttctaacccctctgtgttgcttcctaccactgtgattttgaagaagtctttttctttatcccatatgcaaatgaagaattatctataaggattgaaataccagccctgatagttttccaagatttatgtattgtttacattatacagtatgggctgggcgtgatggctcatgcttgtaatcccagcagtttgggtggtgaggcgagcggatcacttgaggtcaggagtttgagaccaacctggccaacatggtgaaaccccgtctccactaaaaatacaaaaaaaaattagctgggtatggtggtgcatgcctgtaattccaactacccaggaggctaaggcaagagaatcgcttgaacccaggaggcagaggttgcagtgagctgagatcataccactgcactccagcctgggcaaaagagtgagactccgtctcaaaaaaataaataatacaatatatgtaagttattatatattcataagacagtgattttgttaccaccaccacttgaatggaaaaccactacttttgacttgaag

SEQ ID NO: 61133 - DNA, 1598 bp, Homo sapiens
tgggactacagacatgtgccactgtagcccagttcaattctttcttttttttttttttttgaggtggagtcttatgctctggcccaggctggagtgcagtggggtgatctcggctcactgcaacctccgcctcctgggttcaagcgattctcctgtctcagcctcccaagtagctgggattacaggcacacaccaccacgcctggctaatttttgtatttttagtagagatggggtttcactatattggccaggctggcgtcgaactcctaacatcaaatgatcctcccacctcagcctcccaaagtgctgggattacaggcatgagccactgtgcctcgccaagaataaatactcttgatttttatttccttctagctatcttttgtagcttttgttctattttttttaaatcatctttggtttaaactgaaatatactgagatgcagattagaaaaagctttttttcttggtgcagggcagaagaaaggcttgtaaacttcaccaaatgctgcttatgcttgtgggatcgtttaatgttcatcatttggtcagtctcatccccatagcagtcagaatatttcaagtcactttataccatgaagtccatgaatgggaggccttattaaataagatgattatgtgaaaatctaatggcatattgatgctctgaaatatgttatgtaaatcttggcttttaattttttacatttttattacagattctgaagaatatttctgtgtaaaaagaattttctcagggggagatcaaagcttttcacattactctagtccccaggtaataatatagtcatgtaaataattaaatagctccaataattttgacaaattttaaaaacccattattaatgttctttatatgttacaaagtaattgccttagtttttttccccttaagtctacagaataagttttttctgatctatttgataggtttttgtttcaggtgttcaggagagatttaattctgtttaaagaacaaatatatggtgggaatttcttggtttttgagttatatataatatctcttccctctgactaatcttatttgaaaatttagaactgtgggccaccagatgacttcagatgtcccaatccgacaaagcagatctggacagtgaatgaagctctaattcagaaatggctgagctatccttctggaaggtttcctgtggagatagccaagtaagaaaagcattttgggccaggcacagtggctcatgcctgtaatcccagcaccaggcagattgcctgagcccaggaattggagaccagcctgggcaacatggcaaaaccctgtctctacaaaaaaatacaattagctgggcgtggtggtgcacacctgtggtctcagctacttgggaggctgaggtgggaggatcagctgagcccaggaggtcgaggctgcagtgagctgagattaacaccattgcactgtagcctgggcaacaaagtgagaacttgtctccaaaaaaaaatatccatggatatttttaaagatcttaattaaatatgtataagttgtagttctttcatgtgcatagagatatgttaaatgataacataaaatatttaat

SEQ ID NO: 61134 - DNA, 1010 bp, Homo sapiens
gatgctactctggtgctgaatcgtttattgtaagggatttcagtatagacccaggctgtttaaaatttaaacattagtggaaattttctggaccatgctcgtgcagcctgtctatgtgatgcagaattcattctatagattaagtctgttaatgaatatttgtacagaagctttggaactacaattggttttattaattttttgaaaagaaaaattacctcttttgatattttctctgcttttgtcattgtaaattgttggaaggtaacattaagtctgaagttttctatcattttactctaggcagcacacttctgcttttgttccttcatcaggacgaatttactcttttgggcttggtggtaatgggcagctgggaaccggttcaacaagcaacaggaaaagcccctttactgtaaaaggaaattggtacccctataatgggcagtgtctaccagatattggtaagttctgtcatattaaagctttccttcatatattgaagttcttgttaaaatgttgctcttaaatcatgaagatttctgcgaaagaattccaagatacattgttaagtgaaaacagcaaaatatagaacaatgtatatggttgtttgatttgcttatatttacttgtaaatgcataaggaaattctggataagtaaaagttacttacagagagtgggtcatatgggaactagaagatggctacataccagtgggagggaggttttttgttttctattttaaattgtggtaaaatatacacaacataaaatttacagacgtaaccattttttaagtagcattaagcatattcacgttattatgtaaccaatctccagaactcttttcatcttgaggatactaaaactctatgcattaaacagcaactcttcattccctcctcttcctagtgcctggcaactgctattctactttatgtctttatgaatttgacttaacactaggctaggtacctcaaagaagtggaatcatatagtagtgtttct

SEQ ID NO: 61135 - DNA, 1033 bp, Homo sapiens
ccacggcactcaagcctgggtgatagagcaagaccctgtctgaaaaaattaataagtaaataaaaattgctctatttatgcactctggttacatgtactctttttgcagcgcatttatgtaaggcagtaactaccttgaaaagtgaagatgataccgtttttaggtttcgtgaaattatatatatgtatgtggaattcagcaagacagtataatgataatgaaaggcaatgcaaataaataattatttgtatctcttcagtgtctaaatattttataacggtgaaaacatcattacctggaattctcatagttttatgacattttactttgaaagagccatctgtctgttaaattgtgaagacagttcttagaagagaaaaaactgagtttatattaaagatttggacttatttttctggagatcagttattttcttttatcatgccttctaatgataaggggttttgtctttttttaggaaggtggagtgtttacttttggagctggagggtatggtcagttgggccataattctaccagtcatgaaataaacccaaggaaagtttttgaacttatgggaagcattgtcactgagattgcttgtggacggtaaggtgttatgtaaaagagcattttggtctctaaactgcagttgtttagggattgcttattgaattgtttcagagatcctaataatctgaggaaacacattctgcccccaaatacctattttgccactgaggagtcatagtaacaggagaaacatcttttttactgttattttatttatttttacttgaacagatttagctgaggcaagatgttaatagtgtatatgtaatattatatttattgtagttgatatcacactcgaaaggcttctttctttctcttttccacctttttttcttttcttttctttcctttttggggtgatagagtcttgctctgtcacccagtctggagtaccacaattatggcttattgcagcctcaatctcctgggctcaagtgatcctcttgcctcaggctt

SEQ ID NO: 61136 - DNA, 2048 bp, Homo sapiens
tgtaaaaagcaaacttcaccgcagctgcttaagtctttgcttggaatccctttcatgcaagttgcagcaggaggagcccatagttttgtactcaccctttctggagctatctttggatggggacgcaacaagtttggtcagctaggtcttaatgatgaaaatggtaggttctcattatgtatagtttaagtgtactttttgaaagagatggtcttttgagttagatcagtgattcttagtgtaagagagaaatgtatcttccctggtatagaggtggggatgagatgttatttaaaaattccatttggggaatgcagtgggaagatacaaaatatcctttattcattaaagaactataaaaagtatatctggacaaaatgtttagtattggatgtttattaaaagacaattgaaaaacattacttcaaattgttaatccattattggccactgttagtggaaaaaagctgtaaaattattctggggaagtaacatgaagtgttaatctttgagtttttcaaggaaatatttaaatgatttgggctgttaaattaatctttggttgggcttcacttttaacattgatgctaaagtcttaaacattttgaatttgaaaaaattgtaactgaaacaagttgggatcttggaacttatttttcatgattacattgagttgaatgccagtatttgacttacaaaagctaatttcttatagttcagtataattgtaatgactgaaatggacaaaagtgagttattaatctagtaacaactagtaatgataagcaaacaatactttcagaaagaattaaagaataccttgttttgcataagaaaaatatgtcatattaggatatcatgtatcttttctgctacaaaacagcctaaagtacatttttttttccaggcttttaagtaggctcctgtgggtgtaactatcatgaagtgaatataaagaatgatgtatgtgtggaaaattagaagcagttagataattttgaaatttcttgatttctgagtcctttgcatactggcatattggctgtttagcacttaactcttaagtccctcctttatcacaatagtatggataggcctgggaacctgacttagtaagcttgtactacaaaatcatcgaatcatagttaaaattatttagtcacaactatctactgagcttggcaagctgtagaggaaacacatctagatgagttttgatttttaaaatactattaacatctcttgttggaattttcagataggtatgttcctaatttactaaagtcactaagatctcagaaaatagtttatatttgttgtggagaagatcatactgctgctctaaccaaggtattgtacttctaaaacttctttattattactcatcatagttctttcataattaatgaatgttctcatggtattttctcaagttttaacttgagtgttattggtatttcaaaaataatttatctgggaaaaaagacttagattattcttgaaaaaaatttaccttatttttcaatgttgttttatgttattaaatgtgaattctgatatactattatatgtgatgatagtatattgctgaatttctcagctttatatgaaatactgcttaaggtcatactttgaataaaattattccgttttagttcattaagcttgccatgatatatgcatcaaacccatttatatcgtgtagctcagcctaatttgaatgtagtttccatttggcttataaatacttcatacaagcaatagaggagatgaatttctctgttattcataggccaagtattgtgcaagcagttacagtgatcacagtcttatcaatggctttaactctgacctctcactgtcttgggtatgtgccaattgagtatcagtactgtttagttcttgagtgactagaagttagatgaaaatgaaagcattcagttaacctttaccagataattatttattgcagtcatgttaatgtaaagtttttcattggtcaaattagaaactggttaaatttctttatcttttttggtcttacatag

SEQ ID NO: 61137 - DNA, 1032 bp, Homo sapiens
aagactgtctcaaaaaaaaaaaaaaaagagtggttgtctcttgaaagaggaaccaggattctgatttttttggaaggaagcttacttttaagtgtgtactattttgttgtttcaacttaaaaaaatcagttattagtgtatcagttatttagtgcagttgttagtttaataaaaggatgtctaaagttgcaaaatacgatggcaatatgggagcaaaagtgacaggcagggaaaactattataggaatcagttaagatggtgaggaatggatctatttgccgtatttttctttaggaagaaaactggatgtaaatttggtgatatatgatagactggatatgtgtgaggttaaaaaaaaaaagagagaggagtattaaggaagactccctaggtttataatttttgctactgagtcacttaggatgttacttaccaaaatggggagcactggaaagaggtccagggaagtaggatgggggtcatgaattcagtctggggcatcctaagttagaagttcctttgaaatttccaagtatagtgtcaggtaaacaatgggttatgtgggttttttgctcaggagaggtttgggctagtgttaaaattttgaatgtgatcagcagatagttattaaagtttgagcttgaatgagtgcctcttgggagaaactataaaataaaaatgagacttgaatattaaaaggagactgttgaggggcataaggaaatgagattattccttgttatgtgattcaccggttcatctgtgtagtcaatcaaacttaaagtgtactaatactgaatgttcttctaggtagtagtatatgttcatataagaaataagtataattgctaaaaataatatttatattcttttgatgataggcagaatgtcccaaaataatattctttatatgaaatttgaaatgaaatgattattttcaaattaaattttttgcatgtgagaaaaatggttaatttttccattactgttttacagcaagtgaagtcttctgttggggacagaataaatat

SEQ ID NO: 61138 - DNA, 3150 bp, Homo sapiens
ttgaatattcaaaaattagaaatgattaaacacattatcttttttatgtgacaaaggggattacttttgatgagttctaacaaatttatttaattattttctaatttatctctttagaaaaaatggaacatgggaagccttgttttaccattcacagtattttttaatttctaaaagctaaaacaaagaaaacaaagccaatatcccccattctttagggtattaatacatttatatgaagatgaaaggggatagttttttctttaacacagtaatgacgcagaagaatatacttctggtctctgtagcatataatggtaaaagatattagcatttaatgtgtgttacaagccttaggttagtattttggaaaggagagtaactgagtataaattgctatgcaaatttagaaaatttttggcaaattttatgactaatactaaagcctccaagaccttacaaatgtagttatcctttaacagtatattcattacgtactattaattaggcactatagtaggtgccaggcattatcatgggtataaaacacatagtctgccttcacagaacttactgtttagcagaggagacaaatattaaatgaataggtacctgtggttagtagcgataaatgctctgaaggaaaaaacatacagtactgtgagaatgtagtattttgaaatgtttcatttgcaaaattgtacttgatactcagaatagtgtttttttttcctaaaatacttaatatgctgaacaggtcaatgtatcatctgcctagtatgcataaacaataacagtaaatgtttagtaatttgagcacagttgggtatgttcatgtattttttattccttactctgtttgcattgccagtgtttgattttgctatttcaaagaaatggcattttgttgagtttgaaaatttgaaggtgcattggatcctgctaatttgttggattctgctaaattgtagcagtacagctctcaggttttgtagttaagagcataacttcactaaataaaaatatttttaatacaataatatggaatcagagtaactctcctttttcctgctcaaactttgatttgctgaagctgcttcccgaaaatcatgtgtgtcgactctctggtcagaatttgctccggactctcttatggcagaatcaggtcaggtgacagtatcaggtaaagggaaataagaaacatattgtgtacctccccatcccccgttttttcttttctttctttctttttttttttttttttttgagacagggtcttactctatcgcccattctggagtgcgatggtgtgatcttggctcactgcagcctctgcctcccaggtccaagtcattttcctgcctcagcttcccgagtagctgggactacagcgtgccaccacacctgctaattttttttttttttttttgtattttcagtagagacagtgtttcaccaggttggccagtctggtctcaaactcctgactgacctcaagtgatccgcctaccttggtctccaaaagtgctgggattacagtaacccacctgtaatccgcatctggcatcccccctttttttcttgaaaacattcattcaggaaaaacagtaacatgaccaggcaaagggaaagaaccaatggagatgctgggatggttgatgtacatacaaagttaattgagttttgtaatgttttaaaaatgagcctttaaagttgcgttgtggtaaaacaaaactcaggaaaggggggaaggaaattacgaaagtataaggacaaaatacaagacagaagaaaataagacttaacatattagtaatgattgttataactgtgaattgagtaaatttcctgagtaaaaaaattgaatgtccctgatttagacgtaaagcaaaaggatagcttgtaaggaataggtttcataatttgagagttggtagaacatacaagaatccctgttggttcttaagaaacccgataaaggagaacgtgcattaaactaggcaaaacaccaattttagacaaattagataatgtacatttgctttccagatgtattgccaagtttctaactgtaagctgatgatttaaaaacacgtttttataatgaaagaaaatatctgaattataagagcactctgaggagtacttgaggtatgagtatagctcactttgcttaaatactgtctttccaagatgtgttcttttcacccctttaatttttttttttttgtatctagctcttgtttactgattttagcataaatttttggtacgctaaaattgagcttgtatgaaaaaaaataatatgacctatgtgcatatagtaggccatcaataaataacataaatagcattcaagatcaatttgttaaatggaattaactggtcttgatctgtcttcttcttttctagaaatattaaaagtttgtcagatatccagattgtacaggttgcttgtggttactatcattcacttgcactttctaaaggtaagcattagtttttattttatttctcttcagttttattacttgatacttttttgattgtgcatatagttctccagctttgctcatctttctgcaagattgccctggttcttgatccttttcatttccatataacttttagaattagcttgtcagtctgtacacacacatacacacacaaacacacacacacactgctaggaatttgggattttgttgtctctataaatcaattcaaggaaaatctttacagtattgaacctttcaattctagaacacggtatatttgtccatttaagtctccctttaattttttccattagcattttgttttccctggacaggtcttatacaccttcgattagactttcccctaggtatttgattttttgttgttgtgaatggtgtcattttttgtttattatatagacatgaaattgatttttgtgtctgtttattaaacagttaaaaactcttcatagctgcaactggggaagattgcttccccaatctcatttaatctcatagatgaactttctatgcatagaaataaagaaggctaaacatcatatttattagctttgtttgcattcctctcttaccagtttaacttactagtatcctagctaaggattggaacatgggctagtaaagaatctgc

SEQ ID NO: 61139 - DNA, 1241 bp, Homo sapiens
agaatcacttcatggcagcatatacattgtaatatatgtgtcagttatgatcttattgttaaaatcaagcagcccaggttatttaaatgatttcttcttttttttttcacctggactcttttattagtaatagatttgaatagaaggtacattctgagagaatctttataaacccttaacttcttcccaaaatgttcaggtcacttgatattctgagttgattatgccctatgatatatttatctgtggtttaccacaatgagaattacgtttggaacatatttgttgaatagttcaaaataactggttatatctagtgtgtgtttaagcatttctttagcttgtttgtataaaatgaagaatgtgttttgttcttattggaagttcaaaactagaatgcaatatctttttccttgatttctgtactagaatgcaatatttctcttcttgatttctgtagagcaggttgttgccctggatgcccaaaatattgtagctgtttcatgtggagaagctcatacgttagcgctaaatgacaaaggccaggtgtatgcttggggtctcgattctgatggacagcttggcctggtaggatcagaggaatgcatcagagtacccaggtaacaaaggtgaccagaaagaggtccttaacaatcttttaaaataaatttgttaatctaaattgttctgcttatctttgggcctgtaagagttgacatctcattatttctcccctttgagtcctttgataagagtttggttcttgcttatgatgttgattgagctattgattgatttgctatttttatatactctatattttctctataatcaatagaatttatgtctgtaaaaaaagcatagggaatacttgcttcattacaaatttttttagtgggttatactaatttaaactactactatcttgagtattcctgctattgaaatatttattaaatattggtttgttgaatgtttttcactaacttgtcctttttttagtctttattgtttctgttgaatatagaagtccaacatgcttactgtaaaaagaatttagtcactttccactttgtacatagcagtgagcccaatttaattaattcatcatataattatttcacaattaaaaaataagcagtgcctcatcaatgttttagtcttacacagttacatagggcataatcgttttttgtttgtttgtttttgagacagagtctcgcactgttgcctgggttgga

SEQ ID NO: 61140 - DNA, 1294 bp, Homo sapiens
ttggagcacaagaagtgtacaatacaactgtttaatataaatgattgcttctttgtttcgtggattttggtacctttgactttacattgctatctttgactttacattgacatttggtacctttggtacctttgactttacattgctatctttatagctgatgctattaatttgttattgttgaaccaaccaagcagtcttacttacctgtcttgtcatcctatcattttctgctacttcctttgaggattgttctggagagaacttgactttttctggagcctctgagataacagatcttttaaacatttacttcttcataattaagatttatgggaatgttttgatataaacaaatgatgcttctaagtattttttcttttttttttttggaacagtgtgtgtcatatcttgcttgccttttttgtttttgtatgtttctgtaaaatacttttttaaaagctatacaaaaaatgagatattagtgtaataaacttcatgtactggaagcttcaggagtaggtaagtacttaatacatcattagagttgtgcaggttcctagaggctatatagggctaacctccctctccaaaatgcaagatagtaatctagatacaatttgaatttctgtatagataggaatttcagcctctttggttcagtctgtttcattattgaacagctgcatttgtaaattgagctaaactatgcctctgaagaaaccctgattgatccagttttaaccactttcaacataagacttttagtttgttgaagacaatgattatagctttcttattaagctgaaagaaagttaattttaaatggtatcttttaaaaaacttgtgatactagtaaaaaaacctgacaaacacatcttgaggactaagagaaacaaattcactttccttattgatttgtcaattgatggctactggtagtagggccagtattttaagggccaatattttaagttaatttctgttttaaaaattgaacatattttaactacatgtatcttttgatattaagttggcagtccacaaatggaaaccctgtcagtcatggtttactgcctttcagttctctactcaccatatctaatagatgctttatttatgagatctttaaaaaatttgttttccattcagaaattgctaattcagattatttccttaatttcctttttttatcttgagacacggtctggctctgtcacccaggctggctggagtgcagtggcatgatcttggcttactgcaacctccatctcccagattcaagcgagtctcc

SEQ ID NO: 61141 - DNA, 2926 bp, Homo sapiens
atatataatattattataatagcgagagaaacaaaacaacccaggaataaagtagtaagaaatgtgcaagacctatatgatgaagacttgaaagcattactgaggagcacaaaaaacttgagcaaatgaaaaccacatttatggatagggacactcaaccacatcaacccgtcaattttctctaatttgtaaatttagtatgatctcaatgaaaatgtcaaatggcttttgagggaagtagacaaatatatactcaagttcatatggaaaaagaaaaagctaggaaaattctaaaaacacagtaatacgtattaactttttttaaagacagtttctaatatacattaagtaaaatgagcaaggtgtagagagtaatgtatagagagctacattttgggttttttaaacaaggaaaaatacacacttgcatttgctttatagatacacaaaaaaccctggaaggatatatacaagtaataacattggtaactgttggtgtagaggtgggaaaagaagtggtgagagttagattgatggagaacatacatagtagactctcactgcataccttttaaaaaacaatgtaaatatgttacccattcaattttttttttttttggaattagagtgcttacataaaaatcctggctctgttgctagatctgttttcttggtcacattgcttaacctttctgtgcctaggtgttctcttctctaaaattaggataatcatgccaaactcctagagtagctgcaggagaattacttgaacccgggaggtggaggttgcagtgagccgagattgcaccactgcactccagcctggtgacagagtgaaactctcgtctcaaaaaaataaagataaaacctaacagtgcaaagaacaatgcctagcgtatggtgagtattcaataagtgtttgcctagaagaaaaaccaatattagagtgggaatttaaatttaggtctgccttacggtaatgtggtattatgctgtttcatatttgcctaatgactgtatattgtcctgtagggaaactatattgctttcataattacctccagatatacaatacagatcttttcatttatgcctgaagttcagacatttattcaacagacagttgtcttcctgctgtgcccttgatattgtgctaggcatggaagtacttctttgcctttagtcttcaattaaccttactagagctcttattcaaagactatgccaaaattttaaaaaattatttgtttatggtacttagaggtaatgctttattggagcgatataaaatggattggattcctttaccttcagactttaaagatacaataatgtgaccaaaaaagaaaagaattaaagatgcctttttttttcttgtgagaagcacatacgtgatggaagttagattgatcattgattttaaaaaggttatttaatgattaataattataaggtggccaggcatggtggctcacacctgtaatcctagcacttagggaggccaaggcaggcggattgcctgagcttaggaattcaagaccagcctgggcaacatggtgaaatcccatttctactagaaatagaaaaaattagctgggtgtggtgatgcacgcttgtaatcccagctactcaggaggctgaggcatgagaattgcttgaacccagaaggtggtggttgcagtgattgcaccactgcactctatcctgggcaacagaacaagactctgtcttaaaagaaaaaaaaaaataataaggtgtagtttgtttactgatattttgaggatcataggcacttgagtaaatatacttagttatactttttttttttttttgagacagagtctcaccctgtcacccaggctggagtgcagtggcgtgatctcggctcactttgacctctgcctcctgggttcaagcgattctcctgcctcagcctcccaagtagctgggattataggcgcctgccaccacgcacggctaatttttgtatttttagcagagacagggtttcaccatgttggccaggctgctctcgaactcctgaccttgtgattcacccgctttggcctcccaaagtgctgggattacaggcatgagccaccgttagttatacttttaaaaccagccctgcccttcccaaaatgatgagctgaccttaaaatgtagaatgcatggtttgatcatacttctgtactcttattttgcatttgctgttattttcacaccaatctgaataatattttggcttagtgtgttgttgataaactgtgtacccactgttatacagtgcttgactgtgagagaaatttatatgtcaagaaaatcaaggacaaatatatatatatattacatggatgtttgaaattgtataaaactgttaagttgtggagaacaaaaaaaggaacatttaaaatggaagccattgcagttagctatctttatctgtcaaaacaaaatgcaaaaacaactccttttccttgtttgttaatgcttgcacttacttgggttcagaccttaaattcactttaggatcttttcctttcccgtagcaccaacattgacccagttgccagattttggttatttttctcagtgactgtcttgttttttaatttcctttgcaaatagctaactgtgtcgttttgagttaattactttaaactattgggtccttagtttcctcctctctcaatctaaaattctttgttttcattctggactattactggtgtacatgagaactgtggccagtagctctttaactgatctccctgctccagttcattcttattaattccaggttaatctttccaaggtatatttcagtttctctgtcttgaaatttgcccagctaaagtaccatctccatcattactccttggtcactcttataagaattcaagtcacacattttgtgtactaccaa

SEQ ID NO: 61142 - DNA, 1409 bp, Homo sapiens
agctgggcatggtggtgtgcctgtagtctcagctactcgggaggctgaggcaggagaattgcttgaacctaggaggcagaggtagcagtgagctgagatcatgccattgcactctagcctgggttacagagcgagactccaactaaaaaaataaataataaagtaaataaataaaatgtatgacaagctttctattacaacatgatgaatatcatttaatgatctagtagggaatagaaaacaaatgcacaaataatagaaaggcaattaaaatatgctaagtgttacaggatgtataaacaagagtgctgtgtagagatagtatactaagcagatggcaacaggcaagtttgaggcttactaagggaagagtagtccatgtaattgagatgtcttgagaatagtgagcaggaaggttaggcaaaattgaggtcagattgtagaaataaattaaggagcttgaatttaatttggtgaatatctattcactcatagtttgtaatgggaattaccatggatttataaaggaaaggttgaaagggagagaaattggaggtaaagaaatagttaggctgtgatggtagtcctttattttttatttattattttttttgagatggagtctcattctgttgcccaggctggagtgcagtggtgcgatcccagctcactgcaacctccgcctcccgggttcatgtgattctcctgcctcagcctcctgagtagctgggattacaggcacccaccaccacacccggctaatttttttttttttgtatttttagtagagacagggtttcactgtgttgaccatactggtctcgaactcctgacctcgtgatctgcccgccttggctcccaaagtgctgggattacaggcgtgagccaccgtgcccggccgatggtagtcctttaaagcaagaaaggagcaggtagatgatggagacttagagaggcagaaagaatggacaggctttggtaaccagatggaaataaatagtaaatgtaacggaaagagccaggtatgatcctaggtagaatcattagctatagattagtatattcattagtatagaaataaggaatccaggaagaagagaaatattctcttttaagaggcaagttaaaagattctggtaaggtgaattttgtggtaaacttaataatattaagtgagcagtaagaaatgtagtattgtaagtggggagaaagatcagggctaaatgtgtgaagtgtttattttcgattttgttttattttcagttcagataggctgacattccaactgtagacttctcccagttctaacctgttaagtaattaataattcattaacaatacttaactttgtgcttttggaagactgcttaaggcacatggtgatataataccgttgtaaatttaaagta

SEQ ID NO: 61143 - DNA, 1002 bp, Homo sapiens
tacacaataactcatggttcctttcaaaatgcttgtgacacaatttgcaagaattatcctcatcttaggggataaatttacggagaaatggcagcacacgttggtaagtaacttgtcaaaatagcagatgactggtgaacagctataagttgaatctgaaagttagagtctaccagtctcctaccttattcactaaattgtgcttatgtttagaattatttacagtaatatcttctgtttgaggcaggtcaaatactagtgcacagattgtttccctgccattcgatttgatggcctgttaaatcattattttaccaagatgcttacattctgataccactttgatacttcagtataactctgtgtggtatgaagaatatttgaacaaacgaacagaaacttaactatggtaatgcccagtcttttctcttttctgttatatattgtatatatccccttgtctaactgctatgctgtactacaagccaaggtccatagtaactgacttgcagaattgatttggtggctaaccttggaacttggattagttatgttgtataaagtccgccatgtagatacatgcatctctctctaagatgcattggtttggtggatgctttataaaactcttaaaacctacacagaagacaaaaatagcagtagatgcctaatctgagcagtctaacaaagggaaacttctttaaagtacttggaaccagtgattttctcttgggtatgttagtgtttttacatgattagaagtgagccacatactttccttaaaagatcagcagtgtggtagatttggttttacaatttgggtacttagcagattcttgttgcagatggcagtctaggtagtctagttaccattatctccttagtaaagattcttaggttctgtattcccaatatatcatacaaatgtagcactgtttttaaagctcatttctcacaaaggcatgtatttttaaaactgctttgaagacacaaaagttactt

SEQ ID NO: 61144 - DNA, 1131 bp, Homo sapiens
cctgcctcggcctcccgagtaggtgggactataggggcgtgccaccatgcccgggtaattttttatatttttagtagggacggggtttcaccgtgttagccaggatggtcttgatatcctgaccttgtgatctgcccgccttggcctcccagagtgctgggattacaggcgtgagccaccgtgcccagctgacttcacaagaactttaaacttgtgtcagaaagcacatggaatggagggaactaagaattgtttctttacataggttggctttataaatatacatattccataactaataaggaatgaaggagaaagaggtagccttattaaggataaattattctcgagattcataataacctactggaggacttggcctgacaatgtagtgaatagatttaacctgtggcctattgaaaagaggtgtttctgttctggactttttagggaccacacagaaagatttaactgaattcctttattatactaaaggtgcagattatgttcatgttcatctctgttgtcttgtatatgtatgtccttttctatcactactggcttttctgaattatttccagagaagtgaatgtctgtttcactttcatgtttttttcttcataagaactttaaaatactttttaagctaatgtctcaatttttaaatttatagctaacaaatatatttaatcttcagtgcgctagaccaatccatttaaatgaattgttgtttttttatactttcaaattcagttctgaagattttaagtatgggaagtatacttttctttacaagatccttttcttactgtgtatctaatcataggtataatttggtgaccatggttatgttttgcacattgatttccatttgtttcatgttagaaacagtactaaactgttctgtgaccataatttgtaaataaagtggtgttctgtttaaaaacaagccctgttatctaaaaaacagttttttgtgttttacaacattctttcaaatggagtatctcatttaattctcacaacagttgtatgtagctaaggcaggtatcatggtccgcattttacagatgaggacactgaggttaaaagagattaagagactaatagggtcacttggctagcacatct

SEQ ID NO: 61145 - DNA, 1479 bp, Homo sapiens
ctaagaacattttatggattcctaccagattttcatgatctcaggcattgaggtggtcatattggtagaaatgaatggtaatttactgatacgcatttgatgattgtctctgctccagagacaaatgggccctttactatttttgcttagcttggaatgctgcctcaggttgagattttcatggtacggaggctactgctgttctttgtactttagcatgccccatagaaataactgaacatctctctgtattactttaataatttctgaaaggccatagggcaagtagaaagtaaaaagccagcacatagaaattgccagtatagttacttaggtctactgaggtttaaaatgtttaagtgttagaggtagacactgtgtactagtagtataatgattatagtgccaggaacagcctccaactgtatagatgagattctgagaaacttaactagctagaataggcttctttgtggtcatgttgacattgtgatgattgcactgtgacatctatatcatcttgattcatcctggaaccattatttggtaatgtaaagttggggcagtgggtttccctaatttgggatacctctttaggattgcctcattgttgtcccgattacaccacagcctgtggaagagaaaagtgacaggcattagctttgtcttgagaaatttagagtctgggttgggagttaaggtatacatgaacaactggagagaactggaaattagacatgatgtgccatgcactttgagcctaggacatttaaatgatgggaaatattatgggatagaattaaagtaagatttctgggagaaaatgaaggcttacatttaattctattggtgatcacataaacagctaggaaataagtctggagctgaaatagttttgtagaaggggggggtcctgatcctgagaaaagctttttattatcagaagttctggttcgatgatatattgaagtgaacctaggtttcagagggaagagaaacaagttcaaaaagtagtagttgctgtgataggaacttcatcttttaatctcagctttgattgaatatttatttatttatttatttttatttttatttttttttttgagacagagtttcgctcttgtttcccaggccggagtgcaatggcgccatctcggctcaccgcaacctctgcctcccaggttcaagcaattctcctgcctcagcctcccgaatagctgggattacaggcgcccaccacaatgcctggctacttttcatattttaatggagatggggttttaccatgttggccaggctggtctcgaactcctgacctcaggtgatccgcctgccttggcctcccgaagtgctggaattacaggcatgagccactgctcctggcctaagatgttttttaaataatgtttttaactaaattttaagaatgtttttaactaaagttatttatatttggaataattcgttaatgatttgtgt

SEQ ID NO: 61146 - DNA, 1684 bp, Homo sapiens
gtcagtgtgctggaaagttctacagatttcgccatcagactatccattcctattcttgaaaaatctgcagtgctggagttatttgcaattcccccccgccaatctttaaataattgtctcagagatatagatagatatagattgcccacgggtgatttttttaatcccggttaccacttgtaataaaagaggttgaattttggagagaattgatatttaaattgcatgtttttttttctgtattataattatgcacattgatttagttttaaaattagtgaggttggaatgttagtattttgatttgaaatctgggatctttggaggtgatttaagattatggtttggtaagagaatcttcattttctctctgggctaaagagtaattgggagagtcgtttaaattgtggaaaattgctttaaatttccattattggttttatttctgttacagataagaactccattttctgttgatgtggaggtaggtattagaaagcttaattatactaggattgcaaggttatgtttctgcagttggctaaattttgcactgtgtatatttgctttttgggcagaggaaagatgtcttatttcttgttcccattgaaattatttaaagcaaaaagtagaaaaaattgtgattaatttcatcaaggtacttattcctattagtttagtctatcacaagataaccagaagtcaaaactagttaatatgttttaaattttgcaaaggatcatagaaagtgtcatattttccctaaaaatttctgtatgatacattttaaaaaatacaactgattggtttttgaaactgaatgatacttatgtagcatgttataaagtatatttaatgtttaccatgtagcaattattgtagcctagcacttgaaagagcaattatacatccttttttctttgaagtcatattaacttctttctatttcctcagacatagggtacctccaactttccggggtttcagaagagaattttttattgaaactggaagaccaaaataattacaagcatgttgtgctggggaaatgcatcctttgggcagctaggtttgggtggaattgatgaagaaattgtactagagcccagaaaaagtgacttctttataaataaaagggtccgagatgtaggatgtggactcagacatactgtgtttgttctggatgatggaacagtgtacacatgtggatgtaatgatctaggacagctaggtcatgaaaaatccagaaagaaaccaggtaagttgaaatgtttttaaaatttgctatttttaataattatatcattttaaatttgaatcatcgtataatttctctagttgtaactatatgtttatcaagctttaaaagcaaagtagaagttatgtatttccattatatgtgtatatttgtatggttctaagtactttatgttgtggtttctttttttttactactagtattataaaaccttattttgtatgacgatataaaacaataaagaaaatcagcctgcagtatataaatctttggtacagagtgtgtagtgtgcaggtcctctttaataaattctgttcagccaccctggatagattttaaatgcataatttactctgtgtttaccttactttgggaggggggaggaaaacaagacggaagctttttactttgacttgcttgcctaaa

SEQ ID NO: 61147 - DNA, 1050 bp, Homo sapiens
caaatagattttatcctctttgaagtatgctttggtttagagcaatggttctcaatcatggttaattttgcccttcagagtcattggcacttttgttgtcacagctggggggttgcgttcctggcatccaggaatggtgctaaacatcccacaacacataggatgacagccccccacaacaaaaattgtctagctcaaaatgtcaacagtgttgaagctgagaaatcctggtttgagcaaaatggaaaaaatgggctatttttctagtgagtactgatccttaaaggaatagctaaatccacagcttctacagaagcatccatttcatgggagctctgctgtatcagatcattcaagatggttttccaaaacccagagtggagtctagagcgaacaaccatgtttaccaatatccatatcagttaggcaaacattcttatgtgaaacaagatgcctctcaatttttcaagttcagttcataacctacatttgagattttagctttactattttcaaagtcttgaagtaggagagcaacatgttgtgatttggtggatacaagactttgatgaggagttataggtggacctttatgcgggggggtgtatgtgtgtttgtaacacagctaagagagctacttcttattgtctcttatcatcattgctaagtcatctaaccttaaaacagtgattaagtgccacagacactttaatttatcatgccagtttgtcacaccttagagacagtgctgactcttcaaaggcagctaaaccacaagatagtttatactcagtctcagctaaagtctccccctctcttcccttcctcaactccatctgcctagacagacaggtgacatcagagggatatcaggtaatatctccactcaatttgaaatcttcctaggtactgtgtcttccctgcatctatgtctaggaaaagagtccaactctgtaaaatagttggaagagatttattctcagccaaatatgagtgaccatggcctgtgacagagccctcaggagattctgagaacatatgccaaaggtg

SEQ ID NO: 61148 - DNA, 1028 bp, Homo sapiens
ctcaaactcctggactcaagtgatccacctgtctccgcctcccaaagtgctgggattacaggcatgagccaccatgccccgcctatcatcaagttataaacagtctgtctgaacattgtttgaaaggtgaggccaataataacacatttccttctctctctccacccttgttttgtgtacagtgattccactcagttacaacagcttcataaccaagtcttactggaacaacaccaattgcaaaacccacctccttcatctcctaaggagtttcctttcagcatgactgttttgaactccaatgctcccccagcggtgacaacatccagtaagcaggtgaaggctccttcatcacagacgttcagcttggcccggccgaagtatttcttcccctccacgaacaccaccgcagcaactgtggccccttccagctctccggtgttcactttgagcagcactcctcaaactattcagaggacagtgagcaaagaaagcctcttagtgtctcacccctctgtgcaaaccaaatctccaggagggctttccatccaaaatgagccactcccaccaggcccaacagaaccaacaccaccaccattcacattttccatccccagcggaaaccagtttcagccccgctgtgtgtccccaattcctgtctctcctaccagccggattcagaacccagtggctttcctcagctctgttctgccttctctccctgccatcccacccacaaatgccatggggctgcctagaagtgcaccatccatgtaagtgtcattgaggtttcttgatgtaagatgctagttaagagtcgatgtgcacattgaatagcttgatctgaaacagggctctcattttgtggattcctagataatcttattctcttaggcacagaatggatgtggaacacttcaggacaaaggggatgattactttgaatgattattaataattaaaatatcaggctaggtgtggtaactcatgcctgtaatcccagcactttgggaggccgaggaaggcag

SEQ ID NO: 61149 - DNA, 1044 bp, Homo sapiens
cagagcgctacggcacggttccttctacacactggcagaactgccattgccatcgccccgaggcggcagaatggtacgctctgaaaactggatggttctaacgtaagcaagaaaaacggtgcgcgctgcagctctttaactggaacagcctctgctcggtctacctcgcccccaacagctgcgcaacccaccaccgcgcaggcgcgctgcgtgccgccagcgccatgcgaaaccgactttcccgtctcgcgagagtggggccggccgccttcgcagttctcgctccgccccccacttcttgctcgttccctcccatccccccaagccagtagctgtgctgcgcagctccctaagcggttgtcaccgctggagacggttgggagaaccgttgtggcgagcgctacacgaggcaaacgacttctcccttctttgaactggaccccgcgagcaccagagtcggcgtaactatcgcctgacagggtatctgaagtaaaagggggtaggttgggctggtggtttcgagagcggagtcgggagaaggacgaaaggccgggaggggctgggttggggggtagtggggtggtcgccgctcggaggccgccgcttggaagcggcggggctgcgcctccccgaccatctcccacttcagggagggcggcttgccgatgggaggacttgctcaggtggaattcagtggacgacgccgaggcccgaagtaggggacatccagcattttcccctttccctgctggcttggcctccgccattttgggtacagtggcgcggccacctcggcttcccgcccttccccgctctttttacttttttgttccccagcttccgaaaactgatctagaaggccaggggagggggtggtcaaagctccctggaagggatgagggtgggtagtgaagcgagcagggaaaggccgggcagttgggtggagggaggatcgggtttgccgggcgcgctcccgatggaaatggcgccggatgggcctggcctcccaccgcggcctcccttcctccgcagtctcggcagggc

SEQ ID NO: 61150 - DNA, 3188 bp, Homo sapiens
cttttgagtggcctttgacctcagttttaatctgattaattcagtcattttataatcttgctcttggtgagtttaaactagatttggctaaaatagaggtgggagtgttggcccttcaaagacagtttgatgtgttcaaaattgtagtgcatttaaaagggttagacttctgtgatatttgtccaacgtcaatcagtactcattgcatttttttacttaggctcttgatgttagtggatactggtattatatgcaacttctgaataagttttaaagaatttgaataatcagttgaataaaaacctgaaaagtggtgaatgaaaatttgagagataaggaaaggctagagttggcattcaggggacacaaatagtttgaagactctggtagtagaattatgcaagttttcttaaaattaggcaatatataatattgatactacgaaattcagtacttttccgtaggagggggtcaggtctcattgccttttccgtaccccaaaatatgaaaggtggtctacaattttgttgtggcattgtcacagcagttggccccatgttacatttcctcttgtggcacctctgagaggtgtttcttcattacctcttgacaagagtatattttgattgactgctctatgtgcttgtttattttttatagcatttaaatcaaacggtattgagatggattgggttatgaaacataatggtccaaatgacgctagtgatgggacagtacgacttcgtggactaccatttggttgcagcaaagaggaaatagttcagttctttcaaggtacctctagtattagtcaaagtttagtagtattgtaattttatatttgtattgttttactgtttttaatttgtaaaacccatttgattttggaacttttaagtttaactatgatagtcttggttaatgtattaaaataatatgctccagttaatattcaatacagaatgtgtagaatatgtaaaacctagttaatgtgcagtaacatatttgagaattgtgatgaaatgaaccgtgaattagtatatggagcatatatttgattttgtagccttttttcatgtaatataggtgggcttttagagtgtgtaattacacagtgtttttacactggtcgcaaaaaatttatttaatccagtaatatttgaaaaaatctttcatttgtattatggggtgatgggaaactaagcttttttgttttgttttgttttgtttagacttgttttaaatatttgattcagatgggaatgtttcagcctttaacactgttccccttgatggggttatttgtccttgggttaaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtggggatggagagtttgggatggtgttaaatttttatttttgggggttgtgggtcactattgcttaaatgggggggtagccataacatttttctggggtagtttaaaagaattgataattatctaaatttaacttggaaactacagatttgggtggggaattaatgctaatagttaaattaaaattagattgtttccatttctctgtaggatgttgttgataaatgcttttgtataatcacctatttcctttaaaacacctattatgtactaaaagagacaaagtaaaaatatactttatgaattgttttccgtgactaatttctttgtaaaacttaaatatttaattaagtttgtaggtttaaactgttaacttacggtgtatttaggcaatttaaattgggttatgtatctagatatagaaaaacttactgcattttgcccagtatctaatttacactaatacatttatgctgaaacctgtaccttaaaacatttttaaataggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggtatgtgtatctaatgaacaaaggttctgttgtcattttcttaatgttcctgacactttgtcaagaaatacagaaatggcagtaatttcagtacctattaggttttaaaacctgttcatgaaaatacggattcccatggctagctgtgggacttgactgatgcacatattggcacctagaaaacttacacagaaattaaaattaagatgttggcatattttgacctttttttgcctaaggatgaaatttaatttacatgtctgaacttaattaactttctgagattttaaatttccatcacgttgactgcttttttcataggttttaagttgggaattgcaaacttgcaatcaagttacacagactgttaccacaaaatgtttttgtaaactaaattataaaatttatctctggaaagtgtgtagtcatgtgtttctccttaaattacacaggttatggaggttttgatgactatggtggctataataattacggctatgggaatgatggctttgatgacagaatgagagatggaagaggtaaaataaatattaaagacatttttattcataggtaaattttagtatttgctttgcaagctcttagtggtaatataggaaacttgtataaagttaattcagacaaatttcagtgcattcctatatagagctttataccttgtatagtatgtatgtatacttccctacttgtatctgtaatagtttataatcttggcaaattgtgttttccaggtatgggaggacatggctatggtggagctggtgatgcaagttcaggttttcatggtggtcatttcgtacatatgagagggttgccttttcgtgcaactgaaaatgacattgctaatgtgagtaatttttaataactattagtggttttatacttatcctggtgtctaaatctttaagcattcttaatgttctcatgtttatagcttaataccaaaatcccttgaatataaaaatagatctacctttaattctttttttgagatggagtcttgctctgtcccccaggc

SEQ ID NO: 61151 - DNA, 2132 bp, Homo sapiens
aggagaagcagatgtagagtttgtgacacatgaagatgcagtagctgccatgtctaaagataaaaataacatgcgtaagtggtgtctttggcacacaatcttatttcctaaacgtgaatttataaaataagaggctctaagatctgtaggtaacgcttggcagttgttgggatttaaaaccatttgacctctataatggctttctgtgggctttatatatcgctgtactagtaattaataagcatactttgtttaatattacttaattgatcttttttacaaagcttgtattgatgaattttatccatcattcctttctcccctgttactctttctttttttcttaaagaacatcgatatattgaactcttcttgaattctactcctggaggcggctctggcatgggaggttctggaatgggaggctacggaagagatggaatgggtatgtaaagtttttaaaatatgcagggttagctgcttatcgatgagtctcaattttttttcttttttctttttaaagataatcagggaggctatggatcagttggaagaatgggaatggggaacaattacagtggaggatatggtactcctgatggtttgggtggttatggtaagtatctctagttcagtttgtgttagtccgcatatgtagtgcaaactttaaagtgcaggtattacttttattattttatgcagatatctcctgctgagtgattcttaatatctttttcttaaggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcattgtgggagataatagtatggcgtctgtcctagaatgctttgtgtcagttactaattctaaaatcaaattggtagaaggtggtactacatacgatgtctatgatttaggagagggagccggggcagcctatatatgtggagcctcttgactgaagctatgattcatcttaatgcttgtatccacttcct

SEQ ID NO: 61152 - DNA, 1058 bp, Homo sapiens
ctaattatttgtcaagctctattccagatgtctgcttaagacttgcagtttacgcagaggtgaaccattatcctctaaaattacaccacactacttcttgtagaactaatagtaaaatacatcaacccaaatcttatgaaggcagcacatctttaggagtaactagtatataaaaagtatcaacatcagtggtttgaatataaaaatttatttttaagtcaaagtatgcaacaaataaacctacagaaaacattttcccatcacaatctgttgctttaccaaataatattttgaaaacacattccttcagtcattataaagttcttaaaatacaaaagaaattaaatctgtaagaaagtctagtagaccagatgctgttgtcaagacttgtatgttggtgtttttgctttcagtacatcccacgccatccacctccactcatgccgccttgcccatagtaacctccactgcctccaccaccacggccttaagaaaaagatattaagaatcactcagcaggagatatctgcataaaataataaaagtaatacctgcactttaaagtttgcactacatatgcggactaacacaaactgaactagagatacttaccataaccacccaaaccatcaggagtaccatatcctccactgtaattgttccccattcccattcttccaactgatccatagcctccctgattatctttaaaaagaaaaaagaaaaaaaattgagactcatcgataagcagctaaccctgcatattttaaaaactttacatacccattccatctcttccgtagcctcccattccagaacctcccatgccagagccgcctccaggagtagaattcaagaagagttcaatatatcgatgttctttaagaaaaaaagaaagagtaacaggggagaaaggaatgatggataaaattcatcaatacaagctttgtaaaaaagatcaattaagtaatattaaacaaagtatgcttattaattactagtacagcgatatataaagcccacagaaagccattatagaggtcaaatggttttaaatc

SEQ ID NO: 61153 - DNA, 1008 bp, Homo sapiens
gctggaattaccggtgtgagccattgtcgcctggctgcaatcttgttttttatacttaatccacatcccacctccccaacccagaatattttgaggctaattccatacatatttacatatatatacatctctcaaagaaaataacttattttccattcttcatatatctattcctataaataatgttcttgggggaaaaagttttcacatttaatttttagtgttaccaatttgagcattaatattttcttcctactagggactggtttggctgaaagacaaagaagcaacacattgtaaactttgtgaaaaggaattctcactctctaagagaaaggtaagggagataagaagtgagtccaaaaatttggagtgcaaaaatgctaattttatttaaagtgtttttttccctctgatttttctgtttaatagcaccactgtagaaattgtggggaaattttctgtaatgcctgctctgacaacgaactacctttgccttcttcaccaaaaccagtacgggtttgtgattcctgtcatgcactgctcattcagagatgctcatctaacttgccctgagactccagaactaaatccttatgtatgaaattacctacaatgaatgttatgatgttgtatacaaaggtaaccagacagctctccttaagcggctttcggtcagtatttggtaccagtttatcttctacatattcagctcatggaaattacaagttatatatttccttccccattgtttttcaaaatgtattttcaacagagcatgcttaaaaatcatgtaactcattaaaaggccagagagcagagctaacacaacttgccttatcttgtaaaggccttaaaaataaggcttcagattgtttttttcttctgaattctgtcaatttggtatttgatggtgcctgcagttctcttaatgcactttaaagcttcacagttctgaaactggaaacgcataaaacttttaaaattattaatattctaattcaacag

SEQ ID NO: 61154 - DNA, 2198 bp, Homo sapiens
tagtttgcaaattagcactctgcaacagggctgattttgccgttactgaagttaaactgatttagcaattgctgtaattcttatattggaataaagtttgttgtaaaatttttcacatggcatagaagtgtaagacaattagaatcttacattcctcctcttagttccattcccaagatgtaaccagttttaatattatggtgtgtgcctttccaaggcattttctatgcttatgcaatatttatgtatatgaaattaattaatggtataaatggtttagcaaggattttttcgtggctggcaaatgagtcagtattttgtgactggaaaaccctgtgctgctgaacttgtttactgaaaaatatttgtgaaagaaaatgtctgaaaaatgcattacaaaggccaaagtaataaaccaaaagggtgattttagtaaagaatacataacaactgtcgtgtgagaaatagcactgagcttctgtgtgttatttgtcattcaagggtgcaactggaaactgacttgaagattgagaaggaatggaggcagactttgcaggaagatcttcaaaaggagaaagatgccttatctcatcttagaaatgagactcaacaaatcattagtcttaaaaaagtaaatagtggtaaaactttaaaaattctgtcttgacaaatgttaacttatttaaaaagataaatcataatttacattataccaaggaaatggatatactagtcatcttaaaaaatatcagtaaagagattaagtaaatggaaaatagttgatacagcagctaggaaagagctttggacacaatttgtttcttttaaaaagctaaaggatgtttgtttctaattaatggtatatgtacaatctggagtttcttgtttctttcttttaaatttcattttctgtcttttattgttctgaaggagttccttaacctccaggatgaaaatcagcagttgaaaaaaatatatcatgaacaagagcaagctcttcaagaactcggcaacaagcttagcgagtaatttcttttttccttcaactaagtagtcattattgacttttataaaaggtataagtgtgccaaatctattaggcagaagagtttaaatataggaaagatacgaactaggccgggcgcggtggttcacgcctgtaatccccgcactttgtaattcctggccgaggcgggtggatcatgaagtcaggaggtcaagaccagactggctaatatggtgaaaccctgtctttactaaaaatgcaaaaattagctgcttgtggtggcgtgtgcctgtaatcccagctactcgggaggctgaggcatgagaatcgcttgaacccaggaggtggagtttgcagtgagctgactccagcctggcgacaaagcaagactctgtctcagaagaaaaggagaaagatacaaactattaaacaaaacaaaaactctaaagattaaaaaatgagactagactagagagattttattaaaagttttattcaatttagtagacttagctttgaatatttcccagtagatgaaagctaacactcttgttcaatttattcaatgtcagagaattcagaagttattaatatatttttctcagaaaaacagaagctgaattttcaaaatatccggggagctgtctttgagattgttttgagaagaagccagcatcacgagaagtggaggtggtttcatgcctcctggagacagggcttaacttcatacagtttggttttgttgcagtaaaatgtcactgggatcctgtaaagacaagaaggagaaatggtgttttgcctttctttcatttccttttttttttttcaaagacagggtctcgcctaggcaggatgtagtggtacaatcataactcactgcagccttgacctcctgggctcaagcaaccctttcacctcagcttaccaagtagctgagactacaggcaggcaccatcatgccctactaattttttattgtttatagagatggggtcttgcatgttgcccaggctggtctcaaactcctgacctcaagcagtcctcccacctgagcctcccaaaatgctgggatcacaggcgtgagtcactgtgcccagccacattttccttttgttccccatagtctgtgttttggggtagcagctttgcgcctgattgaacatattgccagatatttggaataagctcaaga

SEQ ID NO: 61155 - DNA, 1062 bp, Homo sapiens
cacttgattcctggcatacacatcctagcataacatataacagtgtggcttcttcacctagtgtaggcataaatcctttgcttttcatggttttgtaaaaaggtagtaacatacctattatgctttgaaatttgattcgttatgctctgcataagtggtaaaggctgtattgctttgcactgttaattatgaacaagaaataaaacaaatttgaagatagtattctgggcatactacatgttatattgaaaaaaaaaaatcacaaaacaacttctagacattgtgtggctctttcacgtttgagtttgtgagttttcccccaaactttgttttcatttagaaatgtttctatttccccatttttcttttatttgtcttcttcacccttttacaccctagttctagcctcagttttacccaaagttgatttgaattacaccagattgcagcaagcagagaaggcgcaaatggaagctgaagatgaggatgagaaatatctacaagaatgtctcagtaaatctgatagtctgcagaaacaaatctcccaaaaggagaaacagctgtgagtatttcactctcagaaacaaatacttgtgttaacataaccccctcatttttttgcacataatgatagaataccaatatttttatttatctaatgatgccagttagcttttagtgtttactttaaaaaacaaaaaaatttagaaaatataattgtaataatacttatgtttttactccctttatgatttacagagtactttcaactctgttttgctgtcttcttgctctaggagagttttattcattcttctgttgtttaacattaatctgatggtcattatgtttctaggtgctgagtataggcttttgtaactacaagaaacttatattattaaaggacatgctgttttctgagaatatatatatatatatatatatatatatatatatatatatatatatatacacacatttttttgagatgaagtttcactcttgttgcccaggctggaatgcaatggcatgtgacctcagctcactgcaacctctgcctcc

SEQ ID NO: 61156 - DNA, 2570 bp, Homo sapiens
ctaagaatacaaaaaaattagctgggcgcagtggcgggcacctgtattcccagctacttgggaggctgaggcaggagaatggcgtgaacctgagaggcggagcttgcagtgaggcgagatggtgccactgcactccagcctgggcgacagagtgagactgtctcaaaaaaaaaaaaaaatgactaatagcactgctttatatcacacaattattttaatgtataaagtaactctgttcatttcaaagtaacagtcccatagcaaaatggtgtaagaaacttataaatactcaggttaacagatcagaactctacttgggaggctgagaggtgggatagcttgagcccagaagttcaaatccaacctgggctgcatagtgataccctatctattaaaaacacgcacacacacacacacacaaacacacacacacaaatcaaaaccaccatagcttttgtttttataaatagggttctgaagatggcttgaaagaaaaaaatgaaataattgcccgactagaagaaaaaaccaataaaattactgcagccatgaggcagctggaacaaaggtacagcatttccagtcttagtttctttttttcttttcttcttccctttttctttattcagttcctacacctgccacaaaaaccattaggaagacatagattaggacatgttttttgtttaagcccagcaggattttgcgtttttgctttggttgttgcatggaatcaagttgctttatattacgctgattcatttgaagttgtcatattgtagatttttcttagaggcctaatatcagcagtttcatgtcgttcagttacataaaacaaatacacaaataaaaatgtcaaaaaaattaaaaatgaacaaacagagtgagattatccctgattgatttccatgcatattaattgtcatattctttgccattcaccatctgtttatctgaaatcaagcattccgaattggtggtttagttttgtttctttgagctaggaccctcaacccaaccgaggatataattttgtttaaattgaattgttttatattggcatttttcacttttattgttggaaaatgtaatgtatttccattgccctgtcatgttggtgtcaacatatgtcttttatcattgctttctttgaatctacttatgaaaaacataactattaatgctttattgacatgaatattcttttattgacatcctctttcttcttttttcttttttgttttctttatccccatttttacattttggacatttttattacctttttctgtctttgatttctttccattccattatgaagtgacaacgatttgttaactcaaactaggacaattgcaatgtcattggtgaaatgtgccagcagtgacacgcaggaccagtacaagctggttaaagatatatctttctgaagaccacttgtatttaaacagactaaatgaaaagagaatcaacaattttataatatattaaatagaaaggaatctaaatgctattaaatattctaaaaggatgttaggaaccctgtacatttcttggtcagctgctgtggtaatacactgccatcaagcagagtgggtgcacttggatttccagacatacgttcctcaaaccttgtgcacaaagggtgatttgagtattgaccctttggaggtcaggattttcaaatgcagttttatctttttagctactttttgatgaaaaatataaagattgtttaaaaataacttaaccttcagttttatactgtgttggcacagatatttttttctcattggcccactctttgcccaatggctcccttacagatttttacatatgctttaaaataatttataacccagactggccaacaccctgtgcttcagcttctcagttttccggttctcccttgccctcttctgtgatagcacaacttcaaggcctacctcactctgacttctattttcctttttgtaaccttagagaaaagcttgggtccaatcccagcacctgaatattttaatttaaacttggatttggagataacttaaatgttactctcccttccttggaagcagcatttatacccctgaaatatgtgagggttgctccattggtatggttttaaggaagaaaggaagaggaagagttttttagttagttgaaccgaaatttctcttgtgatttcctgcaaggagttaatatcctttgaatcttggtaaatattttcttataaaaatattgaagttaaatacaagaaatcctagatggccaaagaaggcagggagtggagctaagcacaggaaaatgcaacgacttacaaataaaaacaggaaagatgaaaatcacaatgttttagctaatttttaatattaaatggtgaggaacaaaaatgatctctagcaaatgatgccaactggcaccaaattctttttgaatcttaaacatatatgcacacgtgcacacacacacacacacagagcttcggcataatttagtaaatgcataaagatgccgtaagaaggacttggctatcatttggagtaattgcaggtctttgctcttggcct

SEQ ID NO: 61157 - DNA, 1030 bp, Homo sapiens
attaataaataaaaaataaaaaatataaaaagttattcacacgtataaaggctaatttgaaggcacctaactgagatggcttccatttctgtaaggtagaagattaggaagataatggtgattttaaattttagtttttgaaataaatttgtgatttaaagtccttattttttaaattttcacagtgagttttatgagtatcacgcactaatgatggaagaagaaggagcagtaattgttgggctgctggttggcctgaatgtgatcgatgctaatctgtgtgtgaagggagaggatttagactcacaagtaagtgaaagtgactagtgccaaatgcagagtgttttcagtttgcacagttcctccttgatcaggtgtcatttgaagttgtaaacaggactgttaaacactaaaggaatattaagagtaacattcagtaaaggtacttctgataaagtattttctcccctttaaattaaaaaaaactttatttacttcaggttggagtgattgatttttctatgtatttaaagaatgaagaagatattggaaataaagaaaggtatgattttcataagttatttcacatattgggttttttatatagctctttacaaatcattataagatccatctatttacagtgtggttttattttgttgttttcccccctgtgacttcttcatttcattttcacttccattacaagctttacaaagcagattatggaaaatcacttaggagaaggaggttttattaatagtatgaagtgggacctttggttatacctgtagttactgagacccattttaatagtggttttttggaataaaagagatgaaagcttattattcacaagtttgcaaatactggtttacttcaagatcgaactatgtttttttttttttgagacacagtcttgctctgttgcccaggctggagtgcagtggttctatcttggctcactgcaacctccgcctcctgggttcaagcgattcttctgcctcagtctccccagtagctggaatta

SEQ ID NO: 61158 - DNA, 1025 bp, Homo sapiens
ggttccaaaagattataatactgtattttgactttaccatttccatgtttagctgtgtttagatacacaaatagttaacaattggttaataattgcctacagcattcagtacagtagcatgctatataggtttacagcctaggaacaatagggtatactatatagcataggtgtgtataccatctaggtttgcaaatgtacactccatgatgaaattacctaacaacgcatttttctgaaagtatcattaagtgacacactactgtgtttagagagtcatttcttccaagacattaaatagtacctggatgtcctacaggaggaacagatttacccagctctcagggattggtttgtgtgctcaaaaagataaacctataaaaatgaaaacaaaaccattataaaaatgccctttttccttgttaatgtttacctctagagacagaagatgtgatctttgggctagggctgttttctgatcaattggttcttctctttaggacccctctgggtcgagcaagagcgtggcttcgattagccctcatgcaaaaaaaaatggccgattacttacgttgcttaattattcagagggatctcttgaggttagtactattaagtcgtgatcttttcattttttattttatttatatgctgtcttccaaaaaggatttaagatgtaatatgaaaggatatataacatataataaaatgatataaaataagaggaggagcaaaatgagacagaaaaacatgatagagacataacatggatcaggaactagccttacatatgaataccataagctttgttatcagccaggatggggaaatttatatatattacatttcttcctctttgtttaaaaattttttcttttgccctgcctggaaactgccgtatataatacatttctgttagttttatttttctgaatatggttaattctatggataaaaatttgtgttggaatttgtggctttaatttcataggctttttgttttttgtttttttttttagaatttg

SEQ ID NO: 61159 - DNA, 1016 bp, Homo sapiens
taaaaaaaaaaaaggcattataaaaaataaaataactttttatttgtgcttggtttgtttaataaacttataaagatcaatcagctagggccaccagcctttattttggtattggtagagaatgagtgcagtcatttttcactttaattaccttactgcatatttgatatgaaagaatggtcactgtgtctttttatcatgtggaaaaaaatagcaggatgggcaacaggatcctactggcacaggctccagatccactgggatatgtagtggataaaagaggaaagatctctgaataattgtatgttaagttagaaatgttgaaactaaatatttaaaaataagttactacagttttttatgttgacattgtgtgcattatgtgttctttttttcagtaagaaaatcatttttgagttacaacaaaaccatctggggccctttggaactggtggagaagctgtaccccgaagcagaggaaataggagctagtgtccgggatctacctggtctgaagtaaggaggcctattacttgttcatccctagccacagaagtgtattcattgttcctccaaagtacctcacactctagcttattgtcttctcttagtcttaagtccccttcttctaatcctcttataataaaattatgttcattctttatggctcaactcaaatcccatttcctttatgaagtttttcttagcctcttcgatcaaaattaaccactcaccattctgccttgtattgtaggaaattgaaagtccttttaagataggatatatcagttatgcatctttgttttctgagtgttaaattagtttgcctgtagtagaaagtcagtaagtattgaggaaagactgatttaggctgaatccagggcacaggctcaggatattccagttctcagataagccagttgtataccctaggactggtgtacatttctttgcttcctctgaaaattggtacctataatgtcaccagcctgtttcatcagacaaatgtatgtaaa

SEQ ID NO: 61160 - DNA, 1044 bp, Homo sapiens
taacctccatttttgttaaggtaatttagaattttcaaggctagcaaatattaaagtgcagaataaaagaatgttagactgtaagacacttacaatctggcattaagtctcgtttattaagataagggggggattgaagccccattgtttttattttgagaaaatgtatctaagacatgtaatattttataatgacatttggagttttcatttacgataataactttttgtaatgtcagctaattctaattgagacaatactatgttgtagtgattaggaattggaaatttttctgtgaaagaaatagcagaaggtgaaatgtatttctttgtactgtgtgtgtgtgtgtgtgcactgttttagtagcatataatcctttacgttctcatgaaactaaaaattaagggagcaatgtctaaggaattatttcatcctgggaaatatggacagatttagagcaaattcagtaattgtattcagtctttgagataggaaagtttgttataaacatcagttgggcacataatgtaaacatttaattattaaattcagaaaagtttaacttaatcaggatttctttcttttaaattgtgtctttttctatttaggctggatgcagtccctctgatattggtattattgcaccgtacaggcagcaattaaagatcatcaatgatttattggcacgttctattgggatggtcgaagttaatacagtagacaaataccaaggaagggacaaaagtattgtcctagtatcttttgttagaagtaataaggatggaactgtgagttaattgtgtttgctactgattcatttggggcatttctctctctttaaaaattgtgggccgggcgcggtggctcacacctgtaatcccagccccctgggaggccaaggcgggtggatcacctgaggtcaggagtttgagaccagcctggacagcatggcgaaaccctgtctctactaaaaatacaaaaattagccgggcgtggtggcaggcgcctgtaatcccagctacttgggaggctgaggtaggaga

SEQ ID NO: 61161 - DNA, 1050 bp, Homo sapiens
gtttacttgattatttttaatttgtagaaaaaaattaaaatttgcatgctataaatatttcagaattaaataatatcgaaggattcctgatgccatagaacaaaaaccttttgatcttttcatttcaaaaatgagagaaacaaaactacatttcttttacatgttaaataactgatctgttttccttgtttttagcttatagttgcaacaacatgtatgggaataaaccatccaatattttcccgtaaaatttttgatttttgtattgtggatgaagcctctcaaattagccaaccaatttgtctgggccccctttttttttcacggagatttgtgttagtgggggaccatcagcagcttcctcccctggtgctaaaccgtgaagcaaggtaggcagacacttaagtgttaattttaaactagattattttcaaggaacagatttagtacactgataaacatgaatctgatttattgacagagctcttggcatgagtgaaagcttattcaagaggctggagcagaataagagtgctgttgtacagttaaccgtgcagtacagaatgaacaggtatttgtaacagtgttagctaggagtggttttcatgtttgtttccatctaccaaaactaaagttatcttttgtaattcccttagtaaaattatgtccttaagtaataagctgacctatgagggcaagctggagtgtggatcagacaaagtggccaatgcagtgataaacctacgtcactttaaagatgtgaagctggaactggaattttatgctgactattctgataatccttggttgatgggagtatttgaacccaacaatcctgtttgtttccttaatacagacaaggtaaaaaaaaaaatttctgtttagtttttctcattttgtcctattatttaaatttctcagttttcattagcacatgccctaattagagcttatcagttaaaaggcaaaactaggctgggcgtggtggctcacacctgtaatcccagcactttgcgaggccaaggcgggcagatcacaaggtcaggaatt

SEQ ID NO: 61162 - DNA, 1033 bp, Homo sapiens
tggaaaatgtaaaaatgacaggctcaatattagtctgttttgttttgtttttgtttttgtttttgtttttgagaggtggttttgctcttgttgtccaggttgttgagcaatggtgagatcttggctcactgcaactttcacctcccgggttcaagtgattctcctgcctcagcctcctgagtagctgggattacgggcgagcaccaccacacctggctaattttttatttttatttttttttttttagtagagatagggttttcaccatgttggccaggctggtcttgaacatctgacctcaggtaatccacccgcctcggcctcctggagtgttgggattacaggcgtgagccaccacacccggcctcaataataatttttaggagtcagatgaacaagtaagttgtaggaaaatgcagacacaatacttacgtatgtaatataaacagaagtttttttctctttggtcttttcatagggagaagagtggcagttgcattggaaacctgattagaatggaacatgtaaagatagtttgtgatgggcaatatttacataatttccaatgtaaacatggtgccatacctgtcacaaatctaatggcaggtgacagagttattgtaagtggagaagaaaggtcactgtttgctttgtctagaggatatgtgaaggagattaacatgacaacagtaacttgtttattagacaggtaatgaaatgttactttttttgataacagctttattgatatataattcacatctgtgtagttcatccatttaaaatgtacaattcgctggtttttagtatattcacagcgttgtgcagctatcaccacaatcaactttgagtattttcatcaccccaaaaagaaactcccaaggaagaagccctataccctttagtagtcacttttcattttcctccaatttccccagcccgtggcaaccactaacctgctttctgtctctgtagatttgcccattctggacatctcatgtaaatggaatcatgcaatatgtggtctttggt

SEQ ID NO: 61163 - DNA, 1052 bp, Homo sapiens
agagacacaaaaataaatgaagaagctggacatggtgggatgggcatgtggtcccagctactctggaagctgaggtgagaggatcacttgagccctggaattccatgccagcctatgcaacatcatgaaaccccacttaataaatgaatgaacgactaagtcttgctcaaatgttattatgaggtactatgagtgacttacatgtgttttaaaatgtcagtgtgtttcccagaggcagaaataaaaatactgaatatctttgctcttaaaaaaaaagtaacactatagatttgtttttgttagatgatttgctctatagtagaatatttaagtagactgtgaaatatttattaatatagatgtgaatatcaaaaaatgtttctaaggtattatgatgcatcaactagttcttccatgtaaaataattttagtgcaatatgaagacgtagaaatgtaaaatatgatttgaattgttatcctttatattaagaaaatgttttaaaatgtaagaattccatttattctgtttagagtactttttatgatttattataagcgtgtcataaatgggaagggaatatttaaagttctgtgttcagaaagagtaatttgtagaactgatgtgactttttttttttttttgagatggagtctcgctctatcgcccaggctggagtgcagtggcgcgatctcagctcactgcaacctctgcctcccgggttcaagtgattctcctgcctcagtctcccgagtagctgggactacaggtgcccaccaccaaaaattcgcctggctaatttttgtatttttagtagagacgggatttcaccgtgttagccaggatggcctcgatctcctgaacctcatgatctgcccaccttggtctcccaaagtgctgagattactggcgtgagccacggcgcccggccctttgatgtgactttaaagacattagaaggccaggtgtggtggctcacgcctttattcccagcactttgggaggccgagttgggtggatcacctgaagtcaggagtttaagatcagcatggtg

SEQ ID NO: 61164 - DNA, 1420 bp, Homo sapiens
taccatcaacgggtcatataagatttatttcaggcctggtgtggtggctcacgcgtgtaatcccagcactttgggaggccaaggcaggcagatcacctgaggtcaggagttcgaggccagcctgaccaacaaggtgaaaccccatctcttccaaaataataataataataataataacatagctgggtgtggtggcgcacacctgtaagccgaactactcaggaggctgaggcaggagaatcgcttgaacccaggagcagaggttgcagtaagccgatatcatgccattgcactccagcctgggcaacaagagcgaaactccatctcaaaaaaaaatttatttcaaatgccacatttctgattttattcagccaaggtactttgattgtgccattgaaaacacgagtgcagtcatcagtttgctctgccagcctggaatctctgttccttctgtgtaggaggcaaattttattcatccttgtatgcctacattgtagtgcaagaatacatttgtatgaatcaatcagtgaggaaggttaaaagtttaggaatctttcccagaacagcccggttatacttatgtgtatacgaataaaatctaagtgcagaatgggggtagaatggtgtgaaatgcaatgagggactgaatcctttctcttcacttgaagtttgacctggaaggaatgaagattccatgaacagcattttccttaccacggtgaccccattaaaatcctggattcccttgtctgtgtcatgactgctggaagaagcaatagctatcaaacatttagagaaaaattcagatgccctagtcagtcttaattctggcgtaatgccactggttattcctcctaattcggaaaacttagctcttcctgccctttcatttcttcattcataaagtgaatacgaccaccactgaggtccagggccaaataactaacagaaatattatgatgaactttgcagacatccagcccagagtcagggaacacagccctcatctggtttctctctttggtgttgagggcggttttccgttgctggcgacctagacattgctcaatggtgtcatctctgacctggcaccttcttcatacatttataaacatgcaatttagagatcctaaaaactttttctagagctcccctgggaaaaaagttaatgacaaaatcttgacacctctctacgtcttcttcggagacagagaagttgagagaggtggagaacgagggggagggggagggggtcgagagggagtcgaggagggattccagctccagtttgggtaaatccagctcgcgttttgtctctcgctcaactgtgcagggtccagcgaaggcagagccccagcttcactccctgaggtctgtcctggggagacactgctgctccggggggctgacctggcgggga

SEQ ID NO: 61165 - DNA, 1122 bp, Homo sapiens
tgcctcaggggtgggctcgttccccgcctcgaccccccaccccgggacgctcgggacgcttttgttgccggagataaacaatgcccccggccggaggtatcggccacccgctccggaggccccgccacagcgccgggttgggggcagcgggggcgcctggggctctgaccccgggctgcggtggaagcggggctgggggagggcaagtgtggcgtgggggagatggctgaatataccagcggttggttccctggcccctttggggagttggaggtcggggcgcctcggggtgaggagaggctagagtctgtgcaagttgtgagtggggagtccgggctgtcccgtgctcaagcgtaccccctaaacaagttttctccctccccccatatatatatgagagacaggttggtagggaaacgctttggcgcctgtctccccgagagttttgggacggcagctccagggatgaaacgtttggagtggaggcagtggtgcagtcttgctaggagttggctgggagttgtaaggatcagggaagaagggaagagggagtagagtgtgttctgtcaaaatggcatttaagaaactcatttatgagcaccactgggtcgctggacgcgctggccttgcgatcccatcagtccccgtctggcgggatcccggagcgggccccgagggtgggaggtgcgcggagctgggtgctggggctggtcgtgcagcacgtgaggggcctggtcctcgctctcgggcgaggaggcggccgcacaacctaccgcccccagagaaaaaatgctctcctctctctctgtgcttccctccctccctccctctcccccgctccggtccccgcctctctcgccccaggctcttgaatatatatatatatatattctacaagaagtggtctggaagggactggccgacgctggtaatctttccacgtgaacgagaaacccacgctgggcatttctgatccactaaaaactaaagtgtttccaaaagaacacttaaagcttcagcctcggagtctttcccgcgcccccaactcgtccctctcccaaattaaccaacctttctgcatacgtctcttagggtgcctcttcccctccgtcccggttccac

SEQ ID NO: 61166 - DNA, 1016 bp, Homo sapiens
cttttctctttgcaaagatgaggagtccaggcttacaactctgggactgccactttccattttaataagagttaactatcgctctccgggctggtctcccagaatagatgggtgggagggttgggtctccactgtccctgccctttgtttctcttccttctcccatctgatttgtctcccctcccccaccttctgagcgtccgtatcttccctgcacacttgatttcccctatccccttggtcttttagttttcggccttttgatcccagttgcctttttatgttctagctttattactatagatgtcgaaccccttcctcagtttttactataagtaatttttgcccttcctcagttttttactatacatttcttccccttctttcgtttttggccttttttgttttctttttgggcattttcttccttctcttgctttttcttctacttcctcctgttgtgtgttatgtctttcttgtcttcggaaggacagttctatgtccattctaacgtctcccttcccttttcttggcccttttccccccttttttcccccttcctctctgcagggcagaggggtgttttacatatggaaggagccattgactaaatgtgctggcattctagtgagtttccctgaacagcttttacatgtgccgagggctctcacacttcctgtggtagaaaactatctaggaacagcaagcagttgcctgcctgctcttcctttcgaggtagaacttagttgctggaggaaactgagccaggtgctgccttttttaaaaaatgttttaaatcttgtttttctctgccaagtgcaagagcctttaagttctgtagagctgaatggagggactatgaaatcagtctcttgcaactagctctatgtatgcaaataccacgtttttggccactgctggtagtgggaagaattgaaatatgactttaatttaacatgcaggctggattgttacatcagttaagcatttttgcccagaggattttgggggaatcc

SEQ ID NO: 61167 - DNA, 2933 bp, Homo sapiens
aaatgctgggatcacaggcatgaaacactgctcctggtccttacttttaactggccgggcacgctggttcacacctgtaatcccagcactaggggaggccaaggtgggtggatggcttgagcccagttagagaccagccagggcaacatggcgaaaacatgtctctacaaaaaatacaaaaattagccaggtgtgatggtgtgagcctgcagtcctagctacttggggggctgaagtgggaagattgcttgagcctgggtaggtccaggctgtgctgagctgtgatcatgcctctgcactccagcctgggcaacagaatgagaccctgtctcaaaaaaataaaataaaacaattagtagtgaatattctatttcaaataggggaatgcataggaaaaagactcacttcagtgtattctgttgttatttcagaccaaaaccttgtgtgactgagctgaagagcagtgcatccagattctcctcagaagtgagactttccaaaggaccaatgactctgtttcctgcgccctttcattttttcctactctgtagctatgtctcgatcccgccatgcaaggccttccagattagtcaggaaggaagatgtaaacaaaaaaaagaaaaacagccaactacgaaagacaaccaagggagccaacaaaaatgtggcatcagtcaagactttaagccctggaaaattaaagcaattaattcaagaaagagatgttaagaaaaaaacagaacctaaaccacccgtgccagtcagaagccttctgacaagagctggagcagcacgcatgaatttggataggactgaggttctttttcagaacccagagtccttaacctgcaatgggtttacaatggcgctacgaagcacctctcttagcaggcgactctcccaacccccactggtcgtagccaaatccaaaaaggttccactttctaagggtttagaaaagcaacatgattgtgattataagatactccctgctttgggagtaaagcactcagaaaatgattcggttccaatgcaagacacccaagtccttcctgatatagagactctaattggtgtacaaaatccctctttacttaaaggtaagagccaagagacaactcagttttggtcccaaagagttgaggattccaagatcaatatccctacccacagtggccctgcagctgagatccttcctgggccactggaagggacacgctgtggtgaaggactattctctgaagagacattgaatgataccagtggttccccaaaaatgtttgctcaggacacagtgtgtgctccttttccccaaagagcaacccccaaagttacctctcaaggaaaccccagcattcagttagaagagttgggttcacgagtagaatctcttaagttatctgattcttacctggatcccattaaaagtgaacatgattgctaccccacctccagtcttaataaggttatacctgacttgaaccttagaaactgcttggctcttggtgggtctacgtctcctacctctgtaataaaattcctcttggcaggctcaaaacaagcgacccttggtgctaaaccagatcatcaagaggccttcgaagctactgcaaatcaacaggaagtttctgataccacctctttcctaggacaggcctttggtgctatcccacatcaatgggaacttcctggtgctgacccagttcatggtgaggccctgggtgagaccccagatctaccagagattcctggtgctattccagtccaaggagaggtctttggtactattttagaccaacaagaaactcttggtatgagtgggagtgttgtcccagacttgcctgtcttccttcctgttcctccaaatccaattgctacctttaatgctccttccaaatggcctgagccccaaagcactgtctcatatggacttgcagtccagggtgctatacagattttgcctttgggctcaggacacactcctcaatcatcatcaaactcagagaaaaattcattacctccagtaatggctataagcaatgtagaaaatgagaagcaggttcatataagcttcctgccagctaacactcaggggttcccattagcccctgagagaggactcttccatgcttcactgggtatagcccaactctctcaggctggtcctagcaaatcagacagagggagctcccaggtcagtgtaaccagcacagttcatgttgtcaacaccacagtggtgactatgccagtgccaatggtcagtacctcctcttcttcctataccactttgctaccgactttggaaaagaagaaaagaaagcgatgtggggtctgtgaaccctgccagcagaagaccaactgtggtgaatgcacttactgcaagaacagaaagaacagccatcagatctgtaagaaaagaaaatgtgaggagctgaaaaagaaaccatctgttgttgtgcctctggaggtaagcaaacagtcaaggggctgggagacagctgacacttggtatagtgatctatatgcagagacacttctagtgtctctagtgtctctatgtaatagtgaattgcttcactattacatatttttactttggtacaatgttactttaagttatccataaaagaattcctggacctacctgaagtatgtcttgtgcagtgatgccttagctagcttatttttagaatttgtcccagaaaactagaacatacagtttttttctcattacaggatttgatggaaacatagagaaattgtatgaaatgtgtttttgcagagatttcccctatgcctcttttggctagttgcatgtcttttttggcagtcacagatttaaaaattaagagtggaacaaattcattaactccatagcagcctgaaaaaccagaggaattaaacatctttccttttgaaagaacacagttgca

SEQ ID NO: 61168 - DNA, 1076 bp, Homo sapiens
gagatagtcatactgcaaagcagagatgccatgaggagcagagatgatgtctgtaaagcgtcttgcagtgtgtctgctatacaacagatgcttaaaagtggtgggtattgtatatgtttgaagagatttgtgtatttatttcattactttcacctgttttccatcttgccattttattcatgttatgtagaggaaagtaattaagttttctaagtattccatatgtaccatttctcagtatctgcaaaagcatttttcctgctggaggattaagatactttatgaatgaattggtttcactgttcccatgtgatgcagaattatagttgtggtttccagcgagatgactatgccgcagttattttcttgtgcttgtataatgagagggttttggtgtttctgctgtgttctagacagttacactatacagctcattttcatatcatatttcatacgcaacaccatattgtggtgagttttctgtaaaagtaggatcaagggacgaggaagtgggaggacaagacagtggaaggccagagttgatccaagccatggaattttggatggagtggatataggttagatttagagaaaaaagcgggtgtctgttggtttcttctatccttggaggagtaagtaatttgtacaggagttattacagaattgcagggagatttgtctactgggcaacacagaagttaagttgctttccttatttcccattttctagagactctgatactgcattatgagttggtaaaacagactaataaaacaagaaaatcaaaatagtgttctattttctcttcctttttaaagaaccaataacctttattaattaggtacattactaattcacattacttcattactaattaggtacacgcagttttaacaaaattgaaactttgcttgaaacacacacaggaagctggcaaaggaaaggaaggtggaaggagactaacatttttttgaggggcagacacagtgataaaagacttcctattactgtattcaatgctgacagtaaccctaacccatgaggtgtaagtattcggattctcattatgcagaat

SEQ ID NO: 61169 - DNA, 1577 bp, Homo sapiens
ctccgctatgtagcttaggctagccttgaaatcctgggcttaagtgatccttcaaccttggcctctcaaagtgcttggattgcagatgtgagccactgcacctggcctctgctcagaatttctgactattctctcccatcaaaactcgcccagagctcagaccaccaaatcacttagtataggaattgaaacacctgatctatgctgtgttcaaacaagtatagatcttcgtggtgaagcatcaatttgatatttggagttaatgttagttctgatcacattcattaactttcatatatagctaggatgagccttggctttatttattatccaattttacagaagagtgcacacacaggccttcgatgtttgcttaggttgtcaagtgcaatgttgtatggcttcatgagtatcctatacagtgaaaacacctgtctttgggcctttacaaaacagacctctcagcaatatagatattctgtacacctaaccctctgagcctgatttcattttattttattttattttcatgatcacacagctaatggatttttttttttttttttttttgagaccgagtctcattctgttgcctaggctggagtgcagtggcacgatctcggctcactgcaacctccacctcccaggttcaagtgatcctcctgcctcagtctcccgagtagttgggactataggtgcatgccaccactcctggctaatttttgtatttttagtagagatgaggtttcatcatattggccaggctggtcttgaactcctgacctgaagtgatccacctgcctcagccttccaaagtgctaggattacaggcgtgagctaccacgcccggctgatcgacttaaattatacaattctatcataatatatcatggccactttactaaatattgaacaattaacctggaaaaaaatgttcattttttaaagttatattcaaacattcaacagaagaggcataatgtgtaactgaaatgcaaggcacttcaagaaatgtaggactacccttgtgcaaagctgatgggaatgtaaaatggtgcggctgctatggtaaacaatttggtagttcctcagaaagttaaacatagccttatcatatgattcagcaattctactccaaggtgtatactacttgtatacctacttgtacacctatgttcatagcagtaatattcataatcaccaaaaagtacaaatgtctaacaacagaataagggaaaaacaaaatgtgttatgtacatacaaaggaatattgttcagccttcaaaatgaatgaaattctgatacattctacaacatggatgaaccttgtaaatattatgctattaataagtgaagcaaagagaaacgaaaagaaaaatactatatgaaaaatactatatgattccaattataggaggtacttagagtagtccatttcatagacagaaagtagaatggaagtcagtatgggctgggggaaggcaaatgaggagttattgtttaatgggtatggagtttctgtttacaaggaagaaaaagttctggaaatggagaggtgatagttgcatagcagttgt

SEQ ID NO: 61170 - DNA, 1101 bp, Homo sapiens
accatattcattaggttttttttttctttttctttcttttttttttttttttggagacggagtctggctcagccatctaggctggagtgcggtggtgctcactgcaactactgtctcctgggttcaagcgattctcctgtctcagcctcccgagtaggtgggattacaggcacccaccatcatgcccggctaatttttgtattttagtggagacagggtttcctgttggccaggctggtctcaaacgcctgacctcaggtgatcttcctgcctcggcctcccaaagtgttaggattacaggcgtgagccactgtgcccggccaatagtttttttcttacatgaatttgttaaaaatgtgggtgaggggtgggtgagtgagaggtaatttaaaagtggaaaaacaacgcatgccggacttcacgttccaacacggaaagcatgcttttgtggcaaactgaaaggctagggattaagggtgatgaaatgcaggccttccggccctcactctgttcctgatttctggttgtgggaatctgttctgaatccagctgcaagtggaaaacccatctttggctgagcagccggggaggccctcctgccaatccccgaaatgtgctgctgaaactttggccctgcaaggctggagctagggctgtcttccccagatctgtgcagctgtcaaggtggctgtgatgggactgtgaccgccctctacactgcattttggcagtgaccttgagaccagccagctcaccacagctgccctgctctgctgccgctgttgcaatgccaggtggcttaagaggggtcgtggggggcacggctcccggtccagtctttcccagtgtctggcaggtgctagctgtggtgccagctgtcccactgcctaccacccactgggcgtgggggcagtccaggtgtgtgtcgggagatggtggtttgttctacccctggctcaggtcccgatccctgggaagtgggtggttccgtctgaccgcgagtctggtgcgcagaccggccccacgtggggacttgcttggcaggtctgcggatatagatgctcagtgacagttgatcttgggagacagaagagccaaagg

SEQ ID NO: 61171 - DNA, 1033 bp, Homo sapiens
catcgatccaatggtggtgacctgggggatttgtgtgcattgtttttgttgaagcctcctgtgatttcggcgcgaccagatcctctgcagcgaactccatgtcgcagcttgtggctgcctgtgtcctgtggtgagagccgagccgcacaggagatcctttgtctaggaagggctaggctgagaagatcactttggagttgctaagctctgcattgccattggctgcactctttgtggggctgtttttgcaaaaggcatgcccagcacgtctacagtgctggcaggccagggctgcctttaaacaccatgataataataccaaaaagcagtttgcagaactgttccactgtagaggcttcctctgcagaagcaagcaagatggctacctcgtgggcttcgctgtgaagaatgcagaggctaattaagacagactttaaggggaaaaaagggtatttccctgcttcatctttatgcaagatttttttagtgacttttaaagtatacattttacataagctctttaggttctgcctagcaaacatgttgatgattttaaatggtataaatagttttacagagaaatagccaaaaattttggggatgtgggagctaattttatttcttaaacagaggctcattttgcaatttgattttttttaggttataaaggaaaacaagaggccccagagggaaaagaagcccaaagttttaaaggtaatcagctgttgattaaataatatttcattatttttccatttcatatagtatttttctgcacttgggtatatttggagtacagtatatgtgaattctcccagattttcagtagatggatgaatttccactcaactaaagtgttttctctctcttttttttgatgtgctgcataatgtgcatattagcatcctttattttcaactccactcaagtctacagaaagaaaagtttgtatgcagagtgttgtgaataaaatttgtttttctttatagctccctttgtagcatctgcatttgtggtgttgcaccagtgtgta

SEQ ID NO: 61172 - DNA, 1920 bp, Homo sapiens
ggcatcactaaaagttcaaggctagctttagtctaacgaataggtgcttatgtgtttaagatttcaagtggtgtattgctattacaaatgtaagcaacctttgcaagccaccttttaaattcatgaagaaatactaagcaataaaatgacttatctttaattattttgtgtacatttaatttaaaatagttttacctaatcctagctttccttttttacacataaagttttagcactcaaagaggaacaacatgttgaactatgaatgtggcagaattttatttcatttgttgccccagtgtgtaacttgaaaatgttgacacggagaaccaaaccttgccctgctttcaaatttgcctgaccacattgagtttctgcttcctgtgtatatacagcattttcatgtacctgtttcatcaaccaacaagtatttatttaatatttaccacatagtcagcaatgtgctaggcactgtgaaatgaatgaaattgcttgacacaaattttcactgggcctggacaaatagaatcatggttattctcaaggtaaattaaacccttttctgtttttcttctttgtgttgatccatcgacccccatttattccttttccttccaacagagatagaagtttatcattaaaagctccttctatactttctgtgttggctatatccatctcaggcattttgtgaaaaatagatttagtcttcctcttaaaaatggctctcatttgttggggttgtggatggggattagcaggagaaagggatagattatgtggagaaactaatacagaccaagcctagtatctatgtcttcccctgccttggctaggaagtagaattggactttgggaatgcaatttaattctatgtttattttgttagattgtgagtgtcctgtcacctgaaataaatgtaaaaagtaaatatgccatgtgttgctttttggaatcacggtagtggactctggcttaaaagaaaaagaataaaagtgcctgtgggtggccacatttcatctgcaacagcaagcagaaccaaattgttgctcacgttcctctatagttagcaattactgtacaagagcaggaaaatattctaaaaggaaaaaaaatttctgatgttggcatttaaaaatggttttccacattttctgttagacataattttttttctcatccaaagaaagctttgtttctctgcttcacagtagaaatgctaaaaaaaactttcagattttagcttgatgtgtataaaattcatagagcaaatgtagaatattatataatcctatagaagacataaaaaaaatgaaacctgtgtttgggagggagagtgggagaggaatacaactgtcagcttgaggttttatgagtgaggacttcaacattctaggagcatgctacctgggggaccagtgatgggaatctcacagtttatgatttggtcttccatcattatttgctgtctttacatttggtgtcattccagaaatttagtctgcttcctttgactttatccttttagatgttgaaatctcctggatcatttaccctttgtcagggtggatgctgcaggtatcctgattgacttttcattttcatcatctattagaaagtagttggatacgtgaagaacctgattcaagaagttgggtatagaatttgagacttgtttcatcctacactgacctgaacctgataactattgaatccagttgtggggctgaaattggctggcatgtcttatatccctctcctcttaaaaacatacctgttatccaccaggtatgatgactcatatgtgtaatcccagaactttgggaggccaaggcgggaggattgcttgaggccaggagtttgagaccagcctgcaaaacctagcaaaatcctgtctctatgaaaaatttaaaaattagc

SEQ ID NO: 61173 - DNA, 1096 bp, Homo sapiens
ggagggttaaggaaagaactaaggatggtgaagaaatccagatctaatgaaggcagagctattactaatcctaggcctgaagggggatggtgagtggaaaccaggtaatgtagctacagctgagtagaggaagcatgggctggagcctttggtaaagagatgctcttgcaaggagtcaagtggggggtgggtgtgggataaatgccctgctctccagtctcctgctgctttgattggttgatcccaatggggagccagagtgaaaggggagacctctgatgtagtacacgctggtcagccttctgggatgtgtaagaaggttatggaaggtggaatgtaggcctggaagggaaaacaacatactgggcatgactagtgaccacaggggtggtatggtagagtgaacaatagtactagaactgtgattacataagatggtaacattaggcaaagatggctgaagagtacataagaactctatactatttttgcaactcatctgtaaatctaaaattatttcccaataagcatgaggatccttgaggggatgcatttatacattctgtaattagatagtctttttggctggtaaggaatattttctagctatttaattataaaatatcatcagagtagtatttggaagagctgggtgaacaaatataaagaaatgtcagtggatattaaactaggagagtgtctccagaggttgattttaaaaaggcaaaatgaaaactaagggatcttcctgcagggttcagcactgacttgctcttctcttttccttcattccttgatgatgctgataaagaacaagtggggccaggagagtggctcaggcctgtaatcccaacacattgggaggctgaggcgggcagatcacctgaggttgggtgttcgagaccagcctgaccaacatagagaaacccccatctctactaaaaatacaaaattagccaggggtagtggcgcatgcctgtaatcccacctactcgggaggctgcggtaggagaatcacttgaatccaggaggcggaggttacagtgaggaaacaagcaaaaattgccgagatgatgaaggaaaacatcatctaggg

SEQ ID NO: 61174 - DNA, 1053 bp, Homo sapiens
ctccttaagagttcaggagattcttcctatgacaaatctggttttcttaagacaattttgttttctttctttttttttttttttttacaacttaaactttatttacttgattgagagcttattgcacatgaaatgttttatgtggttgatcttaacttcgtttacattgacttcttttctatgctcaagattgttcaattgctgctgccgccgttgtgttttctttcaggatcgaggtgggtaccttcatataatatcttctttttaatttcttctctggcaattctttcctggattctttgccttgcataattatacctacagtgaaaccagcatcccaaagtcaccaagataaacccccctactccaacatcacatgatcttctaattctactagtgaacaaaaaatgtccaaagccagccacaacagatcctaatgaaccatacaatattgaatgccgggcgcagggagtattttcaacatctaaaaatcctaggagcttaagggacttcctctcctcgggctcaccgggctccggcgtggaggccatgaggactactccgcgactccacccgccctgcaccctttcttttttttttgaaagggaatctggctctgtcacccaggctggagtgcagtggcgggatctcggctcactgcaagctccgcctcccgggttcacgccattctcctgcctcagcctcctgagtagctaggactacaggcgcccgccaccacgccccgctaatttttttgtatttttagtagagacagggtttcaccatgttagccacgatggtctcgatctgacatcgtgatccacccgcctaggccttccaaagtgctgcgattacaggcatgagccaccacgcccggccagatcctgttttctactagggtttagccaatatcaagtcatctttcgtggaatgctccctcatgatcaaagatagctttcagggaccttgcctaactccaagcagaaggccatcagataactagttaattcatgatccgacaagccaccaatcaacgtttaggcttttagttct

SEQ ID NO: 61175 - DNA, 3437 bp, Homo sapiens
tttcttggagaagaggtctcactttgtcacccaggctggagtatagtagcacagtcctggctcattggaacctccacctcctgtgctgaagcgatgctgtcaccatcagcctcccgggtagctggggccgcaggtgtgcatcaccacacctgactaattttttttgtatttttggtagagactgggtttcaccatcttgctcaggctggtcttgaattcctgggctcaagcgatcctcccatcttgtcctcccaaagtgctgcgattacaggtgtgagtcactatgcctagcctagttgtcttttctttttgtatattatgtccttttggtattttatgacttcgctgaatgtgtgaaaagcaaaaataatattttaggctgtatccacaggggctttacatttagttgttattaaattttaatcttctatggctgttattcagatatttaagtagatgacataagtaatttctgtattttacaggcagattttgacaacaaaccagtaaatggccccaagtcagaatccatggactacagtagatgtggtcatggggaagaacaaaaattggaattgaacccacatactgttgaaaatgtaactaaaaatgaagacagcatgacaggcatcgaggtggagaagtggacacaaaacaagaaatcacagttaactgatcacgtgaaaggagattttagtgctaatgtcccagaagctgaaaaatcgaaaaactctgaagttgacaagaaacgaaccaaatctccaaaattgtttgtacaaaccgtaagaaatggcattaaacatgtacactgtttaccagctgaaacaaatgtttcatttaaaaaattcaatattgaagaattcggcaagacattggaaaacaattcttataaattcctaaaagacactgcaaaccataaaaacgctatgagctctgttgctactgatatgagttgtgatcatctcaaggggagaagtaacgttttagtattccagcagcctggctttaactgcagttccattccacattcttcacactccatcataaatcatcatgctagtatacacaatgaaggtgatcaaccaaaaactcctgagaatataccaagtaaagaaccaaaagatggatctcccgttcaaccaagtctcttatcgttaatgaaagataggagattaacattggagcaagtggtagccatagaggccctgactcaactctcagaagccccatcagagaattcctccccatcaaagtcagagaaggatgaggaatcagagcagagaacagccagtttgcttaatagctgcaaagctatcctctacactgtaagaaaagacctccaagacccaaacttacagggagagccaccaaaacttaatcactgtccatctttggaaaaacaaagttcatgcaacacggtggttttcaatgggcaaactactaccctttccaactcacatatcaactcagctactaaccaagcatccacaaagtcacatgaatattcaaaagtcacaaattcattatctctttttataccaaaatcaaattcatccaagattgacaccaataaaagtattgctcaagggataattactcttgacaattgttccaatgatttgcatcagttgccaccaagaaataatgaagtggagtattgcaaccagttactggacagcagcaaaaaattggactcagatgatctatcatgtcaggatgcaacccatacccaaattgaggaagatgttgcaacacagttgacacaacttgcttcgataattaagatcaattatataaaaccagaggacaaaaaagttgaaagtacaccaacaagccttgtcacatgtaatgtacagcaaaaatacaatcaggagaagggcacaatacaacagaaaccaccttcaagtgtacacaataatcatggttcatcattaacaaaacaaaagaacccaacccagaaaaagacaaaatccaccccatcaagagatcggcggaaaaagaagcccacagttgtaagttatcaagaaaatgatcggcagaagtgggaaaagttgtcctatatgtatggcacaatatgcgacatttggatagcatcgaaatttcaaaattttgggcaattttgtccacatgattttcctactgtatttgggaaaatttcttcctcgaccaaaatatggaaaccactggctcaaacgaggtccattatgcaacccaaaacagtatttccaccactcactcagataaaattacagagatatcctgaatcagcagaggaaaaggtgaaggttgaaccattggattcactcagcttatttcatcttaaaacggaatccaacgggaaggcattcactgataaagcttataattctcaggtacagttaacggtgaatgccaatcagaaagcccatcctttgacccagccctcctctccacctaaccagtgtgctaacgtgatggcaggcgatgaccaaatacggtttcagcaggttgttaaggagcaactcatgcatcagagactgccaacattgcctggtatctctcatgaaacacccttaccggagtcagcactaactctcaggaatgtaaatgtagtgtgttcaggtggaattacagtggtttctaccaaaagtgaagaggaagtctgttcatccagttttggaacatcagaattttccacagtggacagtgcacagaaaaattttaatgattatgccatgaacttctttactaaccctacaaaaaacctagtgtctataactaaagattctgaactgcccacctgcagctgtcttggtgagtacttgtgtgcatgtgttcttatttcacctgcacaaattacctcaatcatgactgaagcaaattctgattcatcttttttgtgtgatattttttccccattcttattctaactaagatggattaagtaaatctataaccatttttctgtgggaacttttggttctgccacaagaatggaaaattcagctcataatttggaaaaacaaacttggaaaaggtaaacccgctcaagtggaaaaataggctgatatatctctcaatgttgaatgtctgtcaatttatcgtgcgtagcataagaatgaatttcgtaggccaggcgcaatggctcttgcctgtaatcccaacattttgggaggccgagtcagatggatcacttgaggtcaagagtttgatactagcctggccaacatggtgaaaccctgtatttacttaaaattcaaaaattagttgagcatggtggtgcacgcctgcaatcccagctactcggttggctgaggcaggagaatcacttgaacctgggaggtggaggttacagtgagccaagattgtgccactcccctccagcttgggcaacagagcaagaccctgtcttaaaaaaaaaagaaagaaagaaataacttaatagtttattacagttt

SEQ ID NO: 61176 - DNA, 2527 bp, Homo sapiens
tacttgggaggctgagacaggagaatcgcttgaacccaggaggcgaagattgcagtgagccaagatctcatcactgtgctccagcctgggcaacaagagtgaaacgccatctcaaaaaaataataataaaaaataaaggtgaaaaaggaagccacagaagtaattcccctagtatttgacatccagtgaaaatgactttttggtgtaggtataccatggctagaaattcatgaaacgcagaaattccccagtaattcttactacacatgagtctaaggggccaagttaaaaatagcattttttaagaaacataaaattcatgctcacaaaaattcaagtggtgcagaaatacgacgcaaacatcttcctatactcccattctatacaaaagaacattattgattttaattttgtttccatttttacaaaaatttaaaacaatctttctacttggttttttaatataatgatattgtggatgtctaaatgttttataaatattattgtttcaatagatttattgtataccactatataaacatcccataatttatttaaaccacatgttattgacagatgttgagtgttttgctctctttttgatattacaaataattgtaacaaggaacattcttttgtaattgtgcaaatgtatagtagaataaattgtctgcaatgaaattgctcaattttcccagcactttgggaggcacaaggtcaggagattgagaccatcctggctaacatggtgaaaccccgtctctactaaaaaatacaaaaaaaaaattagccgggcgtggtggcgggtgcctatagtcccagctacttgggaggctgaggcagaatggtgtgaacccgggaggcggagcttgcagtgagccgagatcgcgccactgcactccagcctgggcgacagagcaagactctgtctcaaaaaaaaaaggggattgctcaattttaataggattctaagggcaacctttaacatttattgttcttggataacttttagtattacacctcaattaatacagattttttttttaagcaggagataggagtataaatatgacccacatcttaaaatattttttttctcctctgattttcagaggaagaaagaattcgttaggggcaggaagaaaggaacattaaaagttaaatttcatgggctgttgtccttgcctttaattatcaaatcttaccaaaaccttgtcaagattcatggttctgaattgagggggaacaaaaagtataaaagtagcttctcctgtcccctatgcaattctgtaaagctttgggtctaataatcttattccttccacagatcgagttatacaaaaagacaaaggcccatattatacacaccttggggcaggaccaagtgttgctgctgtcagggaaatcatggagaataggtgaggaaatacgcttccctgttaaaatcattcttactgtggatctgactcaacggagataaatcatctctaagaacaaacgccgtgattgaaaaatgatcaggagtatgagttggatgtttcttagggcccaacaaaagaggggtgtcctcgtgtccctactgagccacccatcatacaagctgttgggcacataaaagcacccacaaagcaagactagttgtctttgataaactcagaagtactttttatatatcgcataatggtagaaataggtcaaattaccacccttgacactgcataccctacattcccattgcttgtctggcactcagcctattttttaaagagtgatctttgaggataagtgagtaggactggttaacaaattaaaatacctgccacacaaaagcaaatgtttaacaagagtaaattacgaagagtgtctaatttttgaacttctgtacatctatatcttatatacattaagatgttcaaagccaaagccttcaagtacagattgcaattaattagtacattcccttcactgtgttttatactcaggtatggtcaaaaaggaaacgcaataaggatagaaatagtagtgtacaccggtaaagaagggaaaagctctcatgggtgtccaattgctaagtgggtaagtatttcctatttatacatttttttgaagcttgttattccagagctgatatttatacatttacaatagccagagtgatctttattttatttattcatttatttatttaatttttgagacaggctttgtcgccccggctggattgcagtggtgcaatcacacctcactgcagccttgatctcccaggctcaagcaatctttccaccttagcctccaagtacttaagacttgccaccaaacccggctaatttttttttttttttttttttttttagtggagagctcaagtgatcctcccgcctcagtcccctaaagtgctgggattacaggcgtgagctactgtactgggccagattttttaatagatttttaagtaaattggccatttgtgatgaaagttgcaaatatattttctcagtttgttgtggttttaccagttagatttttt

SEQ ID NO: 61177 - DNA, 1114 bp, Homo sapiens
cttgtctgttgtgcaaactataacagcagtgaaataaaacacagactgccttgtactacttctacaaataataaccacgtgtcacagatttttgttctgcctgttgtttgttagtcatataggttcaggtactcttgtgatgagtctcatggagggaactgttgaggcagtggaaagtcctacagggttttatcccttgagaagtagtaactttaaaaaaactaaaatatggccgggcatggaggcacatgtctgtaatcccagatctttgggaggccaaggaaggaggattgcttgaagctaggagtttgagaccagccttggtaacatagttagaccccgtctgtagaacagattttataaattaagtaaataaactaaaatataatcatggagaacatcaaaaggaatatccattgcattcaaatttggcatacttgtcttccatagatgaatgtattctgttttttcaggttttaagaagaagcagtgatgaagaaaaagttctttgtttggtccggcagcgtacaggccaccactgtccaactgctgtgatggtggtgctcatcatggtgtgggatggcatccctcttccaatggccgaccggctatacacagagctcacagagaatctaaagtcatacaatgggcaccctaccgacagaagatgcaccctcaatgaaaagtaattaaatctgttttatactgccttaccattcagatctctattacatattggtaaaattgttaattagctaccaactatgtatattatatgggagaataggatttgagtattgtggaattaaaaagaatgaacatttctgtaaagagagagtctctattttatagtgagttaaggttactttaaatcattctcctttggaatattacttcactgtgaccaggtgcagtggctcatgcctgtaatcccagcactttgggaggccgaggcaggaggatcatgaggtcagaagatcaagactatcctggctaatatgtctccactataaatacaaaaaattagccgggcgtggtggcgggcgcctacagtcccagctactcaggaggctgaggcaggagaatggtgtgaatccgggaggcggagcttgca

SEQ ID NO: 61178 - DNA, 1510 bp, Homo sapiens
tggtgacagggctagaccccatctcaaaaaaaaaaaaaaaaaaaaaaaacaccaaaaaaaaaaaaaagaaaaacccaggttctttatttccctatctcagacatctccaaatcaaacaatactgtgagtattttagatctgtatagtttattcccacttatttggatttgcaatcatgaccaaatatttctgctaaaaatttggttataataaagtatagttaaccctggtcccctagtcagatttcttgaaaaaacaaaagttagctttttattgttaacattaaactattttaaataagtaatataatagataagtgttataaccggttctttaggcatccatccttctaaagctatagaaacctgaaatgttctctctgaggtattgtaatgcttcatcaattcactctcttgaattacaatcttacagtcgtacctgtacatgtcaaggaattgatccagagacttgtggagcttcattctcttttggctgttcatggagtatgtactttaatggctgtaagtttggtagaagcccaagccccagaagatttagaattgatccaagctctcccttacatgtaagtgtccttctttattcaaataatttatttttgaattacacattgaatatgtaagtgcattcctttaacattttttgaaacactataaaaactaaatattgaaaagtagtaatcaaatagtaaaattatatttctattatataagtaaataaattaattaagactctaaataaattaggtaaagactttagctatctccccaaattccaattgtccctggcttcctcctcctgctctactaccccaccccagcaaaatcatcattaaaagaacctagaattttatactcagccaaaataggaaaaacccatttgccaaaatttcaaagactcagaaagtttactacccacagacctactatgaaagaattactaaaggacgtaatccagaaagaagatatatgaaaccggaacgaatcagtccgggacacgaggccatggtgagcaaagaaattagtcgaacttggtgttaagttaaataagttcaatacttatatattatattaaattaaaataacctataagtataactccacacctttatcagctcgtgggtgggtaggcagtgggagggggtggggcaccaataggaactaagtattctaatgtgttatgctttgtttgtgtagtgaggatttatatattgattaactataagattgatatcttttaatctttgagcagtgaccaagagtaaaaaacattttatattacaagccactatacacatacatagacataagaaaataattagacctatctgaaaacaatacttacctttcttacatgtaacagcagtaacatcaaaatatttaaaaagttaatatcaatgtagttattctaagagtctatgatacatcatttttttatcagatttctttctttttcttttttttttttctttttctttttctttttttttttt

SEQ ID NO: 61179 - DNA, 1058 bp, Homo sapiens
atgtgatagttttcctttgaaaaaatctgatgtctctatcagtagcaatccagatttcttgagtgttaatggtcctcatagtccttcaaagtcttcttcaatttgtagttattatggtgtagaaaagagaactatagacaaccacttgcccacttacttcctttgatctgcaggcatttactaaacctctcagttatcctgaccttgctctttcgtagagatcatgcgtaatattcctgtttcatgggccataaggacatgtgtttaattcataaggacatatggattccatttgaaacaggatctcacacagagtaggtgttttatgtatgtactctctcttctccgttataggaacctgttacattgtaaccaagttacttgccatttccccttgccagcaagaacgttgtttgcatttattccaagtgtgcaatactattgaataaatataaaacatagctctcatttttcacaacatgaacagtattgtaatttatctctaacactatttaaatttctaattaacttagaattttcatttcaaaagacttcattaaagcataacaatgtctaatagtttagatggagaaaagaagcagtgtaattttctgtggtagctattttatcaggataagtatgaattgtgcattaaccaccatcagccatgatttatgattcagttgtaccttaaacacatgaaggtgcgattataaaatacctaatggattctgttttcctataggaaaaaaaccttgaagataacttacagagtttggctacacgattagctccaatttataagcagtatgctccagtagcttaccaaaatcaggtatgtattggtatgaactttttatttatttattaatttgaggtggggtcttgctttgttgcccaggcagcagtacagtggcatgatcaaagcttactacaaactcctaagctcaagcaatgctcctgcctcaccctccaaaaatgctgggattacagatatgccagactgttttatatcttaaaaagtcattgttggccaagctcgttagctcacgcctgta

SEQ ID NO: 61180 - DNA, 1119 bp, Homo sapiens
gcccgcctcagcctcccaaactgctgggattacaggcattagccaccctgcccagcatccaccttttcattttaaaaggagttacaaattgactttcagtaatggttcatgaaatgtatgtatatcttctttttacggatattgaaaactctgtgtatatgattaatgcgcttttattggtctttctttctaatggaatgattgagtctattttacttgcttatccatctccaacaagaattagtatcctcaccctgccttcccttgtaaattcagtgattttccttttactccatgtattgtcaagtgctttctcctgaatgttgctaagctacaccttcatgacaataatacatttagtctcagaaattacaaagtgtaattaattagaaacttcatgaggaaattatttttactctttactgaaggtaggtgatttccttctctctcttaagattgtgctccatgctttcttttctaggtggaatatgaaaatgttgcccgagaatgtcggcttggcagcaaggaaggtcgtcccttctctggggtcactgcttgcctggacttctgtgctcatccccacagggacattcacaacatgaataatggaagcactgtggtatgtacctgtgtgaatttgtattctaaaagctccatcactatatgcttaggctgcagtccttacgtatactgtgatgactattactgtgaaaaatcttaatttatgtgttattagaaataagtggaaaataaagtgaaaaaaaagaaataagtgtgtagtgcaggtcttcattaaatgcattatctatgcacttctaaaaagtaacagggccagcttcaaacaaacattttattgaaaggctatgttacatatttaattgttgtgtttttgctgggaggcaggagtacttttttttaaatttatttatttatttattttttgagacggagtctcactctgtcgcccaggctagagggtagtggcacgatctcagctcactgcaacctctgcctcctgggttcacgccattctcctgccttagcctcccaagtagctggggctacaggcgcccacgaccacacccggataattttttgtatttttagtagagatgggat

SEQ ID NO: 61181 - DNA, 1135 bp, Homo sapiens
aaaattttttttaactgttagcgtataagtctttctggaaagagaaatcaattatgtccctgctatccaaggaatgtgacattcttgaaatatcagaaatatggtgctatgtgagctaaaatcatatcttcctaataagttatacttaatatgaacacaataaacatagttcaatagccattccttaatttaggcaatgaagtaagatgaaatgtaacaagaatgtttagtatcaaaaatacgtaagtattttataacgttatatttacttagaaaattaaatattattctggtctgcctacaaacaactgggaagttactatgattgaacagagttgggtggcttgatataaaataataatataccatcagcaaccaattgaaaataaaatgggaatacaaatctctttcccaaaggcaacaacacgaaggtaggaatagccacaatgaatgtgcacgacccgtatatctttcccatttcatgtttttctccctatcaggtttgtaccttaactcgagaagataaccgctctttgggtgttattcctcaagatgagcagctccatgtgctacctctttataagctttcagacacagatgagtttggctccaaggaaggaatggaagccaagatcaaatctggggccatcgaggtcctggcaccccgccgcaaaaaaagaacgtgtttcactcagcctgttccccgttctggaaagaagagggctgcgatgatgacagaggttcttgcacataagataagggcagtggaaaagaaacctattccccgaatcaagcggaagaataactcaacaacaacaaacaacagtaagccttcgtcactgccaaccttaggtgagccctatggaacctggtaatctctgcacaactttgatggatagatgtgtttggactttgccttgccttatttgtttagagttaaaactaagacactgaatatatttttacatataccagaaccaaaagtcaacaaaaaagtgacccatcagtatttcttggtaactttttcgacttatccttttttttttttttgagagggagtcttgctctgtcacccaggctggagtgcagtggcgcaatcttggctcactgcaagctctgcctcctgggttcacgc

SEQ ID NO: 61182 - DNA, 6396 bp, Homo sapiens
accctgtctctactaaaaaatacaaaaaattagccaggcgtggtggcaggcgcctgtagtcccagctactcgggaggttgaggcaagagaatggcatgagccgagatcgtgccactgcactccagcctgggggacagagcgagactccgtctccaaaaaaaacataaaaataaaaattattagatgaaaaattatacaaaactacataaaatttttaattcgtgtttgtgatttgaaatgaacagaacaaaaccaaccaacacaacatcagcgttttcttatataattctttgtacttgtctttgaaaatactttttaaaaggcaacccctaccaaaagtaatttgtatttttcttcacatttggtgtccttgtttagggagtaacactgagaccgtgcaacctgaagtaaaaagtgaaaccgaaccccattttatcttaaaaagttcagacaacactaaaacttattcgctgatgccatccgctcctcacccagtgaaagaggcatctccaggcttctcctggtccccgaagactgcttcagccacaccagctccactgaagaatgacgcaacagcctcatgcgggttttcagaaagaagcagcactccccactgtacgatgccttcgggaagactcagtggtgccaatgcagctgctgctgatggccctggcatttcacagcttggcgaagtggctcctctccccaccctgtctgctcctgtgatggagcccctcattaattctgagccttccactggtgtgactgagccgctaacgcctcatcagccaaaccaccagccctccttcctcacctctcctcaagaccttgcctcttctccaatggaagaagatgagcagcattctgaagcagatgagcctccatcagacgaacccctatctgatgaccccctgtcacctgctgaggagaaattgccccacattgatgagtattggtcagacagtgagcacatctttttggatgcaaatattggtggggtggccatcgcacctgctcacggctcggttttgattgagtgtgcccggcgagagctgcacgctaccactcctgttgagcaccccaaccgtaatcatccaacccgcctctcccttgtcttttaccagcacaaaaacctaaataagccccaacatggttttgaactaaacaagattaagtttgaggctaaagaagctaagaataagaaaatgaaggcctcagagcaaaaagaccaggcagctaatgaaggtccagaacagtcctctgaagtaaatgaattgaaccaaattccttctcataaagcattaacattaacccatgacaatgttgtcaccgtgtccccttatgctctcacacacgttgcggggccctataaccattgggtctgaaggcttttctccccctcttaatgcctttgctagtgcagtgtattttttcaaggtgctgttaaaagaaagtcatgttgtcgtttactatcttcatctcacccatttcaagtctgaggtaaaaaaataataatgataacaaaacggggtgggtattcttaactgtgactatattttgacaattggtagaaggtgcacattttaagcaaaaataaaagttttatagttttaaatacataaagaaatgtttcagttaggcattaaccttgatagaatcactcagtttggtgctttaaattaagtctgtttactatgaaacaagagtcatttttagaggattttaacaggttcatgttctatgatgtaaaatcaagacacacagtgttaactctacacagcttctggtgcttaaccacatccacacagttaaaaataagctgaattattatttcatggtgccattgttccaacatcttccaatcattgctagaaaattggcatattcctttgaaataaacttatgaaatgttttctctcttaaaatatttctcctgtgtaaaataaatcattgttgttagtaatggttggaggctgttcataaattgtaaatatatattttaaaagcactttctatttttaaaagtaacttgaaataatatagtataagaatcctattgtctattgtttgtgcatatttgcatacaagagaaatcatttatccttgctgtgtagagttccatcttgttaactgcagtatgtattctaatcatgtatatggtttgtgttcttttactgtgtcctctcacattcaagtattagcaacttgcagtatataaaatagttagataatgagaagttgttaattatctctaaaattggaattaggaagcatatcaccaatactgattaacattctctttggaactaggtaagagtggtctcttcttattgaacaacctcaatttagtttcatcccacctttctcagtataatccatgagaggtgtttccaaaaggagatgagggaacaggataggtttcagaagagtcaaatgcttctaatgtctcaaggtgataaaatacaaaaactaagtagacagatatttgtactgaagtctgatacagaattagaaaaaaaaaattcttgttgaaatattttgaaaacaaattccctactatcatcacatgcctccccaaccccaagtcaaaaacaagaggaatggtactacaaacatggctttgtccattaagagctaattcatttgtttatcttagcatactagatttgggaaaatgataactcatcttttctgataattgcctatgttctaggtaacaggaaaacaggcattaagtttattttagtcttcccattttcttcctattactttattgactcattttattgcaaaacaaaaaggattacccaaacaacatgtttcgaacaaggagaattttcaatgaaatacttgattctgttaaaatgcagaggtgctataacattcaaagtgtcagattccttgggagtatggaaaacctaatggtgcttctcccttggaaatgccataggaagcccacaaccgctaacacttacaattttggtgcaaaagcaaacagttccagcaggctctctaaagaaaaactcattgtaacttattaaaataatatctggtgcaaagtatctgttttgagcttttgactaatccaagtaaaggaatatgaagggattgtaaaaaacaaaatgtccattgatagaccatcgtgtacaagtagatttctgcttgttgaatatgtaaaatagggtaattcattgacttgttttagtattttgtgtgccttagatttccgttttaagacatgtatatttttgtgagcctaaggtttcttatatacatataagtatataaataagtgattgtttattgcttcagctgcttcaacaagatatttactagtattagactatcaggaatacacccttgcgagattatgttttagattttaggccttagctcccactagaaattatttcttcaccagatttaatggataaagttttatggctctttatgcatccactcatctactcattcttcgagtctacacttattgaatgcctgcaaaatctaagtatcacttttatttttctttggatcaccacctatgacatagtaaacttgaagaataaaaactaccctcagaaatatttttaaaagaagtagcaaattatcttcagtataatccatggtaatgtatgcagtaattcaaattgatctctctctcaataggtttcttaacaatctaaacttgaaacatcaatgttaatttttggaactattgggatttgtgacgcttgttgcagtttaccaaaacaagtatttgaaaatatatagtatcaactgaaatgtttccattccgttgttgtagttaacatcatgaatggacttcttaagctgattaccccactgtgggaaccaaattggattcctactttgttggactctctttcctgattttaacaatttaccatcccattctctgccctgtgattttttttaaaagcttattcaatgttctgcagcattgtgattgtatgctggctacactgcttttagaatgctctttctcatgaagcaaggaaataaatttgtttgaaatgacattttctctcataaaactggtcatctaacattatttctacccctctattatgttttactgtaatgatcaccttttcttatacctctcttataacacttaaattgggttttaaatctgcgtttgttcatagtatgatcattgaattcactgatacatgacctcctaatagcccactcagttcataatatgctacaaacttaccaattttaatgagagaataattcctgcctattgcagaatcgtacaaaatatcatgctgcccttgatattccatttcttttttcttttttcttctttttttttttttttttgtagagactgtctcactatgttgcccaggctggtctcaaactcttggccccaagagatcctcctgcttcagcctcctaaagtgcaaggatgataggcatgagccactccacctggcctgaaattccatttctaatggctcttcagccattgttgaaatttcttttttttcttgtgcttgtctgtctcacctacctcttgtttccaattcatctacaaagtaccaaatagaccaggtcataaacataattgaaatacattcttattggaaagtgaggctatctgaaaaggcatagctgtaggcaaattattgcaacatgtttacatcttaaataactttccaacatctttgttactcagtctgcatgttgataatttcatttattaaatatagaacttcaactagatgagatccataagtaatttacttaagacataaactcaatacatatttaattgaatgcatacccttgtgtaaataagctactgatttaattcacatgactaacctactttctaacattattacagtggatttctactgataacatttcacaatagcgtgtgtgaaaataaccctgaaccagtttttaaaacaaaaattatattgactttttatctgggacataggactttattgcacgaaacttccactgacaggggcacagcatttccttcgcatgtgccaactaaatcagtagctgtatgcaaactttaatagatttatagctactaccttcaatttcacaccttgatgcatggaaatcttttttatctagatttaatacaactgtgagttttgatcttttatagagatttatgacaagagaattttgaaataagttcatatagtagtggcctctcatagcaatggaagacacctgagaaatcacagagctcaatcactggggcccagagagcagatcttaatgctagattgtaattagaatttaaatagatgaaggccactttgtgttgagaactgtagggaaacttgattttcttacccaaagggtattttatcactgggaaataaacaagtatcagatgcttataaagtataggctttcaattcccctggaactagtgttaagcatatacaagaagttataaaggcatggatgattgaaataattaaggaaagtgtatttccactgtatatactacctagccatgcttacaaagttcattcatgccctttgcctagttagcctcacaattaagccccagcatagtttattttgatgtagctgtctacatgtattggaatactattttattgcacatagcttctaaacttgcccataagtatattgaacaccagttgtgtggcacactcaaccaagtgaatgtaatcaatacgtaattgctgaaggagtctggatttatccaaatcaaattatgctccatgttgagctacctcttaacagctttagaaaatgatgtcatccattgctctggaatgcagttcagaaagtcagactcagtatgtccatcagaaattaaatttgtgtgttttcatagaatgtattgagatttattgaaatgttcttgcttttcctatatgtataaaggggaaactgagttcctttattacttcctgagatggtagagctgacttttatgcaggatatcatcactatttttgtctgcattgatagctacaaattttattattatttttttggtacaaattttaattctctacctttcagtgtctggatgactttttaattccctatttcttctgggcttccaatcatataccattgtttgcttcaaaagggatatattatactctctctagtaatccaaaggtattcctaattttgccactcctcattttcgcttctctttaagggccttatagtatgttctaatttctcatttggtagtatgcaacattcaatatttctagctctaaagttccatcattaattatttctttttttctttttttttttctttttttgagacggagtcttgctctgtcgcccaggctggagtgcggtggtgtgacctcagctcactgcaacctccgcctc

SEQ ID NO: 61183 - DNA, 2355 bp, Homo sapiens
taatcccagcactttgggagaccaaggcgggtggatcacgaggtcaggagttcaagaccagcctggcctagatggtgaaatccccgtctctactaaaaatacaaaaattagccgggcatggtggcagacgcctgtaaccccagctacttggtaggctgaggcagagaattgcttgaacccaggaggcggaggttgcattgagccgagattgtgccactggactccagcctgggtgacagagtgagactccatctcaaaaaaaaaaaaaaagcaaaattgttggcatctctaagacagagcaagactccctctctaagagatagtagtgtctcccacttaattgaattcgttttgttttgtttgctttgctttgattcttgccacgtaaaatctgtgggtcttgacccagagatttgctcagacagttaagaaaaataataagatgtatttgtaaatttttacataatgaaaaatgagatgtatttgtaaaattttaaaataacctctttataaatacgtttataaatataaagaggtaggatgttttggctaattagcacattctgggtcatacacacacacacacaaacaggccaaacactctagatagtcaaataaattccccttttggtgattcagttcagtaatggtgattcagttcagtaactgcctatcctcatcaatgcttgtttgtgatgatgaaatagttgacaaccgggactttacaaaaatagctcctgaaaaaaattaaatattttattgcaatatatgttcatattttttttaacttttatgaaataacattgtgataggtgctttaagaaaaatatttttccagaagtggtttatagtataaactaagggcagtttttacattgtgatgtgtgggtggatggtcatatttagttaggttattaagaaatcatgaagtgttccctaacaagaaacttgcaaagctatttggcaggaagaaaatcattaacttctagtttatttattttttttctcatgctatacgcttaattaccaagtaaattcacttgcataccattaccttaattcaaaggagaagccagaatgtttatcattggtgggagtaaaatatacacagattctttaccatggtgaaatagaataatactgaattcccaatacagaaatactaatttcataagctaatattcctatcttttagctgacttctttctctcttcaggatatatttactatttattatttacctttgaatttttgatttgggggatttttacctattgccatcctactatcttaagtatcctgtacaatgaaatatcttagcaaggaaacacttttaaaacttcacaaatatccaatttcattcttaacatatgggggaagcagtaaaagaaaaagcacttcaccacgtagaagagaaagtgatcattttaattaagataatttcaattcattatcaacatttaatcctctgcaaacaagggaacacttactagcagtacttgaagacttgtgagttggaattgcatgttacttgaaagatctaattaagctaaattttggtgcacagcaggttgtacatgatttcatgtttatgtagcaaaatgcattgaaatgtattagtgttgaaacatacatgtaaaggtagttgtggaaattgttatattttccttgtgtgtcatttatttagagcataaaggttttttttattcagcctaactgaataaggctaaatgaatactgtaattgaaaatatattttaaatctttgtcatgagtttttttaaaaaaaactattgcaaattgtatcattcctgattacacagaactttgtgggtggttttaaataaattttatacttctattttgcacctgatagtctaatttttctttccttctaaaaatcacatttaaaagttttaatattcaataaaattcacacattttaactacaaaggactataagatttaatatttggagatgactaaatgtatgcatgtgctcaccataaaaccaaaatggctagcatttgtgaaatcctcattatgtgccagaaaccttacattttatgtaaattatgtaattcccatggtgattctattaaggactcttatcagcctcattacatagatctattctgaggcttgaagttattaagttcacagccctagtaattggcagagctgttactctactcatgtccttacttggctttataattgtttcaataaacttaatacttttccttaagtctgctaaatttaaatttaattctgaatgcagtttgccaatatattttactttttttactttttttttgagacagtctcacactgtcgcctgggctggagtacagtg

SEQ ID NO: 61184 - DNA, 1049 bp, Homo sapiens
tgtacccataacacattactagtatcttaagatattaaagaaatttcatgagaaaatagttttgtggtcaaagtttgaggaatgctgagttcctttactatacttaggactttcctaagcctttattatgccagtatggatattgtattagtaagaacactcatctaagggatcttgatgaaataggctaaaaataatttatagtttaattttagacctgactctcaagatgtacatgtatatcttctaacataatatgaaatttttaacattctgggttagttttaagtagtcatattcagtttttagatgatttcaaatcattaccttaatttgatgttgattttgttttatagccagctgttgcactgcctacaagccttagcctgtctactcctcagccaacagcacaaataactgtatcatatccaacaccaaggtccagtcaacagcaaacccagcctcagaagcagcgtgttttcacaggggtggttacaaaactacatgatacgtttggatttgtggatgaagatgtattctttcagcttaggtaaacttaatgaggtcttgtcacatggcttcttgcatttaccacaaaacacctgtttagttgtggcagaaattgtatgtagcccaggctggacacagttgtgcaatctcaagtcgactcactgcagcctctgcctcctgggttcaagcaattctcttgcctcagccttcggagtagctgggatgacaggcgtgcaccaccacactcggctaatttttgtatctttattagagaatgggatttcaccatgtcggccagattggtctttaaactcctgacctcaagtgagccacccgcctcagcttcccaaggtgctgggattacaggcgtgagacactgcgcctggccagtgtagctatgattttctttccttttttatttgagacagagcctcactcggttgccaaggctggagtgcagtggcgtgatcttggctcatcacaacctccgcctcctgggttcaagtgattctcctgcctcagcctcccgagtagctggg

SEQ ID NO: 61185 - DNA, 1032 bp, Homo sapiens
tttattattattattattatactttaagttttagggtacatgtgcacaatgtgcaggttagttacatatgtatacatgtgctatgctggtgtgctgcacacccatctactttttaaagagctttccaggcttccatttctgatatagtttactgtttatttttttttgagatatggtttactttaaagtactaactatgtaaatcattttggggagaaatctattttaattgtatttatatttaactttttttttctttttttttttacagtgctgtcaaagggaaaaccccccaagtaggtgacagagtattggttgaagctacttataatcctaatatgccttttaaatggaatgcacagagaattcaaacactaccaaatcaggtacagaaagtattgagttaggtattatagaagcttggtaaatgagtcttctaattcacaaagattttttttcttattctttcattttttaattgaagaatcagtcgcaaacccagccattactgaagactcctcctgctgtacttcagccaattgcaccacagacaacatttggtgttcagactcagccccagccccagtcactgctgcaggcacagatttcagcagcttctattacaccactattgcagactcaaccacagcccttattacagcagcctcagcaaaaaggtatctttgcttttgtttcaggcaaatgtataactttttagttgttgataatgtaactatgcttttaattacaaaaaaaggcagggatttcaagaaaacttgaagcctaaaaatcctgaataggacacatctacttccatagctatgtggaagtatttttttttctcttagtgataagaaattaaaagatacacctttgtggacttaaatatcaaaactattaaattacttattaaaccataccacatcaaatgaatttgctgggttttaagtttttttgcaaattgattgtttgaaactccagatgtgttctttttcgctctgtcgcccaggctggagtgcagtggtgcaatct

SEQ ID NO: 61186 - DNA, 1040 bp, Homo sapiens
tttagtcactctcagttatttaactttgttcctctaattttatcaggtaatgccttcgaactttgtttagacacgctaaacgtttttttcttttatcttttaaagctggtttattgcagcctcctgttcgtatagtttcacagccacaaccggcacgacgattagatcccccatcccgattttcaggaagaaatgacagaggggatcaagtgcctaacagaaaagatgatcgaaggtatattttctaaagtgtactgtggatggtggcaatggttgtacaacaatggaaacatagttaatgccactgaactatgcttataatataaaattttaaaatggtaaattttatgttatgtctattttactacaatttttaaaaagttaaacaaatatactgtggattcttgcttatattacctactctatttacttcattgaagagcttttccataatattagaaatattagtaattttagaaaaatttgctttcagtcgtgagagagagagagaaagacgtagatcgagagaaagatcacctcagaggaaacgttcccgggaaagatctccacgaagagagcgagagcgatcacctcggagagttcgacgtgttgttccacgttacacagttcagttttcaaagttttctttagattggtaggttattccccacccattgttttcttgagttactaatttcatataatttgatagaatatgtcacagaggtatttttcttgcaagattgatttcccgacagttagtgttcttcatataagggcagaaatgcaatttgaaataacttaattatctacaatgctgcattatttttatacccccatgaaggatatcgactggtattgaaaaaggcagcccctcaaggaaattcctctgtcataacgttattcccctaaagttagaatcagttaagatctagacttactgataacttgaagatcatgtatagtccattgtgtatgataaagcaataatagagtagtaaactgattaatttcaagtttagccctggcagtgtagtata

SEQ ID NO: 61187 - DNA, 4320 bp, Homo sapiens
atttttgtatttaattttgaatgtaagtatgcttgatctaggaacttactatagtaaaataaaagttataatttttctacactcaaaaacctgattgaggggcgtacagaaatactaatactctcattgctgttttgtatctattcaacatgaaccataattttcaagtaatccacagttccaactgaggaaaacctgcttttgtacagatcttttctggagctgagattcaagttatttcaaagcgtcttctgtaacaaaaagtatcaaaataaggataacactgagaatactatttattcaaagctttgcgtatataaatttgaacgtaatattttcatatgtctctatgcaaatctatagctcattagtaactgactttgtcttttttcagcttactttttactatatccagttatatttgctacagaattaaatgtttgtgtaaccttttttattaaggctatttattcactacttatgtctgtttttcagtcccagttgtgacatgatggaactaaggcgccgttatcaaaatttgtatatacctagtgacttttttgatgctcaatttacatgggtggatgctttccctttgtcaagaccatttcagctgggaaattactgcaatttttatgtaatgcacagagaagtagagtccttagaaaaaaatatggccattcttgatccaccagatgctgaccacttatacagtgcaaaggtttgtattcagctgtgatatgcagcttaaatttcttagcagttattcataataaaagggtatgtagaattatccttcagaaagtgtttgttaggtagacccgaatacctgttttcttcttaactgcttgatcctattttggttacataatttaatttaagctctctttgcctcatctcttgagctgtaaaactagttattctaacattttaaaccttattaaaaatgtgaagataaagttgatattaatgagatatttggaatgttgtatgacttctggtagcctcagataaaacttaatgttagatgaatgcactaaatgtcaatcttaagggaaacattcagtatattgtgtatagtctatagttttgtttaaagcattgtgtgactgaaaaagcatcccttcaaaagttaaaactaagtaattataaggtatctaggcctggcgtggtggctcacgcctgtaatcccagcactttgggaggctgaggtatctaatactgtttctgctatagtattacttcctatttttatttaaatttcagacatcttatatttaaagataattagtagtgcttctcattttttcacattactttagacttttgacaggattgaattatttgactataataggtaatgctgatggctagccctagtatggaagatttatatcataagtcatgtgctcttgctgaggacccacaagaacttcgagatggattccaacatcctgctagacttgttaaggtaaaaggacacatttgttttaactttagatgtattcactttgcttagctgtaactttgtacacataaaatctaaagccctacattttaatatttgttgattaatgagtaattttagtattaaggcacccagaatttaatgatgtagatgtttttctcattgcagattacaactatatcttatttgtacgctactagttcaacagtcattttgatgttttatatttgtaacatagtagaatattagtggtaataggattcagagtgtctttggatgttgttgaagtttgaattatagcttgtttctttaaaagaactctatctgaagaaatattttaaaaggatgagttatgatgtgtgtaaatcctattccattgctgaaatgcagtgtggaacacaatgaactgaactcttccttgactgacagataccagaggtagtaaaaatgatattggaaaggtttgtacctttccttctcaagtatcttattggtaatttgacagggtgcgtaatatatgtaaatgattctttgttttgaattagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggtaagtactaattcatttcttgattagaagtgttttactgatagtttatgtagttgttcttatcgatcagccttttccccccggcttattttagcaaccctggtcaatgcaggtaatctcaaaggaaaatccccatttgtagctaaagtttatttggtgccaaaatgttttgggggaaaagggattaagaactaatcaaaataaactgaaaatttaaatgttttgttatgttgtactttggaagttggatgtatgttgaaaatacttttcatttcatgcatagctggagaagatcgtcaagagagaacttcatttcattataattcttttgttataaaatgatgtagttgcgattatttttgttcagccatattttctcttgaggcttatttgtcctgtgtattttagtgtatctcttgtgacttaatttgagaatattcttttttagcacatgaaatctgaacagctatccagcttcttcaggtattctctaaaatgcgggtagctctgtaatcaaacttgaaaatgccttgggggaacatattcttcctttaacttattaaatattgtacaaatgtaccaaaagaggaactatggcttctataatttttttttctttagaccaacctcaagttcttgcagcaaaatttctttacttgatgtgctacaagtgaactagggtctttaaaatgtattttagaattttttttccaacatgcttcttcccttgcaacaggtaccgttttgcagagattcgctaccatcgccctgaggagacccacaaggggcgtacagttccagctcatgtggagacagtggttttatttttcccggatgtttggcattgccttcccacccgctcagagtgggaaaccctctcccgaggatacaagcagcagctggtcgagaagcttcagggtgaacgcaaggaggctgatggagaacaggcactgaacgctaatccctttttctatttccgcttctcacaggcacaggaacacaggcacaaatgcacaccacacactacataataaacacacatggaggaacataactggtaacagcgactggtaatccagctttcagcagtatagttgtatgttcttttctcttaaaatttctgtcttattatcctaactttaagagtgctgagacctcaaaggaaaataagttgtgcttaaattgcacagaattttgtttttatcataggtctagttgctggaatctgggaccagttgttgaacaagattcagtattaagccattttaaacattttgccattttctaaaatttaaaaaattttctttttcatggtcatcagttctagtcatggatatttgaaattggacaaccacaagtctgagagatttgaaatttcaggctatgtggcaacgtctttggtacatttcaaaggtctgactaaatcagtctttgggtggcttgaaaattgaggcaagatcacacactgtgtggtttgtggagaccggcagtgtttgtgcatccctgatatcctttgtgttgtaatttatcacccttttgtgtttcacagatctggctttgattggctgatgagtgtctttgtgatcagttaaaagtggtagaatgtatgtacgtggacttgcctaaataataactttaggagaagacaatctgaaacatttgtgaccttgcacagatcagcaacagacttttaaaaataaattatttttattttaaggtttcataatagtaattacattcttaactttgtatgtcaggatgaagaagagaaggatgatggtgaagctaaagaaatttctacacctacccattggtctaaacttgatccaaagacaatgaaggtaactttgataaggatggattttatttatttttttcaattaaaaagttctttctgagatggagtctcgctctgtcgcccaggctggagtgtagtggcgcgatctcggctcacttcagcctctgcctcctgggttcagtagattctcttgcctcagcctcctgagtagctgggattacaggcaccctgccaccacgcctggctaatttttctagttttagtagagacaaggtttcagaatgttggccagtttggtctcgaactcctgacatcaggtgatccacctgcctcagtctccca

SEQ ID NO: 61188 - DNA, 1005 bp, Homo sapiens
tgttcccccaaggcattttcaagtttgattacagagctacccgcattttagagaatacctgaagaagctggatagctgttcagatttcatgtgctaaaaaagaatattctcaaattaagtcacaagagatacactaaaatacacaggacaaataagcctcaagagaaaatatggctgaacaaaaataatcgcaactacatcattttataacaaaagaattataatgaaatgaagttctctcttgacgatcttctccagctatgcatgaaatgaaaagtattttcaacatacatccaacttccaaagtacaacataacaaaacatttaaattttcagtttattttgattagttcttaatcccttttcccccaaaacattttggcaccaaataaactttagctacaaatggggattttcctttgagattacctgcattgaccagggttgctaaaataagccggggggaaaaggctgatcgataagaacaactacataaactatcagtaaaacacttctaatcaagaaatgaattagtacttaccattgtgtgcacacacttagatcaatgcctgtcagagccttacaacaacgaatagcagtcttaatcaacacagagggatctttttctgggtctggtccatccaacgaaggagaccagtggcctccaatggccatagcttcatccttgcctttcatgcccactaaaaactaattcaaaacaaagaatcatttacatatattacgcaccctgtcaaattaccaataagatacttgagaaggaaaggtacaaacctttccaatatcatttttactacctctggtatctgtcagtcaaggaagagttcagttcattgtgttccacactgcatttcagcaatggaataggatttacacacatcataactcatccttttaaaatatttcttcagatagagttcttttaaagaaacaagctataattcaaacttcaacaacatccaaagacactctgaatcctattaccac

SEQ ID NO: 61189 - DNA, 1133 bp, Homo sapiens
accacatttttaaaaagtcacacgaaaggctgggcgtggtggctcacgcctgtaatcccagcactttgggaggccaaggcaggctgatcacgaggtctggagttcgagaccagcctgaccaacatggtgaaaccccgtctctacaagtacaaaaattagttggatgtgattgtgcgcatctgtaatcccagctacttggggggctgagacaggagaattgcttgaacctgggaggcagagcttgtggtaagccgagatcacgccactgcactccagcctgggcgacagagtttggctctgtttcaaaaaaaacaaaaaacaaaaaaaaaaaaaacacacaaaatataattgttaattgtagctagtttgtttcctatttcaatatccgctgccccccgccccccgccaccttttttttttccgtgtttttctgctccatatattcaggtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggtatgtactcaatctattattatactctatggtattaatattcatgtatagggtgttcttggaatacgtgagttaagattatgtgtgtgtaagcttttatttatttaatttaattaattaatttatttatttgagactgagtctcgttctgttgcccaggctggagtgcagtggagtgatctcagctcactgcaacctccgcatcccaggttcaagctattctcctgcctcagcctcccgagtagctgagattacaggcgcccgccactacgcctggctaattttttgtatttttagtagagacggggtttcaccatgttggcaggctagtctcgaactcctgaccttgtgattcgcctgcctcagcctcccaaagtgctgggattacaggcgtgagccaccgtgcccagctatttatttattttttgagatggagtttcgctcttgttgcctaggagggagtgcaatggcacgatcttggctcaccacaacctccacct

SEQ ID NO: 61190 - DNA, 1159 bp, Homo sapiens
tatgctttctttggacacattcatcagtaacacatgggtcttttggccttttcccacccatttgtatattggtttgtggggataccttgtcacttagttttgttatgaatgctatcagtttttgatttttatatctatattgctttgtctttttagtgtgaggtttcaggaagatctaaaacctatgctaccactactattttccgagaattttctaatttatataatctcaatatagataatttttccccctctttacaaggcagtttcttatgctgggaaatccaaaagagagttaggagccatcaaagcttactactcttagtgaatttgagctttcctcccttctcaacgcttatggtttgtataagtaccatgaagagtcatgggaattttgttccttttatttatgagatatatattcaatatatattcatcttgcacatgtatatacatcctacttgcagatttaaccttgacttgaaatttgaaatatttaggaagaagaaaggaaacgtcaagaggaaatagaacgccagcgtcgagaaagaagatatattttgcctgatgaaccggccatcattgtacatccaaattgggctgcaaaaagtggcaagtttgattgtagcatcatgtctttgagtgtcctattggactacagattagaggataataaagaacattcatttgaggtaatgttttaagtttgaaataagatccatataaggtccacacattatgactagttaatatatctctatctctgaaatcttttttctttgtttttcgcttttcgtggttttttttgttttgttttgtttttgtttttttttgagacagagtttcactctgttacccatgctggagtgcattggcatgatggtggctcactgcaacctctgtctcccgggttcaagcaattctcctacctcagcctcctgagtagctgggattacaggcacctgccaccacacccagctaatttttgcatttttagtagagacggggtttcaccatgttggccagcctggtctcgaactcctgacctcaggtgatctgcccgcctcagcctcccaaagtgttgagattacaggtgtgagccaccatgcccgtatctctgaaatctctttgaatgcctctttcattctttcttttttga

SEQ ID NO: 61191 - DNA, 1042 bp, Homo sapiens
tgaaaccctgtctctactaaaaatacaaaaaaattagccgggcgtggtggcgggcgcctgtagtcccagctacttagcaggctgaggcaggagaatggcgtgaacccgggaggtggagcttgctgtgagccaagatcgtgccgctgcactccagcctgggcgacagagcgagactccatctcaaaaaaaaaaaagtttgataagtttacataatcgttgtatgtggcaagtttttatttgctaaattactctgctagctttattatttctgttgaaatttggctaggttcatgttgatatctttttataggtttcattgtttgcggaacttttcaacgaaatgcttcaaagagattttggtgtccgtatatacaaatcattactgtctcttcctgagaaagaggacaaaaaagaaaaggataaaaaaagcaaaaaagatgagagaaaagataaaaaagaagaaagagatgatgaaactgatgaaccaaaacccaaacggagaaaatcaggcgatgataaagataaaaaagaagatagagatgaaaggaaggtctgtaataacaacctgctttagaagctttcagttactcttctaggttataaaggttgatgttgatttccatcagaatattagatgtaaaagccaaactgaaagattttactatattagaaaatcaagtctttgagaccatcacagctaacacagtgaaacctcgtctccactaaagatccaaaaaattagcctgacatgatggcacatgcctatagtcctagctattggggaggcagaggcaggagaattgcttaaacctgggaggtggaggttgcagtgagccaagcttgcaccactgcactccagcctgggtgacatagcgagactccatctcaaaaaaaaagataagaaattcagatcttcaaattaagccaatatgagcatctacagctagttttctaatactttattcttaaaatttttttttcctttttctgagacggagtcttgctctgttgaccaggcttgctgaagtgcagtggcgtaatc

SEQ ID NO: 61192 - DNA, 1048 bp, Homo sapiens
ggatgaggaagaaatgaccaaacgagatgacaaaagagatatcaacagatactgcaaggagaggccctctaaagataaggtgtttattgaatactgtattctttataatatggtgatatcttacatcatctaaacataacacagttgtgaagtttattagtccttatacatctttattaccactaagtaaaattctgtcagttgtttttttgtggctatgtcagataactagtatgtctgattcttttctctcatattcgtataccagataaactcattttagctaggatgaggcaaatatcttattagattattgctatcttatgcacagtctccgtttctcactttttgggggtaaaaaatttgaaatttgaatactatgttttctacttctccattttcttaggaaaaagaaaagactcaaatgatcacaattaacagagatctgttaatggcttttgtttattttgatcaaagtcattgtggttaccttcttgaaaaggatttggaagaaatactttatactcttggactacatctttctcgggctcaggtaatctatcttgtgaatatttaaaaggaaaacattttttaaaagttacctttccagtgaaaagttaatagaacctctgttgactttttgatatattaaagcaatataagggccaggcgtggtggctcacacctataatcccagcaggttgggaggctgaggcgggcagatcagttgaggccaggagtttaagaccagcttggccaacatggcgtagctccgtctctactaaaaatgcaaaaattagctgggtgtggtggcacacgcctgtaatcccagctactcgggaagctgagacaggagaatctcttgaacccaggaggtggaggttgcaatgagccaagatcacgccactgcactccagcctgggtgacagagtgagactccatctcaaaaaataaaaataaagcaatataacacaagccagttgtaaaacacttcccttctccctctccctctgtttctactccttaggactacaatatataaaattct

SEQ ID NO: 61193 - DNA, 1324 bp, Homo sapiens
ctttttaacaatgaagttttttttttcaaaagtaacttggatcttactcaattccatggatttccatcataagtgaaaattacagctgggcatagtggctcacacctgtaatcccagcactttgggaggcggaggagggtggatcacctgaggtcaggagttcaagaccagcctggctaacatggtgaaaccctgtctctccaaaaatacaaaaattggccaggcatgatggcgggtgcctgtaataccagctactctggaggctgaggtaggagaatcgcttgaacctgggaagtggaggttgtagtgagtcgagatcacaccactgcactccagtttgggcgacaagagcaagactctttctcaaaagaaagtgaaaattatatcatagtttttctaagagaatcaagaaatgtattttcatctctgtattttgtttacttgcatgcataacaggtaaagaagcttcttaataaagtagtgctccgtgaatcttgcttttaccggaaattaacagacacctcaaaagatgaagagaaccatgaagagtctgagtcattgcaggaagatatgctaggtctgagtaatattaagattttgctttttaataaatatactagtaattaaagaagaaaaataacttactaaaatatggtatattttatattataggaaacagattattacttccaacaccaacagtaaagcaggaatcaaaggatgtggaagaaaatgttggcctcattgtgtacaatggtgcaatggtagatgtaggaagcctcttgcaaaaattggaaaagagcgaaaaagtaagagctgaggtagaacagaagctgcagttactagaagaaaaaacaggtaagggtcagctttgaatatgttaatactttcagcaccctgctgggacacgtatatgtttatgtgtgtacatacatatatacgtacctgtgtacacatttgcatatgcataccagatattttcatcgaagtacataaggaactttttaaaattttttattatttatttgtttttaagacagggtctcactccgttacccaagtggagtgcagtggcacaatctcaacttactgcaaccactgcctcccggatccaagtgattctcccacctcagtctcccaagtagctgggattacaggcatgcgccaccatgcccagctattttttgtatttttagtagaaatggggtttcaccatgttggccaggatggtctcaaactcctgacctcaagggatcacccactttggcctcctatagtgttgggattacaggcaggagccaccatgctctgcagggacctttac

SEQ ID NO: 61194 - DNA, 2105 bp, Homo sapiens
ttcagaccgggcgcggtggctcatgcctgtaatctcagcactttcggaggccaaggtgggcggatcacgaagtcaggagattgagaccacagtaaaaccccgtctctactaaaaatataaaaaaactgcgagactctgtctcaaaaaaaaaaaaaaaatagagacggggtttcaccatctttcccaggctggtctccaactcctgggctaagcagcccacctatcttggcctctcagagtgctgagattacagtcatgagccaccacacctgccccattcactgcatttttagaccccatttattcttgggcagaattgaggtaaatgcttcgtcaccattaattttaagatactaaaattaatttattgttctttatcactagaaaaaagtataccaaactgaataccattgtactctaaaatcaaagtaacatttaagataatctaataaaatgtattttttccttctctattgtcttataggataatgtaaagaatgaagacaaagatcaaaaatccaaggagaatggtgccagtgtatgataaaatccatgtagtgatgaggaatggtgttaaataatgtaatatataaaaatcatgatataagaatgtttgaaggtgatgcatgtttgattttagtagtataaatgtattttagttcaaatgatgtataaagttttatgaatgtgagtttctgcttttgaaaattgcttgtaattcctagccttcaaattattaaacactccttgagtgaaataattttgcattgcaaagtgttttaggatgaactttgttatagttttaactccaataaagttcatcagtttaattgactgtagtatttaattaccaaatttcttttattaaaatgcctagaaatttttaatttatagaattattaggttttaaaatttttagttcatctgttaaaatttcagtcaaaatcataaaatagcatgatgcttaatttttgcaagttttttgaaactttttgttttttttactcatcaccaaaaaatcccctcttgatcagtctctaaaagcattcattaaaaattcagttcaggccgggcacggtggctcacacctgtaatcccaacactttgggaggccgaggcaggtggatcacctgaggttaggagttcgagaccagcctggccaacatggtgaaacccggtctctactaaaaatataaaaattagctgggcatggtggtgggtgcctgtaatcccagctacttgggaggctgaggcaggagaatcgcttgaacccaggaggcggaggttgcagtcactcaggatcatgcagctacactccagcctgggcgacaagagtgaaactccatctcaaaaagaaaaaaaaaaaaaatcagtttatttgaaagacagtatatcagaaagaaagaagcaatagagaactagtattgttctttatgggttagactttacataatattagttgtcctgatgtcaatgttactgctttcaattaatttttctactttcccagaatagcatctatattccttttaattttgagggtttaaaaaaaaatgcagtgtatgtcaaatttacagtttagtaccaagccagtagatgtcagtatgatgccttaaattaagtcttctttaattaaagatatttttttaaattaacctgtgtacttccttcagaattttagtggatacatgaggtgacttaactgtagaataaaaacggtagtaaatatgagtggttctcaacagagggtgaatttatcccttagaggacatttggcagtgtctaatgaggtttttttggtgtcacaactgggtgggtgctgctggcatctagttggtagaggccaaagatatcactaaacatcctttgttgcagaggatagccctctacaacaaggaattatccagccaaaaatgtcaatagtgtccagtttcagaaaccctgctctaaaggaatgtaaagttaaatgacattttgtcttccaagttttactagtgaaaacttaatggaatccattactggaatgtttcactgtcatataaatatatggtgtattagagttttgttttattttgttttgaaacggagtctcgctctgtcaccca

SEQ ID NO: 61195 - DNA, 1087 bp, Homo sapiens
tatacttgagattagtttgctgcaacagattaccctttgcaagggtcatgtaagagtttggaaaattgatatagcagttagtaatctaagcttcatgaaaattggtcatctcatgttattttccccattctaaagatgagaaaatgcaactaaagtaaaaaagttcaccttcgtgtcccccagataaatggtaaagggcttaatatttttcatcatctggcttcactaaaacctcagatccacttcctaattaaacctgccctcccagtctttttattaaagtgtgtttccaaatgcagctcattggttatctctagcctttttgtttgccttcaggcagagaaagagcagaatctactgttaacacgtaaagaattaatatttcatggccattcattttctttcttaaatagatggacatattgtaagccagtcctggccacacaaagaccacttgctgtttctggctataacataaatatttaattaaaggaaaaactactctgagccattcttttataaggcataaactatactagctttgggctacacttttgcaatttcccaaatccatctgttacttatcccagagtttttgccagcttggaaaacttaggaggcgtattcacctgggttttagaaatgtttccaggaggctgggtgtggtggtgcgcgcctgtaatcccagcactttgggaggccaaggcgggtggatcatgtggtcaggagttcgagaccagcctgaccaacatgttgaaacaccatctctactaaaaacacaaaaattagctgggcatggtggcaagtgcctgcagtcccagctactcaggaggctgaggcagaagaatcgcttgaacctgggaggtggaggttgcagtgagccaagatcatgccattgcactccaacctgggcaacagagcgagactccatttcaaaaaaaaaatgtttccaggagatgaatgtgcaatctttgagttgttatttctagaagagaaccatccaaccgtcactataagattctggatttgcagttaggcgtggtggcatgcacctgtagtcccagaacttgggaggctgaggcaggaa

SEQ ID NO: 61196 - DNA, 1211 bp, Homo sapiens
atgggcagactcaagctcccatcaccatggaatctgttctttctctcctgaagcagtgacgcttgccatttcgttttcattggccctcttagaagatgattaagaaaaaatgattgctttgaatatgtgttgcttctgtcaccccgtcccctgtgcaagaatcctggggaaagcgatcttaggtttacagacctcaataactagtctgtagaggcttaaggaaaagtgtcactgagacttgccaggatttgtcagtgatggagatcgtgtgggttgcattattaatagcctttactgtcagtattttcattcaatccgcaggtgtttattgaacctaatttgtaccatactctttgctgagtaccaaggaggttaaactaaataagtaaagaaatggtctctgctctcaaggagcctgtagaggagttgtagtctttcctcctcccagccccctgccctccaaaaaaaaaaaaaaaaaaaaaggaaaagaaaaaacatcctgaaacactcagaggatcacaaggtgctgaaaaaatgcccaggtaaaattattactggagacatttgacctggaaaaaagaaatcagctgaagaggctaaggtggcagtattcgaaggctgacattcgacaaaagaatgagacttattttgtatagccttagaaagcagaatctacctctctgaccttatcactaaggtaaacttgccatttcagctaacacttttattgtgctaaaatacacataacgtttatcattttaaccatttttaagtatatagctctgtgacattaagtatatttacatcgttttgcagctgtcaccatcatccatctccagaacttttcattgtcccagactgaaactctgtgcccattaaacactcacttctcattcctctctccttccactcccggcaactaccattctactttcgctctgtgaatttgactactgaagttacctagagtgtaagcagaaaaccaagcaggtattttaaaaaaggcttcttttgaaattcttgtcttttgcatcccaatcctgtccagcggtcaaggcctagtttatgtctttcctgacaacccgaatgtaccgttatctagtttcagtggctatcttcatcatttgattgacatttgttatgcatgtctatataaaattagttcatttttcctgtatgtatcccacatatttcccaaaagttcttgagga

SEQ ID NO: 61197 - DNA, 1341 bp, Homo sapiens
tgtaatcccagctactcgggatgctaaggcaggagaattgcttgaacccaggaggcagaggttgcagtgagccaagatcacgtcattgcacaccaatctgggcaacaagagcgaaactccgtctcaaaaaaaaaaaaaaaaattagccagccgttgtagctcgtgcctgtagacttagctactcaggagactgaggtgggaggatcacttgagccagggaggttgaggccacagtgaaccatggttgagctgctgcactccagcctgggagacagagtaagacctgtctcaaaaaaacaaaactgaagtgaatagtggtctggtattgaggtgaggataactttggttcggacgtgttgagatatggagctggtgcttagattcttagagttggaatgtaggtgaggaagggagtctggaagtacgtattgagccatgaaaatagtactaaaagtgaacatagagaacagatactcaaggagcatccactggaggaggaaggagaggaaccattgaagaagatatgtggtagaggtaagaagatagaggtaagaagggaatataaagtgtaactgaaaccaagtagacggagagtgccaagcattgtgggtctaaagtggaattatttatttaatcaccttgagatgttactgggcttagaccgagaggtctccttttgccttgcttcaacttctctctgtagtgcagggcccagaagcaattcaagccccaaggctgaatcgataaataatcttatttttctgtagaacctattggtttggaaagatgtggtctagtgtagttaactgcagatcatatgatgtaatgtgtaactgcaaagcattttcacacatattgttcaattctcacagcaattccaattttatggatgagaaaattatatgtgaaataactctaaaagttgtgtaagttatggtgaacattttggtggtagtagtttttactatcactaattactgctatctattttgaatatttgaccaggtaattcatttttttgagagtggccgagattacaggcgtgtaccacaacatgcagctaacttttgtatttttgtagagacggggtttccccatgttggccaggctggtcttgaactcctgacctcaggtgatccgcccaacctcgcccccccagagtgctgggattataggcgtgaaccaccacggctagccaccaggctaaagtcctaaattcccaaatcatttattgtgttctgtaaatatcacaacactggccactagtttgagattttaaaattgaagttgaaaaatagtgttttttaaaaaaattaactgaatttaaaacgtaaaaaaaaa

SEQ ID NO: 61198 - DNA, 1867 bp, Homo sapiens
gttgggttaccaaagtgctgggattacaggcgtgagccaccacggctggcccaaaggtttgcagttttaatggatatgcaattaaaaatctatcactagattttgtaaaactcctgtgccttttctgaccaaaaggagaacataaaaagcatagagaagtagctcttctttaattgcacttacttttacatcatccttttcaatattctgccttgtttttagctttaagatttatatgcattcgtcaaaagtttagactaattttttagtaatgcttgtttgtggtaggaataactgtgtcaccaggtggcatgtctttaggcagacatagaagaattatgattgtcattttcaaatgaatatattttttcctaatgctagtcgtaaagaagtattttaattaaatctcattttacaggtcgaggggtaacatatctctttcctattcaagttaagacctttggtcctgtatatgaaggaaaagatttaatagctcaagcacggacaggaacaggaaagacattctcttttgccatccccttaattgaaagactccaaagaaatcaagaaacaattaaaaaaagccgctcaccaaaggtaatcgttatagggggtaaaagctttaaatgttactctaacagaaagggaaagaaagttacacgagtcctaagttctagtacccccaaaatagaaaagttagcgctgtggcataaaacaaaaatatgttgtttttcacaaaaagaaatttcaagcaaagttaaagtgaagtagtttttgcatatgaatgtgatgtgtatggatccatagatgtctttgataatttcatgaattataaagccggtatatcttatttacagtttttatatttagttgacccttttcttctcttttcttcagtcctgacctttgcttttaaataaatgaattttctaaagaggtgttcatttatttgtcattcagtaaatgttcagcatcatttatttcagtgttacctttttttccctttagtatggaatacgtcatgaattttcatgtcatccttgtgcaggggtcatgctaatcttccctgtgtcattccaattttagcgtatgtgctgctgaagtgagcacacacagatggactttttaagaagagtattatagaaatgatactgctagtttatatattattggggtactagacatcttattttataaatgtaaaatcaaccaacagagaggactagtaaaatgtaagcctaaaatttgacctaaaaagctgtgtgcacttaaggtttgtaaaagtgaagaaaaaaatcagcatcataatatgaacaactgtatgactaaaagtaatttgttctttgtaagactcctgagtggtattataagagcaaattaacatacatacataaatataattaaatcataatagtcttggatcagctatcccaaatcaggttggctgtgttgacttacaggataaatatttttggagagttatgtttttcgggtgaaattaggaaaagactgaaataggacataggatataatctcaacactgctttttttttgttttgttttgttttttgttttttttaaagacagggtctctctctgttgcccaggatggagtacagtggggtgatcatggctcattgtagccatgaactcctgggctcaagcaattctctcttcctctcagtctctccagtaggtaggactgcaggcaggtgccaccacacttggctaattttttattttttgtagagttggggtctcattctgtagtccaggctggttttgaactcctggcctcaagtgatccttccaccttggcctcccaaggtgttgggattacaggtgtgagcctccacgcctggcccca

SEQ ID NO: 61199 - DNA, 1965 bp, Homo sapiens
tgtcccctgcgttctaacaaaactaaaataatttggtatctgttctgtccttgaaaaagaaagtatgatagcatcattttaactattttcttagctttctgtgctttattctatttttttatagtcagtagttagatttactaactcattttattgatttctttgttcattgttcctgcttaaattctcactttccttttgggttcagttctcttcatattgtcccccagttttgcaagttgaaagttttaataattgcaatgaagtctgtgtgttaaaaattcaccccaagttttacatttttcattatttttttgaagcttgggaggatttttaagagcgggctacatcgtgggaaattaagaaaacatttgaattctttttgtttatttaagattctgaagacaatcctcagactttacttttttctgcaacttgcccacagtgggtatacaaagttgcaaaaaaatacatgaaatccagatatgaacaggttgaccttgttggaaaaatgactcaaaaggctgcaactactgtggaagtaagtagctttctagcatgatagattttagcttttagttggtatttacttttgacatttgttgaagctaaatttaagttttgggtacctcttcatgcctaatcttccttttctgctcttagtaagacacctatatatttttatagtctgagactgagtagcagaatagaataaatagggggaaaaaaagcacgtgaataggcaagtcctaataggaaacacacaagcagccatagagacagatttgaagtgtttctttctttctctctttaaagccgctcaaaaacaaaaacaaaaaacaaaatatttacaacgtgacaaagaaggcgatttatattgactagaaaagaatagtgcggagataatttgttaaagctgaggtgaaaaaaagatagatcctcatcccattcccccaaaccaaaaaaatttctcaaagatttaaaaaattaagctgtaaaataacttaaagcagacgtaggtgaataaagagttttttgatttcaggaaagggaatgcttttctaacatagaagttgggctgagcatggtggctcacgcctgtaatcccagcactttgggaggccaaggcgggcagatcacttgaggtcaggagtgtgagaccagcctggccaatatggtgaaactctgtctctactaaaaatagaaaaattagccggcctggtggcgggcccctgtagtcccagctatttgggaggctgaggcatgagaatcacttgaacccaggaggtggaggttgcagtaagctgagattgcgccaccgtactccagcctgggtgacagagggagaccctgtctcaaaaaaaaaaaaaaaaaccacagaagtcagaagaagaatccataaaggaaaaggtttataattttgactccatgaaagttaaaccaatggtatgtttaaaaaaagaattagggccgggcgtggtggcttacgcctgtaatcccagcattttgggaggctgaggcaggcggataatgaggtcaggagatcgagaccatcctggctaacacggtgaaactccatttttactaaaaatacaaaaaattagccggtcatggtggcgggcgcctgtagttccagctactcgggaggctgaggcaggagaatggcgtgaatccgggaggtgaagcttgcagtgagccaagatcgcgccactgcactccagcttgggtgacagagcgagactctgtctcaaaaaaaaataaaagaaaaaaaaggctgggtgcggtggctcacgcctgtattctgaacactttgggaggctgaggcgggcagatcacgaggtcaggagatcgagaccatcctggccaacatggcgatacctcgtctctattaaaaatacaaaaactagctgggtgtggtgacccgcacctgtaatcccagctacttaggaggctaaggcaggagaa

SEQ ID NO: 61200 - DNA, 2862 bp, Homo sapiens
aaaaattagctgggcatagtggcaggcacctgtaatcccagctactcgggaggctgaggtaggagaatcgcttgaacctgggaggtagaggttgcagtgagccaagatcgctccattgcactccagcctgggcaataagagcaaaactctgtctaaaaaaaaaaaaaaatctgacagaatatttaccaaactcttagcagtgaattatttctaagtcactagtattagggaagcttttacattttatgttaaatattttctgtcatgtttgactttttttttttacagtaagcatgcattgttaaaatcatcaaagtaagatttaaaaacatgcaaaaggagcacagactagatgttgttgtgctatcagttgcaagtatgagctgtacacttaattttctccccctttctcaaatagaatgcccagtgtttacatggggacattgcacagtcacaaagagaaattacactaaaaggcttcagagaaggtagttttaaagttttggtggcaaccaatgtggctgcccgtggtttggacattcctgaagttgacctggtgattcaaagttctcctcctcaggtaggaaatgggatttgatttgggaaaaataagagcaattttataaattcccatttaatttacaacatattgcttgggatgtgaaaaatatgtcatctcttcttgctcttagccattttttgttagtgtgctattaaatttatcagattctgatacttttgcagatgattaactctattgtttgtatttgaagcatggagcaacaaaatcaggcagagaattacaaaaagttgccataaagaaacctgggatgaggtggattaaaaggttttaaatcatattgcctttaccccaaaatccacacatataaattgtttggaatgttgaaaagggcaacaggattgaaataaatatattattattaacattattatttggattccggaatgactgcaacttgctagatttttaaaaaatattaccttttataatctttaggatgttgagtcctatatccatcgctctggacgcacaggtagagctggacggacagggatttgtatatgtttttatcaaccaagagaaagaggtcaactaagatatgtggaacaaaaagcagtaagtagagttaaattatttcaggcttattgtctaaatggtgccttaaaagagagctcttcttatatttattcttacaagtaggtcttcataacttttctcagtttaagctgcatttggctgtgaagcctgtggagatctaaatttatattagcttcaagactttaatacagcttttattgtgaagacagtggagctgactttctcatcttttccttgaatttctctcttcatactaaaatcagaagtgcattgtgatttcagtacttcttagtgtaaatgggtgactaaaagattgtcttggtataatagttaagattcttttaagtatggtacaatagacagtttctaaagaaactgtacattttctgtggtctggattttttgtggtatttcacattttttcctatttttatatgtgtttttatatgcaatttcatatactttgtaaaatgagatagtgtaataaggaaaaaagctgatagatttaaacatctgttttgttttgtttttttttcaaatcaggcttgttttacaagtgaaattccatgattgtaactaaggggcaattcaaaaaattatttttctctttctgaaatttgtaattgatgatttatgagaaaaaaaagatcttggctgggtgcagtcactcacgcctgtaatcccagcactttgggaggcggagatgggcagatcacttgaggtcaggagtttgagaccagcctgcccaacatggtgaaaccccatctctactaaaaataccaaaattagctgggcatggtggtagacacctgtaatcccagctactatggaggctgaggcaggagaattgcttgagcccaggaggtggaggttgcagtgagccaagatcacgccactgcactccagcctgggcaacagagcaagactctgtgtcaaaacaaaaacaaaaacaaaaacaaaaaagataaaactgatcttttaatctgctagggctatgaaatctttaaatgcaagaaatagaaattcaacgaactattaaaatattaatttaggaattaattgtaaagacttccatttttctttaatgtaactctttcattttcagggaattacttttaaacgtgtaggtgttccttctacaatggatttagttaaatctaaaagcatggatgccatcaggtatgctttctgaacttgctgaataattgtttcttttgtattaggctattcatctgtaagctctcccagttcaaatagcagaaaattttaccaccagttttaccagcagacatttagttatattaaaatataaaacagtggctcatgcctgtaattccagcactttgggaggctgaggcgggcagctcatgaggtcaggagattgagaccatcctggctaacacggtgaaaccctatctctactaaaaaaatacaaaaaattagccaggcgtggtggtgggcgcctgtagtcccagctacttgggaggctggagcaggagaatggtgtgaacctggggggcggagcttgcagggaatcgagagtgcaccactgcattccagcctgggcgacagagcaagactctgtctcaaaaaaaaaaaaaaaaaaaaaaaaaaaatatatatatatatatatatatatatatatatataaaatgtggctgggcactgtggtgcacgcctgtaattccagcacttcgggaggctgaggtgggcagattgcttgagcttaggagtttgagact

SEQ ID NO: 61201 - DNA, 1055 bp, Homo sapiens
gcacctgtagtcccagctacttggaaggctgaggtgggaggattgcttgagcccgggaggttgaggctgcagtgagccaagatcgtgccagtgcgctccagactgggtgacagagcaaggctctatctcaaaaaaaaaaaattactccttctttttcccatttttcttcttatcttttattttttccctatgtcttgaccaagaatactatttttaaaccataggtctctggcttccgtttcttacgctgctgttgattttttccgaccatcagctcagagactgatagaagagaaaggtgcagtggatgcattggctgcagctttagcccacatttctggtgcatcaagctttgaaccacgatctttgatcacctctgataaggtagaaatctgtgagaaaattgtacatgagtgggaaaaggttaaaattgaacataggaaatattgtagtgaattattgtgctttttgtgcagaaaaaaactgttttgctctatgagaaactggtctccttattttcctctactccctaataaatccttttttgacaatcacctcttccaaatttttcaaacccacagaaaaactgaaagaataatgcagtaaccacatacgatccacctagattcaactgttaaaagtctgtatcatgtgctttatatccttttttagctctaatttgtaattaaaaaaaaaatgacatgtaataattgtacatatttatagggtatgtggtgatgtttcagtacatccgtacataccatgtataggtatcagatcaggatcattagcgtatccatcgtctaaacatttatcatttctttgttttaggaaccattcaatatcttccttcttgctttataactttataagtttttttttttttttttttgagattgagtcttgttctgttacccaggctggagtgcaattacgtgatcttggttcactgcaacctctccctcccgggttcaagcaattctcctgtctcaccctcctgagtagctgggactacaggcgcacgccaccatgcctggctaatttttgtattttta

SEQ ID NO: 61202 - DNA, 2030 bp, Homo sapiens
tatttagaatgttagaatttatttagaatgtatatttagaatgtatatttatagaatgtatttaattagtacatgtaattagtaatacatagtttaattttagaatgtataaactgagtatgaatttatgatctcgaaaattgaaaatatttttgcttattttctggttttcatttttgttccagatacgttaacagaatagatggcctttagctaatagatatgaaaaaggtgtcttcttgtacttaacatgtttgcttatggtttctattttgcatttatattaatcctgtaaattcccctaacaggcagagtggcatgattccgactggatactctcagtgccagccaaattacctgaaattgaagaatattatgatggaaacacatcttctaattccagacagaggagtggctggtcaagtggtcgatcaggccggtcaggccggtcaggtggtcgatctggcggccggtcaggtagacagagtcgacaaggaagtcgctcaggaagtcgacaagatggtagaagacgaagtgggaatagaaatcgatcaagaagtgggggccacaaacggagttttgactgagtatttgatagttaatctaccagtgtgagcttgcctatttctgcctaatcatgtacattatccaccaaaaattaggtcatcatagttgaggtatgtgtctgctatttgcaaagaagttggtcgtatttttttaaaaagtatttcacaagaatggaacaaatctacttatccagttatacctttgaataaaaaaacctccttttattgtctcttttcacttatgtgttaagaattttctcaatgtaatctcaaaaatttctttaaaaacttggcaatcaggccaggtgcggtggctcatggctgtaatcccagcactttgggaggctgtgttgggcggatcacttgaggtcaggagtttgaaaccagcctgaccaacatggtgaaaccccaactctattaaaaatacaaaaattagctggacatggtggtacatgcctgtaatcccagctactcgggaggccgaggcaggagaatcacttgaacccaggaggtagaggttgcagtgagccgagatcatgtcactgcactccagcctgggcaatagagtgagactctgtctcaaaacaaacaaacaaaacttggtagtcaagctaatcataacataagattacttgcattttacaaaatgtgatgtatttgtattcatataattcctcccataggttatgtgataaaaataagaaattcccttctacattaaagggctgtgtaaactgttgacatggttagttaggtgtatcattttagtctagacacagttaattaaaagagtgtgccaacagtgcatactcattaatttattccacagatatttattgaatttctactatgtttccatcactatgctaaccactggggagtatagttgtgaataaggcataatcactatccttaaggaacttagagtcaattattacagactaacaaataaaagctaagacagtggtaggtatggtatgctaaggacctacttggggtacacctgaccagttttagcagtcaggaaggccttttaaaagtgatacccaacagagaaataaagaagtatccatttagccacatgtatgtacaggtgggaagaggagtttagaagggagagggcttgcaggcagagagaacaacatatgcggacaccagaggcaaagaatagcatggtaagtctgaggtttccatatgatagagaacaggaataagagactggttcagtatttaacagggacagattttaaaggccttatgtacattgttaaggagtttaaagcttttcttgaagacagtgggtaatcatttaagggcttaaagtaaggagtaacatgatttgatttacattttagaaagaatgctggccacactgaagagactggattggagaaaagccagactggaggcctggagacctcttaagatgccataggagtaatctatggtagagatgctggtgat

SEQ ID NO: 61203 - DNA, 1062 bp, Homo sapiens
gcaaagcaccagattttcaggcttatggatgagacttcaaatatttactataattggatgctttaaagtttgttgatatttttcagtcaagcagattctttactatcagaatatttctgagccaggtatgatggcttgcacctgtaatcccagctgtccatcaggctgaggcaggaggatcacttgagcccaggagttcaaggctgcaagtgagttatgatcacaccactgtactccagcatgggcgacaaagcaagaccttgtctcttaaaaaatatacgtatttgagcctaactttgtagatgttgaccagaaggtagaattccttaattctgcaggaccagaagcatgagtagtatacttcagtatgtcagtatggctaatgttttaagaattgcagtgtgagataacacagttaatttgttcataggccgaggagtgaccttcctatttcctatacaagcaaagacattccatcatgtttacagcgggaaggacttaattgcacaggcacggacaggaactgggaagacattctcctttgccatccctttgattgagaaacttcatggggaactgcaagacaggaagagaggccgtgcccctcaggtaactgtcttaaatacaagggctctcagtcagcataggaaaaaccaccacttgggcattgtgtacataccctactattttttattgagttcttatagtcacccattctatttactgtggatctttatgtgaaagtaatccaggacaattcttttatatttaataattaatatatacagatcattctctgtatatttcaatattttaatctttcccacagttttgatcatctatataattaatgctatcatatttccttcaaaccattagatgtccctggggctcatagctttcgtcaagtgtctgaccatttttgcctagatggagaaagcatttttggtagaaaagcatgaatgggcggtggctcacacctgtaatcccagcactttgggagcccgaggtgggcggatcacgaggtcaggagatcgagaccatcctggctaacaacatgaa

SEQ ID NO: 61204 - DNA, 1034 bp, Homo sapiens
cagtttcatgttttatatatatatagatcaaattcatattgctctaggattcaaagccccttacattgttggctctaccttacttctctgattttgttctgcttcaaattttctctactgtagaggttaagactataggttttggatcccaattgcttgaaggctctgctccttcttagcctttggggtttagtcaagttatttatcctctaatacctagctcaaaaggttgcaagaattgaatcagaataatatatataaagaatttagtagagtctcagatctattagacaaaaatattagataatgttatcgtcatcatcagcgttagaccttgttcaagtcgttcttttcctggaatgctgttctttaaggactagattaagaaacaaatactacacagtaatttgaattcaattatttttctttatcaggtactggttcttgcacctacaagagagttggcaaatcaagtaagcaaagacttcagtgacatcacaaaaaagctgtcagtggcttgtttttatggtggaactccctatggaggtcaatgtgagtacattcaaaaagtgagggaggtataatgccacccattgttgactgctctgattggatttcttttcaccttgacatctggcttctctatataggatagtcgtttatggggattttcttttgccattgtttaaacatggtcaagaacatggtcctgcttgatgataggcaaatcctgtatatcgttcttaggacttttatctatttatatttatctaggggctacaaaagtaatttattattgaacccaaaaagacagtccatttgggctctaggaaataggaagtcagaattcaaggttcctcttgtctgtcaggaccttgggtctgtccctctttctgcatggttgcttctttcttgatgtaggcaggctttctttccttggggctcaagggccaaatgttagtctctactcttatattccattacttcccagttcaaggccttggagctttattattagagcagatgtataaatt

SEQ ID NO: 61205 - DNA, 1830 bp, Homo sapiens
cactgcaacctctgttgcccaggttcaagcgattctcctgcctcagcctcccgagtagctgggattacaggcgcccaccactgcgcctggttaatttttgtagttttagtaaagatggtgtttcaccatgttggccaggctggtcttaaactcctgatctcatgatccacccaccttggcctcccaaagtgctgggattacaggcgtgacccaccacgcccggctgcatatttcttttatgtcactttgtacactagactgtcacttcaaatatttactataattgggtgctttaaattttgttgatatttttcacttctaatgtttttcccactagattaggagtgccatgagtatctttatcattattacttagcatattactttgtacttgtaggtatttaacaaatattttagagtaacaatacagttaactgtggtaccccacacagataaaagtacttactaaaaacccagcaaatcttgtcattgttttttatagttgaacgcatgaggaatgggattgatatcctggttggaacaccaggtcgtatcaaagaccacatacagaatggcaaactagatctcaccaaacttaagcatgttgtcctggatgaagtggaccagatgttggatatgggatttgctgatcaagtggaagagattttaagtgtggcatacaagaaaggtaatccacaaattcaagaagctgataaaaaagaccaaaggaagggtggtaactctgtctcctgggttcaagtgactctcatgcctcagccaccctagtaactgggattacaggcacccaccaccacgcctggcctcgtatttttagtagagatggggttttgccatattgcccaggctggtctcaaactcccagccccaggtgatccgactgcctcaccctcccaaagtgctgggattagaggcatgagccactgcgcctggcctggtgactaagtagttttctaagagattaataaagccttgggaaattggaatggggctcattttatctagaaacttggattaaaaaaaaaaagtcattactctgggattaaagctggtgaggaaaaaaaaagtcatgatttatcatattaccacaatggggaaaacttggaaaagtaaagaaaaataccatcttctgtcatcttgatgtggtctgcttttggtgtattcctgatgttttgcattttattgtatatatgtgttgattatactctgactatacatataaaaattcagcaaaaatactgtatgaagtggttggccatgacttaattctaccatctgcctagtttgatttttattcaatataaatagttctgtttagccacttttatacagatagcttctcacctcaatatctggaattgttttttgtttttttttttgagacagggtctaaatctgtcacccaggctggagtgcagtggtgggatcttggctcattgcagcctccaccttccaggttgaagcaatcctccgagtagctgggactatagatgtgcgccaccatgcccagctaatttttctgttttttgtagagctgggtttcaccatgctggtcttgaactcttggactcaagtgatcttccctcccactttggcctcccagaatgctgggattacagatgtgctctaccgcggccgccctttttttatttttaagataggccctcaccctgtcactcaggctatagtacagtggcaccatcatagctcactgcatccctaaactcctgggcctcagcttcctgagtagcttagggctacaggcgtgcgccaccatgcctggctaatgtttttattattgatagagacagg

SEQ ID NO: 61206 - DNA, 1086 bp, Homo sapiens
ttgtcaaattctctccagaagggttctatcacacttctatttggaatgtttgagaatgtgatgtcactcttaagtagaattgaacaaacaaaaatagtagctggactcaatgattggacaagaattctaaattcataaaatattgagaatagaaatcttagaatagatttcgtttgtaattcaaaagcctaatggtcagaaagcaaaataactttaaagtactttcactattttaaggatcttttagataaattacctagcggtatttctttgcccattgggaaacctctgtcttccagttttgtgtcctcagtgcccgacttggcctcaggtggttgctggtgaacattgatggactgtggaagtattaggttaggtggaatactatgtaggcttgtttggattattcatactgactttttttttccccctcctcaaagattctgaagacaatccccaaacattgcttttttctgcaacttgccctcattgggtatttaatgttgccaagaaatacatgaaatctacatatgaacaggtggacctgattggtaaaaagactcagaaaacggcaataactgtggaggtaaattatttacttagttgccagaatataaaattgtatatatttttttcttgtctgttagtattaagactggcaaatgctctttttccagataaatactaaatccatgtgaaaagccaaggaaaaatatttctatttgagctgtatatgatatctgtgtttttatttttattttttgagatggagtctcgctctgtcaccaggctggagtgcagtggcgcaatctccgttcactgcaacctccacctcccaggttcaagtgattctcctgcctcagcctcctgagtggctgggactacaggcatgcgctaccacgcccagctaatttttgtatttttagtagagacagggtttcaccatgttggccaggatagtctcaatctcttgacctcgtgatctgcccatctcggcctcccaaagtgctgggattacaggtgtgagccaccacgcccggcccgatatctgtgtttttaaaatttcatcatctatggcctcatttc

SEQ ID NO: 61207 - DNA, 1021 bp, Homo sapiens
agcagagaaatctagtgctttgtgtttaagcttaaaagtgttgaagtttaaaatttcacctttgattctgataatctagatgaattaatttcactgaggaacagacctgtatattaatctactacagattgggtttttaagtaaatgaaaaggcaaaacatacagaaatttgttggttatttggtttcctgtagaaagctagggagtggcatttcctttcctgcattttcctggttgtcagaaaataaagaagttagatgctctttagagaaaggggagaggcatggggagatgggcagatcatgttgctttctgctttactggcttatttaggtttttttctgtcagtggtggctgcagacagctcttatcaggcttgagtagttgtttccaggagcaagacattagaacattagtgttgtgctcactgatcattgtgttgtgattttagtttccagcaaagctttactaaatagatgttttttttcttcttacataagcatctggctattaagtgccactggactcagagggcagcagttattggggatgtcatccgagtatatagtggtcatcaaggacgcactatcatcttttgtgaaaccaagaaagaagcccaggagctgtcccagaattcagctataaagcaggttggtccttccccttatgccagcaaaactggggatatcaacaaatcttcaccttgggcatatctgctcttggtctgattttcattcattcagtgaataccagtttagtttagtttagaaatgagaggaagctacttttttttttttttttttaattgaggcagagtctcattctgttacccaggctggagtgcagtggtgtgatctgggctctctgcctcctgagttcaagtgattctcccacctcagtctcccgagtagctgggattacaagtgagcaccaccattcctggttaattttgttttttctttatttttttgagagggggtctcgcttcttcgcccaggctggactgcaatggtgtgatctt

SEQ ID NO: 61208 - DNA, 1019 bp, Homo sapiens
ggaggctgagacagcaagatcacttgaacccggtaggcggaggttgcagtgagctgagatcatgccactgcactccagcctgagtgacagagtgagactctgtctcaaaagaaaaaaaaaagactagatatattgagttaaaatacattaagcttcttaaagaaatcttttcagtctgtctactggaagactgaaaattggaattacatatatgcctctaatggacaagcactatttagacaatgctctttgtaaatttgcctgcaggacagggaccattgttctagaagctttaaaaattgccagaggtctttaaattgaagtgctaagggaccttctccctcatgtccccaggtttataaccacaattgctagtgttcactgacctgcataggctactcaggtgtttgtctctcttttttggtttagtgttactcatgtattttacttcaataggatgtagagtcctacattcatcgatccgggcggacaggcagagctggaaggacgggggtgtgcatctgcttttatcagcacaaggaagaatatcagttagtacaagtggagcaaaaagcggtaaaactattcttacctttcattaagcaaatgttgagttctaaagtcagtctttggtttcttcaatttttatccactttaaaatatttttatttctagtgtgtggcaatgactgaaagcttattgttaggtacatatgttgtcctgtgataaaaggcccattctgaagtaactttgcatttgaaaacagtgattttgttttcatatgtttgaaaggaagttttcagacaatgataaatatgaaccagagataattaagattgaggggctgtaggaattgcttgaaaatcaaatgaatgagggtatgtcaaaaggataaaggggagaagagactaatttttcctccaggagaattggaatagtgtatgtagattcttgccccttcaggagcttcactcgtctccttcctcttgagtggactgcacttagggacttgctttcaa

SEQ ID NO: 61209 - DNA, 2944 bp, Homo sapiens
ttttctcatgctttttaaaaattgaatactaattaaagcacacaaaaacaaaacattctctcaacaggagaaatggcatgattcacgacgctggcagctctctgtggccacagagcaaccagaactggaaggaccacgggaaggatatggaggcttcaggggacagcgggaaggcagtcgaggcttcaggggacagcgggacggaaacagaagattcagaggacagcgggaaggcagtagaggcccgagaggacagcgatcaggaggtggcaacaaaagtaacagatcccaaaacaaaggccagaagcggagtttcagtaaagcatttggtcaataattagaaatagaagatttatatagcaaaaagagaatgatgtttggcaatatagaactgaacattatttttcatgcaaagttaaaagcacattgtgcctccttttgaccacttgccaagtccctgtctctttcagacacagacaagcttcatttaaattatttcatctgatcattatcatttataactttattgttacttcttcatcagtttttccttttgaaaggtgtatgaattcattacatttttattctaatgtattatctgtagattagaagataaaatcaagcatgtatctgcctatactttgtgagttcacctgtctttatactcaaaagtgtcccttaatagtgtccttccctgaaataaatacctaagggagtgtaacagtctctggaggaccactttgagcctttggaagttaaggtttcctcagccacctgccgaacagtttctcatgtggtcctattatttgtctactgagacttaatactgagcaatgttttgaaacaagatttcaaactaatctgggttgtaatacagtttataccagtgtatgctctagacttggaagatgtagtatgtttgatgtggattacctatacttatgttcgttttgatacatttttagcttctcattataaggtgattcatgctttagtgaattcttcatagatagtatatataaaagtacattttaatagaaagccagggttttaaggaatttcacatgtataaggtggctccatagctttatttgtaagtaggctggataaatggtgcttaaatggtaatgtactccacttcttcctattggaagattaacattatttaccaagaaggacttaagggagtagggggcgcagattagcattgctcaagagtatgtaaaaaaaaaaaaaaaaaaaaagaaccaaaccactggaaataatcaaatgcaaaaaggtaacaaattcataactggaaagcaaagagaagaacaagtatgatttggatgataaagcattgttttaatggtgaaaacttcacagatcactaatgtttctagaggttaacttcaagtgggcaagctggggtttttaggtagtcagtggcctagttcctaaagccacagtataggatctgttaaactgaatgtctgttgaaagtttgttttagctgcttggaggcttccttttaagacaaactgtatgtgattaagttgttttgagggaactgaagaacctgatgtagcccctggccagataactgcctgatttctcagatattatttctctgggaaacattctacatagcacaggagcttaagagtggcattatcttctcgccttaatttccagagattatttctgtactgagaatcctggaactactatgctaggaaatttaaagctgcatggtctgtcttgttttcatttaattattgtgaatacctagaatctttcttggtcctgatttctcttgcttaatccagtctttatctctaactgccccttatttgatcaccatgtactaggagctctgatagccagctcagctcctaatccttgaggcaacattctttttctatttgaacttcagttctgtccttgaatcccgactagatatttcttgccctctggtctcagaattctcttggcttttattccttgatccacttgccagttttatcactttacccttgttcctcatggcttcccatcaagccatgggtattaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttgtggattatggatttagcctaaagaaaaataatctggcataaattaagagtaagagagaagattaatagaaatttcacttcacataacttaaaacatggctatttcaataaaggactaaagtttctcctggatcccagaattcaacctgtatttataaatgtataatgtatttagctactttttggtttaaatgaacttgttgggttagcttggtaaatgttataatttttactattttctacaaagaaaatattttctaatttaagttggagctatctgtgcagcagtttctctacagttgtgcataaatgtttttactataaaatgagctaatgtataaaatactgctgtataccataataaagatagtaatacttgattttagtggcttttgttttctaaaatgaaaatagcttgaaatatttattataaaaataataaaagctagatataaaaatctaaagagaaaaaaaaccagtcacccttatctaatattttagtgagcagtcttccacatgttcatttataaaattggaattatttgattttgtgtattgcttttcccccctcaacatgttgtgcacaattttgtacaggcttacatggacatttttgatgacatgttttcttgtatggatatgccactacacatttaaccagtactcgatgtccatgttggttatttctaatttttcaccattataaacaaccctaaagttaatatcctcac

SEQ ID NO: 61210 - DNA, 1854 bp, Homo sapiens
attacaggcgcctgccaccatgcctggctaattttttatatttttagtagagacagagtttcactatgttggccaggctggtcttcaactcctgacctcgtgatctgtccgccttggcctcccaaagtgctgggagtaatgtatcacatatatataatgtttcacaattctcaaagtacttttacatgtagcatttatcttattggaaggagtaactgtaaataaatttcagttcctcagaataaatgatatgtaagcagcttgtctatttaaatacttttttttccacatttcttgagtttttaatataatcggaagaaagaaagaagttttcaaaggtgtttaagattatgatacccttctaaaccaggctggaaagtaagagacttctcttctaaaaaactctgaagtttgctttaatattatttaacagcaggaggtgagtgtcctacttaaccataatttatttttttttccttcaggacaacataggagagcttgatcttgataaacagtctgaacttagagctttaaggaaaaaagaactagatgaggaggaaagcattcggaaaaaagctgtgcagtttggaaccggtgaactgtgtgatgccatctctgcagtagaagagaaagtgagctacttgagacctttagattttgaagaagccagagaacttttcttattgggtcagcactatgtctttgaggcaaaagagttctttcagattgatggttatgtcactgaccatattgaagttgtccaagaccacagtgctctgtttaaggtgcttgcattctttgaaactgacatggagagacggtgcaagatgcataaacgcagaatagccatgctagagcccctaactgtagacctgaatccacagtattatctgttggtcaacagacagatccagtttgaaattgcacatgcttactatgatatgatggatttgaaggttgccattgctgacaggctaagggatcctgattcacacattgtaaaaaaaataaataatcttaataagtcagcactgaagtactaccagctcttcttagactccctgagagacccaaataaagtattccctgagcatataggggaagatgttcttcgccctgccatgttagctaagtttcgagttgcccgtctctatggcaaaatcattactgcagatcccaagaaagagctggaaaatttggcaacatcattggaacattacaaatttattgttgattactgtgaaaagcatcctgaggccgcccaggaaatagaagttgagctagaacttagtaaagagatggttagtcttctcccaacaaaaatggagagattcagaaccaagatggccctgacttaatccttgtttttaaagaaaggaaatgtgcaatattgaagtgatctttttccctagtcagacaggcccaattccattgtgatgtttacctttatagccaggtgagtgcagtttgaacttgagatacagtcaactgagtgtttgctaggatcctaaggaacataaagttaattaaaaacttacacctaattatgtaaattgccttgttaaagacatgtgatttgtattttagatgcttgtttcctattaaaatacagacatttctaccctcagtttctaaatgtagactatttgttggctagtacttgatagattccttgtaagaaaaaatgctgggtaatgtacctggtaacaagcctgttaatatattaagattgaaaaagtaacttctatagttactccttctaaaatatttgacttcctaaattccccccacccaaaatctttcccttttgaaaatactaaaaactaagttatgttattataaagtgtaaaatgg

SEQ ID NO: 61211 - DNA, 1050 bp, Homo sapiens
ctgcactccagcctggatgacggagcaagactctgtctccaaaaaaaaaaaaaaaaaagtgttcaatgttttttagtatattcacagagtcatgcaaccatcactataattgcttctagaacattttcatcatcccccaaaagaaagccttcgttacgaattttaattagctgagattctgaactctgggggaattttgtattctagaaatattttttactaatatgctacagttgtatttgtcatgctggtgaaaagatgtggtctttcacctggatgctttctcattaagcattatttttctgtttagcttcctgtgtgagcaaacattttctcagcttgatactcagtgcatcagcggcttgcagaagagactgcctaggcctgctctgtccagtacggtagccacaagtcacttgtggctactgaacacttgaaatgtggcaaggccaaattgggacaggctgtgaatgcaaaatatacaagatttggaacccttagtatgaagaaaagaatgcaaaatatcccagtaataacttttacattgatgatatgttaaaggacaatatttgaatatgttaggttaaataaaattaatttcacctgtttctttttacttttaaaaatatggccgctggaacatttaaaactccctatgtggtttgctttgtgtttctattggacaaagttggtctagacagtacaaggtgtgaagacaccgccctctgctggagaagatgctggatttttatttcacctacaggaagagacgtctaagtagcaattagatgctaaactaatgctgcctcaggaaagaatcaaaagagaaagagtgaaaccaggccgggcgcggtggctcacgcctataatctcagcactttgggaggccaaggcgaggggatcacgaggtcaggagatcgagaccttcctggctaaccccgtctctattaaaactacaaaaaattagccgggcatggtggcacgtgcctgtaattccagctagtcgggaggctgaggcaggagaatagcttaaacccaggtggcggaggg

SEQ ID NO: 61212 - DNA, 1527 bp, Homo sapiens
tttttttctttctttcttttttgagacggagttttgctcttgttgcctaggctggagtgcaatggcgcgatcttggctcactgcaacttctgcctcctggattcaagtgattcccctgtctcagcctcccgagtagctggtatcacaggcgcatgccaccacgcccggctaatttttgtgtttttagtagagacagggtttcatcatattggtcaggctggtcttgaactcctgacctcaggtgatccgcccacctcagcctcccaaagtgctgggtttacaggcgtgagacaccatgcccggcctttgatgtagcatttgatatatgtttttatcatttccttatgaactcacagatttgcagtctatttaaccgtagttcataggtaattaaattcaaattataaaatgtagtgactgactaaacatgataattatgaccattttcattttatttcagagttttcttggaggcttttttggtccaatttgtgagatcgatattgttcttaatgatggggaaaccaggaaaatggcagaaatgaaaactgaagatggcaaagtagaaaaacactatctcttctatgacggagaatccgtttcaggaaaggtaaatcttctgtttgacaaaactatctaattgtaagatatcagaattagttatcaaagtggtctgtgctgtttcttaaatttgaataattttatgagggagagagatttttttttccctaaagttcagctaaaatatttgattgattagaagataatctttcctgcaaaggaaagattcttaccctggaaggctttcaagggaagagcctctaaatttcatgcaaaattttctgtttaagtctcctgtgtggttcatgaaaaaaaaaatattttttttttctgtttgtgattatgtgcttctgtctggtttcagacagtttcttcagatcggagctgtaattcacccaaagtttgtttttcctttaacattaagttagagattgagagtaattctctggtataactttctaaaggtttttttacattctttgtaacttacctctctgtactgctactattgtgtctgttgatcttatttctaggtactctgtagaggacttgagtacttttgggatgtgtctatgcatggtcagatatgtttatgacgccttctataaggtttcacttttttccccttttctttatccggtaatgtatacggttttttgttttgggttttttgggttttttgttttgttttgtttcgttttttaaatagggtctcactctgttgctcaagctggagtgcagtggtgtgatcatggcttactgcatgcggccttgtactcctggactcaggtgattctcccacctcatcctctctggtagctgggactacaggcacacaccaccacttcagctaattttttaatttttttgtagagatggggtttgtccatgttgcccaggctagtcttgaacttctgggctcaagcaacccacccacgtaggcctacaaaagtgctgggattacag

SEQ ID NO: 61213 - DNA, 1063 bp, Homo sapiens
taatctcaaacttctgggctcaagtgatcctcctgcctctgccttccaaagtgctggaatgacaggtgtgaggcactgtgtccagcctcagattcttacataactatatagaaaactggtttgcattatctgtatccagcagttctactcctagatacatactcaagagctcttttaagagcaattctagattttcagaaaaattgagcagaaagtagagttctgtgtactcccttcttcctcaccccagccccacatggattcactgttactaatcttgcattagagtgatacatttgttaaaattgttgaaccattattaccacattattattaactaaagtccatagtttacattagggtttactctgttgtacattttctgggttttgataaatgcataatgtcatgtatccatcattgtgatatcatatagaatagtttaaccaccctaaaaattccctgtgtttcattcacctagtcatgccgctctggcacctgcgctaccaccaccatccacacagtcttcggcaactactcatctttttactgtctataattttgtcttttctagaatgtcatgtagttggaatcatatagaatgtagcctttttagattggtttatttcatttagcaatattcttttaaggtttctccatatatctttgtgacttgattgctcatttatttttagtgccaaatcatattccattgtatggatgtaccaatgtttgtttatccgtttacctactatcttggttggttccaagttttgctcatttttctatctagttgactctttttctcttattgatgtgtaggattttttgtatgttcttgataaaggtgttttatatatctagatatggagtcctttgtctatgtatgtatcataaatatcttctcctaatttctggcttgactttgtagtctcttaatggtgtcttatgataaacagttcttaattttaatacactagatacataatgtttcctttttgtttatgcttttcatatctagtttaaaaaatctttgcctaccccttgggcacaaagatattct

SEQ ID NO: 61214 - DNA, 1057 bp, Homo sapiens
tattagtcatagaattaactgtttgaccagaaaacaaatatggatagttgaaggctgttcctttctttgagtctttttatagttctccacctattaaggattccttcttaacaaagcagactttatgttgatgtaaataagaggttcacccatgattgtgtataactaaattacaccttctctggtgctataacatcatcctgatttaggtatgtggtggtgtctcaaacttcataaatgaatacctgaaatatttatatattgcattcatctgaaaggaagctactagtaggcccactcataggattgttaacatctcttataatttcatgttttggcaggtaaacctagcctttaagcaacctggaaagaggctagaacaccaaggaattagaattgaatttgtaggtcaaattggtgagttttaaaatagtattatttctttttctttgataactgaatttgaagagggttggattttgcaccaaaataattgaattagagcttagctttgtagaaggaaggaattgattttgcataataaaagagaggatttactttataactatattaaattgtgtttctttgacttgtatgaaatgatatttgatatatcatttcatgatatatatgaaactaccagccttgaaaactaattcaagtaaattagttgacctactgaaattttcatctgcctgcatttttcaccatccttcttataattagcagcctcaccttcattcttcattttctaattacccatgccatttgtcttcctgatctagtgtgtgcctgtagccagactcacttgtgtcaacacacaattccatgtgagaaggaaaggtgtagtttcttcttgacttagatcaacttatgtacatttccatacatgattccagatgaatgcttgatttagtagggagttaaactatataaatctttctatactgaagattcagaagagaaaagaaaatatgtctttataatactgtctacataactaggcttaaaatctagctttctaagtttcagtgtacatttttaaagtatcagaatt

SEQ ID NO: 61215 - DNA, 2109 bp, Homo sapiens
tatatatctgttctgactgagagtgtacttacatgtctattctgactgagaggcaagttgtagtaattgatagttggttttagtctttttgtgttttgtaattttatgaaggtaatatatttgcctaactaaagcaaaatagaatttttgccttgtctaggggaagttcaaataattgctggtaatgtgtcaaatggcttcatattgggagagccccaactacatcaaaggaatgaactcatttttaaagaaattttcattgtgctatgccacttgaaatcttttatgcctacatgaagtataattataaaaaggataatggaattcagagcataggtctagtttattagagacaaactcaataattcttttggtaaaaatcgtttgtgtttgaagtagatgtctgggttttattgaaatggctattaaataattggtctttttgccttttaaaatttctcagaacttttcaatgacaagagtaatactcatgaatttgtaaacctagtgaaagaactagccttacctggagaactgactcagagcagaagttatgattttgaatttatgcaagttgaaaagccatatgaatcttacatcggtgccaatgtccgcttgaggtatgaatgtgtattataaactgtaaacagaatcaaaaccagaaagtaatgactactgttgatatcttatttgaacctctaattataattctgtattggaagatttaagatttttaaaaattctgtcacatactttggctaatgctgatttgaggtaatagagcgttctaacattatagagttagacaacattgttatgagacatttcagttatacacttccctggtatgaattgtcccttacgtacttcatttgtcatgtaaactgaatgaccttctaaatccactagtttcccagaaaatctcctttagtatatggttcagaagtaatctggagtaccagagaggctctgatacatctaaaatgacacaaatagtggatggcagaaaaggagtacgaacctagttttctaaactctcaattcagtgtcctttcccttcactaagtctgtatgcaggaagccagggatgcctcagagtccagggcatttcaggatattaatctgaatgcatcaggtccgagatcttgctttctctgtttaacttggcattatctatctggaactgggtttgacaacccaaatttcaaatagcagttccttaaagaagtgatctggagaggtttcttcaagtaggcttgatgacagccctccaaactcatctgtaaagtatttacactattcttaaaattgaactttgtattttttttcatgttgggggcattaaagaaaattggaactccttcgtgaagtaatgaagtaagttgatcccaaaggagttccagcaaggaggagaagcctgagttgcagttaatgtttgctgatttaaaacatgaaaatttatcacaggtgatttaactcatcgactctcttttaactttgtaggtattttcttaaagtgacaatagtgagaagactgacagatttggtaaaagagtatgatcttattgttcaccagcttgccacctatcctgatgttaacaactctattaagatggaagtgggcattgaagattgtctacatatagaatttgaatataataaatcaaagtaagtatcattcacagataagttgttcagagaaaattcaaaaattaacttttcaggtgtttgtcagttggtcaaagtaaggatagaattgacattaatctgatgttaacaaatcaacaggatctctgagctaaaagaaattttaggagtttggtctggtttccactcagtaaaggtgtcttttatgttctattcctgataaatctctgcttggccactttgtgtagaggatgtcaccatctcagaaggcagccagtccttctgaggatacaatttatcttactggcttgatattacctcatcctagccatctcttttcacatattttcacctttaccacttaatcactgttaatgtctccttgtatatcatttcttggggggagggggaaggtatatatgtttatatatgttgtatttttacaaaactggctcatatttt

SEQ ID NO: 61216 - DNA, 1049 bp, Homo sapiens
tgaatactattgttattccccatttcacagatgaagaacttaaacaatgagtaagtgatttttccaaggtcacacaaccagtaagtggttgagatctgaagccaggtattctgactctagaacagtagttctcgtctaggggcaacttcacctcacaatgaatgtttggtgttgtctggagatatttttggctgttacatttggagagtactactggtatctagtgggtagaggccagggttgctgctaaacatcctacaaaggataggaccctccccacaacaaagaattattcagcccaaaatatcagtactactgaggatgaaccctggtctttgttattttgcatctcatgaggatgtgaagcattagtgtcaactctatagtgcttagtcctacctgttatgtgactatatttaatcatctttagaattaagtagaaattccttttctttcaggtgaatcaattccaataaggctatttttagcaggatatgacccaactccaacaatgagagatgtgaacaaaaaattttcagtaaggtactttttgaatttagtgcttgttgatgaggaagaccggaggtacttcaaacagcaggtatggtgccacttgggctggtattatgttctgcggcagatctaaaaatacctcgaaagcactcttctaagcttcactgtactgagcgagtgggagtttctaaataaataaaaacactgtgggtatgatagataaagaagtagaggagaatagaatcctatgatagatccctccccaatcattctgcagtactccagaatgagctataatttttcagggcttttagttttctcttacaagttcttttgtttttgttttttaataaaaacaatacctgctgcttatttagaaaaaaataaggcaataaagaacaaagaatgaagtaaaggtcagcagaatttccaccaccattgcaactaatgtgtgtatgtgtgtttacatcatattatggatattgcttttttttttttcttactgtttttaattttttgtagagacagagtctcac

SEQ ID NO: 61217 - DNA, 2565 bp, Homo sapiens
aaagcttttggtgaattttgaatgaagatagtaattagaatggtcttttgtattctgaatcagattaataaacatgtagttaaatgtcagttgagtgttcaaagctaagttagaaattaccctgtcctaagtactgtgaaaaatacaaaaactaccttttataaacatgatctgtcctccatgttctcacattgtagatatctgggaaaaagaaaaataatataaactaacagaatacttaaataatagcttgacagtaatttagaagagacaaaacctattccagtattgccatcctaatgttgtataattaaacatacatgatttataactttgaaataaattacatgatttttacaatttcaaaatcaattgcatatcatggcactattggaggtaagtctgttatttcccatgtgcactcatttggatgtttaaattctgatatgttggggaaaaaaaaaagcctataatgacttcatgaagcaaataattttaggaatttagaagagggaagttctcaggatggattggttagggtaagagttaggtagagaaatcgagatttgaagactggggaagatgtagggcgagtttatttggattgcattggaggcagagagtaactccatttggccgatgggggaaaatggtcaagggagggaagagaataatgttggtaaattggataaaggttatagaggggcatgaatacctgtttggagatttatcctggaggcactgagaactactaaagagcaatccaagcaatgtgctggaggattaacctgctagtgataataaaggattagatagaaagggctctgcctctcttgcctctgaggaagctgttttaatatctaagtgacaagaacttgaatttggatgagggcaatgaacaattaaaggatggatttggggaattctttaaagtaacaataggacttcttgacagattggattggtggtggtggaatgcatgggtgctggtgataggagcactagaggtagaaggggcagtcaagattagagctggaagaaagtggaaaagaagttggaaaagaggagggcttttgtagggaagaatttaattttattatggttaaaattgaagtggcaatcaatagagataaggcatcatatcaaacattaatttgttaatatcttgcatttgtttactaggagataattttatggagaaaagctcctgaaaaactgaggaaacagagaacaaactttcaccagcgatttgaatctccagaatcacaggcatctgccgaacagcctgaaatgtgaactgaacaggagaaaaaaagaaaagcaaaaaactcctgtaacccttgagattaagttcagcaggttaaagatggttgcagctggagggggcggaaaaaggccaaaactccatatatgttagtcttcctttatcttacagcgcagcatttattttatgatataatgaaatgttcgttcatgtatatacatttttaaaagtgctttctttgaaacactggaactttgttaagctgcctttttttttttaacttcctactttgatgataagcactcagatatatatcagcgtaaacatgaaaaattttcatgtgagtaggctggtatttgtaattttgctttctttctgcataatgttgattataaatcctctcttttcaggctaatgattacctcttattctctacatgcaaaaaattaaatattttgtgttcaaataaaattagaaaacctgagtggcctcttgtgtcctgcagagatttaaaacatggcatctcaatatttttgagaactacatttgtttttaacatatgtgtttgagaaaagcatatggagtgtttcaccgcaggcacttctgagtaccattccatggcttccagaattttatcctctttgaggtcttctgtgctatgaatattagatttctttccccaagggattatgtggcaggtcattatggccttcttttttttggccatattaagtaacagttttgctatattccagtagtaccgttgtgtgttttctgcaatgtggagttgacttagcttggcattttagatttgttaaaactattttttccataaatactttgaaacatatttatatatttcaatttaaggaatctttttgccatgtgtatgcaaatattattttcttcatacattcattttcttttcaggggaaaattttgggatgggggactcaggaggacctgtgaagcatgtagttatctagatctgggtaatttcatgtttattaaactcgaactttggctagttaaactcatattgaaacttcatctagtctcttaattttttaacactaaattcaagtcatttgttttaagtctctaaaaaagaagattgcagtcatccattcatatgcatggggtctgatcgcaaatacactaaatgtggagtgtaggaaccaaaatgaaacctgctgtatggaaactactttcacttatggttcattggtttttgtaccaatattttttatgcacttcagtgcaagtcttgtcagttaaccttactttatgagtaagctaaa

SEQ ID NO: 61218 - DNA, 2565 bp, Homo sapiens
agcttattttttatctttttaattatttctttaggataggctcctgtaagtggagttcttgaggtccatagacatgaatgaacatttctactgcttgatgttggagtgaatttttgatcatgttttagggcagatgttttcaaatttaaaaacaaatagctgaacttggctgggtgcggtggctcacgcctgtaatcccagcactttgggaggccgaggctggccgattgcttgaggcaaggaattcaagaccagcttggccaacatggcgaaaccctgtctctactaaaaatataaaaattagccaggcgtggtggcgcatgcctgtaacccagctactccagaggctgaggcacaagaatcacttgagcctggaaaggagatattgcagtgaaccacagtgaaccgaggtcatgccactgcactccagcctgggcgacagagcaagactctgtctcatggaaaaaaaaaaaaaggctgaactctttttttaaacaaagagtatacattgaagcctgttatgtaaaatacatggaagtggatctgctcggggataaggagcttggagtttcttctgccctccaacccccaacctctgaggtacctcagcgattccatggagcctaatttgaaaaacacaagtatagggtctgtgttcagtacttagcatccaaatgccagcttctaatcctggctcatttcactctgatagagttgaaactttggccaaagcaatttaaaaggcctgagattaataaaaattggataatctttgcccattagaagttggtgattatttcaaggtttgcatcagagataatatttttgaaaatacttggtaaggttgtaaagcaatatgtaagccaacgtaaagtactttggctatgtaaaatgttgtatatttaattataaatctttaaaattaagaaacccagttttgcattgacaggactgtgtgctgaagaggttcatttgtgtggagaacctgctgctattgacctggtgatggagcttatgtacacaacgggggaggaagtggaggtattcgattagatgctttgttctccaggtggcatatcaaatagtccagagtacctaggcagtggcttcagaggccctagataatgccagcgtcagaacttaactaaaaagaaagcttcattttcttgtgatcaactagaccatatatatttgattgaacctcatgatctgaagttctgacagagtggtcatcacaccctaagtcttccaagagtacaggaaattcttcacttcttgacaaaaccttgtggggcttgagtagatctcttcgaattaaataaatcagtactcttagaagttggagacccagcaagtttgtcgttttcaaagtgttgtatgtcagatattggggcctttgatacacatctaattgccagacacagtttatattcctttttgaaattcttagagttggaagtaactggtttccttttaatcctgcttctctttttctttaccagagttctatagtaaaatgaattattattattattattattttttgagacaaggtctcactctgttacccaggctggagtgctgtggtgcaatcacaactcactgcagtctcagcctcctggactcaagtgatcctcccacttcagcctcccaaatagctgggactacaggtgtttgccaccatgcccatctaattttttattttttgagcagagggcatctcactgtgttaccaaggctggtctcgaactccagtgctcaagcaattctcccaccttggcctcccaaagtgctgggattataagcataagccaaggaaatagttttgaattagcctgttattttagttttgtgctcagttttcaaggagagatagtggaatatagtggaagaaattttggagtccattctgtgttttgccattcttagctttgcattctttagacaagtcacagaaggttagacttgcaaaatgtgcctcagacattaattttttattgggctcagttttactattttataaaatggaaatagcagttaataacctttctgaacttaacacattgccgtgaaaatgaaatatatgagaaaaagctttgaaaacaggtgaaacactctgtttcatcttattaatttagagatgccaatgagaagtgatggtaacacttataatatcaaaataaatgtttttctgtgttttcttttgaaaaacattggtacttatcagtttttagctactcttaactgcattacaatcttttcacttaattactagtcacaagaagttgagttgggtgtgtcattttgccatttcatgtctttattgtaggttcgagactataagaggcttacccccatttctgtgctggaccatgcactagaatctttagataaccttcggcctggggactgcattgtctgttttagcaagaatgatatttattctgtgagtcggcagattgaaattcggggattagaatcagctgttatatatggcagtctcccacctggtaattattgactttcctcgtgacaagatatgaaatctcctatctttgcaattta

SEQ ID NO: 61219 - DNA, 1009 bp, Homo sapiens
caccatgcttggctgattttttaaaaattttttgtagagatgggaatctccttttgttgcccaggctgatcttgaactactgtcctcaagtaatcctcccaccttggcctcccaaagtgttgggattacaggcatgagccactgcacctggccgtaaaatcttttttttttttttagacggagtcttgctctgtcgccaggctggagtgcagtggcgcgatctcggctcactgcaagctctgcctgctgggttcaagtgattctcatgcctcagcctcccgagtagctgggattacaggcacgcagcaccacacccagctaatttttgcatttttagtagagacggggtttcaccatgttgggcaggatggtctcaatctcctgacctcgtgatccgcccaccttggcctcccaaagtgctgggattacaggcatgagccaccacacccagcccataaaatcattttttgtacactgccagatcatcataggttttagaaatataactaaaatgtaagcaaaagactaatttctcagtggccataatctgtcatttttactaaatcatcaacttttctaattggtaataaatggtaaaatgatattttttctcttttactcaaattcttggcatttacttcatatggtgagagcttagcctgaatgggactttatcgtgcaataacttaagaaaatttgtcctttttgaaaaaaaaaaaatcagcttatgattgttttttcttttactaaaaggcagctggtcttcatccaactgctgagcagattgaaatgtttgcctaccatctccctgatgcaacactgtccaatctcattgtaagtggaaactccctttcacatctcccctaaaaatgttgatatgtcaggtgattactggttaacctcatgagcatgaatggatagtctgcctttgagaagttgctatttataaaatttattttacaagtgaaaattttttctcaaaatcttttgggactttagccctgaggaa

SEQ ID NO: 61220 - DNA, 1050 bp, Homo sapiens
aaaagcattggtatcacctgggagcttgttagaactaaggagtatcaggcccatgcctgacttgatcagattctgcattttaacaagatccctgggtgattcacttgtacattatcatttgagaagtcctgttctaggccagtgattctcaaaggaggggcatgtccctctccaggagtatatcagagtctattgaggtatagtgctgacccaccctcaggatgacatattcctccgatatgtgggggcagaaatcaaggttgagcaaaggcactgaagagagtttgcaaaaagaacatttagaatttatcaatgtcatgatgtaggtgtgccattgagagttgtccagtgactgcgataagagctgttgctataatgctaatgtgtctttttcccagctaccgatttatggatatgtttccagatgccagccttattcgagatctccagaaagaactagatggtattatccaagatggtgtgcacaatatcactaaattgattaaaatgtctgagacgcataagctgttgaatttggagggctttccatcagggagccagtcacgattgtcaggaaccttaaagagccaagctagaaggacacgcggcaccaaagctctagggagtaaagctactgagccacccagccccgatgcaggagagctgtcccttgcttccagattggtgcagcaaggactcctcactccagacatgctgaaacagctagaaaaagagtggatgacacaacaaactgaacacaacaaagaaaaaacagagtctgggactcatccaaaagggacgagaagaaagaagaaggaacctgattcggactagttttctgttcctgtttttttttttttatttaattttgcaaataaaaatttattttgaatcctttttcctcatatgcatttactccctcctctagtattgtggctatctggtactgggggatttttggtgtgtgtgtgtgtttgtgtgtgtgtttgtttgttttttctttttttgcacagaaaaatctctcttgatgactaaacttgtttttttttt

SEQ ID NO: 61221 - DNA, 1027 bp, Homo sapiens
ggccagagtgtgggagctggcacgatttgtgggaaagtgcgagaggtggtgtgaaaaggcttgaatttgagcccctgctctctaacgagagggcacagctctagcaggctgagccacagcctcctcttctgaaaaatgggtacctggtgtgttggttgctgcagctcatatggcttctagtgagatcacagatatgaacatgctgaacaccagaggcattcacactttattttttaaagttgatggaacttccaggggtggtggaccttcttgagtctcggcttctaaggcattctgctccagcctagccattgcctgggtcaatttctcctccctcctgtaagggcatctaagaatggggaggctgtgggtcacactgggcacatcccggggtcctgggaagcaggtcctgactccctgctctattgcctgcagcgatcggctggcccttctccaggtcaggaggattctgcagcagctgggcctggacagcacgtgtgaggacagcatcgtggtgaaggaggtgtgcggagccgtgtcccggcgggcggcccagctctgcggtgctggcctggccgctatagtggaaaaaaggagagaagaccaggggctagagcacctgaggatcactgtgggtgtggacggcaccctgtacaagctgcaccctcagtgagtgcccacaagaggcgtggcgggtggggctggggagggctggcggccaagtgtggacttggcatagcctcctgaactgcggcatgggaagatgcatccccgtccttttatgggaaaggagtgctgtgtggtcaagtcacctattcaatctgacagacaaggtgtgagccctggtgcctctgctacctggtaatacgatgtgggaatgttagccggcctctctaaaccccaggttcctcatccacaaaaggccagcactaataatccctaccacatagggctaaatgtgtgaggttgaaatgagttagcacatgtaaagtgcttcacacggggctcaagaaatgtaagttggctg

SEQ ID NO: 61222 - DNA, 1071 bp, Homo sapiens
tagactagccctaggggcttctcgtcccggcggagccgggcggtgcctcctgcctgcgcctcgcacctccccgcctggcacggcccacccgggcacggcgccgccacgcgtgaaggcccgcatcggctccctacgtgggggacgtgcaggatgatgcggggtcgggggggatttcgctgcgtcgcccgccccctttccggcgcaggagggagcggccgccgcgtccccgctccccggccgggacgccaccgccgggcgttgcagaggcgcgccgcaaccaatgggcgtggaggaggtgggtcggctggcggctgtcaccctccaggggacgggagcgcggagaccgggagcgcgcgagctgtcgccgcgccccgggccgagggggaggagccgggggaggaggaggaggaggagccgccgagcagccgccggaggaccacggctcgccagggctgcggaggaccgaccgtccccacgcctgccgccccgcgaccccgaccgccagcatgatcgccgcgcagctcctggcctattacttcacggagctgaaggatgaccaggtcaaaaaggtgagcccccgcccgcgccgccgctggtcctggccgcagccttgcgttccggcatccgctcgccgcctccgctgcctccatcctccggcgcccggccttctccgggccagcatcgagttggactgcagggcgcaaggaaagccttcgccttcgattctaccggcattgtcagtgtctctgtgtgtgtgcgtttttgggaggggggcaatcgggcggaagacccccgagaccgggctgcctgctgcagtgtccttgaaacgggccctggatgtcagataggcccccgggctgtgcggggaggtggccggtgggcccttccgcagggcctgttcgggagggtccgagcgccgtgggaggaggtgtgatcatggagatgctggggaggtgatcgagcagcaggcgggggtgctggctggaggccaggcctcccatatttggggttcctggcggagggtgtcgggtgccccggagaagctgtcgccgggctctcccagttgtttga

SEQ ID NO: 61223 - DNA, 1029 bp, Homo sapiens
atctttaaaaaaaaaaatgaaacagtgtaaatgtttcaagtagttttgttagaatctttcatttgccatttttttcaggcatattgcctcccagctttagttttctaccaatgggtcaatagcattttggtagatgccttttttttttttttttttttgagatggattctcgccttgttgcccaggctggagtgcagtggtgcaatctcagctcactgcaacctctgcctcctgggttcaagtgattctcctgcctcagcttcccaagtagctgggattacaggcatctgccaccacacccggctaattttttttgtatttttagtagagttggggtttcaccatgttggccaggctggtcttgaactcctgacctctcaagtgatccacccgcctcggcctcccatagtgctgggattacaagcgtgagccaccgtgcctggccggtagatgtatttttcaggcattgagatgaaaggagttaggggtacatgattatgtcacttagggatgggagggagggaaatgacacttgatgcttactttgtttctgcacattaaaatcctccccataaccctctgaagtggaggatttattatctccatcttaaaagtgagactcagagagattaagtaacttgtccaaagtcacacagctaataaatcggatttgaacccagctctctgtccacagccctgtgtactttccaccatgtgaggaaaatggaaatgcttaaggtgaagccccaaatgggaggttacgagccctggaatctagacccagctgccatttctaaactccccaacttagcttgaatcatgggtctgtttcctctcctagataatggagataatgatgtctttcctgcctacttcactgggctgcagtgacaggagaaagggaactagcattaaagcacctgcttcctgcgtggcacttggcatccacaagctcatttcacttctttctacacagttcaaatgggataatgtatgtgaaggtcctgtatctgaagggccagtgcacat

SEQ ID NO: 61224 - DNA, 1049 bp, Homo sapiens
tgaaggacaaacaattagtgatagccagtgacaacccagggtgcctaaggttaggagcctgggcagcttgaggagaacggggaactcaggaagaggagcaggttgggtcaggcctggtgaagggtgggagtagtttgactcggaggtgcagggcccatggcctggcacacaggcccggcacatgggtatgggagcccaggggctgtctccattcattgaggctgggtttaaggtttctgtgctctgggcctgccaccctgtgttctcagaagggtcctagccctttggccgccatttctgtctttctagaagtcttgcccatggacacctgccagtactactgtctcatgttaataataatagctgatgtttattgagcagttactgtgttctaagtgcttgtgtctcatttgaacttgtcctatatgttaggtcctatctatcatctcagtttttcagttgaggaaactgaaattcacacagctgttaagctctggggctaggattgaacccagttggctggctccagagcccttgttcgtagcctctctgtcattcccatcccagtgagagtgagccagccaattctcagagagagaaggaggcttgaggtgttcctgatactggaggaaacctacctccatcaagtacttgggggttgaagagcagcttccatgtcatatttgagggttggaaaggatcttagagatatcgggttcattttacaggccaggaactagggctcagagcatttgcaagcctgttctgggtgacatggatgacagcagttgaatgaccttccgccatgcgatgtgccagcgtgcgtgttcctgtgcctgtgggagctggctatctcagcgggtgggtgcctcaccttgccctgtcctccccctcgacctcactctccttccttctcatccccctccagattgacaagtatctctatgccatgcggctctccgatgaaactctcatagatatcatgactcgcttcaggaaggagatgaagaatggcctctcccgggattttaatccaacagccacagtca

SEQ ID NO: 61225 - DNA, 1021 bp, Homo sapiens
gtcagagctgacatgcagagacccagggcaggcactgggtggacctcagatgtagggctttgtctgagttgaaatgcggtgtgattttttatttctgcatagcagtgctgtttttgaaataggttaagaaactagagaaacatggggtgggaatttgtacttaattcagtacttccattcccctatagtcagaagtaagagactgggattgcttgaagctatttctgtctaaggactctggggtaggatagggtttcttttgcctactctgcgtatatggcagtggttggatgaagtttgcatgattgctgctttctggctgataacagcatgtggcagggggaggcagacagggcctacgccctgccaggaagcgggcatggtatgtggcttccccttaacatttgaatctcatgtgatacctgttgtctccctaaacagaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccaggtgggtccctgctccctccgggtcaccccgtcgggccagcatccccttggttacctccaggaaccaggcctcaaagcactggcatcccaagcccctggaagagggttgctggaaagagtccctcatagatgcatatgtaaaaggactcctgggcagaggatgtgacagcctgcatgggggccctgcttaaacagaggctctccgtctgggcaaactggtgtagtggaagtgggctgcttggactagcagagtctgggtttgaggagggaggctccgcagctctgttgggtaaatgcactcattccctgtggatcctggggtcggttccccagtgcaggtttagcagagccctgggtgaaaatgcccttttctcctggtcattggcctcacccacttactggaggccccggccttgtagggtatggctgtgg

SEQ ID NO: 61226 - DNA, 1026 bp, Homo sapiens
ctccagtgggctagaggctgtggaattgccctcagagtttctgaaattttcagagagcgtggcgtcgggcggggcgggaaggccactccacctggtggctggtggagatccgtgacctgtgtgttatgaaggcatagctggttttctattatttttccatttttctcagtacccagatgttgcatattagtgaccactgagaggccagttctgttgaaggctttgaattgcttcttaagagctgtacttgcccacagggtagcttttgaaaagtgactcttctctgcattcacacacagcatggcttttcagacagggccaccaggtcccaggagtacgagcactttgtttgggtagatgtattcctttctgtgtgtgtgggagggaatggtttatatttttctatgaaatgctaagcctgctttggggccccctgactgctctcatgtttccttcagctttttgatcatgttgctgagtgcctgggagatttcatggagaaaaggaagatcaaggacaagaagttacctgtgggattcacgttttcttttccttgccaacaatccaaaatagatgaggtaaggatgttctgggattatcgggctctgcagatgccccgggatggaaaagctaacaagcccttttctccacaacttttcccctttgttggcagaatggtttgcatgtctggtatttttaaagaaacatttgcagaagttagtgtggtatcatgatatagtgtttactttttcacttaaacttcagttatttatgtatttttggagacaaatcagggtatttttggccaccaggtagacagaagcatttattaatcttaggcaagcaaaggaaaataaagtagttttaatggtggtggagagaggtgggaaagctctttgccagaattgcatggtgtgatgtttacctggaaactgccctggttactgcgaatatgctcagggccctgtccctcaggtgccagggctgcctctccatagtggagctgatcagtggctccagccccag

SEQ ID NO: 61227 - DNA, 1883 bp, Homo sapiens
cctaataccacattataagccaccctcacacttagtggcttaaaacaaccacgctttattattgttcatgcatctgtgggtcagttggacagttctgctcatcagggccaggattggctgacctctgccggcctcattcctgcatctgcagtcagctgttgagtcagctgggaggcagatctcagacgcccttccccacatgtccagcagttggctgtcagctggggtgcaggggcccctggccctgtgtctcatccttcagtgggccacctggctgttcaagtggtggcagcaagggctgcgagggagaggggaagacttcaaagcctcctggaagcccaggctggggataggttcagctttgcctctgccacactctgttggcctgaacaatcctagggctgggctagatcccaggggaggagaaattgactccatgtttcagtgggaggaactgcagtcatgttgcaaagaaggattttgcacatgcagggaagggaatgatgcagctgtttttgcaaataccccacaccttgacataaattattattttttgtaggagattttcattgttgcagccctggtgaagtctgtgtattgtgacaggtggtttactcacatgctctcctcccagtgtggctccaagtctgtggtggtcagagatgtggtgcccactcttcctctgagtctgtgctgtgtcctaaagggaggagttgcagcttctcctctatgtttgctatggggttctccccttgaaagtctggagtcttggggttactggctgccaagaggcacttagctgtttttgacattctttacgcttttgactgcaacagagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagaggtgagattacaaaaccatagtgcatgtgcactgcacacacggccagtggcaccggcagtcacgtgatgaccaaaatccgccacggggtgcccacatggatttgtgtccttgtggcccagaagcaccagatgctttttgccatgcctggcttgtgacactctggtggctgagaagattctggaaaaggaggctcactctgcatgtgtgtggggtgtgttttcctacgtgtgtgtgtgtatacacactttggtccatgtgcactgataaaattaaaaccacagagagcacgggcgatcctttcttttcccctgcagctgtttgatcacattgtctcctgcatctctgacttcttggactacatggggatcaaaggccccaggatgcctctgggcttcacgttctcatttccctgccagcagacgagtctggacgcggtgagtctctgttcttagggctcagtgatcgggcagcactgagtcccctgtggcctgggtgggctggcccttgaggccttctccagcctcagtgtcattcctagatgacagtcacagtcacagtgggttgagccaggctttatttcacagcctgcagggcatactgagactcttctctcttcttttctctttgaaagcgtcaccttttctgggaaaccttctggtcctccaagcaaaaaaagaacctcatcctcttctgtgccccctgttcatttgattgttgccttgcttataacacttcttacacagttagttcttagtgtcttttgtttctgctagtggtagactccgtgagcaaggacctgtatccctgcacgccctagcacagtgtccaatcagaggagataataaatgtttgttcaatatatgagatgaatcagggtccaggatcagagcttgagcac

SEQ ID NO: 61228 - DNA, 1033 bp, Homo sapiens
tatacacatatatataggcatgtatatattgtatattcatgtgtgcatgatgttgtgtgtgtacgtatatatttcttcttctggtctgaatgttgcctaaacctctaccattgatgctccatctctttgctataaagccatcttctattaaaataaacataaccctgcctggacgggtgaacacattggctcttggttgaaagtcagctaagcaggtgccctctgggtgatgtggctcagactctccatttacatttcaaatttttccatttcaaaattgggaaagaaaaactattactttgttcatcacaaaaaacgtgccccctgcctgtggaacctcaggccccagaccccaggcccagttgcaagacccccaaatgcaaggccaccgctcctcattgccccctcgtgtgttccagggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtaaccccgcctggtggagaggacactcacagtcagggtgggggcagcacttggctgcattctgccacttgcagtggaagaagtttctaggaggagaggtctgaacagaggtttcaagactggaccccctggctcactcctgacctttgtcttttggacagcagagaaccagggaggacagacccccaacatggtacaagatggcccagggttgatgcctgtctaggggctgcctgtgactgttttttagcctggaggattctggccttccggtccccttgctgtgttcctttcccatcagaataacaagggggtggggtgagggtggctgggcggcaggttggtgtgaagcagaggccctgtcgcaatcgtcctttcctccgtgagcctcctgcaccacctagtggccttgtggagctttgcagctcag

SEQ ID NO: 61229 - DNA, 1117 bp, Homo sapiens
gggcccagtgctatgctatgctgtgctgtgccctggggactcagagctgaaaaagacacacatgccctgtcctcttggggctgtcactacagcagtggtggtgggaggcagtgagctcaggtgtgttgtgaaggaggagaatggtgaggtgtgtgggaacctgaaacaggcaggtagaacccaggatcaggaggaggacaggctctcggggaagtgaccttggggctgagagctatcaggcagctgaggagggagaccagtctagcaggtagacatgaatgctggtggttttgtttctgatgtgagagagtggaggactccctggtccttcctggtcctcccactctgcctctgcggcagagcacagggctgggcacatggctgttgatgatgcgcttgaggggcagtaggagacgcggagtgaccgtgagaccgaggggtgacagttctcctggccacttcccatagacaccccaggcccctcctcctgtctcaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagaggtgagtgggcagtgtcttccctgccagcgcccacccttcagaggtcgcctggctggtggattgtgatgggggtggtagggaccctaggggacattttggccatttttgaggattttttttcctctggaatagcagaccctgggcatttgcatagtgaaatcttataattttattataaattacttttcttggcctggtgtggtggctcatgcctgtaatcccagcactttgggaggccgaggcaggcggatcatgaggtcaggagatttgagaccatcctggctaacatggtgaaacccgatctctactaaaaatacaaaaaattagctgggtgtggtggcatatgcctgtaatcccagctacttgggaggctgaggcaggagactcacttgaacccaggaggtggaggttgcagtgagctgagatcgcgccactgcactccagcctggcctggcaacagagcga

SEQ ID NO: 61230 - DNA, 1115 bp, Homo sapiens
agcatttgtcctttgtgactggcttaattcacttagcataatgtcttaaggttcatccgtattgtggcatgtgttagaatttccttatttttttatttttattttttgagacggagtttcactcttgttggccaggctggggtgcaatggtgcaaacttggctcgccataacctctgcctcctgggttcaagcgattctcctgcctcagcctcctgagtagctgggattacaggcgtgcgtcaccatgcacgcccggctaattttgtatttttagtagagatggggtttccccatgttgatcagggtggtctcaaactcccgacctcaggtaatctgcccaccttggcctcccagagtgctgggattacaggcatgagccaccacgcccggccataatttccttatttttaaggctgagtgatattccattgcatgcacacactgcattttgtttattcattcatccatccatggacacttggcttgcttccaccttttggatattgtgacaaatgctgctgtgaacacgggtgaccagtatctcctttcagtttgtgtgtgtgtgtgtacgcaccccaagtggacttgcgggatcatatggtaattccctgttcagttgtttgtggaaccaccatgttgttttccacagtggctgtaacattttacattcccaccagcagcccgtgaaagttctagtttctccacatcctcgccaacacttgttattttctgagttgagaatagccatcctaatgggtatgaagtggtatggaaagtcttttcaagcataatagcaaagaaagaaatcataaagaaaaatggccaaatatagctacatagtgtctgtaagtaaaaaaaaaaagtaatcaaacttaaaaggcaacggtaaactgaggaagacatttgtactgtgtatgacaagacgcctagcagggcatggtgggctttggcaggtctggtctacacctgctcttctccaccggctgtgtgctttgcaatactcaatttctcccagcctcagttgccttatctttaaaatgggaataatcatacattcattggttgtttgaggagtaagtaaggtaatgtatgtaaaatatatgttacatggtaa

SEQ ID NO: 61231 - DNA, 1083 bp, Homo sapiens
tcttagagtgatggactttttggggatgggtggtttggtcatttagtcactcatcaaacatgttctaggcatgagggcatctctgatcctccccgaagctctgcgcttccagaaggccatcccggtcaggtttgtaactttacgtagaagttacaagacattgctaacacagggactggtatctctgctggagtagcaccagcttcccagggcaggggccacaggctcccctagggaggtgggccggttgccaccttgtgtggggatagagggagcaagctgacctgaagtggcaccagaggccagggcccagatcccactggctctctggagctgcaggaaggcagaagtggggccagcatcactgtccttcagaaatgcatcctttaatttttatttttttggataggatatgccagggcgtgagaagtcttgttcctgatgagggagggtggcctgtggtgtgacagagcactggcctgggagctgggagacccgggtcgcagctgctgagtgagggctaatttgtggtgtgaccttgtgggagtgccagcctctctctcagcctcagattcccgtctgcaaaatcagggggttgggccagatcagcatccccccgctgattcctggtggtgcacaagatgattgtagctgggccatgggggaacatttaaacattttaatatgcatgtgggaagtgtgatgtgtattaaaaaaataattagtacctcaaacttgtgattgtgtagatcttgattagtttaggtcaggaccgtatttacttgagtaagaaaagccagtggggttttattaaaacatcgagttaataataatgcaagtagctggccaacctgaccacgtggagacgtgataggagaatggctggagtttgggagacactgggagttctcagtggttccttccagctcttttctgggaatgtaggcagtgtggcacctcttggtcaggtgcagacacttaacacagtctgtgtactgctgactgttagagaaggaagtggcttctcattatggtacagcatcttacagtttacaaaggagtttcaccacctcagggtctcct

SEQ ID NO: 61232 - DNA, 1011 bp, Homo sapiens
atatcccaccaagaggcagcccagccttggcttccatacctctctagtgacagggggttcactaccctctaggcagccatgccacactttgacagctctgacttgaaagtgtacagcctctccctgccccagggtgacccacataataaactgcctccgtctcctgacagggccccttcctgtcgtctgagcagggcctgggcgatgacggcagctcctctttcctgcttgcttccctcagttcaagtgctgtggcggggaggactaccgagattggagcaagaatcagtaccacgactgcagtgcccctggacccctggcctgtggggtgccctacacctgctgcatcaggaacacggtagacactgctcctgtggggactggggggctgtcggggaccccaggtggtataaatgttctcttttctctcttcccaacttgaagatgggtggtgtgggtggatggcagggaagtaggagttggtggcagagcggaggctttcctgattctcaagggctcctgaaagtggagcttctgggggtcgggggtagggagaccatgtctttcttagtggtgttggttaaaatctattgagcacctaccttgtgcaggcctgctctgggcactttggtggtatttactcatttagtattcacgacaaccctgtgaggtatgtactgttattttacccactttacagatgaggaaattgaggcactcaaaggctgggtgtcttgcccaaggttggcagggctgggatgaagtgcaggcagctgttgcctgagctacactctggagaactgtgcaggccaggtgagggcaggagggagaggtgcccaggccaggggagcttagcgggggtagctggctctgcagcattagtggaggcaggcaggacctgcaccttgggcatctccattggtctttggccttgaggtcctggtgatcatcagcagcagagtgcttggaagggggtctggtgacgtaaatgccatcctcttcctctcccca

SEQ ID NO: 61233 - DNA, 1048 bp, Homo sapiens
cccagccccgtgataagcactttatatgtgtatctcactttatgtccaaaacagccctaggaggtgggttctgtgatcatcacaacctattcattcattcattttctcagttaacaaatatgtattgagtacctctgcgtgccagttccttagcagcccacctaaggttgggctctgctcctaagtggcagagcaagatctggacccaggaaatgtgacaccagagggcacgctgggggctctgctgttgccctcctgagtcatcactggcgcctgcagcactcacggcagcgttcacttacatgtagagcagcggggctgggggggacggtcatgggctggaccaggaagtctcactctcttccctggtggttggagaaggagaccctgcggggcacaggtggtgatgggaagtgcccgcggcagcctgtgagttagggcctgcctggggaggggtttgatgaggtctagggcgtgaccacaggtttccctatgcctaaattaatcagtagtcgggagttctggagagcacctctcttcccaagaaggaagttttggcagcactctccgctggtggagcagtggtctatggaacggaagcatggccaggggccctgccctggacctcaggtaaaccacagctgaccctgtgccagctgtagtctgaagttttcctccccaagagccagcggcgcaggaacagccccaccccgacctctgagacggtgtgagcaaagcggtgctctggggcggtcatagcccgggagcgtgggcagcacacctttctctggggtcctgatctgctgctagtggaggggtggttctcccaggtaaaagtcatggaacctgcattcctacagttttttcacggggcatttcttggaggaggaggtggttatgatggagactcaagccagactgcctgggtcggaatctcagctccatccctgctggacggtgcaactctgtgcttcggttttcatctgtaaaatgggtaggataatagtgcctttttgagttagaaccattataaatattagctattata

SEQ ID NO: 61234 - DNA, 1025 bp, Homo sapiens
cagcgtggaggcggcaggcacgggatgctgcttgtgctaccccaattagggcccagcctgccatggcagctccaacaaggaccgtctgggatagcacctctcagtcaacatcgtggggctggacagggctgcggcccctctgcccacactcagtactgaccaaagccagggctgtgtgtgcctgtgtgtaggtcccacggcctctgcctccccagggagcagagcctgggcctcccctaagaggctttccccgaggcagctctggaatctgtgcccacctggggcctggggaacaaggccctcctttctccaggcctgggctacgggggagggagagcctgaggctctgctcagggcccatttcatctctggcagtgccttggcggtggtattcaaggcagttttgtagcacctgtaattggggagagggagtgtgcccctcggggcaggagggaagggcatctggggaagggcaggagggaagagctgtccatgcagccacgcccatggccaggttggcctcttctcagcctcccaggtgccttgagccctcttgcaagggcggctgcttccttgagcctagtttttttacgtgatttttgtaacattcatttttttgtacagataacaggagtttctgactaatcaaagctggtatttccccgcatgtcttattcttgcccttcccccaaccagtttgttaatcaaacaataaaaacatgttttttttttttttttttttttgcctttcctgtgtgctgttttgttggggcgggggtaaggaaggctgcaacctggatttggaaaccccttgtggatgcgaggatgaagggggtgcatggggtgaagatttggcatagcttgggatacaggtggggggttggggggaaagcctcagggccagaggtgaccacgcctattttaccgagaaccgagggaaacagcctgggccaggtacagcatgaggctccacctccaggaaatggggtggatggggtgggggaccagggaagcggagttgccca

SEQ ID NO: 61235 - DNA, 1032 bp, Homo sapiens
attcttatgggtggcatgggggattgctgagaaaggagggtgtgaccctgggtggctgtaggaagggcaggatgcagcctagagaggttgattcctggctggtgcgtcaacccaatgattcattcatctctctctgtcttcacattccagagcttcttcaacaggggccatggtgctcccccagggggtcctggcccccgccagcagcaggcaggtgccaggctgggtgctgctcagtcccccttcaatgacctcaaccggcagctggtgaacatgggctttccgcagtggcatcttggcaaccatgctgtggagccggtgacctccatcctgctcctcttcctgctcatgatgcttggtgttcgtggcctcctcctggttggccttgtctacctggtgtcccacctgagtcagcggtgacctctgagggctgataggggtgggtttgttgagagggacttgctgggccttggtgtgagagcaggcatatttggaggggatctggtggtgccttgaaggtatgatcagagaggggaccacaggtgtgtgtttcccctttgtgttaagcgtgaggcagagggagacgttagtccagcatttccaaagtgtgggtgggtccgttggttcccaagatacttttaggtggtatggggcctgcattaagtggcacaaaatcagagcaagaaagcgatgcccttcccaattctctcaatccttttatgccgagaagatctcagctggatgccaacatgttccgatgcctgtggaagacatgccgacgtctcctctgcctagggagcaggacttgggcttagggcaggtggaaaaaattccagacttttttagcactgtttttgttttaatggtatatttttattggctactttattgtttaggacaagtggtagtggcattctatttattgtgaccttttcaataaatagatttaagtaaaaatgagtccatataaagaaatgtatgaataatcgtacacctgcatgcagatccggaaaacatggtaaagagggattg

SEQ ID NO: 61236 - DNA, 1138 bp, Homo sapiens
ttgggaggtctagtgtggggcctgagattctgctttcctaagaggctcccaggtgttgcccatgctgcggggccagaggctgtaagcagcagggctaaaggggcacttgagagaggctgggtggagctgcaccacagagtcacttggaatgctttaagatattgtctggccccaccccaatcaattgaagcagactctgtgcttgcaccgggacacctgtgtgttttcttttttaatgccccactccctatctaccccaggtggtttgaatatgcagccaggattgagaaccactaggctagattatgggagatcattctccactttaaaattagagatctgtgaccacctaatttgctgtcacagtgggatggctggaaatgacttaacattgtgctcttcccaggagcagcttcatattcaccaagggttgggaggggagttttgcttggaaggaatgacaatggcggaactccagggggagaacaaaggactggccgcatcttgccgaaatggccatgctatgtgatcttgtctcagcaatttcatgccttgggcctccgtgtcttggccctgaccagcacaactcctgttttgttctgtctgttcagcccagaattcccagagggcttggagctttctactgatctggaaggttctcttcccctctcttctcttctgagtgaaaaaggcagctgggaggccccctgcccttctcccctccagtgatccgaagccatggctgagaatagtgggaatgaggtgctaatgcccccgtcttgagtagattttccccccacggcacacacatctggtttccattttcttctgcagcaggccccattgagcagagccttcctctttgaatctcctgaaaaatcatgtccagaggccaggttcagcccccaccctgaccccagtcctcaatgcagcaaaattcctttctcagggacccttggcccagtcttccccatggtccttgggaggcaggtggggccctcaccagaggggagagcaaaaggctggggtggtgtgggggacattagaggagtgctggctccctggagaactggggaagtaggaaggtttgggaacacctaaaaagaacaggaggagtgcatgagccaccaggaaaaat

SEQ ID NO: 61237 - DNA, 1033 bp, Homo sapiens
cttccagtgtaacaaagaaataaaaaaggaaaggaaaatctgacttccatatcaaagaggctgaatcattttcatgcagtagattggatgaccggcaccgatcttcactggccccgccagccaggccttgccacggcatcgtcatggtggagcctgtgtctctgcttcttgactctgggcagaagtgaaaatttactggctccttgggaagcttcctgtgtgcctgctttcctcttctgcttttatagctgccatgagaggagcatgtcctagctacttccttgtcctgggaggatgagagacacagtgtctctgggagcagaacgtccccagctgacccagagacctgcaacaagaagcagcctagggcctagccccttggccaagcccagcctggattagttgagccacagccagcctccttgagaataactgatttttgtgttaagccactgagtttgggatcatttgttatgcagcattattgaggcactagctagctgatatacctatcctgccagaagaccagggtaaagcagttagtaggtacacagcgtgggttgagggcttagtatttggttatcagttgaggcttcctggcaggcgtcattaaagaatactagagtattggccctggaggagcctctaaatgaattttggctgcagagacaatcccagagttgagctttgacttgtcctaggccacatgggggatttgtgcagagcctacactagcactcagggctagtggctcctcaagacagtaagctgactctccacttcctatggaccaggctgatgataaccatgtctccctctgcttcctccttggccatatgtgtgagtttcatgtcatcaagctggaattttgacaaatatgaggtggtggcaagggagaaggagcaggaaaaaggtttggccagagacaagactccaggtgcaagaagggatgttttgtctgtacccacatttcccttgggtgccaaatgccccgtgatgggacccccagcccagagcccaggcttcaggccag

SEQ ID NO: 61238 - DNA, 1091 bp, Homo sapiens
agaggggctcccgggccggcgggctggggccgccggacctgctcaccacgccccccaccctgggcgagtttgcataaataaacaaatccaagccgtcggccccgcgggaggtggaggaggagtgacgaggaggaggaggaggagggaggggggagggagagattagtttgggaagtagcacggattgctcatccgatccgtgccgccgcagggagtgtgtcaagttacagaggcgccggaatcggcccctgcgctcctcgccagccgccacgacccacctctgcccatggggccctccgtgtgcgccccttcgcccggggactgaaactgactggcccgggagacacgaggcgcccagaaggactgacagcgcggcaccaactgctctgcagacacttgaagggaaagactgggcggagagaaggagagccggtcagattcccctaactttcctggacttggaacgttcttcgaaataacttttttctcacctaggtgtaccccaattaccgctggttgtgctttttcggcacttcctctcctactgctaatttttccgtcctctttgccgggagcagcggaaagggacgttttccagcgatacaagccctttccccctgccccgcagtttggatagagccttttggcagcggctgtcgcctttatttattctatttatttatttattggttctcaagacgcgagaggatggtagcggagcgcacccacaaagcggcagccaccggtgcccgcggccctggggagttgggcgcgcccgggacggtggctctggtggcggcgcgggcggagcgcggcgcacggctgccgagtccagggtcgtgcgggctgctgacgctggccctctgctcgctggcactcagcctgctcgcccactttcggacggccgagctgcaggcccgggtgctgcgcctggaagcggagcgcggggagcagcaaatggagacggctattttgggacgagtcaatcaactgctggacgaggtctgtgctctttgttgctggcttttatccctccccgcggcgccccctcgcgcagcctccagactgttcagccggtgtccgcgggcgct

SEQ ID NO: 61239 - DNA, 1038 bp, Homo sapiens
ccatttcaggcaactggcctgctccacaaggaaggttgaccatcaccttggagagggccctgggtttaaggagcacccccaccccccacagccatagctctctatgcccctcatggggtggagggtcaggtaactggcgtgggtgaggccaaaatgaccacagctgctgggagaccaggtgctgcgcggctgctaaaatgctccaccatctgcccctggaagagccttttctctcaaggccctctggctctgcgtttcagaaattcctggggaattctccaaagttcatttcttccccatttcctcccaaaagcacttccagatccccagccctcctggacgctgctgataatgtgtttctcctagatccgctctgataacactggggtggtcggctgagatttgtagggaaataaaaataaggaaatggagggttccggaaaggccagaagagccctggactgggaatcagtcccagaccttgaaggactctgagcagattactctcctctctctgggctttggtttcctcgctgatataaaaaggtgaatgactgaaaaatcatttggcagtatctggtaaagtaaagaatcgtgtccaataaagcagctcccttcctaggcacttctgagagaaatgctcgtctgtgcgtaaaagaagaagagatgctcactgcaacactactgtagtaagaaaaaaggaaaagaaaagaaaagcctaaatatttgtcagcaggagtgtgcagagatatgttgtgcagtattaaattgcagtactttcatcaatgaaaatgcacacacagtaaacaggataaacgagaccttcagactcagcaattccagggctggatctcctcctctggagggaaaaaagcaaacgacaagagaatatttacaatataagtcatttatctaaagttaaaaacataaagacaacacaatacaatcttcaacaactatatgcatagatagtaaacacgtaaagaaatgatggaaatggtaaacatcaaattcagcagggaggagggactgggtaga

SEQ ID NO: 61240 - DNA, 1241 bp, Homo sapiens
gaaaacccaactcccgtcctgcccctgccaattttcatcaaacaggcctgcattgggacagccctgggtttccaagcagatgcttcccctgatgctgtgttcaatgcctggcagctctaagatgctggggagctgatggctttgcaaaatctagcagtgccttgatgtcactagttgctctcccatgtgggccacttggctgtgcccattaccctggccaggcaccaaaggatggagtcactccaaggcattaccaagtccccacagtacagatggagagagagaggcccagggagattcatgaccatccagggccatgttgtgggcaggtgatggcggtgagaccggcattcagtctcctgactccccatcctggggtcttcctaacagagcacaccatatctcatgctgatcctgctgaggtactgcccgtactaccacattttgagagaggaggaagacacctggactccgcccatgcacctgctgcttcctcaggaggaacctgtttcttgcagcagggagaactatgaagattgtcccagccccctcaggtgggctaagcagcccgcaagcagggctgtcaggagagggtcacaacagccatccagggtggggacattctgcctgagacctccctgctgatgtctgtcacgcactgcctcagcttcctgctgaggccactaccgttctccgccggggtttgacccacctcttccgagcaaggcggccatgcttccccaaaatggacacatagggatggacccccatgaagaattctggggtagcattctgggtcgtgccctttttcaaccactttttgtatgttcgttcattcaacaaacacttaacaatgcctactgtgtgagtcactgtgctgggctgtggctctctaaagatgaataaagtatactcattgtcctctgaggaaggaaaacttcatttttttaagcatttattatctaccaggcctgatgcaaagctctgatgatacagagatgaataactcatttcctcccgctgagaagccaacagtttcctatgttagaaagctggagaaattccagtgatgagaactaaaacaaacatgagggtttaagggagaaaggtttgctgtaggaggattcattttttcattccttcattcattcaatcgacatttactgagtgctcattatgcggcagacatagacacagtgctaagcatggtaactataacaccgcactttgtctttataaca

SEQ ID NO: 61241 - DNA, 1059 bp, Homo sapiens
cacacgcacacatggcacttgtctagctagctcagccacccttgacagcactttgagctcatcattcagcagcatctgccttcctctcagagctgacattctgccctggccttcacccctccatgtcattctgaaaccgggactagggaatttgaggcagctcaacctttcagggtcagggatgctgagttcacacagcacgcatgttgctcgtgtccccctcctctgttttcacagtcccattctcgggcaggtcactgttcagcagttgcagggtgtgcggccagatgggtatttgcggagggggagctggaaagcatcctgggctgggccggggagagactcaggcctgggcagccttgctaagtctcccctctctccctgtgtctccctgtttcccgccactccaatggatcctgttcttctcgcttccccggcctggggtcccaccaccctgtctccccggaaccccatgtcctgtgttctcactgacacctcttctcctttccctcctgctgcttccccctactacctgcccttcccaacccattctgaatgctccctccttgcccctgtgccctctgtgttgactctgctgatcccctcgtggccctccacgtcccctggcatccctctcctgtcccatggggccggcctcctgctcctggccccctgccagctccttccctttggttcctctctttcccgctcctcttctccatacctccctgcccctcgctccctctcccccttcctctctccccgcaggggtcccccggagacgctgggctgtccatcattggtccccgcggcccccctgtaagttgtttttgctcttcctcggggtgttggggggatgggtgagttgatgaaaagggcttttaggctggggatgaggggacagcgagggcggctgtgcccctgggtggggaggccaccgcatgtgatgtggtcagcccagccaggcctcgggtgccgatgttgatgttaaggaaagtggcctggctaaatatacctaaattacagtcccttgggagggttctgagggacctgccctct

SEQ ID NO: 61242 - DNA, 1041 bp, Homo sapiens
atccacatccagggcttgtcagaagcatccccactcctaggtctcatgaggcactgaggagaagacccttccccttcatgctggactcttgcctcccaacccttctgtctctgccagaccaccctctctgctcttctccggtagcctcttctcatggaatctggaggggctgtgaggccatcatgccccatcaccgcctctctgggtcactggaaggttcccattgcttccactgctcccaacctgtcactgagtcttttcagtaggtgccactggagccactagccttgcaaagccaacagcccatggctggtctgggcaccctttcctctgttctggcctttactctgctgggacccttatcttgccactaactctccactgcctccaagtccaccaaaggtcagagggctggcactgggaactatgaccagcagcaggcagcctgccacgaaggacttgaggtcattccttgggaggctataaatgcctatcccactgccccagcctcactgggacagcagatatcttgacccccagtgatcaccatgatcaggcagaagtttatttcccctctgaatcttgagatgaagtgatttttcatctttgggcagtgcagcaatatttcacatctctagtttagaaagttcatttattccaccttattcagttcttaccatggctcagtggttagaactcatcctgattgtctaaatgagagagactttgcccaaggttgcacagctagtaaacagccatgctggaatttgaaaccaggcctcatcaagccctgtggccagtctgtctttgcaccctggtgcagaagttgaatatctgctcaggggactcaccccaggctaagctaactgcacagaccaaccctcccaacctccacctactaatggtttctttgggatgtggagggctgtccccctacctcccttctattgcccatcagtcctctcttttattctctcctccatgctctgctctctgcttggagtaaggcctacggaggaggcactaacacgaagggtggct

SEQ ID NO: 61243 - DNA, 1037 bp, Homo sapiens
gctctgtgacctgtaattggggccctcctgcaagttcacatagctgaggacaggggcccacacagctgccaccagggcagggtcctcagagctcaacatgaaccggacagccatcccagcctccagacaagacattctcaccgacatccttgcaggctgacaggccccgagtctggtcctctcctcatgctttctcatttcttcctccagggagaacggggcatgccagggatgccaggcaagcatggagccaaggtacctcccccttccccacatcccaggcagccccaaggcccctcccccagtgcccatccctctctcctcagctctggggacactctggagtcccagctctttgggcctccttctgcctgccctggttctcccagctgcagcattgtggtctctcatcagtgccccctgatgcgggcggcctcctcctgggcatccctgggtcataaaaagccatctcaggtaccactagctccactgcagtcctaagacccaagtggagagtaggggcccccaaaaatcacctccacttgagatttgctaaggggcactttgggcatcatctatctctcaaagtgaaatgatatcaggtgatgtgaaaacagggttttcatatcagctttcacaaagctgatatgaaaacagggttcactccagccactccccagtccatgagggcagaggtgcacagagctgactgtgagggtaatgccaaccaaacactgggggcgactgtccctggtgaaatcagcccctttactttgtcatctattctgcacccctctcccgtggctttccattctcctgccgtctcccttcccatctcctcctcctcctcctcctttcatattccaacgaagctcccccttccaccccagggaccccctcccagccccatctagtgccccacagtccccactgtgcctcccaggagaggccaggagccatgcaggtggttgggaagcccagggagccccgcagactgagctacacaaagccccttcctcagggtccattctcgtggc

SEQ ID NO: 61244 - DNA, 1031 bp, Homo sapiens
ggccagtttcccgactcaggagacctgagttgtgctctgtcatctgtatccttgggaaagccactcactgttgcagagtctccgtctcctcatctctaaactggcgataataatgttttccctggatacctcactggattgttgggaaagagatgaagacatggtttagagctgcctctttggaaagtgtacagaagccctatacccgggagaggctgcatgtacagaaacggggccttcgcccagtccactaggctgctaacttgacttaggggccttctctgggtctcaggggtttccatctgtgaaatgggtgccatcctagacacctacccttggagcaagggagccacatcctgtgcaggccacagttggtcacactcagcaagaccaccttgagctccactaacagaaatcattgtcagtctgtagggtctagatggcccaactggggagaggagaacatggtggccagagcagacccagagtggcaggattgcctaatccagctgggctcctgaggtttacagtgaagccagagggctgggtgtcaaggttgcctgcaggcagccacagatgagggtcctcctgggggccaccagcctagtgggtgcctgacactgtgacgaggctgccctaatcccaagcctgccgacccagcctgggagcaggcagggagggtcctcttaacaagcagctacttcatttgagtgtaaacaggagttgcatcttccttggctcacggtatgatggcctctaggagcaccaacctagttcgacggtgctagaatcttggtctcagaattctcctctaggaagtggaaagagcctcagaggtcaaccagtcccaagtctgacccagtgcaggactcctcactcaaccggcacaggcaggcagctcactgcctccagacctgtccactgcaccatggggcagccccaggatggagggagcattcctggatatggtgtggaagctcccttgtcagcctccccgagttgacccctcagagcctctggcctctggagcc

SEQ ID NO: 61245 - DNA, 1112 bp, Homo sapiens
ccctgagcccctaggtgaaagaaactggtggcgaccttagctccctgaagggaggaaaccaagttcacctctctgtgaatcccctttgtggtcactagagggcactctctttctctgctgcctttggaggcctgattgttgtaaccactgcattgtcccagattggacttaaggtgtgaatgagtagtcttgaagctctctggttgcttctccaagacattgcagctcttggtagtggctgttcttcccctgctaagcacaaccatttctgtctcctaaccattggcagcaactttaaagaggaaatttttttaggggtcaagggttcagaggtcttatgacacctctgacctgcttttgtggcgctttaactaggtctaagtggagcttggcaggaggacgaggccagcctccagggatggattctggggaggcatctctcttgagtgttgagcttttccttcttgggttagggggtgctttaggtatccaggcaggtaggtggtcagcgttggcctggggtcttggtggtttcaccacttttacccaacccagtgcactagtgagattctggcatcttagtacaggggagcttgttcatctcattgtaagtgtgactctgctgccactggaacaggactggattcgttgagcacagattcttgaacatgttggagtctccggtccctttatgaggatgaaccttgagacaatggtggtggggggttggtgagaagacttggagtgacaggcaaggtggagggagacggtatggggcagcatagtggctgccaccattgctggggaccaaggcgggtcttctggattagttagcaagcagatggcctctgtctgcctgggcagccctgtgctctggggagccatggttgaatggggcgatcacatgcaagggcacagtcctatgatgtcagactgctctaacaatggcaaatgccaaggccagtgtgaatcaatgaaaactcattgttggtaggaactctgggagcccaggagagatttggctgcaggtcacatgtgtggtggcatgaagctctgccagcttaaatgcaaggggagtggtagagtggtgaggagcacagcccctaggggag

SEQ ID NO: 61246 - DNA, 1064 bp, Homo sapiens
cccttggctcacatgaccacaaccacaactccccagccttggggagaggcaccattcgggcccagatgacccggtcacactgtcacccatggggtactggctcattctttgcaggtatccaggtggacaacgctaggcatgtgtcctgctgtgccagagcacgcagccacaggcactggaatgagagaggaactgcaggagacaaacggccttaagacccagtgccttacaatttacaaagaactttcaccaacatgctcagtgggcagggctgggtgcacctctggctccctgggcaggcagttctcaccaggaggtgccgcaagtcccccaaaacagacagcatgtctttctcctctgcaagccctctgtggcccctgtccatagggctggcctttccctggtccctcctgcaatgtgcctgcttctcctgttccatcactggattgtttcttctcgcctggttgtcctggtctgctgggcgttagtatggactcacagctactgtgcaaactctttgaccacgtgtctttttacttctcatctccctgtactgcatttgacacacagccaagattcaagtggagaggcttgggggcaggggcctgaagtcaggagcccggggtgcagtccagtgatagggtggggtcctggctgagtactatggcagcaacaaccgtgtggggagacaatgtgtttacacacacggggctaaacctcggggggctgcaacccactgggcagggcagtgtgggctccgaaaccaggcccagccttttttttttctgtgaccactaggtggcctgaagtgatgtgtgtgaccctgcctcagttacggcaaggaccttccccatcccctgggcttcccagccacagctgtctcctctctacttgttttccttgactctgacttttaaacttctctttacacacatttctattttattacatagattcttgtgactttgaatcctttgtggcagtaggtaaagtgtcataagtaaatgaataaccccaggactggaacaaaagaggtttctttgcccatttacccaggatattca

SEQ ID NO: 61247 - DNA, 1161 bp, Homo sapiens
ctgggtcctgaggcactcacatagggttcttcaaatatgcgtggtgttgattgtcagtgcccatagcccccagcctgtccacaccaggctgctgaccatagtatgagggagaagtcttctgcagaacctggcgaccccagagcggcattccactgggtggtagtaatcccagagcatagtggtctctgtgggcctcccatggccctggccacacatgcagcctcttggtgctgaccaaagggacccctcctgtgcagaatacctgtgccttcaaccacagtttttctccaataatccataactactttagtctgttacaccagactccaccaagcacaaaatcatcccgtggcctctttggttgataatctaaaaagggggctccacggaattttaattagtctataattttgagagctttctttataagaaagagtatagaatctcatatcatatttcagcaatttagtaaaaatagcattttgctgggaaaagaatactaaggggaggtgcctggttcccttgttcttaatacttcctttctgcccaactgaacactgcaaacttccacggcagcccaggatgatcttgcctgtttattaaagcaattggattttatacatttgatactttagctcttttgtttaaactttttttcttgttatttggtgtacaatatttaaatgtacagtattttatctccataattagcttaattatagaacagagtttctcttccttctcatagtcttcagataattcagaaatgtttaaatcttcgcacccactttatatatgttgtgctgtttctaacttcatatatgtaaatactttttgacatactttggtgtttcaagttctgtctctacttttattgtgatcattatcaccatgattctgttatcattcttaatgttggattttttttctggtgcactctatttttttaatcaccttggatattttgaaagtatgttagctatttgtgtacgtagacataggaaagtgctgtgcttaaattaagctgtaagctctctgatagacagatattgaccttaaaatttggtcctcttaaatgctatctatatggttttcttccaattaacaggtgctatttcaacaaaacttgtttctctgctgaactactctgtcctttccgct

SEQ ID NO: 61248 - DNA, 1010 bp, Homo sapiens
ctgcgcagccccccacccatcgccccgtgcccatcggcggccgggcgcctccgtcctcccgctcctgcgcccgaaactccgcattcccaggagacctccgcttcctccgggtccagcctcgcctggggcccgctgctgaacctcgcatccctcctccttcccctctcagtaccctcgacgcccccggcccctcgctggccgcaggaatttgaccacttctttagcagccccccctttatcgcccaaggaagcaagttgggcagctggatttaagaatttgtttttgcagagggtgggtcggctatcgagggtgcgcccgcaggggctcgggggagaggcagaggtggttctctccggcccctgcactgccccggcggcgcgttttgtttccagaccccggagcaccctaaacaataatgccatcgccatggcgggctcacctggtgctgcgccgcctgctcccggcgcccggtgccctctgcgcgcccctccacgggcgcaggtttggcccacgcggcgccggtgccgggcaggactctttgcctttctttgggttctatctgtgcgtgtcaatggcggcaagcggcagttctctgggccgcggatagtagcggggggaggaggaggagggagaagggattgctccttctccacataaccacctctaggaggagttgctcagcctcatcccccgccagcccaggctccgcgacgggtccggggctttcggtggggcttgatgagctattgtccttcaggagtattaatggtgaaaccgcgcggcctccgcgtacttggccgatctgcgagacgagccgagggccactcgctaacatgaggctttccccagaactgggcacaaacgcgctatggtcgcgatccagtctcctgttagctggatccacctttggtgggagaaggtggcgtgggcgttcatctggcagctctggggagagtcttcgaaggggaaagcgaaaaatgccaccttctatatttttgtgtccttaaat

SEQ ID NO: 61249 - DNA, 1012 bp, Homo sapiens
ctattattattttaatacagtacttagggtaacacaccaaaatacagtcaaactctattaggtgggaagctaagatttttttcataccctttaaaatatatttcaatgtatagttaatatatttatattgaatcccctcatttcctacctagttttgttttatttcatctcaatgtattctcccaaaggattattctgaactgacaaagatgcttcattgcagtgtctccatcacttttcataatatttgcaatataaaatattctgaagcacaataccacagattagggaaatatcatagaggataaaaatgaataaattgaataaatttcagcaattttaaaacagtacatgagtccattagggatgacactgtgaatttcatgttcatgaaaacaatgtttaaagttttttttaaatttcaattccatcattaaaagctctaagatctcttatttctagatttaaaataatgtatgatgaaagcattttgatttgcatacttctgaagagaatgatctcgaaagagtgctttaaaaataagccgtctcgtgagtctagatcctttgtcaaggtgattcatcggtgtgaccgaaccccacctgtgacaccctggcctataattatagctcccaatcctcaaattactgactgctgtctctttttcaaagcctcgttgtagaagcttgactgtagaaaaaaatggtcatttaagtcaggatgctgttgtatgttctcacccataagtggaagctaaactgtaagggtacaaaggcatcagaatgacataatagactttgggtactcaggggaaaggtgggaagagggtgagggataaaagactacaaatcaggttcagtacaccaaaatctcacaaatcaccactgaagaacttactcatgtaaccaaataccaccaataaaaaatttaacaaaaactaaataaataaataaataaatcaggatgctggagctgtctaatggcccaccttgctggctggcagagggtttgt

SEQ ID NO: 61250 - DNA, 1056 bp, Homo sapiens
ataaaatctaacctgtcggtgttgttatgggcttaaaagccaaacctagaaataaattctgaaacaacagagtctgaatacgccctcttccccagcacacacaagaccaacgatgtgcttcccgttgctgtgctcctgggggttcgggggaacgagccaggagccctacattctccctcttcctctctgagtctggagttttacctccctgtttctcaccgttaacattcttgaaatgctctgatccactctacgagtaattataagactgtataccttggtctttctgctatgaaaggacaggtacattgcagattcagggtttgtctggtttcctctatagcccacgtgcatctgggaaaatggggccacctgaacagagccacgtggcctccagggattgcccacatggtgtctctgaggacaccaagagctgcgtccagccatattctctccaaacatgtaaacttagtgtattgtagtccttaagctttgcctaatcagagggaaattgtcttagagcagaaattgtttccttcaggctaatacttaaatgtaaacatttaatattagcctgaagaaaacaaattttcaccttgcaatggttctttttagacagtaggcctacaccgagactccaattaccaggatgtggataaaaacccattcaagtttttgactcctgacttcccaagacggaatagagttggaggaaagggtggcccgggaaagaaggaagttcagggttataatttatcataactccaggcataatccagcacaggctttggggagaggtggtctttagaaagcagggtcttctctggagtggccccagaggctcagcacttcctcccgtcggtgggctctggtagatgtaacatgtcagctccataagcccctccttgcttcccctagggattcctggatgtgctctaattcttactgtccgtgtccagggacctcacagccctgagtccccaggagggcctgggagataggtgcctggctgcttaaattccgcacaagacctgaaaagatgggtttggcaggcat

SEQ ID NO: 61251 - DNA, 1028 bp, Homo sapiens
aatttgatgtaaaaagactcccttttacaaaatgaatatcaaatcccccattctccctgcagtttattttcttcaggagcttagatatttatatattgcattcgcttaaagcaagacatatcttttgcaggactggtctaggagggccacttacttgattgtgggttctccgccttccatgctgatcacctgtccttcctataccctcttctctcccctaaagtctgcagaagttgattttagccaagcaggccagttgcaaccctgtcaccacccacagtagccttgagccagccaaaaggcaatttggagcatccctccccagcctgcgagggggacccaggggagggtggggacctgggagcaggcagcctcctttgcgtgtcctcattacctgccaggtactcaatgactgccgccatgtagacaggggcgcccacgctgatccggtacttgaacgtccctttcttcagataacgcatcagcctccccactggaaagatgacacctgccctagctgaacgggacagcttggacattttcttcttcccactccggcccgacatcttgcttcagtttccctctcagcttgctgacacagtggcctcccggcactaacacaatgctaaaaaggaaagaagacagagttgaggaagggtagttggcaaacatcttgggcacagtggcatggcccttgggcaccactgtgacacctctgactgccctggggaggcagctgaaatctggctgctactgcaggtgcaggaggcacggagtcaggcatggggtctctgaagggcatgggcaagcccacccacaaacatccctcccccaccaaagcagcctgacctcaagaggaaaggccacagaaaactgtcactgaatagggaggtctcggtcctgtggtcagctgaacaatgatccccaaagatgtcaatttcctcatccccagaacctgtgactgttatcttatatgacagagactttgcagatgggattaagctaagggtcttgagatggggaggttt

SEQ ID NO: 61252 - DNA, 1052 bp, Homo sapiens
gggaatcccagtgtgtgagcgacaggccttcttctattgacttacaatattctagaaggacctacgtgtggggacacagttttccaaactgaggaaaatgttgcaataaaagaatatgttgtaagaaagacactggatcttttatttttttcctttcattttctttttcttaaaaaaacaaaatgaaaccaaaaaaaagcctgaatcaaaacctttttaggagtagttacagatattatagggatgggggcggggggcactaaaacaaaagagaaaagcaccagtgagatgtctttcccattttcttctctccgccacggaacacgcacaccaacagagcccaggccactttttgccctcttcccttggaaaaaggaggaacagaagatttaagaattttgaaaggatttttttcttgtgtgaatgtgtgtaaaagtcaatgctataaatctaaaacgaggtctgtttttttaaaaaagttctaaaacaacaggaggaaaacacatggaaagaaacccctcgcggagacctgcttccttacagatggaggctcttttggaggagagtgtgaagggcagagggctccctgcgccggcaggacctgcccggccaccctccactcccctgccatcacccctcctctctccttttaaaaagcaaaaccccactcttgggactcgggtcgtcctccgatccctgctggaaagtgcggcggctacttggcgtcgagcttggccatctcctgcacgtagatgccgatgctctcgctgtcgaagagcaggaagtacacgttcttcagcgaggacgcgctcgagtcatcaaagtgggctgagatggctttgagggtcacctgggccgcagtctgtttgggaaagcagtttctgtgccaaagcaaaagaagagccgatgtcattttggtccctgggacccatgggagcatgaagtgcctttgtttttactgggtggggccttgctgtgtgcagggctagtccatgcatgatctcctttgaccctagccaaagggacagcctgggggtggcaggtggggcatg

SEQ ID NO: 61253 - DNA, 1050 bp, Homo sapiens
tggtgcatgcctgtaatcccagctactcgggaggttgaggcaggagaatggcttgaacccaggaggtggaggttgcagcgagccaagatcacaccattgcactccagcctgggcaacaagagcaaaactctgtctcaaaaaaacaaacaaaaaaaaatcagggtctcacccaccttcctaaagcgatttcacatttccggccctgagtctgaaggcctcgggaaggatcggcactctgggaggtgcagccccaggcggttcagtgaggttctggttgtttctgtgtctctgcttgcaggtgcactgacgttcctcctgtccatggggagaaatgacggtgtgggccaaatcagtggcttctatgtgggccggctcatggttcggctgaccaagagccgggacctgttcgtctctacgagctggaaaaccatgaggcagtctccaccttgatggagaggccaggcgggagaactaccgcagcaggtgggcgtacggactgcttggcgcatggcacccgcctggcaagtgctagaactaatgctattcttctggaataagatgccaatgatgtggtggctagaaatgcaacttgtataaaacaaaaatgggagagagagaggtattaaacaaataccccccttagaggatactttctgggtttggaaggtgtgcttgctgtggtactgggtgagcggctcatgtgtgctggctgcatggtgctggggaggccacagccagcccttcctctgcacctgcctcctctgggatgtgcatgtgtgtgtacgtgcttgtggtcatgacgcgtgccatttagagctctcagagcagggcagattgctgggctctggtggccagtgtctgtctgtgagggcaggaaggagagctgcacattgagaacaaaggagggacctgaggtggagagaggcccagcaccccaaatctctgccatcacacggtcggggagcccatacattctgcaacaaccagggacttcacaggagccttgttttcaatttgctaacaggtgcataatccctgtgctccttaagc

SEQ ID NO: 61254 - DNA, 1467 bp, Homo sapiens
ttataatattttatcctgtagcctctcattggtggcagtttccattgattgatggagtgtcacacaggtggaggtttgcacagcactactgctatgttagaacatacaactgggcatccactaattccatacgtgcattttcatctcctacagggtgtgtggctggaaatgcagctccatggcttaagcccttgctttaggtgtctggccaagtagatcatggccaagcagaggggagttcactgttttctggggccaggcaagaaccgacactggcagagccaaagagagtcggcatgtccaagagtattgggcaaggggctgccaaagaggcagggtgaaatctgctggagagtcactggcctccctattccacaagtaagcgtggcaggggtcagtagaggagagagaagagagagagagcagattgcaggagaggcctcaggcagcctgaagaggaaaagtgcctcccctccctggccctgctctggtctgggtgtcccctcaggccccaggcccttcacagggaaccccagataagcaatttgccttccttgggtgaggcaagagtttgccctttcggggaagcaggttgatgatactaggggcctgggggtcaagggcttggctcctttggtcaactcattgcccctgaggtccactctggggtcactagactttctttccctggaggaaaccccatgaagggcccggagcaggcttgtatgtccacctgattgtcaaagctgccctggcatggcaggctgtctgtctgtcggcccctgtcacctgtcctctaagcctctccaccttctgccacaggtgccctgaactctacctgcctcctcccttcctgccactgggcctctggcccaagttgtttcctctgctaggaaggccccctgatctcagctctttttcagggctctaggctgtcctttttgagtgtccctgggtgctccagtgtgacctgacgcacagtggactcccctgtccctatccccggccagctgcgtagcccctctcaggggccatgcccagctaacttggaagtggggctttctgggtgttttcttgacctcatccctggctgacagccccaagggtaagacccagcacagagggttgcacgctgccaggggctggtgaaacacacgccacccacggcctgcctcatcactgcctacattctcaggccctgcgcagctcctggtgtgcactgctacctctggctgggcctgtgggccctcctgggtcctggtccctaggagacattcccttctggcccagttggcagattcagcctgaggtacgcttgggattagctctagacaacccttctgagggcttagaggagccagggtggccctgcctgccggggggttgtcttgggtcctaatctctacgagggctcagcctcctcatctgtgaaatgggtatgttcaagcctcaatgctttggggacca

SEQ ID NO: 61255 - DNA, 1050 bp, Homo sapiens
tcctcccactttgtttggtgttgggaatgttactgagcgtctctgggcctcagttataccacctaaaatggagataatgccagtgcctagtttatagggtcgtgaagactaaataaagtgatgtccacaaaacactaacaccaaacctggcccacagtgctcactaagtgtcaggttgattattcaggtacaggaagctttagagaagtagcacagtttgtcaaccacctttggagataccacagaatggttacatgacttgcccagagttgcctgctggtcgattcagggctgatacccagatcttctgacttttactgtcactctcagctccttgatttctcccaagtactgaggagtcagaaagctagcctgtcatttgtttcccttgctcccaggagtgtggccatctggggccgtgtggtatttgccactcaggagacatgtccctatgacatagcagtggtgagcctggaggaggacctggatgatgtccccatccctgtgcccgctgagcacttccatgaaggtaaaggacgaagggcgcagcctgaaggagggcccctctgagctagggtgggcctcaggaaggagaatcagtgttgggcattctcatgaagtcagggtagcattggtcaaggtccttggaggcctgcctccctttttgtgctggtggggcacatggagtgccctgggaaggataatgctgcacgccctttccccgagtgcctgcagcaatgtagtgtgaggatgctgggcctttggggttccttaacacttcaggctggtcagagaggcatgtggcactttcaaggctccaggggcacgatttgggtaaaaggctttgtgatgctgccacataagtactgatgttgcactccatggaggcagtgtgatacagtgatgaagggtccaggggctctggatgggcatctttcctatgccacctattagtcccatgtccttggacaggctagttaactatcctctgcctcattttccacgtctttgaaatggggctaatgcatcctatttctgggtgttgtgagg

SEQ ID NO: 61256 - DNA, 3974 bp, Homo sapiens
cccttcctactttattcctctcaatgcctgagagagttcttcgcacacaatgggacttggtgaatacttggggaattcctgtagtcatctttgaggctctgtagccagagcattcattcttataggactttgctgagggacatcctgaggatagtttgtggctgagcagattagctcaaaagttaatattggggcagttctgctgccttgtaaataaatagaataaagttgcaactgtttcgaggcacttaggagatttttacttaatgtcatgggtgttatgtaatgtcaaggtgaatctttaatcactcaggtataaagttgatcagattttcactttacattaatgccttaaaagattagtggaagtcagaattttcattatctggtgggcttttgtagattcctcacttaattcttttttttctttttttcttttttttcaatctttaggctttaatgactgatgaaacaatatccaatgtgccaatccttatcttgggtaacaaaattgacagaacagatgcaatcagtgaagaaaaactccgtgagatatttgggctttatggacagaccacaggaaaggtaagagaaaaatatttgggttacatataaaggacattaacagtttttaaaacatgatgtttcgctatctagattacccttttcttttaaaggcttaaacaggcttaggattagttttactgtgagtattttgtaagctcactagaggcaggagtgtgttctttttaacgttttaaatgggattcattcatcaggtatttgaggaagaaggaaatggtagaaaaggcagatttactcttctaagagtttatgattatctttcaaatttgattctgagaaattgcttttgaaatagccctttttagccagaaaataattttttttttggactggagtttgcaggttatgaagaaaaataatcatttcaatcactttccaagcattgaaatcaaagcacttgattatcctcattgcttcttgctgagagaggtaggactgttggccgcattttgcagaggaagaaacagagagtgatttgttcaggtctacacagcaagtcagtgataaaaccagaaaaagaacttgagtcttccaaatcaatagtttttactgtcttcaattggaaggaggactcttgtagaaaagcaggcttgagagagagaaaatctagatcagataaagttaagcaggaatcttactgttctttttagcttggggttttggcatatttagtttttaaatatcttccttttctgtgataactttctgacttttttacatggttccttagtctcacctcttcttgattatcggtttctttatagaaatacttcctttctttcatttaatttctcctcttttgcatcagtattaaatacacatgaattcttcatttcttcagtgccacctgttatgagtgtttatttctgcatgcttttgttaatgagaatgtccttatttttaaacagtcccagacctcttttctgcatcagagggcatgctggttccataagtcccagtggcttttttcttggtttgctgccataactttacagataaatattgggtgttcaaagcaaatgctcttcagagagagaaaggctgggaatagaactgtgctgcttattctatcctgaaaacacgaagcctggggaagtcatctatatggccttgaccacatttctgtaattaatacctacttaggtttgcttttaaggaatggataaaatgattgtaatgatcgtcctttcaatcttttccaccacagagatgctaacaggcctttcttggttttgcctcctttaggggaatgtgaccctgaaggagctgaatgctcgccccatggaagtgttcatgtgcagtgtgctcaagaggcaaggttacggcgagggtttccgctggctctcccagtatattgactgatgtttggacggtgaaaataaaagagttttacttctctggactgatcctattcacagcttcctcatgaacttttctaatagaacaaggaaagctctccaaccatgtctggcgttgagaagccaagagtctctgtcaactctctcattgcccagtggtgacatgtgctcttctccacactgttgggaggtaatgctgccccacgtgctggtgcaggtcagtatcctgggacttggaagctggcaggatttgccgggtaaagctgtatgccatcatggggcacctgaaaagaaaaacacgtctcaccactgtggttgattcaaaagaaagtgattctattttttaaagaaagcgttgttaatgtaattggtatccctcctaactttttgagttcacaatttacttggtccagagttttctattcttttttttttttaaactaatgaatgacatttagatacttcataaaattatgaacagatatggaggccagagctcatttgggtaaacttactcctgctgagttagcaggttggtgagagaagctcccctgagctcacctgtctctctgactgccttggagtaggtggcataaccttgtgcacagagaactagaaaaggggcagaaccccggccttgcagttgtggcaggtttccactgtggtaagctaggttcattcctcatcaaggaatgtgtagcagattgttcactgtggaggagttaattatagaatgggttattgttgttattcttactcatgaagttacagattttagccagtctttgcttttatacttttgtgaaatttaatttctctctatagcaccttcctttttcgttttcagttatcaaaagtgactttgacctcataaaagagttgagaacatctctcgtgtcacatactgcaggtgcatcagttacttttgcacagattctagggggacatttttctgaataggaagacaggacaaagttaacagcttaagggctcttaattctgtgagttgaggacttaaaagtattgtagcatttgtttggatccatgaaaaatgtattcagtgggctttaaaatttccatttgcagaatttggtctctcaggctgtttgggagctcttttttttacattttttctcctttgacacctattttattggtgtttaaagtaaaggttaacatctgtagcttttccaggtttttttttttttttttttttttttggtatgaaattgtctttctccattgcagaaataagctagggaaacactaacccaaaaactttctgtagagctgttcctttggaggcagcatcacttattggcagtaaagactcagtataaaagcaccggcatccctacttgggtgatggggattaattttatagcattccattttcctagtgccacatgtgaaattggattttgatgatcttaatctatattctacccttataataaaagatcaaaagatatatctcctatgaacagattggagataggagatgaaaagttgggaggatgtctttattctaatgtgagggtagggaaaatgtggataacattactggggtgagggaggcattgttctttagttggagttctcattcttattctccagtactgacttgtggggaaagcatactttttcactgccaggtactgaatgcagaggctcagtgaagtatatatgtgggaagtgcatgcatttcgtttattagcaaacatagctggattaagacaaagttgttggtttggaaaggggttaaagccttaagtgaacaaatctagctaacagtgaatgaactaggtaatataacttgcatatttttaatttcctttggttaaaggtcccccatacttctctgttcggagacatgagaagtatgattacttcagtgttagttttcttaattttttttttcccctatttgtcccttgtcactttgttgcaagctagaaatctgtgggttatacatagggcagctctttgtgaaagtggtttattccactggagaaaggggattgaaaatca

SEQ ID NO: 61257 - DNA, 1053 bp, Homo sapiens
taatttgtatcctgatgttttaactcagaggttgcaaactagacttggccccaggggcaaggcaagtcatttaagtgagtaaaattggctgactgtaagacagcagggaaattttgtcaagcaaaagtgttcagacatcatctgaaggggcagccactgcttagttcctgctgataattgtcacgtggataagtaggcatgggattgccagatgttgcagtttttcaaaaaaagcggaaactctgattttcaaatttacaaaaatcaggttcagctcatggaccatcagtttgcatcctctgttctgaattaatactggccagaacttggagaaatccatagagtctaatcttactgaaacccgaccaagatttgtccattttatagaccattaggttattcattttcacaatgtatattttttactcatgcaactacaaactttgttttttagcacgtcgcgtttggaaaaattatctcccagcaattaatgggattgtctttctggtggactgtgcagatcattctcgcctcgtggaatccaaagttgagcttaatgtatgttttgtcctttaatgtgtattttaatgtatattttgttcttttttggcctctatttttttttaaggaatatagctcagtagtgccaataattagtcattccagttaacatttggcaaaaagacctagttgcaggaggaaaatgttttaaatctaagacattgcttttcaatgtcctgaggaaactcagctcaaacttaaataaattaactgttgtttctatcatacagtgattatatggccaagtttgctcaggatactcctcatttatgcctgttgtcccagcataattaatagtattctgtttcacgtgtcatgaacagtaattctgttttttttttttttttttttttttttttgacggagtcttgctctgttgcccaggttggagtgcagtggcgcaatcttggcttactgcaacctccacctcctgggttcgagggattcttctgcttcagcctcccgagtagctgggactacaggcacgtgcca

SEQ ID NO: 61258 - DNA, 1049 bp, Homo sapiens
tgagaccctgtctcgaaattaaaaaaaaaagtttgaaaatcacactatgcaattagcatgaagtgtaaggaagcccaaaagaaaacacctgcatttgctgtagagaaattttgtatgtatgcctgttaattttcaggtaattcatagtaggattcattaaagcaagtatattagtctttgttatatgttaggtgtatttttgattctcaacaggaattctaatttgtttttcttttctctgaatacagtggataagtggttccatcaccagaaaaactaatgagatttctctggaatacaagctgatattgctacatcgtgttcatctggatgtattagaagtaaaagtagtagcttttcaaagctttaaatttgtagaactcatctaactaaagtaaattctgctgtgactaatccaatatactcagaatgttatccatctaaagcatttttcatatctcaactaagataacttttagcacatgcttaaatatcaaagcagttgtcatttggaagtcacttgtgaatagatgtgcaaggggagcacatattggatgtatatgttaccatatgttaggaaataaaattattttgctgaaacttggcttaggatatttttattttaatctgaagccaacattaagtaggtatgggtattttttggtgtttgttttctgttgatagtcttataattcaaatttataattattagacgaagaaatcgcttatatttatagtactcttgatactatgctctagtacataagtcctagcataccattctaaagcaaaagtttttaaatttatatcatattagcagaaagcacaatgttgctcaccctttgaagttatatattaatagttatttttttacttcttcagtcaactaattggacgcttaagtcatttatattatattctaagttatcagctgaacaaaccagtttgaatgccagcccatcttcttactagctctgtaatcttaagtcagtttaccaaccactcaacttcagttccttcatctgtgaaacagacattattcatgtaat

SEQ ID NO: 61259 - DNA, 1049 bp, Homo sapiens
tctttttcagtatcttgtacacttctcataggaattatctacatttgccaaactggttgtttcattatgtagccaccagctgtttgcccttacctaacagagattactattgtactgattgttctctgtacttagtgtcagagctattcagagatactagatgattttctttcaatgtatatgtgtatggcttctcttctcaacaaggggcttcgctccaatgttatcttgaacttccgtgataagtcattccacagctctttcaaaataagtacttggaatttttgttgagtgtataattatttgtgcatcttgaaatctgcttattctcttctttctttttaaaaaaatcattctcactgtcatcttatgcttcttctcttcttagatatcaatgatgtcaaacggctgaaacctggctacttagaagctactgtggactggtttagaaggtataaggttcctgatggaaaaccagaaaatgagtttgcgtttaatgcagaatttaaagataaggtaatatgtcattcagaactgtagctttaggctcatttgtattgagactcataatttaaccatattgttaccatctaaagattcacaaaacagaagtctggaaacataacacagtcttggtgtttatttattcactttaatattctcttccatttttagaataaggaaatgattcagaagagacaaagtatcaggctttggggaaatgttgataataggaaaataatacctttttatcattgtaatgcaaacctcttcaaattataggactttgccattgatattattaaaagcactcatgaccattggaaagcattagtgactaagaaaacgaatggaaaaggaatcagttggtaagtgtaaacactttgcatgtttaacacacaaagcagaccagcttgcagaaaaggttttaataatcataagacactgtactgttactttcacttagaaaagagatacaaggctgggtgcggtggctcacacctgtcattccagcactttgggaagccaaggtggatggattgcttgag

SEQ ID NO: 61260 - DNA, 1039 bp, Homo sapiens
gttatcattttgttttttaagtcataaagtttttgagtcatcgtatgacttgcttaactcatgacttttataaaataaaaggtaaagcatattaagatacgtatttgagactatggaggacttattcttcagtataatcaatgacagtgcaaaaaacattgattaccctgagctatgtactggtttccctatgacctagaagaaaataggacctataagtcctgttttcaactttaataggactgatgaaacatttactcatttaggtttttaaaatttgcttaaaggaacaatcttcaggtaaattctcaagaacttggcctctttcttatttcctgttagccaagtaaaactgtcttctagagtgtggttctgtaatgttgtcctgactttggctattgactctcaggtatgtgcaagaggtgaaataattggcgtgaaagttctaggcatattggctatgattgacgaaggggaaaccgactggaaagtcattgccattaatgtggatgatcctgatgcagccaattataatggtaagaaaatttgaaaagtctgaagtctttctaattaattcataagcaccaccatacttaacctataatgacagaattgtaagcccttaccttcaaactgttaaaggatggaggaacaaagcactggacaagcattatttctatgactgcacttgtaattaactaagtaaactttctccttcattccaggaaagaaaaaatctggtaggttcttactgtttttttggtcctttccttccccacataccagcactcagttggtatgtttatttattttaaaacatttaattgagatattcacatatcaaagagtcaccattgtaaaatgtacaattcagtggtttttagtatattcactaagttgtacaaccatcaccactctctaattgcagaacatttcatcagcccagaggaaatcctgtatccatgggcaatcactccctgtcccccttccctcagtccctgatgactgcagatctactttgtgcctatggatttgccta

SEQ ID NO: 61261 - DNA, 1023 bp, Homo sapiens
atatttataacatattttatatcacaaactcttaacagtaatcactttttttgtgtaataaatacccaagtatttgaataattttaaattctgtgaaggaaaactaaaattggataatatttattttgcccttttaataaaaattgtggtatttttattactcaaacattagaatttattccagctaattttagtctttgctttctagaattagtaaatgttctttttcccttcttgatagttcctttatacctcacataacctttcacttaatggccgattatggaaacaccttagttcaattataaaagtgttagggataaaatatatcattaaagtggaattagggaacataggtaccataattcatttcctcagatccttatttgaatagtatttcacatccaaatatgcaaagatttgaaattttcttatttcagattgctacaaaggaccctttaaaccctattaaacaagatgtgaaaaaaggaaaacttcgctatgttgcgaatttgttcccgtataaaggatatatctggaactatggtgccatccctcaggtatgtcttcatgcaactgctgacaatgtactttttagcttactaaatattaatttactgctattagtaaaaaaggtttgaatacctgtggagagttttttctatggtagattttgaaaacataagaagggataattaactcagaatgcttccttaaataacttattttcaagataaactaaatatttacaatgtttaaattcagatttgaacgtttattctttcctgaaatatttcttcttttttggactggttataagctatataaattctctacagactgagttgcaagtctgttcagtcaagaaagagtgtatggtagtagtcaaaagcactgatttttggcaccagacagaccagagttcaaatcccaagatggccaattcctagcttacctaacttgcctccctttctttctccttgagacgtccatatcgcctccctgagctattcacagtatgta

SEQ ID NO: 61262 - DNA, 1018 bp, Homo sapiens
atatttttaaattgtagggatgtcctttgctctgggtcaattttaggatcaaatataaaagcacctatagctcagagtatcttctaacataaaacttctgagataccagaaattttccaaaacatggtataaacagtatgaaacactgggtagataaaagctttctctaaatcttaaagtgctcaaatatcatgacctgattttttagttttagaaatcagatatttttctattccatatcttaaactttcatgttaaattctagttctgacaatgtagggttctatttttttcaggtgattgttgggagcgtatagaagcatatataaatatggaatatgtgtttcttttttccccttctgaaagaaagtcaagcctctaatcaaatagattgatgcttcagaaacttaacagaatattatctgcaatttggcataaatgcatttttcttggggaagtttccacgctcaaaattattagtcattgcaaaacagaaaagtttgacaactggaaatgcagacccttttgcttgattttgtaaagacaggaaaataaacagattatgcttagaatatctgttttcaaaatttagtcatcataaagcttatctgaaaagaaaaaatagcaaaaatagcagctttttctttctttttctttttttttttaagacagggtctcactctgtcacccatgcagtgctgtgatcttggctcactgcaggctccatctcctgggctcgagcaatcctcccacctcagtctcctgagtagctgggactacaggcacacaccaccgtacctggctaatttttttgtattggtagagacaggctttcgctggtctcgaactcctgagctcaaacagtccacccacctcagctcccaaagtgctgggattacaggtgtgcgctcccacacccagccagcagcttattcttaattatgacatgacaaattaagttattgctctacacaggtacatatggtagtgtgtagtagcaaatacaggcatttgtttg

SEQ ID NO: 61263 - DNA, 1046 bp, Homo sapiens
tgtactgtatttagcaacttaacacaaggacaaatatcttattctttttctacctttcagtttttttccttcagtaaggaagtttgattcacattgagtacaaaggtttttgagttgtaagagttacataggttattgactttctttagctagatgtcaatatacaacacgaacatcactttgcagtgcacgtctagaataatagtaattttgttcttgtgtgtgctgtcttactgtttttctgggcctgactattagatagaaatagacacattcattgcacttctaccaggaagtttgctgcagttctgtactgcctgaaattccaatttttacattgcttcccaggagccttcctgggtaagactccaattagaggcaatggagcaaacagccctaggccaattatgtgccacaaatacaggagggacttctaattggcatgtgtttttcctgtgggagtgtcagagtggtatttattcagaaactcgaatttgttacatctgatttcctgggagttgatataaactgcagaatccttccctcttcaattggccccattgggttggcttgaattatctgcttgttgtataatagcatgtatatcatactgtagcatctcagaccattttgagcaatgaagaggtataaaatgatgaccctaagtttattgataataccctggcatacaggtatgctacaggtaggaaaacattttcttgacatagagctattttcccagtgttctaagtgactgtattcctaccaaggaccagaatgatcatagatgttttggtacctactcttattgctgcttcaggttactccaaaataggaaacaggctacattttggtgtcctgttaagtgtgttcacttagattactctcagacactgaagccttataagggactggttgtgtctataaagtggattactcaaaggaagactctgcccttggcacgccctgtcccagctcaaaagcacaagttcttatgactctggattttaccagtagtctagacctcagtggaccttgggcagaag

SEQ ID NO: 61264 - DNA, 1015 bp, Homo sapiens
aggtattttctgagcccctgcgggtttgaggccttgtttttagtgctgagagccagttgctgccctgagaagagaagacaacctccatctatttattgcttcctgagaactgacctggatgcggccctctgcagggcccagtcttcagtcctgtggtccctggactggtgggaacctgaactaggagtcctgggagagctgtggtgggaatatgggctggcactgctgcagggcaagaacattcatgtaggagcccgaggaccagcaggctgggaatggggagcaagtcacgtcagctctgtcattccccacagttaacaaattggcggggtgggaagtcctgagtgctccgtccctctagcatcactcctgagctgcgggagaggtggcccagagaacagcagagtcagttacacctgcagctcttgtctaaagtgattagatggccaccctcaccactgtccagtccagcagcagcctggctgccttgtcatggcctcctgggggcagaaggcgatgtggaccacgggatttgtagccagccagctcccaggccaacgcccaaagccctgatgacctggttcttctgaggccctcaacctggcatcttagggtatggtcaggcaacagggtgaccagctgtcctggtttcccaggacatggaactttcaatgctaaaactgggacagtacccagcaagtggggatggttggtcccctaccaggagagggcctggggctcttgcttcccgagaacgcctgtggcttgaagaaccttgactgcttggtcctcaggtatctacctcccaccttctcctcatctgtggagcaagccaactcagtgccccagaccccacctgatctgcatctttgtttgcatctccagagacacctgaggccccagagcttgaggcaaagccaggccgtccaaatcctgtgtgccgtggacgagtggccactttactactcctaaggctaagatgttgagagctcagaccactgctcagagcagtaat

SEQ ID NO: 61265 - DNA, 1056 bp, Homo sapiens
gctattactggccttcagtagggtggttcagagaatgccacagaccctggagaggccagctctgtggcagacgtggaaacagcaagccgagaccccggcagtgccgctcccactaggcctggagtcgtggggatgtgttccggggctgggctgcagtgggtcttcctgccatgcccagcaagcctgtggcagcagcatgacagggggacccccccatcctcagaagtactagccactgtgtgggccactggccttcccaggtgagggacagaggagacacgggagtccagagtagggagggtccttagcaagctcctgttcagcctcctctggagaaactggggaaggatcagtggtcttcagtagcggatggggagaaggggtgacagcagctctgagccaccatttctcaagtgggaatatcttgacaactgaggttgtgatctcttagcccgggcttcagtccttactgaatcgctcagtgaaacttgcctgtcattgttatcttctgggggccgggggccagtgcaaggagaccaggttctggccttggccttgcccctctgcgttgtgtgttgaagtgtatgggctctgggatcaggaactgtcctgcctccaccacttactggcgtggcaaccttgggcatcaagaaactgagaatcaagttttcttacctgagaaatgggtcattgtgaggaactgtctagcatagggcctcaaacatcagttcccagaagcagcctgctttgctgggcccatttagacaaaggtgctacacctccttgcgccttgatttcctcctgtgtccaatggagtttgatgccccatgaaataaaagccaagtgcgaggggtctttcttactctgggtgatcaggggcagaggggatggcatctgtacccctgcccacgctgctggctgtgccgctggggaatggctgcaacagaactcctgaatatgaagatgtgcaagagtccaaggaattagcccttttcttcccagccattattaatagggaaaatgggggccctgcttgaaagaagagactcaagaact

SEQ ID NO: 61266 - DNA, 1579 bp, Homo sapiens
acgtcctaaggaagaacagtgaaagtaggggcacggctggtgtgtacccaagcatggggactccagttcctcctcccatcagccctgggctgtgctcctccaccacctgctgcccttgcttcctgccccccagctctcctccctgcacagggccctgtgggcgcccggcttctctcactagattcagcttcagcccacactatatctggccccatctcttggtactgcctcagccgggttcccagcagagggactcccccggcccagctgccttcccacacaggtccctgcacaggtcgctggccagctttcagagcagctgctctcggagcaggaacccacccacattgggtcagctgtggttggccaggggagaaggggcacatgacactgaaagaatgtggctgcccctggtggctccttgagcagggagggccatggagagtggtgtcccctaaatggagtgtggggagccccgagggggagaggccgcccatcctgacctgccccgtcagggcccggagttgaggctttgtctgagggaggagccagcacctcctgacccctcgctgaggcccaggcttctgctgggagagccttccattccaaagtcagcagcaggcagcctcagctggagtgacaggtggcaggccccgggcagcggtaggagggtgacccctcctctagcacaaataaacatggaatcagccctgtgcggggctccctctgtggcctagggcttcctctgtgccttcctggcccaggcagggtgagagccacagcgggcagtcactgtggtctcggggtggccccctcctcatcctgttctctctccttccctgcacgtggcagagctccacctggaggggaacttcctacaccgcctccccagcgaggtcagtgccctgcagcacctcaaggccattgacctgtcccggaaccagttccaggacttccctgagcagcttaccgccctgccggcgctggagaccatcaacctggaggagaacgagatcgtaggtgagtgggcctggcccacctggccctgggctgctgcacgaggcgctcatgggccacaggactctggagtcgaccttcacaggtgggaggagaagcttgggctttctgtctgagatgcctgagcaaaggacatggggcctgggaaggtagacattttgaggccctgttgcctaccgggtgctgggtgggacacttgctttccctggcaggtagacggccttggctttcaccacagtgcagctctgaactagccaggccactgtaggccacaagctctccctctccagttctcacctaccagcctaggcggtctcagacccttcggctctggccctctgtgtactttttcctccctgagtcccctggcttcacagagacctcttcacaggagtgagcagggcccactagacagccatgttcagcacagcctctctatgccttccagaacaaacacgctgctccctgtcagcccagcctgccagggccctcaccaccagggaaccaggggtctgataggtgccttctgcaaacagcaaaccccaggaggttgggttctgct

SEQ ID NO: 61267 - DNA, 1979 bp, Homo sapiens
agcgtgacaggactaggaagaagatcaaaccataaagtctgtgtgaattgcctgttttcaaagaagtagactattgtaaagcagtctttagactgcatctgcgctgtcgagtctttgatgattctaaagggacttgtggattctgcaggatctcaaaggcactgctatgaatgccagtcatctttgtgccggcagacacgattctggctagtaggctgtggtaacagagatggtgctaacacaaatccttaggttcagggtgcaagggagggacaggtgtgagttaatgcctatgaggagggctcctggaagagggagggcagggtctgaagcctggtcctggggagacaggtgggagggcaaggaggctggaagggggcatggaggtggggtctgtgtgagtctgggacaagttctcgggcagctgtggctgataactctggtttgtttttgttctttggctgcagacctggccgagtgcaagctggtctcctttcccattggcatctacaaggtcctgcggaatgtctctggccagatccacctcatcaccctggctaacaacgagcttaagtccctcaccagcaagttcatgaccacattcagtcagctccgaggtaggccctggtcagctccagccaggagggcatggccagctctcatcgttcaggctctgaccctgtctggggagtgccaccagagctggtccctggtcagcgacacccatgaaatcattcccatgggttgactttgaaaatggacctgtgttctccctgcagcttggaactctctaggtcacttctgcctctagctggctgtgaagcagattgaacaaggatcaagggtgtggttcctggagtgattctcttgttctgaacagaccagcagggtgtttgggtcctgaggccctgggagttgttatttcccagtagtcttgaatgagcccccttctcaccttccaatctagtgttgttctcctgtgttgctctctcagttcaggagtgacagatgccagggatgttggcattttcttttctttttttttttttgagatggaatcttgctgtatcgcccaggctggagtgcagcggtgtgatctcggctcactgcagcctccacctcccaggttcaagcgattctcctgcctcagcctcccaagtagctgggattacaggtgtgtgccaccacacctgggtcattttaatatttttaatagaggtggggttttaccatgttggccaagctggtctcaaactcctgacctcaggtgatctgcccgcctcagtctcccaaagcgctgggattacaggtatgagccaccatgcctggccgatgttggcattttctctgctgggcatattcagagcatgtggttgtaggtgcttgccatcaaggtggcaggagtccagcaggtgagcctcgtagatgctctagaaatggttcctctggatggacaagcagtgtggcctgactgctgcagtgcctgccctcttctccagagagcagtctctccatccttctacgagaggtcactgctgctcagtgacccatgtgacagagctgtggcatgggcgcctgttgtacgtttgtgaacgagtggagtgggagaattgcggagggcacaggaagcctaggggggcagatcctgcttcatcccagactcacatggaccccaactccatgccccccttccagcctccttgcgctctcacctgcctgccctggagaccaggcttcagagcctgccctctgtcttccaggagccttcctcacaggcattaactcacacctgtctctcccttgcaccttgaacttaaggatttgtaacagcaccatctctgttgccacagcctcctagccagaattgtgtctgctggtacaaagacgaccagcattcatagcagtgcccttgagactttgaagaatccacaagtccctttggaatcatcaaagactcaacagcgaagatgcagtttaaa

SEQ ID NO: 61268 - DNA, 2353 bp, Homo sapiens
atgtgtgcatgtgcatgtatgtcacccatggaatgcaggcaccactgtagaggcctggagcacagtcctgccttggggatgatcttgcagataggcaggcagaattggagttaggtacatggagaggaatttcacaggcaggtaggggtgtgtgtgtgtgtgtgtctgtctgtctgtctcacaaaggagcgcttccttccatggtagttactgccttagcaaagtcacagagactggaaaggcagtcagaggcagagaggtggtccaggaagtggagagacactcagccttcaggatgagcttgatcactgcctcttccaggaagccctccgccttccctcatccaccctttgctccctttctcctctgtagcaccccttcagcatctgtagagcacagggaccctgtggttgtttgcttccccctgccctgccccagagcccagcgcagtgtcaggcactttgtaaacgtgtggaagtgtttgctgagcttagctaaggcgagaggcatttcctctatcagcaggctcgctgaagattgtcattggtgttggagggaagcctttggaaggagccttaagctagtgagctgatgactgtgagccctcagtgaaggaattccggaatcctgtactggtcagtaatatggttgtttaaggctctctaccactgagactgcggttcagagctaggctttgagtcacatgggcctggatttgaatctctactctgccacccactcacctggtactgtagcagattgcttaacctctcagagcctcagtttcttcatctataaaatgggaatggtaattgtgtctacctcatcaaggtagttaagagtaattggaatgtctgtaaggtgtttggcacatagggagctcaataaatggcagctattatttttaatttttgctcattcccaaaagctggtggcgagacctaagcccttccccttgcaaatgcactttctacaggtgtcagccagccacgtctgtgctgggtgttcttctcactgccttccaatggagggttcagtgcaaatcgacagatgtctgtggtgagtaacctacccctgcttcaaaatgtcacagggggctgggcatggtggctcatgcctgtaatctcagcactttgggaggccgaagcaggtggatcgcttggggccaggagttcaagaccagcctggccaacatactaaaacatactaaaaattcaaaaaattagctggtgtggtggtatacacatgtaatcccagctacttgggaggctgaggcaggagaatcgcctgaacccaggagatggaggttgcagtgagtcaagatctcgccactgcacctccagcttgggtgatggagcaaggttccatctcaaaaaaaaaaaaaaaaggcttcacaggggatagggacacagcagctccacttcattcagatgtggcaagagtggagaggccgcaggggagggaaaacaattctcaccggggcgttggggaagctgcttaggggatgggtgctgtttgagagaggatgtttcaggaggcagcggtgaggagacaggcactccaggcagtggcaggggtgtgcctgagttggaggagaggccctgcccagttaccacagcagcactggggcaggtggtgagggatggtgcctggcaggcggagagcctggaaggctgtgttgaggagcccctgaacttcaacctctgtggactggagattgcaaggtcaagtgggccagtggacaggtgggcatttctgtgagctgaagagtgggcaccctgcatcaggtgaagtgtgcagggcggctagggcagggcatgctgcgaccagctcccctgcactgcctgggagccatacccaccaaggaacccaagcagttctctggccaccctgccagaccactgccatgcctgggattggaaccttgatttctgacaccagagcctgggccctgtctccaccatgcagccctggggtgggggcacatgtttggtgattgccagggtcatgactgctgtgaagctctagtcaagttgggagagcctttagccatggcgatcttgcctgaagctcaagactttcatgtggaggggactgggtcttaaagttgtggttgaataacagggatcctttgcatctgtgcattggccagagaagaagcaaaatttccaacctggccatagtaggcacctgtaatcctgacccttaggaaatggagctgaccaggcttatacactctaagggggctgggtctaagcagttagcatgtattgagtacctgctgtatactagttgcttgggggctcccaggaatgtgtgtagtagagtcctggacctgagaccagcccaccac

SEQ ID NO: 61269 - DNA, 1028 bp, Homo sapiens
gagccagcggtagggccagcttgcacacatggctccggaggctccggttgcccatccgagcccctgccaggctctaacgttcccaactgacaacaccagtaactaaatataggagcagatggtggggacgggctgtcgcagcggctcctttgcagaggtctccggactgcagataaggtagagttattgatggtaagggctggagtcagggggccaggtcagggtttaagcaaaaatcacccctcccccagccagcctgagtccaggtgaaaccaggttatagggacaggagggctgtattgccagctcccccaaagcaggacaacgtttttgtctggcattgaatttattacatccaaacttcctctctacacctgtttgattacctactggtaatgccttggtgtgggaaacatgtaatggttcgcaaagtcctttcccaaaagttacatatcagttacttcccacaataatccggtgaggaaggtggtatttccattttacaaatgggactgctcacaacactgttaactttgcaaaactatggattaggctgccttcctcaaaaaacttctcttagttcgctacacagaagcagaggacagccttgtaagagggctgcagttcccttcctcagtaatctgggagcccattggctccctgtctctctctctcctgaatctctttgtgcacctgctgctcacccctgtcccttccccctggccatgccatgtgccttcatgcccccctaggcctggccctgtagccttactactatcaggctcatcctgcctcccagtgggaagcttgttctagcccatacccagtctctgcccctttactcccacagtgggggccttatggaaggtgtccaggagacgtttgctggatttaaacatttcaccggaccaggatgctcactctgaggaatggggttgagggtgtgtggagagggccatgctttgaggatgtaggcagtgtgagtatgagcttcgaccctgtgctgaagtgtctctgggatttggagt

SEQ ID NO: 61270 - DNA, 1091 bp, Homo sapiens
ttgggacagaatttcataaaggtcattggatgggtttggaaaaaaggagaaagcaggaagaagggaaaataatccactgggagtgaaagtgaactataccaaaataaagagtattgggggtgaagggagctgcttttttttttctttctttctttgagacagagtttcactcttgttgcccaggctggagtgcaatggcgccatcttggctcaccgcaacctccgcctcctgggttcaagtgattctcctgcctcagcctcctgagtagctgggattacgggcgcccaccaccacgcgtggctgatttttgtatttttagtagagatggggttttaccatgttggccaggctggtctcgaactcctgacctcaagtgatccgcccacctcggcctcccagagtgctgggattgaaccaccatgcccagccctgtttcttttgttaagataaaaattgtctttgttggtttattagcacttcagagatttgatggttgtgcacagtgaatgtggtttggccaccacctgtctccctgaagaatacagagttaggcagcttttagtttcctctgggttatttgccatagagcttttcaggagtctgtctcttcatccagagtctccatgaagaacagatgtttaaaactgaagttcattcatgaatgttctataactcagtcaataaaacatagaccttgttctaccttcctaagttgaaagaataaaaagcagagaaaacactttctttgttaagtcctttctgttttttcctttcttattttcccttatgggggtgggagagagaaagacaggcttagacttcttttctgagtgcattagaagcacttgctgcttgttcatcttgtatctgtttctcatcttttggtgggcccttatgtgagacatagctggagaattgtcaagaattcctagtagaaattgaagttacatgccaaatgctttgtttctttttttaattcaatgtctaggcttgaaggataccttcctcctcgtggtccctgctgccctagcagtgttggtttgtatgtatgtatttataagatattttgtaagcatcttttttcttagtt

SEQ ID NO: 61271 - DNA, 1145 bp, Homo sapiens
aaaaggggctgtttattttttctcatacttgtttattctttcatttaaaactttttttttcttaaagatgttaatgttagggcctaggtcacatataaataagacatagccctgacataagaaactcagagtctataaagagagacagatggataaacaggagtcctgtaatacatgatgtgtgtaagatggagaggaagaaccttttaaaaaagtgaggggtgggggtggcttcataaaggaagtgatggttggagctgagtcttgaaggatcaacaggagtgtccctggcagaagagaaagggcattccagatggcagaagagcctgtttacaggcagagaggttagagattatgctttcaacttgaattgtaaaatccttaaaagttaggattacatgggatttaaattaaattcctgggtggtattatatgttgataaccccttaaattgtttcaaactctttttaaccctgttttccaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggtaagagaatggcgatgttggagacctagagcgtggctcttggaatttgaatgtctgtttgctgtaggttgagaagctattgattcttcagttttgttttttgttttttgttttttttgagacacagtctcattctgtcactgaggctggagtgcagtggcacaatctcagcacactgcaacctccgcctcctgggttcaagcgtttctcctgcctcagcctcccgagtagcggggattacaggcgcctgccaccacgcctggcaaatttttgtattttttagtagagacggggtttcgccatgttgcttaggctgttcttgaactcctgacctcaggtgatccacctgcctcagcctcccaaagtgctaggattacaggtgtgagccactgtgcctggccaattcttcagttaataactaatgttcagttatatgtctctaaggtttccctcctcccccaaaggtttcttgaaa

SEQ ID NO: 61272 - DNA, 7872 bp, Homo sapiens
cctcctccaacacattctttttttctttatcactgtagaagcagaatggtgcggtaggagtggccagctcctgaaatattcctcagggactgcacttggtgacccctagatgggggccagcattccgctttgtcatatttcagatgagttttttaatggacaaagtgttagtttggagcagggccaaagtccaaagcctccagaagaatgtgctcccctgagagatggcaaagagctccccaagagctgctgtttagtcatcctgaagacaaagggacaatggggatgttttcacttgtgtccttttccccaaaacttctccccatgggtgatgggactgccattcttatttttcagattaagaccagccaaagcaaagcagagtaattgttttaaggcagcagagagtgggacaatttgaattactttttgtctctcatttagagggaatgacagttaaaactgttatgcttctttgtgtacgtgctaaactcttcattttattggtcctaactaggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctgggcttggggtctttaaaaccagcagggggaaatgataaaaagagagctgctttcccttttaccttgaggtattcgtccctcgggacagagcacagcttgtgcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacaaaagcatccatcccctcatagttaagtagccactggtgtcctgggaatttctggttggatttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcattttacatattcttggaaaaacctaagttgctctgtaatttacataagaagcatgctcaggacctctttgtaccccggggagcctgattctttgggaatgaagcttttcattcttcatacactggccttggcatcctgtggaatttgacccaactagcagctagtcagtctgtcagtgagcagaagagtgaactcttcttgatctttattgctatgtgtgaaaacttggcttcctcactgaacggtgaggaatggatttaaagcatgagctttagtagtatcaagatgccattttcctttttcttgctgtcttggggagcttctgcatgtgaccccctaatcagaaggcatgtttttagtatttcttgggagtgtcagctgtataatgcagcagctgttcaatcccttacccttctctgcaaggacttccttacagcttggtgcagttctttcccagaggccaccactactagacagtctttcttttatcttatggagataaattggcatttaaaaaataatttcacaaggcatgagataaactttcaatagatgatacctttgtgtcatgcctcatggaattatttttagaacaagccagagtccattgagtggtttacctctgcatgtttggagggaacctcacagatgaaacccttaatgaataatgtgtccggggttttttagagagaaggagcactcttaagttaccactttgagacagctcttaacatcttagtgaccatttgtagttttctttttatgaggaacccatgcttctatacttgggcggacaatcgagcttaatgagaagtgacttcccttcaaattccaacagcagacatgcattgtcatgattctgtcttctttttagtgtggtttattgagttcagcagttctcatattctgtttaaataggtacagcattttcaagggcacagatacagagaagctggctttctaggtattgggcttccaagccaagagttttgtccttccacctgtattagttatctattgctgtgtaaaaaattaccctaaatttagtatgttaaaatagtaaacattatctgtcagtttctgtgggttaagaatttgggagtagtttaacatgatggttctggcccatggtatcatgaagttacagtcaagattgaacaggggctgcagtcagctggagctggagaaaccacttccaagttctctctttgtggccgttggcaggatgcctcagtttcttcccatgtgggtctctgcgtagggcagcatgagtgtcctcacaccatgacacctggcttctccctgagcagctgattccagagatcatggggcagggccaggagaaagctgcagtgccttttaagacatagtcttggaaaggacacaccgtcacttcttatcctagttgttagaagcaagccactaagttcagcctgcactcaaggagagaggaattacacatacctctaccccaatggagcagtagcaaagaatttatggacatatcttaaaagcaccacaccccaactggggatgaaagtaggtcaacagggaggtaggtttaatctagataagctgaaagatagattgctatcaaaaacagttctccaagatgtgcatagccaaactgggatagaaggcaaactccccaaagctacctgctggttttgagaggggtggtaagacatggcaattcccaggagtagtagaaaataatatgcctgactaccaacagctcaagtatgcttatttgcacatcctagacttggtgtctgtaagactcagttaccacttttattttcctgtagctaggagttagcaaaaggaactggggccttccagccgagccactaaacctgtcttatttggaatggggattgtccagcaaagggagcaaacatgaattagatgttaagctattgagctgaagaaaagaaagcagttcacatttaggtgaaatagatgatgttatcaggaagccaggttcccaccagagtcggtgcttggtacctggtctctccagtctcaacagactcaggtcaggtctctcacccaggaagcaaccactcaataaaatagagaacatctgagaattacaaatgtctatgcttgattgctcctctaaatccagtgcataggttaaccctgcatgcccatttcttcctgggcttcttgatggcaatgtgttcttaaataactggtcttgtgttcatgctaaagacaaacttacatgaagtttttcagtttaagacattctagtgaatggctgctatgtgtttctggcactcattcctaaccaagtctttagagatttcagatgaccttaaagatgcaatatctttttctttctttctttctttctttttttctgagacaagagttgcgccctgtcgcccaggctggggtgctggagtgcagtggtgcgatctcagctcactgcagcctctgcttcccaggttcaagtgtttctcctgcctcagccttccgagtagctgggattacaggcatgtaccactatgcctggctaatttttatttctatatttttagtagagatggggtttcatcatgtttgccaggctggtctcgaactcctggcctcaagtgatccgcccacctcagcctcccaaagtgctgggattacaggcgcgagccaccgcgcctggccaaagatgcaaattcttgtttggatttatgctctgcctcttcccagcattttcttatctgtagccctgcttgcttgagagtatacttggataagaagtattgctgttgagggagctataagaaaaggattcttcttccagaagtaaagaactcatctttagagtacctttaaatgaattttgtttttctttcttattttgaggtggattggtcttctctttttttgggtttccagctcactgggactctcagaccttacctttccagctcaaacaccattagttaaattccttcattctcattagaatgcagcctgctgagtatgtgggtttcactgccggagtccatcatttagccagtatacatagaggaactgcttcgaatcaaggcaactggtgaagggcttagcatgttggcagcaatatcccagagattgaatctgtttgcattttcctcatctaggataacagctgcttgaagccagggctcttagccctttgcattccccttgagcgaggaagccacactgcctttctgtgtctggttcagagctcttccttcttggcatgttttctggactacatgcacatgggcagctatagattaatctgcaaaacctagtcacttacctacccataatatctgggaaggtgtggtatttgttttaaagaaacattgtttctttgggagggcagtttctgtctggactttgaggtggacttagttatccctacagttctttaactctcagcttttaataaaagatgaaatcagatattgatgcagttgggtcacaattctttagaatgcttctaccccagggccgcttcctgttcctagtcatggttttccagtttagtagtggagtttcttgaggctaacttacagaaatttctaactgaaaactttaagagttattgatacttgttttttcagtcagtcacttacatcacctagcctactctctggaatttaaatttatttctctaggctggtcctggaagttgataaccttttggcaaagcttagatttaggagaaggcttgagtccctgttcagcgggtctgtggattctctttgcttatggctctctgcctgcagccctggcagaccatactgtatgtcatggatacccagtggaaatattactgagatgaaacacatttccaagggtatttaaactctcactctgccacctttctaagggtgggaggctggcagagatgctgcaatgcttgataatcatttggccacactgaaatttccaaagggagctcttgccggtgcttaaaaccaaaactcctggacacttagaaaattccatgaatctagcacaaaatatccattcttgcccaagtgtatcccctttctctccagcttaatcttttttttttttttttttttaaagcccaggccaagggtacttttaactggaaactggggaggagggaagaacactagcagggagctaagaggcaggttgctgggtaagccatcctgctcctacctggtgcctgtatctacattgctgagtgctgtgcgccagtgcctttccttcatctgcagatggagcccatctctttccacctgggtgaggagaccctctgctactccaggggtaaaccttaaagaaggtgtcttgaagagcccagaggacactcacgtgctaaggtgtccattttatgcatctttaaaatattttatttaaaaaaaaaaatagccctgccctgtcttagtgccactaacggcccagttccatccattctgaatggaaaagcggagactgccagcactttccttggtcttccctttgtctcccatgatgtgttgttccctcatccctcccatccatttcactgtgtgtggatggatagcagagggtaccacgcagtccttgaggcagtcctgtgtgattccatgatcagttgtttttgtattttaactattcttccaaaccagcagatgtttggaaattaaggaaaaaattaaattctcatcaatggttgctgttatagttaaatcagtaaagatcttgagtatcaacttggtgttttaattttttaaaaatttctggtgaaatcctgctaaggttatttcacatttcaggagtttcagctggtgggggagatgggcagaggtaagaggcagttggctctttatctgtcagttctccacacttgcggagcatgcactttgtcaatgtggacctgtgtatgcaaaggagatggtgggactctcagggagcatgaccctggtcctgtgctcaggagcttgcaggtgaacatgtatatgctgggctgacggcacccaagcatgtccttctcttaagtgccagccctgaggaagcccaaacaacttttcctttctcagaagaggggctgcctgtgcccctgggagcactggttagatgcccatcatgcctgttacctcaaaccaagctgtgctgcatgagcgtcagattccctgctgttaactaatccagcgggtttcatgta

SEQ ID NO: 61273 - DNA, 1083 bp, Homo sapiens
ctaccttggagaattgtgtcctgtctgaacctgggatgttttctgttgttttgatacaggatcttgctgtcaaccagactggagtgcagtggcacaatcatggctcactgcagtcttgccatcctggactcaagcaatcctcctacttcagcctcccaagtagctgggactgcaagcatgcaccatcatacccaactaattttttagattgttttttgtcaagacagggtctcgccatgttgccaaggctggtctccaacttctcggctcaagctcttgtcctgtgttggcctcacaatgtgttgagattacagctgtgagccactgcacctggcctgaacctagggttttaagagcactcaagagttattttaacttgctctcaagaagtgccaagtcagttgtgagtggtaaaaattggacacattacactccttggctgaggaagtgggtgggcctggcagtaggtaagcctggagaaattagaaacattgtaagaaacagaaacacgggatccatagagatgtggggagtggctgtgaccctgggatagcacccctaacctggggtttatctccgtctttaagtcttccttttcggtccggcgcggtggctcatgcctgtaatcccagcactttgggaggctgaggcgggcggatcacgaggtgtggagtttgagaccagcctgaccaacgtggtgaaaccccgtctctactaaaaatataaaaattagccaggcatggtagcacgtgcctgtaatcccagctactcaggaggctgaggcaggagaatcacttgaacccaggaagcgggggttacagtgagccgaggtcgcaccactgcactccagcctgggcaacagagcaagattcagtctcaaaaaaaaaaaagtcttcattagcagtaagatccttacctatcctaattgcctttagggcagagtaaaggatgtaggaaagcgcttttaaggttttggtcccatcttcccttaaagagatcctttagtccttctataggttccatgagtaggtggtagctgcagtgctcaaacctgttccattcctaaacttacacacttggagg

SEQ ID NO: 61274 - DNA, 1799 bp, Homo sapiens
aatacaaaaattagccaggcatggtggcatgtacctgtagtcccagctactcaggaggctgaggtgggaggatcacctgagcccaggaggttgaggatgcagtgagctgtgatcacaccactgcactccagcctgggcaacagagcaagaccatctcaaaaaagaaaaaaaaaatggtattccctttagactagaataataggagaacataaaaattagctaccacttaaaaaaaaaaatagctactactctacccagatacatgtaattttttgaatctgtttaaaggctgttttcacaaaacaagcacagagctaaaggtagtttagacattagagttcatgatatattggcaagctaattcctttatgaaaataattttctgctatttttgcactcaggaactgactttaactccgtaacttttttactctttacccagaaatactattctgacctgcccatcaggatgtgaattgacacacccttcctttcctttacagagtctgctgaaacgttaccagccccaccgagtcccttccacttgttgtgccccagtgaagaccaagccgctgagcatgctgtatgtggataatggcagagtgctcctagatcaccataaagacatgatcgtggaagaatgtgggtgcctctgatgacatcctggagggagactggatttgcctgcactctggaaggctgggaaactcctggaagacatgataaccatctaatccagtaaggagaaacagagaggggcaaagttgctctgcccaccagaactgaagaggaggggctgcccactctgtaaatgaagggctcagtggagtctggccaagcacagaggctgctgtcaggaagagggaggaagaagcctgtgcagggggctggctggatgttctctttactgaaaagacagtggcaaggaaaagcacaagtgcatgagttctttactggattttttaaaaacctgtgaaccccccgaaactgtatgtgaaagttgagacatatgtgcatgtattttggaggtgggatgaagtcacctatagctttcatgtattctccaaagtagtctgtgtgtgacctgtccccctccccaaagattaaggatcactgtatagattaaaaagagtccgtcaatctcattgcctcaggctgggttgggggagccccacagctttctggctggccagtggcaatctactggccttgtccagaggctcactggagtggttctctgctaatgagctgtacaacaataaagccattgtctagttctcctgggccagctggtgcctgtgaaggcagaggcaggaactcatccaagaggaccggccatgttgggttacagaagacatccctgcgtcagtctgcttcggcagacacagcctgagtttgttaaagttggtgacaatccacctcagtctctcaatgtgtgctattaatgaggcctctgagcttcctatccagcagtggtgaaggccttgccctgggtggcaagatacttgctctatggtcacagctcagccactggaagctgtgcgacctcaggtgagcaattcactgtccagtctccacttgtaaaaggaacgctggtgaatcctaatgcattcatattaaatgtctgttgtcaggctcagaagagccatgagctttaagctgtagactgaataggaagagctaccttatccctacctccctctaaagcttataaagcttgctaaacccagtccctgccacatgcccttaatctaacctttatcggctcttttgttactcagggttctaagacagactta

SEQ ID NO: 61275 - DNA, 1115 bp, Homo sapiens
tcccgggttcaaatgattctcgagtggctgggattacaggcgcaaaccaccacgcccagctaattttgtatttttagtagagacagggtttctccatgttggtcagacttcatgtatgggaggagacaggggagggggagatgcaactcatcacatttttactgactgtcctctggctgtgcaagttatcttggaagggggactggaagaacagtaattcggagtctgggcttggcagttgggcaaatccaggtttactcttggctctgccaccttccaagaatgacaccttggtcagatcttttaaccacactgagcctcagttttcctcatctctaaaagggactcgaaaatcttaccaactcatagagttggggtgagaattcgaaggtaattctatataaggtaaggcctccagcaagagctatggtggttgtgacactgactgaggctgggggaggccctcactcaccctccttccttcttggttttctcctacccagatgtggcagtggatgggcagaactggacgtttgcttttgacttctccttcctgagccaacaagaggatctggcatgggctgagctccggctgcagctgtccagccctgtggacctccccactgagggctcacttgccattgagattttccaccagccaaagcccgacacagagcaggcttcagacagctgcttagagcggtttcagatggacctattcactgtcactttgtcccaggtcaccttttccttgggcagcatggttttggaggtgaccaggcctctctccaagtggctgaagcaccctggggccctggagaagcagatgtccagggtagctggagagtgctggccgcggccccccacaccgcctgccaccaatgtgctccttatgctctactccaacctctcgcaggagcagaggcagctgggtgggtccaccttgctgtgggaagccgagagctcctggcgggcccaggagggacagctgtcctgggagtggggcaagaggcaccgtcgacatcacttgccagacagaagtcaactgtgtcggaaggtcaagttccaggtggacttcaacctgatcggatggggctcctggatcatctacccca

SEQ ID NO: 61276 - DNA, 1064 bp, Homo sapiens
aggagccctagatcccgtccctggaactaggtcctccgccagctttgcgggcctcctccgcaccaggctcaggtctcgcccatccccagcaggaggtctctctgccccccaccctccggaggggggttatatgatcttaaagcttccccagagggaggaaaggtgggggcggggcggctgctgaggcccaggatataagggctggaggtgctgctttcaggcctggccagcccaccatgcacgcccactgcctgcccttccttctgcacgcctggtgggccctactccaggcgggtgctgcgacggtggccactgcgctcctgcgtacgcgggggcagccctcgtcgccatcccctctggcgtacatgctgagcctctaccgcgacccgctgccgagggcagacatcatccgcagcctacaggcagaaggtaggcagtgccgcgtgccgcgccctgctgggcacccccggggcgcctccgccgcgtccagccagcggactcgggaagtgctgtgggttgggggctgcggctccgagccgggtttgcagccgcccgggcgtcccgagcccagggcctagctctgcgggtgtctccgcgtcagcaggctcggggtgcagcgttggtggctgggggcgtatccacggccgagtcgggaagggattctagcgttcagggtgtgtcctcgacggggaccattgtctctgggttttggtttgggattgcgcggagcgcagcgcggaagggtgggagcttctaatctccagtcttgtgaagttgcttatcccggagcctgggtctgcgcatctgtaggataggtgtaataaataacacctcgcctatcagactgtggaaagcgcgagatgacaatgcgcgcgaaacgctcagcgcagtacccggcacagccacagtcaacggtcgttggtattactgtaatggtttggtcttggcgatttttttttctttctgcgagtgagggtgaatgggtcccggggtgtgacgtcgggagtatcggcagctgagctggtaacatcggggattcgggctcacggcccggagatcaggga

SEQ ID NO: 61277 - DNA, 1133 bp, Homo sapiens
gtcccagggcctggcagggaagggaggggaaggattccagagtggacagagatcccatgggcagataggggaggagtccaaggcaaattgcctggaggaggaacctgaactcagcctccaaacacccctctgccctggcaggttcagggctaggtcatggtgtgagcttgggtggcaacagtaatgacaggaacagcagtcatcagtaagtacttgctgagtgccaagcaccttttatcctccagactttcccaggaagcaagaactgctctttgcatcattttacaaatgaggagacttggagcaatgtggtaacttgtagcataggggtcacatggtggtaaagttgctgtggctagatccaagcccaggtctgccctgcttaaagcccttgtctttaggattgcacacagaagggggctgaaaaagtgggagtgctggatgctggagatggggcagtgggcctggaagggcggatggccagggcagacaggggatccgtctgtgttgggattcaggcgtcacggatgagtttgcctgaggctcagagaccactgggctcagggcgaaatcacaggccacaagactcccaccctgaagggtgcacatgatccctgttcttggcagtaaggtggtcacaaggagcaaggccagcccatgtcctgatgttgtccactcctcaggtccagtgtccctcagctgtggcagatgtcagggaagagtggggagtagagaagagcagcaagggcctgtttcccatctttgatcaagattcatctttgctggtttgaacccagctcctctgctttccagcgagtcatttgtgcctgtcaggaaatcatttttggcttgagtgttccctggagggaatctggggttcccacagctcatgtttttgcccaggaactgaacttgggagctctctcccaagagcaccagcaccttgcttgggctgatggggcagtggatggccacaggcgagtctgtcggggcgtgagtaacaggttactcatattctttgcagcagcagcttgtctggttttggacggttgcaggtgctttgtgtgtgtgctacacgtacacacacatacacacatgctcacttataaagccacactcactcccactagaca

SEQ ID NO: 61278 - DNA, 1076 bp, Homo sapiens
accagcgtggcatcttgatgtgggttcctgagctttcttggccctgggttcagtatgaggtgcaggggctccgaaggtagattaaactctgtccctgccaggaggtgagtgaggtacatgcagacaccatgtctggttctgtgatggggtctgtgctagttatggttggagcctgagggagggaatggctggcctggggtgtgtgtgatacttcacgtgggctttgagggatggccaggagtttgcaaaggaggagggcaaggcttccccagcagaaagagcagcgtggcagaggtgtgacagcccttgtgaagcgttttgtgtatttcccataactggcatgtgggctgactttggctttaaggggtgcccctgcctgggctgaagctggggcactgatgagagaggcaggtggggtgtctgggtcatctgcacacccatggaaggcagtagagaacatctttgggaactgggtgtgtcactgccaatgctttgggctcccagggagctggggctttcagaaattccccaaggagagaggatgtggtgctgtgagggctgtgggtaccctgggaaacggccaacaggctgggctggggcccatgggaggggagaggggtgggtgccctgagatgacctgggaccctgccagcttctgcatcctgctgagccccaggcccttcctctctgtgggctgtgccggcctctgtctggccttcccagaatggaggcctgggacgctgggacatttttcgaagattctgtttggaaagcacagaagggacttctcctccccttttccttttcctggaatggagaatctcctgaaggagttaacccctttcctgctggtcacagagtggcccatggatgtgtccccggctttttttaggatcactgttttattgttgccctttctgttacacgggatgtatacatcaggtgctgaaaggtacaacacattctgcaactgagtgccaccttccatgattgaacaggcaaagaaagtacactgaacatcagcatctggcaatatattttttgtttgtttgttttttttgagatggagtctcact

SEQ ID NO: 61279 - DNA, 1105 bp, Homo sapiens
cataggtgcataccaccacactggctaattgttacatttgtatgttttgtgtgtgcgtgtgtgtgtgtgtgtgtgtgtgtgtgtgtgtgtgtgtgtggtgtatgtatgtgttcgtagagatgaggtctcaccatcttgcccaggctagctttttattgttttaaaaaaattttccctgttttgtttatccaagtggctcctttgtgccaagcacaggccaggccctgaggatgccagtgaaggccagcaccaggtcctgcctggtgggtccccagggagacccctgtggtgggaaggcacggaggggaggataaggaagcctcctgatgcagggagtgggctggacaagaagattgagccagtcaggaagatgtggaatgagtgattggggggctggtgtgtggccctcaaacttcgctgctccacggaagaaacagcagcatcttttctgtcgctggaggaaaactggctgggccagaccatttgagagacggcccagccttgttgtttatggaatatgtcaaggatcttcaaaggcaacatttctgccatcaacagactgcaaaacaccctgctcccaccccctggtccagtaagatgctcctcggctttcttattatttttgttattgatgttgattatttgccaaggcctgttgatggtgcccattctagggactgtgaggaggtgcactggctggagtttagggcatgggagttggggagcagcaggttggagaagggctgggccagcccagcgtgctcctggactgccacatgctgcgccctgagtccagctgatatgcttaaggtagaatctgcctcctcagaagcagggtcactggccccagctggacgtgcccagtgatgcgcatgagcacgaggtgccatagagagtgaggagcaggagaaccctgtcccaacgccaccacccactgttcttgtgactgtgggcaggtctccggccacccgtggaccccagtttcctcctttgtaaaatgaaagggtcagacttgggtctcaaaggtacttctggctctcaactctaagatacacgtgggtgcccagggtgggtttcgactctgtatggcgtgtgtgtgtgtgtg

SEQ ID NO: 61280 - DNA, 1010 bp, Homo sapiens
gtgtccgttgggaaagctggggtggcttcagtggaggaatgagggagtggcaggtgaagtgcaggaagagccagctgcggaaacggaggctgggctctgtcttgtactgtagagaactctctggcctgttttttcacctgcttgatgggacagttgccctgtgcttctcccttcctcataaggttgtcctgaagttccaatgtgaaatgcacttggtaaagtggcatttggaatctacaactattgtgggctgaatcctgttagtagggctgccccacagaaggaacatcagacccagagtggggaggtgaggcatgtacttaggaaacaccaggccaccggggtcagggccaggctgggtggagcacaggctgagtgctgcttggcttggagcaggaggcccattcatttccactggatgttgatggatgtactgaagggggtgagggtggcctggcgtgcctggttgtgggacccacaagggtgagggcagggaagggccttaggtcctgggaggaccttgagggccttgagcagctctgtggggcagctctggaacttctctctaggagggcacaggttgggtctgggggcaggaagcgctgcagcttcttctgagcgtgcagccagtacaccagctctgctcctggctgttggacacacagggctttcaggaaacattgattttgcacaaagaattcagccgctgaaatgtctgaaaaccacccatctatctcgtccagatggaaataagcgtgggctgtgccgaactcttggaaagtcagggctggaggaaaacttctagtggggcttttttttcctgttcaacactacggggcagctgggatctggatttgcctaaaatattggggatgtgtggggcaaattcatggtgttgagatgagggtgcctaagggggtacttgagtgctgggcaaaggagtttagactggaggccacagtggtgggtgggatggagacagatgcccagaatccaggtcatggttctcc

SEQ ID NO: 61281 - DNA, 1004 bp, Homo sapiens
gcaggtggatcatgaggtcaggagttcgagaccagcctggccaacatggtgaaaccccatctctactaaaaatacaaaaattagccgggtgtggtggcgggtgcctgtagtcccagctactcgggaggctgaggcagaagaatcacttgaacctgggaggcggaggttgcagtgagctgagatcgcgccattgcactccagcctggagacagagcgagactccgtctcaaaagagaaaaaaaaaaggcattgaatccaccgtgaggacagagccctcatggcctaatcacacctcttaaaggcctcttaatactattataatggcaattaaattccaacatgagttttggaggggccattcaaaccatagcagtactgttagcctgttagtcacatggccccaggtcgctgcaagggaggtggggaatgcagtcttggctctgggcagctgtgtgctcagctggctgtccctgcttctgggggatgaaggcattgtgagatttttgattaaatctgggccatttccaggctgaaaagctggaccagagcttcagggcttgagtctctcacagagagatttcccaatggggacatcagtcctgccttgggaccagaaagccacatgctgtaggccaggaagggggaagcaggggctgagcccgagggagaaaggctttagaggtgttagcagacagctcagtggcagtggttagaattagggaggcagcgacctcttcttagtgtggtcagagcatgccaagaaagtgtggtctgtgtctgggctgctgaggcccgagggcaagggccaagctcattcataggacagtggccaagaagcggggactgaaaggcttgggaaaagtaaggaagctctgcaggttctgggacacaagtgaacacggtaagcagtggaaggcccaccccaggacagggttagactgggagcactgtctccttgtagcccacaagaggccagggcagggcccaagtacagtgtggaagtc

SEQ ID NO: 61282 - DNA, 1146 bp, Homo sapiens
aggcaggggaggagaggcggaggtgtcaggccgagcccagccctgtggggacgggccctgatgcctggccttggcctgaagctgtggccagctgttgccttctgcagacccttctgtgtcctgcccatcctctccctcgggagagctgccctgagcccttgttctccaggctgttcccacacatgtctttttggcccaggttgctgggaggggtctgggaaagtttgatgagggccgtttggggcctgccagggctggtgaggtggagagaaggttccgctctgcccttggccagtgagggggccactgcagagctccctcccctctttgagctgcctatttttctgtttgggaacatagaggctcattccctccacccttgccaaaaagagagagaaagagagggagaaattagggtgtggagcaccatggagatggggctcttttaaacacaaggtgtgtgtgttaacgaagctgtcacgaggctcctgggagttttcaagggtgacaggcgtgagtggggttgggggtgggaggatctttccagactggagagggatgggtggctgtttgagaaggttctgggagggccgatgagtctggagttgttctctctgagagtccctgaatgggaggtggctctagggtaggagcctgagtgcatggtccagaggaggcctggggaacacccacctggggatcagagctctggttcaggacctggggaagaaaggacagtgagctcagccttcagactgacctgacctcagcttcatgctgaccccatgaccctaccttccacttcttgaggtgatgctgctgcttatgggagggctggggggagtgtggatggttgggagcagacagtccctactgatgtggagcagcttgtgcctggttgagggcagctgggaaggttgccatgctctaaggatgcttattgtccaaggatgcttattgtcctggtgcttctgcagagtcgaggggttgggggctggcagggcagcttgccccgatccccagtcctggaccatcagtatgtggggccagtggccacggagctcccagaaagttccttgagcctctgtccctcctgtctgtcgccctctgtccatgtggaattcccagccccctcccttctctgca

SEQ ID NO: 61283 - DNA, 1061 bp, Homo sapiens
ctccatctgcagaaaatacccctgagccatctgagtgaccttcctgtggctctcccctgccagggccgctacttcctggtgcgggatgtcactgagaagatggatgtgctgggcaccgtgggaagctgtggggcccccaacttccggcaggtgcagggtgggctcactgtgttcggcatgggacagcccagcctctcagggttcaggcgggtcctccagaaactccagaaggacggacatagggtaagtatgccacttcccaggcagaagccaggtccccaaagccagggagaggggcaccttggaggggcagctttagaggcgctggaggggcctgctgcatgctggagaggtggggtagtggcctggaccaggccctgcctgccaggatggtcactgctgttggtctggttgggaaattctggtgaatgttgattgcatgtcctgagtggatggcggggcacaaggtcagaagccttcatagaccctacttgggagcctcagaggaagcagggggcgtgaccgggtgacaggaggagccagctcataatttgacagcttgctgaatggtgatcacagctaacacttaagtcctgatgttagccctgtgatggagtggcagtttgtctcccattttgcagaggaggaaacaggcccagagaagctaagtgacttgctcaaggtcacacagctcatgagtggtaccccaagacccaaacccaggcagctgaattcccaagtgcctgctttcaaggactgttcttacctgtcggatgttgaggcagggttttgcgtgtccctaggacacaggctgagggtctgctgcgattgtaggcttcttgagtgcagctgcatctgaattgaccccggagttaaggtggaaaggctttgagtgagacagaatggggtgggggtgtgggctgtgtgcaggtcccatcttcccatcttgatgataagttcctcaaggggaccatctgcccacacatttccctctgcctgtatggtgctcagtgaatgaatgattgcgtggtcatggggcattcatttcttcagctgatgtt

SEQ ID NO: 61284 - DNA, 1082 bp, Homo sapiens
ccgctagcaatcgcttcccctcccccaccatctggcagccactgatctttctgcctctgtggatttgcatggtctggccatttcgtataagtggaatcatacaccatgtggtcctttgtgtctggcttctttcacttagcataatgtttgaaggtttatccgtgttgtagcatgtattattactgcatttgtatggctgaataatattccattgtatagacatatcccattatgtctgtctgtttatcagctgatggacatttggtttgttgtagaactttttggctattatgaataatgttgctgtgaaaattcatgtacaagtttttgtgtgaacgtatgttttcatttctcttggttatatacctaggagtggaattgctggatcatatggtaattctgtgtttaaccttttcaggttaaccaccgtgagttggtggctgagtggggatgagaggcaacgatcttcactcccagcccacgctcctccccagaccatgttgtccttgacccaaggatctcatccatgttgccccagtgggctgcagggagatgtgcggagtctctagaaaggcagcggcccctaccaccccttctctctaatggtgacttctggaaattggcagctgggtctcacctgtggtatcagctgtttatttaaacttctgccctctggtttcaaaccagaagtcccaggtggcctccagcagggtctgtggttctttgctcagagccgggtgctgtccatgcagagggtgccatcagcctggtcagatcccccacagcctctggatgtaaatggacctgagctcaggcttgggtagggctttatcccctccatcggcttaatttgcccgggaatgttctaggaccagtccacatttggcccatctgaagttttccaaaatcccaagagtccacttgggatcctgaaattcaacagcatgtgtctgcttggcttcctgcccctcactccccagagcccccaaatggtgaatttccttttcctggccccctgccggcttcagcagtcaacttatactttagtaataagcagtgaagaacacagctcctgtgatatg

SEQ ID NO: 61285 - DNA, 1053 bp, Homo sapiens
gggctcaagtcatcctctcgcctcagcctcccaaagtgctgggattacaggtgtgagccaccatacctggctgctgagaccgctcatctctcttccttcccattgtagggcaagctggtatttccattctccaggaggactttcctgctttattcaacaacaaacatccattgagcagctatggtttctaagtgtgcaccactgggcttagaattgttgatgggcttgaggggattaatctcaactccagcaccaccgcctccttcaccccctgggtaatcccgagaccctgacttggtgcctgctgctctcattgtcccgattgtggttgttaccagaggtccttgtttctgctgcaagatccacctctgaaaccctgactccaggaccctgcctggcacaagtaggggctccacaaatgtctttctagtgagtggatggagggaaggttgagtaaatcattgcataaataaataggaaaacctgactctacctttattattaactattagtcttccaggacagagcgttcttctgcagcaagcaaaagagccctgggtcaggggttggaagccctggctgcagccctggctctgccagtaactccctgtggaaccttgggcaagtcactttggcctgctggacccctgtttttccatctgtcacctggagttgttacccttgctctgtgtgctttgagggatggtggtgaggaccagtctggggcccatggcaggtgggatggggtgtggggtgtgcagggtggctgggctgccaggcaggctctatgggctacatgcggacacagtgggcctcttgaggaacgagactgtgtcctctcagcattgaatctctgtgcctggcctagaggtgctgctgaacagcgtctgttgaactcacagcatgcagagtggcccacggcaccaggtcaagtcccttcacactttgaaattacttaacaaaatatgatgtcacctttggaaaatgggttactggtagggattgagggcaattttgtccttccaggggttaggtacagaaaagcgtcctgta

SEQ ID NO: 61286 - DNA, 1043 bp, Homo sapiens
agcaggagccccaaggagtgctagctgagggtggttgctggggtggtcctcatggacagtgaggtgtgcaagggtgcactgagggtggtgggaggggatcacctgggttccaggccatccttgctgagcatctttgagcctgccttccggtgggagcagaaaaggccagaccctgctgagttagaggctgctgggatccactgtttccacacagcgggaaggctgctgggaacaggtggcagagaagtgccatgtttgcgttgagccttgcagctcttccagctggggactggtgcttgctgaaacccaggagctgaacagtgaggaggctgtccaccttgcttggctcactgggaccaggaaagcctgtctttggttaggctcgtgtacttctgcaggaaaaaaaaaaaaggatgtgtcattggtcatgatatttgaaaaggggaggaggccgaagttgttcccatttatccagtattggaaaatatttgacccccttggctgaattcttttgcagaactactgtgtgtctgttcactaccttttcaggtttattgtttttatttttgcatgaattaagacgttttaatttctttgcagacaaggtctagatgcggagtcagagatgggactgaatggggagggatcctttgtgttctcatggttggctctgactttcagctgtgttgggaccactggctgatcacatcacctctctgcctcagtttccccatctgtaaaatgggagaataatacttgcctacctacctcacaggggtgttgtgaggattcatttgtgattttttttttttttgtacagagcttttaagcattaaaaacagctaaatgtgagtgcacctggctgctaatatgtctttagtgtcagacagacgttctagaactggtacaacaggctgaggtccctgccccttcagagtaagggtgggcaggcagagtgagttgagagcacctgttcttggcacttccagctctagagcaggcgggtttttgcagacacgcatccccagttttgcctcaccctc

SEQ ID NO: 61287 - DNA, 1055 bp, Homo sapiens
gatgcacgcggcttctgctgcccacagtttcgtgcttacagcctggctgcctccttggctggcccagaaggggtatgccagcaaagcgtacatctcctgttcccctcctggctcaccccttgccatgggactgtcacgcctgtgtggttggaagtgctattactcttctccgtgtggtggacaatggttgctttgtgggttgtaggttgatcactttgcttttgagtggaaaagaattgatggctgaagggcatggggagatggaagtagtgagagcaagactatgcatggagctccggcccagctcctaggaagccatgtgggcaggaggcagaggctgggttccacttctgatggcatcacctccctaaccgcactgctggcatcacatccctgaccgcgctggtggcatcacatccctgactgcgctggtggcatcacatccctgaccacactgctggcatcacatccctgaccatgctggtggcatcacatccctgaccacactgctggcatcacatccctgaccatgctggtggcatcacatccctgaccacactgctggcatcacatccctgatggcggcagtggcatttttttgtagagacagggtctcactatgttgcccaggctggtttcaaaatcttggcctcggccgggcgcggtggctcacgcctgtaatcccagcactttgggaggctgaggcgggtggatcatgaggtcaggagatcgagaccatcctggctaacacggtgaaaccccgtctctactaaaaatacaaaataattagaagggtgtggtggcgggtgcctgtagtcccagctactcaggaggctgaggcagaagaatggcatgaacccaggaggtggagtttgcagtgagccgagatcgcaccactgcgctccagcctgggcaatagagcgagactccacctcaaaaaaaaaaaaaaaaatcttggcctcaagtgagcctcctaccttggcctcccaaagcactaggattacaggcataagccaccgtgcctatgcccggtcaagattaggcttttaaatgta

SEQ ID NO: 61288 - DNA, 1614 bp, Homo sapiens
agcagggctgagggcgaatggcgaagggccagggttctcagatgcgcccacacgtggagtcccctggagggcttgtgaaagcacagcgctgagccccagcctgagtttctgatgcaatagggctgggtggtgctggaggatgtgcattgccagcaagcttccaggtgacgctgctgctgctgcgtgtggggacatcactttgagatctgctgctctaggggattttacttcctcttccatgtagtcagggctgactctcccgtcaggtggctctgtagcccccaccctgagaaaaagctttatagtgggtccagcaggggcaggggtggagggcgggcagtcagtgggtaagtgggagggggggccacctgactgacaggcatccccacgttgcttccatccttgtccttgtgctgtgtgtgcagcggagccctgcacgggagacaggtctgtcttctgccagatggaagtgctcgatcgctactgctccattcccggctaccaccggctctgctgtgtgtcctgcatcaagaaggcctcgggccccaaccctggcccagaccctggcccaacctcactgccccccttctccactcctggaagccccttaccaggaccccaggaccctgcagatgctgcagagcctcctggaaagccaacgggatcagaggaccatcagcatggccgagccacacagctcccaggagctctggatacaagctccccagggacccagcatccctttgcccctgagacaccaatccctggagcatcctggagcatctcccctaccacccccggggggctgccttggggctggactcagacacctacgccagtccctgaggacaaagggcaacctggagaagacctgagacatcccggcaccagcctccctgctgcctccccggtgacatgagctgtgccctgccatcccactggcacgtttacactctgtgtactgccccgtgactcccagctcagaggacacacatagcagggcaggcgcaagcacagacttcattttaaatcattcgccttcttctcgtttggggctgtgatgctctttaccccacaaagcggggtgggaggaagacaaagatcagggaaagccctaatcggagatacctcagcaagctgcccccggcgggactgaccctctcagggcccctgttggtctcccctgccaagaccagggtcaactattgctccctcctcacagaccctgggcctgggcaggtctgaatcccggctggtctgtagctagaagctgtcagggctgcctgccttcccggaactgtgaggacccctgtggaggccctgcatatttggcccctctccccagaaaggcaaagcagggccagggtaggtgggggactgttcacagccaggccgagaggaggggggcctgggaatgtggcatgaggcttcccagctgcagggctggagggggtggaacacaaggtgatcgcaggcccagctcctggaagccaagagctccatgcagttccaccagctgaggccaggcagcagaggccagtttgtctttgctggccagaagatggtgctcatggccatactctggccttgcagatgtcactagtgttacttcta

SEQ ID NO: 61289 - DNA, 1019 bp, Homo sapiens
cacccaggctctgccacttgttaactgtaggactttggacaagttgtttcacctgcatgtgtgtagatatgtactgcatataaagcacatagaacaattcacactgtgctcatcaccagcttttacctaagtcgctgcctctgtgcccagcacacacaaaaatagaaactcaataattggcaacagtgatccttctaaggaggcctacacgttccccgacctctgctctaccctacccagagtcctgtgtgtctcagctccaggaggggcagagtcctttctcaggatgccccaactgccatctgcccttcagttctctagaacataaaaggaccagggaagccccacgtggaggtagcacttgggctttcccatgggagtggggagtagggatggttccgtgcagcccatctctctcttggcatcagtgaccccaaccaagcacaggcctcccactgctaggaaagcagaactgtcctctctcagggaagacggttttatttagtaagagttttcacggtagggaatcaggtactgctgtgaaggtggtggagacagaaacacccctgaacccttggggctgctcttgagcaaggcaggtgcaagtgttagggcccctcagctctctgccctcggcttcgatgtcttcttctctgtgttctggcttgaatgcatctggaggacttgagcttctccaatgtactctagtgggaggagagacagcaggcaggagaggaccgggaaggtggggcccccacctgggagctgcaggtggatgtgtgagtgctgaggggaaggtctgagtcaagcccagctcctgctctcagctctgctggtgaccgaggagggaatccaacctgagaggaatggagcgaatggaatccaacctctcttctttcaacatccaagtaacaaatatcaatgagatgcctactctgtgcctctctgccaggcactctggacctttgatggtctaatcagggagaataatatacattgaggatgtgtttccttttctc

SEQ ID NO: 61290 - DNA, 1009 bp, Homo sapiens
gcctactgcattcttgtttatctagtctgtaaatgttaatacacaattgatgggaacaaagcaaccttagttctttttgagtatgaaaaggaccctgttaagggcagaatttaaaatatttgtagtagttaattctcaggttaaaatcataatcttctagaatgctttagattctaagtggctattgtagtaacactttatactcaatattgggggaccatgttttttggaggctttcactgaagcatttaattccattcttttgaattcgttttgacagatgggtctaaaaaggaatagatcaattctgtattgaattccagtcttaatggcaccgagtctttgagacaattgaggcaaattggaaattctgttttcacattcttctgaaaggggatgcctttcagaagtgtcctgaagggcgctggggagggcaaatatgaggatgccagggtaagtctgctccctgtctggctgtgttgggccagagtggaagaaagcctaagactctgttacccagccctttctgaaaatgttttcaaatgctttcccaacaatcacgaccacaagagtcaacagtctgtttggatgactgaaaacacacaggtttacgatctgtaaagatagtaggtaagtgatttaatcttgttgtataggtaggccagagggcactcgcagccttctgattgatttaatagattgttgaagattaagagttgacttaacatctctcttagaaaactgagaaatagctcattactaaggtgtgttttattaccaccgtctgtaagaaaatacaacataggcatgggaatcaaactacttaaagcctcttccagctcctttgtgactgggaaggttacttttccttgttgcttattgaagagaaaaggaaaatgtttatcattggataattcaggttcactgaatatttaatgagtgtttattatctgcagtcattttcttattaccttatctcatttaatattcacaacaaccctgtgagtgg

SEQ ID NO: 61291 - DNA, 1598 bp, Homo sapiens
aaggagaatgtttgctttgcaacacttaaaatataaaataatttagtatcaagctcattacagaaccagtttgctgactactggggtagagaataggaaagattcaaatagagaagagaaatgacattgatattgggggtattagtgtgagttaagagagtgggacagtgattctagcagtcatatagaaattttagggctgaagtgacgatctagcttaaccctcttactgtataaaataggcacaagattgaaaatagtctcaaagtccactagctgttaagtggcagtggagtgctgctggagtgactggtacagaagccttgagggctgtagatgataataagattattgctgaagaagggcaagatccggaatgaccttgcccttgaaaaatgagagttgaagtacaaactaagaacagacttcttttctctctctaaatgtaatgtttttatttttcacttgtatttctagaaggcctttgagccctacttagagattttggaagtatactccacaaaagccaagaattatgtaaatggacattgcaccaagtatgagccctggcagctaattgcatggagtgtcgtgtggaccctgctgatagtctggggatatgagtttgtcttccagccagagagtaagtatgctgtctcctctgtaaaggtatagtggtgtgtcactagcctcaaactaattgctgagagataggactaatttattgccttttggttgtttttttgtttgtttgtttgtttttgagacggagtctccatctgttgctaggctggagtgcactggcctgatcttggctcactgcaacctctgcctcccaggttcaagtgattctcctacctcggcctcccgagtagctgggactacaggcacacgccaccacgcccagctaatttttgtatttttagtggagatggggtttcaccatgttggtcaggatggtcttgatctcttgacctcgtgatccacccacctcggcctcccaaagtgctgggattacaagcgtgagccaccgtgcccggccctggtttggttcttatttttaaaatctgtttaaatgtaaagcagtactttgtcttctgattggtcaagttataacaggactcttgtataactaatactccttacattgattttttttggatttgtagttcacgtaaaaacgcctcagaattagtcattgtaaggatccacagaaatctcagtatggtttaaacctttggtaccagtttcttccctagaacataattatgtcacctggagttcccagagcaggaatttattgctttcattttgtgctatccttttcagtaaagattaggtgaaattggaacagcacttacatggtgaccatttgagtgcttgctatgtgccaggcactgccatcaggctgtggggatatctgcacaagtagtacaggatctctctcctcttggagttgaactggtatcaggggatcgtatactttgagcttcctagaagtgactcagtgccagatcaacatggggaagaagaggccacttctcagggtgcagaagatgagcagtctcagtgatctgcttctgaatcttccacctttg

SEQ ID NO: 61292 - DNA, 2338 bp, Homo sapiens
ttcagtctgtgtcttagttacctggttttgtcccaggtgtttacagaatgtggactctagggagagttagaaagagagggatgcagctgaagcaaaaacagctagcagagatgcaaggcatgatgtgatagatacaaaaagggggtgcagacacatcccgtggttgttgagtgaagagggagctccttctggccaggaaagtgggaatttccagatctcctaggaatgcagtagaagttcatattcagttcacaccttggataaaagccaggcttagattcttatagactcaaacagaaaattcctgtggtgcatttgaagcagtatagaatcctgggaatcctggactgaaaatacaaagacttcagttaaatctttgctctatcactgattttatctgtggccttgagcaagttttgatgctttgatcttgcattgccttttatgtcactcgtagatggtatataatgccttctgtgccagcctcagaatgctgttgtcagagtcagtcgagatacattgattgtgaatgcatcagaaggtctattagtctatttagatgccatgtatttatgattattatgatcgacaggatttgtattccctatttgttctatgtactgcctgacagagtggactctggcatctgtgatttttcaaacttttttttctttttgttgagacagggtctcactgtgttgcccaggctggtctcaccctcctgtgctcaagcagtcctcccacctcggcctcccacagtgctgggattagaggtgtgagccactgtgcctggccagcatccacaattttgagggcatttgtaggtccagaaaatgttagaatctgtgttggatgagaggctggacatagatccaagaaaaacaaaactaaaaacaggctgcccattagtcttgggggaaggaagagaaatgttgaacatctagaaaccttaggaaggtcaagaattctggaacacgtatatcatttgacctagtagttctgcttctgggagtttatcctgtaggtgtacttgtagtttatcctgtaggtgtgcagtatggtgtgtgttacaaggttatttcagcatgatttgtaatagcaaatattagaagcaacctatatatccatcattaaggggcaggttaaataaattttggcacatccataaaatggaatactctgcagctataaaaatgaatgaggatgcactgatctttaagataatactcctaagtggaaaaacaaggtctactacagtgctagagtgtgctactttttgtgcaaaaaaagggagacaaataagaatatagctttactgttgcacgtgtatgcataaggaaactcaggggggtagcatgagggttggggggatacgtttgagagagggaagcttcactgctttactgtgtgtgttatgtgtttgtatttttaaaattttgaaccatgtaaatatagtacttattcacaaacttaaatttaaaagtttttttaaaattttttaaacgaaagaaactctttgcaattggaaggcaagtgaggtggaagacacattgaatggttgctatatgccaggtcatatccatggaaatttatttgaataagagaaccatttgtttcttttaggtttatggtcaaggtttaaaaagaaatgttttaagctcaccaggaagatgcccattattggtcgtaaggtaagtagaatctgtgtatgtcattttttcccctcttgataatcatacctctttctttctatttactaaacctaatattctcaaagtggaggggtgattttgtctcttacctccaggggacacttggcagcatttggagacatttttggtggtcacagcttggatggaggggtgctcttggcatgtaatggatcgtgtccagaaatgctgctaaacactaaacatcctacagtgtacagggcagcccccccccacccaccaaacacagaattatctggctggaaatgtcaaaatggccaaggttgagaaccctgacttaaccctttctccaatgtaactggccaaaggagagatgagaagcctgttaaggaagtaagaatttgagaaaacctgactgtattgttaggtgctttggaacaacatgcagctggctgactttaggtatttatctaggagttgggtgcttacatggtttaggtcaggggtcggcaaatgttttctataaagggctagatatgaaacattttgggctctgtaggccatatcatttctgttgcaactcctcacctctgcccttgcagagggacagcagcaagaggttcaggaatgagcctggctatattccagtgaaactttctttacgaatt

SEQ ID NO: 61293 - DNA, 1046 bp, Homo sapiens
ccacctcctgggttcaagtgattctcatgcctcagcctcccaagtagctgggattacaaatgcctgctaccatgcctggctaatttttgtatttttagtagagatggggtttcaccatgttggccaggctggtctcgaactcctgacctgtaatgatctgcccacctcggcttcctgaagagctgtgataataggtgtaagccaccgcgaccggctgagtgcatcttgacctttagagagaagcttcgcttttcaaatttttaagaggctattgtacatgccagaaagtagctgatcagtcagaatatcaccatatatctttaggaaaaatgttagtttagttacttgtgcggtgcctagcattgagcagttgcttgactgtcataataattctgctgtctctactgtactcttgcatctggataactttgtctttcttacctttggagattcaagacaagttgaacaagaccaaggatgatattagcaagaacatgtcattcctgaaagtggacaaagagtatgtgaaagctttaccctcccagggtctgagctcatctgctgttttggagaaacttaaggagtacagctctatgggtatgatgcttggcatatacatgctctctacttccttaaagagacaggttttgtcattgtttaatgttcacataggttaagaataactcatcattggttaatacatgtttaggagggcctactctctgtttcacaggttgaatttcctatttttaaaattatgtttagattcatccttcatccataaagcaagcaaatctcagagacagtggaacttggcttttatttccttttgtaagcatgaataaaacaaatatatttgtgtttaagaagagagaatataagatatgtaatacaaatgaaatacagatccatgtaaaaatgtgaaatctgcataaaggcacaaaagaaaataagtcactataattccactatcaaagataaacagatggtgtctatctttatgcatgtagctataggtagagctgtctatatagtttacatctatc

SEQ ID NO: 61294 - DNA, 1049 bp, Homo sapiens
attatcagattgcctttattgtagctaaatgctattaatatctttttcacattgctgataataatgatttttcatctttattttattgtgctaactctattgaacttttttcttgatttgctataagaatgctgttgggtttccactcaacatttttttcttttgtatccagaggagtttcttcctgtttcttctttatcagaacctgtcttcccagagattcttgcttactgaccagtgaccttacctttctctgcagacgccttctggcaagaggggagagcctctggaacagtgtacagtggggaggagaagctcactgagctccttgtgaaggtgagtgtccagttcttgagggaagcctgtgaggtctgtgccagtttacatgacctcctttttttcccttacttttgtaattagaaaaattacttaaggaaagcttattggtacaataaaaccataaaagtttctcttcacccaaacataggcgaatatgtataatattatcaaagacatcttcagtctgtaaaatagtaaaatgttatttatgttttcagtctttgcagatgtcctgtctagaaggcagattactagggaaggtagtcctgtcagatgagatttttgtggtgagacagattttgtttgataagaagagataagatagggaaactctttcataattttctcaaatcatgtgacccaagatgagcagtggtctcatgtatacttcaaataattctcattcttagcttcttccatttctaatcaaatttatttttattttattttattatttttacagacaaagtctcactctgtcacacaggctggagtggagtggtgtaatcatggctcacttcagccttgacctctttggctcaagtgatcctcccacctcagcctcctgagtagttgggactacaggcgtgcatcatgacacccagctaatttttgtatttttttgttggagatggggtctcactctgttgcccaggttggtcttcaactcccagcctcaagtgatcctcctgccttggcctctgaaagtg

SEQ ID NO: 61295 - DNA, 1065 bp, Homo sapiens
tgcagtcgataacaacagctgctttgtgccagacactctactaagtgcttcacatgcattatgttatttaattattgctagaacactagaagatagctaccataacaacttctgcgtatgaagaaacaaccttagattatgtgacctacacagctgaaagtaataggcaaagcttagacttcctcctgggtcggtttggtgttatagtctgcgcttttaaccatatttatacttctttcctcatcacattgtaaaattatttatttacatgtctgtctcctctgctatgttttgatcttttggttgaggaatatatcttatctttttttccagtttatattgttgtgcctaatacttagaaactgttgtttagtgcatgattctttgtcctgtatagtgtaatagttttgatttcacatctgcttgcatttttttgcaggcttatggagattttgcatggagtaaccccctgcatccagatatcttcccaggactacgcaagatagaggcagaaatcgtgaggatagcttgttccctgttcaatgggggaccagattcgtgtggatgtgtaagtatatgcaaggggcatccaatagccttattttttaggttaaaatagaagagtttttaataaatattaattatattttaaaaaataaaaaatattaaaaatattttactacacaagaaatatttgatcattgtagaaaggtcattttactacacaaggaatatttgatcattgtagaaagatcctaattaactgcagttttaaatgttacttgtaattttgtaacctagacaatgtcaacattttggtatatattcttctagatatttttattttcacctttttattttgaaaaactttgaacctacattgagttgctaggatggcttaaagaacaccttagattcactaaatgtaaatatgttgccatatctgctctctacactctttccctccctacccgcttcttccctcatcccccacctgcatacctaccattcccctatttatctgtgtatacttttgttgttccatccagcagtgtttttagtgta

SEQ ID NO: 61296 - DNA, 1022 bp, Homo sapiens
ttagcttgtttccttctgtgttgggtttttattttgcatgctacatactaccttttcccctgccttttagtttgtttgcatagtttccttgccattttctctcatcttggggtggcattctccagacattgttcttatgcactgtgggtgcttcctgtctgagaccatttggctggggacaaagctcagccaaagctttgttctatctgtattagaataaccaggtctattctgagattctcttcaaagttacctatcagagttcactctcttatttggaagagataatataccctttgagctctgattatttaattcactgaagtcttcactctaaagagccaatcctgatgttctctcttcattttgctcatttctccctagcagccatgtttaccactcactcatgagaagaagaagaaaataaggaaaccccctcagcttgcctctgcagatttgggggtataaaggaaaattctcaggattttgctgactttgcggtacagtttcaagggctgattagaaactagtgttttgcttacttctgctctctgctgtttcactgtttcttttttttttttgattgccaatatttgaagtttattgcctagattatctctctttccttgtttggttgttgttattgtagattttgactcttttctctccctgcactcaccctttttttttttcttcccatcttactcctgaagtccaggcctaggggttttttgcattgctgcaattaaaccatatctctattattttgatcttcagcacgtgtgagggatcagaagaaggatagagtctgattcccaggctcttctaatatttagacttttataaaataactaatcagcactggtattgtctttttccctctcccactctgtctcccccactcctcccttagcttcttacttctctctctggatgagctgcttctagtgaagaaagagttcactgttcagaggtgggaagccagaagataaaaccaaatggctgggcagtctttaggttat

SEQ ID NO: 61297 - DNA, 1332 bp, Homo sapiens
gtcaaaagtccactggtgtttgcataacaatgatgttttgactagttattggactaaaagtaggacacatgaagcaggtgactaggaatttggaaatattattgcttaggtcattactggaccttacgaagagattgttgcactggtgacttggactttgctggtccctccccgactcttcacagctggcttgacgactcttgtgacattctgaggttttatgctaaaccacaggacatgctgctgatttgcagagctgacctcagctgtaagcactttgtcttctgcagcgtagaaatgtagtgacctacaagtgtcccatgcccaagttgggtgcattattttttggtgatggtcacatgtttcataaagacttcctgagtcaaaaaatgacttttctcagttcatcttccatataactcctggccacagggattttgtatccaatggtatttttgttctatgtgtggatattattttagcaaagttcagtggtcactttctctgattccatcttgtattaagctacactaaatatgaaaacgtagaaagttttacttcttatcaacagatgctaatgtatgacattgagtgaaacactttaattcctcaagggctcagttttctcacctgtaaattgaaaaaacctttcaaagattgtatgaatcttcagagatggtaagtctaagaagttgtccaactagtttagtattgtggctttttgtttgttttggaatgattcattctcatatattattttttaaaaaaatagccaggtggctatgacatgcctgtgttggtcaaggtttactgagagtcaagtcaggcattaagaaatgtgaaggccaggtgcagtggctcacacctgtaatcccagctctttgggaggctgaggtgggcagatcacttgaggccaggagcttgagaccagcctggccaacatggtgaaaccccgtctctgctaaaaatacaaaaattaggtgggcatggtggtgggcgcctgtaatccgagctactcgggtaactatggcaggagaatcgcttgaaccaggaggcaaaggctgcagtgagccgagatcatgccatggcactccagcctgggcaacagagtgagactctgtctcaaaaaaaaaaaaaaaatggattgagggtttgttaggtgtcagccactatgtcaggtgctaggaatttgtcatgaacagactggtccctactttcatgaatttatagtccagtgagggaaataagatgaataaaaagacccctacgtctttttgtttgaactctggtaaagaaatgtgtttatcagaggggctaggccaaactttagga

SEQ ID NO: 61298 - DNA, 1144 bp, Homo sapiens
tgcacctttggtcccagctacacaggaggcttaaggcaagaggactgcttgaacagcccaggaatttgaggttacagtgagctatgatcacaccactgcactctagcctgggtgacagagcaagaccctgtctcaaataaataagcaaacaaataaataaaaattagatatatataaaaggtcctcctatagctctgatagggccatttattaagacctgctataccatttcttgctttagggattacatatgactttttagaactgtggagatgggcagattacttttccagaaatttttttagtacatctttcatgcctcagaagcatctaggggaatataattgggagttgggtagacaggttcgaagtcagtgattgagtcattagatctagatggggtttgggccttggaattccatttttattgttccatctatgattctgatctcagtaagaaccactgatccagtgtagccctcttcttttttgaagatgagaagactaaagcccaaagggttagattgcattcattataaggaagactttgaatgattaaagagatagtgaccaggggattgtatgtgactgaatttactttttcttccttcatttatttttttgttttaagactggaaaatatcaaaggcatctttgtttttgggaatccccaattgtcagtcattgctctgggatcccgtgattttgacatctaccgactatcaaacctgatgactgctaaggggtggaacttgaaccagttgcagttcccacccaggtaagcttgaagaagcctctttcccttattttgctccatgattttggaagaacttgggtggtacagtaacctgaagtatagagtttgactgctagaggctagcacgttagtagcaactgtagtatataaaggatttctctcttgccacctggaattattagatacaaagaacaagaccattagctttaaactctggcagaattaggtgacagcctcctagaccagtggttggtcatgaggtttttctctcagtctctagcctttctactctccaatccatcttgtacacagccatcaaattgctcttataaaatacttgttacctggctaatatttagttcaagatcttcctgggggtctctaatc

SEQ ID NO: 61299 - DNA, 3721 bp, Homo sapiens
tgatctctgcatcacccaccccttagggttgctgaagtctcaaatgagatacactataaagtaccttgtaagttagagacttctgtataaaagcagctggtggtagtgtccatttgaaaagaaaattttgtcacaggaaagatagtaaacatgttttttctggaattttcttaggctagtccctttatgcagaaaggcagactggaaagtccctgtgaaaaattgactatgccagctgtttttctgatagaatgatgggatgccttaggtggaaatggggtagggcagtgcacatgcgaagctaggactcggggagaaggggctcattgctgcagttttattcttgcttttggacctggcctcactaataatgtctctttctttggatttgtagggtgccatctatggcatggcccagacaactgttgacaggaatatggttgcagaattgtcctcagtcttcttggacagcttgtacagcaccgacactgtcacccagggcagccagatgaatggttctccaaaaccccactgaacttggaccctttctagtctcaaggggattccagccttcagaaggttcttgggatatggaacaggccgtgcacaactttgacatctggtcttgctccatagagcacaactcaagatagaccatgagacagcttgagcctcaggattcttgttcttcctcttatcttccttttgtggtttttaatttgaagaccccagagaattccattacataatgattttgcccttgttataaatgttaccctaggaattgttttaaccatttccttttctaaactctctagctttcaactttacttaaacattgtgtggtagctctgacctgtcctgattctttagagaagctggggtacagtttatgagatagctagagcttctttgttatctcaggcaggaggcgtttacataacagatgtttcctcagctgggtgtgaggtatactctaagcaggaggctttttcagccttctctctcttttttttttttttttttttttttgagatggaattttgctcttttgcccagtctggagtgcagtggcatgatctcagctcactgcaacctccacccactgggttcaagcgattcttctgcctcagcctcccgagtagctgggattaccggcacccaccaccacgcctggctaatttttcaattttctttttcagtagagacgggttcaccgtgttggccaggctggtcttgaactcctgacctcaggtgatacccgcccccccgcctcagcctcccaaagtgctgggattacaggcgtgagccaccgtgcctggccctgtctctcttaagagtaggttcattgtctgtcttagagtcacttctattgcaactcattttctttttccagggcacagatcgaccaagctgccgttccctattctgcaggacaggactattctagcatacctgcttcgtccacccaggcagggtttggggtggtctcttctgtgcctgcagtccccatttgacacttggttgccaccatctttggagattattgtttggaatgatgcttccattggctttttcttgttaccatggactaggaagaaaacatggtttccaaataatctgggagcttttggccatggtgccgccttcctgaattggcagtggtcagagcacacctgaaccctatcctgggctggtgatgagcagaaatcagacctttttctatgcttttttgaatatcagagtaggatgaacacccagattcaaatatgtcaccaaagttggtggtggtccttccctgcacccttgcgttaagccattatgtaatgaaaatgtgtttgcttgaaggaacagctcaaagcaccttcacaagttgccttgacttaccctaggtgggtgtgaaagagcacccgtagcaaggaaaattttctctattagtgtgttcttctgcctcttcccccttgattcagctttcagaggtactatggcagttttgcctcaggtgctgaacatttctcagccctggctaaaagggagcagcacagggagagaaacaggataggaaagcagaatggcgagcagcctatggcccagggcctgtaatcccttcccaagactagctgctcagggtggtgcagggacaggaccagaccctgcgcctatttcctgccttctttcccctatagggaactctgtaggctgagccactgtcctgctcttatgacattatatcttgtgcctttctcctcagcagtgagcagtgagctactcctggcccaggccctaggggaaatggatcagtctttgaggtttctatttggggaggggagtacttaagatgagtcaaaagacactttcctctgttccattccccatctcagggactcctgaatattcagcctctccaggctggtgtcttctagtttcccccactgggaatgctggctgggagagccatgactaccagacttttcctcaggctccttggcatgttagtctgaattgttcttgagcactgtactactgacccaacaactgtgactagctggccacgccattcagggctggtgtggcatttatgtgtgtgtgtgtgtgtgtgtgtgtttttcctgtttgcccagcagtgcattgtgggttccaagagtgggtagtgtgtgtatgtgtgtgtgtcagagggagacctggcaggcacctctttgagagtagctgtggtcagagctgtttggtcagtgcattatgttgaatgaggtccaggaacccagagccacccagcagacaccactgtggcttgccagctgccaagatggagaagcatgtgcccctgtagagcgtctccccagaaccagaccccgagccactcgcttcctctgtgctgtgacaacattggtgccaggggagatggtgtttttcaaagggacctactgtagccactttaatttacaattaagagccttagtttgacttaacacttttgtaggcttttcattgtgtatttttgtgtatgtgtgcatatagcagctactctgtagcagaggtgggtagagacacttaatagtatcatgtcgcatgcagatgtcacatcggcctctgcaaaaactgtactgtcttgtttctgcattagacttaagtagtcatgtgaatatactgctatgtcacttttaatattacgagttttatacttggaaaatggtacttgcttcttttaaatctctgtcttctctaacctcccccttcccatttcaatgctcccttcctaatttcagcaataatctcaaaaagcaattaaatagttaaatgaccctaattgtaattactgtggatggttgcattcatttgattacttgggcacacacgagatgacaaatggggcagtggccatgcttgaatgggctcctggtgagagattgccccctggtggtgaaacaatcgtgtgtgcccactgataccaagaccaatgaaagagacacagttaagcagcaatccatctcatttccaggcacttcaataggtcgctgattggtccttgcaccagcagtggtagtcgtacctatttcagagaggtctgaaattcaggttcttagtttgccagggacaggccctatcttatatttttttccatcttcatcatccacttctgcttacagtttgctgcttacaataacttaatgatggattgagttatctgggtggtctctagccatctgggcagtgtggttctgtc

SEQ ID NO: 61300 - DNA, 1034 bp, Homo sapiens
ctcactgtcaggccattaagctgctagtcacacggccagattccatggctttggaaatgttactgtatttgtgcaatgttgttttgagtcatagttgctcgcagggtcggcgggctgcccctgattgtggctgctgtgtttggggaggggagcaggagatggagctggggaaagcctcctatgaagtcccaggggactcaagagtcccaccgcacctgctagacagtggggcaggagtagccacaggcactcgtttgcatgagctgacctttgaggaaagtgtgtatgggaagaagaaatcccaagcatggttgtgggtggacagagatagggtgaggggtctagggagctggggacctgagatgagagtcggccccttccccccagctcagggctgcatcagactctgtagtccagcatgtgactttccttcctttccttgaatatgtcttgtcttcttcccctgccaggtctctgcacatctctttctactgccacgtcacctggggtcatccgtccatctcagtgtgccacactgcccagatgaggtcaggcccctgttaattgccacccctggagtgactttgtgccatgactttgtggggccaggctccctttgtggttgtcagtcccatgagagttggactgtggttgacagttcatggctgggcccctctacctggcacagagcagaccctcaaagagtgtttgccaaaggaaaagatgaaccgagggaagtgcggtcacactggagggcctttggagacaggagatatgggggtccctgctttaggtccctggtggtccagcatggcctgacccagggagagaagcatcccccagcccacttctgtccagaacacagagggcctcatgatgcaaagaggactgaagggttgacctgggaagggatcagacctgggacccctactcctttctcatgagggtacacatgaggcctgggcatgagcacataggagaggtccctcccttaccctccctgggccccccacatcttcctggggtggggcgga

SEQ ID NO: 61301 - DNA, 1004 bp, Homo sapiens
ctacagacaggggagccaaaagtgagagtcctatgtttaatcagaggagaaagctgacatggccaagccaaatgaaggcgcaaagccagatttccttaatttgggggagcgaaaattgggccgcctccacgtccagccattctccagcggccgggtttttcaaaacgctgcgcccagcgtctcgcgaggaccctccccccgggtcccccagctctgccgcggccgcgcccagatggccgtcggatcccccctcaaggtccccctgtcggctccgccctcggtcgcccaggccccgccccggccgcgcgcggtcccctcggttggcgaactcactccggcgagcgagcggcggcgctcggcattgtggcaggcggctggggccggctagggcgccggagccgcacgcagccgcggggctccgagaggcgcgcactggggctgggactgcgcggcgccgccgctgcgagcgccactgagcggtcgcgcaacttcggaggcacagcgccggagccaggcgagcgctcagagacccggagccagaggggcgcgccggagcctcgttcgagagccggcgccaggcacccaccgcgctccgagtgccaggcggccctccgcgcagcgtggcttccgctgcccccacggaaggcacgggctggcgctgccgggcgccggggaggacggcgaggaggaggcggcggcggcggagacggcggcggcgagactggggccagggagacagccctgggggagaggcgcccgaaccaggccgcgggagcatgggggcccggagcggagctcggggcgcgctgctgctggcactgctgctctgctgggacccgaggctgagccaagcaggtaggaagcgatcgggtctgggggcgcggggctaggggacccttgcgcctcactctgtcctgaagttgaggtggtctttcgtcgcatcgatgcgcgcaggaaaagcggcaagggcgcccaagttagaatgtagattttactgcctccca

SEQ ID NO: 61302 - DNA, 1280 bp, Homo sapiens
aagtccctaaccctcctctctcgccgtggatgaatacgtttctcgctcgtcctgtagctggacccggcgtcgctggctgggctgcgtcttctcggggaggctgtggactgaatggagccagcctctctctggtacccgaacccaagcaagtgggctggccacggctgccgggcggctcggctccggagccaggtggggacggggcctcctgcacggagtcctctctgagttgaggctgagaatggagcaggaaaactggagcagaaagtggacgagatgacgcagccctccccacctcctacctcctgctgcgaagttgacatccgcccttcccccctccatagccaaagattcctcattctggaattagtgattcccacggccaggagtgagggcttggctttagcacattccccacttttttttttttttctggtgcaagtcctgtgcagtagagttacaacactcaaccatttgatccaagttaattatgatttgggcagactctggtatttaaagcagtgttttgaagttggaaggtaatgatggggatggggaaggcaggctgctgaatgtccaaccttgttttaaagggtgcagttagacgtgggaggtgcttggttggggtgctggtttctggttggagggggtttgaggagatgattgaagggtagggtgaagtctctgtaaatggcacatgggcagggttgtgtcttgggaagctgcttttgtaccagcaggacagtgggatcaggaataaatacttaggttaccaggaatgaggggctgctgtaggagaaagacaagactggttggcctatagttctctgggtgggtgggcttggccaagaaggctgggggtggcctgcatttcctgcttaacaaagcatccagcccccaccttccccagaagaaaccccaggcccagggctttgatggatttgggcacgaatggtgcccagtcagaaatggcctctaatacccggctttgatttctcaccagcgagcagaagcggtgttggaattgtgctcattacttagtgcggcagtagctgcctgcccaccagcctggagaggggccaactggtggggtcggcctgcagccttctcattgcccagaatgtgtggcccttagaaacctgccttcaggagggagaacatgtcccttcctcccacacaatcttgtttttctctaatgccacaggcacagagcatcattctttcagaatgttctttgggtttttccattggatccttcacaagctccatttcactgatgg

SEQ ID NO: 61303 - DNA, 1111 bp, Homo sapiens
ttttccatcttagcggcctgattagcatcgccgccgcttgtggggctggattctaccctctcctgcgtcccccacccccagtccccatctccacctccctccccagccgagctaaatcggtctgcggagccccgggagctctaacgccaccgcctagcgagtgagtgcacggagccgccctccttctcacctcccagaacaggctgcccccagtgcttgcaacttaccccttcgcggcgctgcacggctcggctcacttctccaagaaggcaggcttgtgggtgtgagagtatgtattaaggagtgtgtggggggtgagaatgtgtattaagcaggtgggcggaggtgggagtttgcagggaggggagggtgggtgtggtgttgcactggggtgtcaggtgtgtgtgggggcgaggcatggactgggtgtgtgccggaggatggatgtgtgtttgaggagggttgtgccttttgtaactcaggaggtgtgatgtataggctgtgtctgtgtttgggtgtgtgtggggtgggcaatgtcacatgggcacacttgtggtgtgtttgtgtataaataggtatgtgtaatgtggagacagtgagtcaccaccaggcatgggaagctccatccattgtattccgttggggattccacttcaggatgggacccaggccatttgcccatcagcacttaagagacctcattttgccccacacctgcactgtgagcagggtttggcctgagtgccaggttctgctgttggaagggcagaggacagcttcccctgctgagtgcagatgggataggcctgcctgcaggtgggtcctggtgctccagggggaggaaggttggcagagatggaccctaagccagcccagcagcttgggctactgcccccaggaagatcagagtcccagacctggagtcttctgcagtcaactcccagcttccccagagcatgggagcggctgtggtttggagatctgctctctgacctgggtcagcttatgcttcagcctgtctcccccaaagggagtgagttctcctctagagtttgctggagaaggggccagcagagcttgagtgggtgggatccccagtggagaaccccat

SEQ ID NO: 61304 - DNA, 1125 bp, Homo sapiens
ctagcacttctgtgagccatttggcaggggtaggggtggggagatcctttgtcatcaccacctctgggaacccccagctgctctctttccacacacacctctccccggggccttagctgcgggtgcagaagagtgcatggcattgccaattggaattctaaggaggttaacacggcctcccagcattgtcactgactaacttggtgacgttgggcagctcacctaactggactgtacctccattttctcatctgtaaaatgggggtaataataacatcatcctcagaattgccttgagagtctcatgagctgatgtatggtaaagcccttagcacagtgcccggcacacagtgatcactcagggcctgttggcatgcagcctgccccggagagagcctagcaatgcatcatcatcttcctccacgggagtgaaagctgggaggtcaggaccaggagtctcagctgctcctggctgaggagttagtagactctggctcttgattttcatttgctgtgagaccctaggcaagtgcctttccctctctgggttctgattgtttggtttcccttcccatctgtaagtccggagtggggcagaggtggaaggatgatccatacaggatgtggggtttttgtctggttctatctgaagaggctccagcagtcagaaagaaacagaggtagccgaggtccagaaccacttgtgtttacagaggcccctctggaaagtcagtatattgactggaatgcccttgcacgcattatgcagccctgggtgtctctctcaccgaagccataaatcaccctctgggaactcggtccctttttcctgctccataagcatttcctgcttcagaaactgagaaccccagatgccaagcagggcccaggaggtagagaagggccccactggcagaggcagcctgggcatgtgcgagaaggggcctgtggtccccccccttgtcacccactccgaagctcaagtgcgccctgctgagggtgttagagacagactttgcaggcctggcccccgtgtcatgcatagcttcatttctcagaggcagggggaggccaatcttgggggttggggaatgaggactcctgtctccatgtagggtatcagaa

SEQ ID NO: 61305 - DNA, 1008 bp, Homo sapiens
gaggattgggaaaactggattcttttttttctttttttggaaataaaaaactggattctaatcctagccatgtagctaatctgctttgtgacattgggccagtccttttccctctctgagcttcctctgtccaaatgaagaggttctgccctggaatcagaaaacctggattcaagtcctggccccatcactaactgcaatttcatgagcctccatctcctcactataaactgggcccccaattggttgtggggacattaaaggaaatgggcatggtcagtgaaggtcggttttctttcctttccacccagaaggaaatccacaaattgctggatcctgccttctagtgggattttggattgctggatcccaaatccacagagcccgccttctttctttctgatattgccttcttgacatgggcatattagacataaggtacagtagggttatcctacagacttctgagataccttccagccttcaaagcccatcgctgtaaagcaccgtggatacagttcaggaagtcctgtggggtgacttggtaatcgtctgagggttatcagcgaggggagagcctgccttgttatacacatttgggagagcctgccttgttagacacatttggaaagagcactggactaggagtctggaatctccagctctaaggccaaatctgtctctgtgtgatacgcaaatctcacccaccttctttgagcctcagtttacccatcagcaaaaggaacaaaagaagttgaatgccaggtagggccaagtgagaaaacacccagagaggtgcttcagaaactgttctccaaacccacgggggtcgctgatctgaggcagcaggaggcctgcagaacagtccctggactatgcggtgcatcctgggaactgctgcctgtgtggcagggatgagagggcccacgtgcccatttccctggcacctcccatgcctggctggccacagctgttgagctaagtgacaagagttttagccacttctca

SEQ ID NO: 61306 - DNA, 1023 bp, Homo sapiens
tccctggatgtgtcacagacttgtaccatggctggaacacacaggttgtttatatggagagcagccaggaacagggatttggggtgtggctgggggtaaagacaatgggcttgacagcagcaagccacctccatggtgaagtcattgtcccatttaaccctgtcagagcagagatgctacagcaaggcaaatcacttcctctctctgagcctcagtttccctgtctgttaaatgagggggttggactagtgaaccataggattccttatatgaaagctatataagctgtgcatcgtaaagtccccttagcccagcagcctatagaatttcctgaggggcagaaggtgccattgtgacacccactggcctcttccaagcatttcctgctgggcaccctaaaaatacagtaggggtgaggtgggggttggcgagagtatgggctcggccattgctagagtcgtcatttcacacatcagcaaacgtgcctctggagggagtgctctcgcactgagcttggcgtggctggctccttgtcatccaggtctcggctccaatggcccctccccagagagtcctttcctggccccctgcctcttttactcttcttccagcacttcttgccatctggaatggttgtttgaatacagacttatgtgttgactccccagcctgggagcgcagggctgtgtacgctcagcaatgtaccctaaatgctcagaacggtgcccagcacacggtgggcccttgtgaacaggtgcttagcaaacgaaaaaccacaatcgtacgtaaaaatcttaagagttttttttttttaatgcacatgcctggcctttaccctaaaggttctggtttagggactgtgggccaggtttgggcatatgaattttgacaaaacaccccaggtgattctgtggcacacttatgttaaaaagagactagcttggtcattctcaaccttagctggacaatgggatcacctggcacctaggtcccacccagagatcctgacttaattggtcttgg

SEQ ID NO: 61307 - DNA, 1125 bp, Homo sapiens
gtcctcccaaccactctgtgagatgggcatgattaccttgctcgtggagaggaagaaaccaaagctcagggagcttgagtgccttgtacacaaagctgcgaccttactccaggatttctgccagctgtgtctgcacctgatgggggacttgtgggcaggtcgctgtccctctgaatgtggtctgcagtatttctacttccacagcacttgtccattctgatggcctaaatgccaagagaacagggatcaaggaccagtgtgccctgtgaccttgagcaaggttgtttctgcctcagacctcaattttcccaaaggtaaagcaagagttggactgggtggtcttccaggaaggtaggacccctcggcttttcgttgcaggttttcaagtgtgtcctagcaccgaggagatgaggatcctgaggtggccccatcccggggtcctgaggtggccccatcacggggtccacagtacaaggtcaatgcacttgtaataaatattgagccaaccaatgctgagccgcatccctagcctctgaataaataaaatgttgcccagaataacagcccggaagatgctggcggcttcagccagctctcacctttgcctctcccactggccaagcctgtcacccgtccctatactcccttgtctcccccttccctctgcctccccactccacggtccatcactctagctccagaggtggccaccgtcccagcctggctttagtttctagctctgcagcctgcatctccctctcccagcccctcagctgccacagcagttaatgaggaccaacccctacagatggcagctgggagacaggccagccaggttctggtggggctggggtggggcacagggaactggaggtggggcacaggggagtgtgcctttaatccccagcaccagacagaagcctttccttctttgtcaggacccttgctggcatttcctcctgcagcccatccctgggagatgaactggtccaactcctgcaggaggccagcccactctaactgctcttggctgaggccgccaggagattagaaacagggtccacaaaggaacctggtcccagggtgctccaggccacacaggcacacttgatttgatgcttctct

SEQ ID NO: 61308 - DNA, 1045 bp, Homo sapiens
gggagactcatcctaaaagctgggttgaggggacaggatttggcatccagatcccctccccagcaggccagatagattcccactggtctcctggcccagaaggagaggccagcccttcccacccccagcgcccaggggggcccctcctcccccggcctggctgcaatgccgggcccctattgcaggactcgctgccgctgcctctgactctgcctctgcctctgcctctgcctctgacagacatcccgccccagaagataaggatcctgtctggcgccggagtgctttttttcctccttctttccaaatctgttccctgattatctgcagacagcccctcgctaggggagccaccagggaaggggcccagaccacagagaaagacaggaggggtgggactaacaggcctgcagccaccagcccttctgaacccctctgggggcttgatggtcatttgctgagcccccactgtagccagagccctgaactcagcagagagctgaggactggtttccctgggtgggactgacccacttcagcgggaagaagagggtatgtggactggaggttgtgccagcgtgggctgggatggggacagagggtggggttccttccgtggtcagcgttcctcagccttgggcctggagagcacccagaggggatgtggtagaggcttcagccagccagacggccacatcctgtgggagacattggcccttcccaggccagacggtgggaggacacttagggactggtaggggggtcctagggggttcccggagcccagcctccagccctgaggactgagcttagagaatggccagggctggtgtggcctcttggcctcaacctgaaaaggaagggcagctccccaccaactgggcttcagaccaggcaccattgtggaattccagccttagagtgcccaagccgctgagagccctagagagcacctggtcgcatctgggccatctatagacagagggacccatgtggaaggcaaagggatcatccccacctcgcccactggcatgtcaggagcctg

SEQ ID NO: 61309 - DNA, 1076 bp, Homo sapiens
tctccagctcagaggagtgagctccacggctgggatgtggaaggcttcctggaggaggtggaggtgtagatgggggctccagggtattcagaggtttggagaagaggcaggaagcacaggtggtgggcaaacaggcctgcctgggcggagggtagctaggatcccaggctgggtgtggaatagcaaaggccacagagcctgtgagcagaggcccactctggggaccaagtgcacgttccctaatgacccctgtttgcctggtcaccaagactcgtgtttatgtggaaaagctctggcaacagcatgggttcaaatactaccctccctgcttccaaaccacgtgttcctggacagtttagcccatgtgagcctcgtcttcaaccacaaagtggaattaatagcaatctaccccataacgtctccatgaggtttaaatgagattttagagagagagccgtctcactcagtgcttgggcatttttggagttggttagcctgggtctgaaactcggctctgcctcttactgaccatgtgcccttggggtcacctcttaagacctcagttctctcatctgtaaagtgggggtaagagcagtgagacgtcaataagtaaatacacgggaagtcctcagcacaaagctggcaatcctgagtgcattaactattattatgcaaggtgttcctgcagcacctagtgtgaaggaggtgcggtgaagtccgtattggaagcctcctgcctccatctccagcctgtggcctctataggatcgggaaggaggtagttttactgggagcagaagtggtctttactaggactttgtaagtcctttattctgtctcaagaaatatttgatgctcaccttaaggcaagtggaaatggtaaaacctcagccagtccatttccctcattggtgatgagccaggtgagcctgggggaagaggtgtggtacctggagctggggaagatgaggaaggtggggagaggctcctgtcaggcaggtaattggggatcaaggggcttcctgtgtcttcccacagaaggggacgggagacaaggcagcttccactgagtcgcc

SEQ ID NO: 61310 - DNA, 1048 bp, Homo sapiens
tttaagaaaagcttttcaaaacctcgttcccacgaggaatcagagttcaggaaataatcccaattctattcactattgtccccgggctcccttctctgacctcctctcccccaaccctggggaccacttttgaaaagatttctttttatcctacatgacgtgtgctctctccataacaccatctctctgggagctagggcttagagctgggagccccttagagctttgctaccagcatcacctggaagcttgttaggaattcgaggcctcagcactgtcccagaccacaatcagtctgcgttttgacaagatcccaaggtattcgcacctacattcgcgtttaccgtgagcctagctctgtcttattgatggggtaatggaggctgagtctggcaggggggacccttctatcaggtcttctttagcagaatcccagtagggcctggtggtacagactgagaggccctgagccctcagagcttggggtctgaactgtccttctgggtgggctggcggggagaggcagcccagctagtctctgatgtggggaggcaaaggggtggattcatccagagaatatgccacctcatccctggtagccagcatggccacagactaggtcccatgccagcctcgccgtgccacatggccactaggtttgggccagtcctagatctgctctgtgggctcctgtgagtccctgctccacccacagctgccctctggagatgggtctggccctccctgtctattctgtaggcactctgggtgctcaggtggggtgccacaagctggtgtcctcccgttccattgtgacccggcttgtcatcctgcctcctgtgaaaatagagcaaatcgtatcagctctgttggtctcagggcagtcccaaggacacggggctgtgacttactggtgatacaccgccagcaccctcctcatttctgggcgtcatggctccctcctctctgtatctgagcgagggtgtgcggaaggcctggcacacctggctggaggtggaggtgggggcggccccgagagaactgaagc

SEQ ID NO: 61311 - DNA, 1925 bp, Homo sapiens
gttcacctgatgccaggtgcacaggagctaaggcattacttatcctctaggctagggactgttagcccattttacaggcggagaaaccaaggccagggagacaaaatcacctgcctgaaggccccacagctatcgatgccgagactctatcctgcggatgttgggctctttccactgagtaaggttccctcactctctagtgccacatggggtgccctcagtctgggccagggcagggcagatgcagggccccccactcccctcctaggatacaggaatctgtattgcctcaggcttgtctctgcccacctgctggccaagtccaggacagaaagagagggctcacaaattgggagactctgggctgaagacctggtggtctcagccatttttgtttcttgagggtcccaagaccacccattcctcctccaagcccagccctgtagctcctccaggaagcctggccccttcctgagctgtgtggccagctctctatgcttcttctggaacctccactccagagcacctgagagcagcaggacaagccgtggtcttgggcagcgtcctttcagaggaggaaggtccagagaggggaagggacttgtccaaggtcacacagctagcgacatcccaagcagccctgctggagctcttcagagaaaggacaggaggagccaagggtgagcttggccaagctggcacccacttgcctccagagtcaccaaggtccccaccctgccccaacattgccttttcccgaggagttgattcccaacccagcagaggagctgccagatgggtaaagaccctcctgctgaagaactgagcatcccaatcccctcttgtcctccccgcccagtggccagccaggtactgccctgtccaggaggcagctgacaggcaacagggaagagctgagcctcagggcaggcagcccgtgtgaggccacgtgagcccaatgtcaccagggtcccatcgggtgaactgggatagaatggcccagcctttcctcatgggcagggtggagggaggtgaagtatggccattcattagaaaagtaatgactgggccgggtgcagtggctcacacctataatcccagcactttgggaggccaatgcaataggattgcctgaggtcaggagttcaagaccagcctggccaacatggcaaaacccttctctactgaaaatacaaaaactagccaggtgtggtggtgtgtgcctgtaattccagctactcaggaggctgaggcaggagaatcatttgaacccgggaggcagaggttgtagtgagccgatatgccactgccctatagcctgggtgatatagcgagactccatctcaaaaaaaaaaaaaaaaggaaaagagaaaaataataatgactaatcttggacttgggcagcccttcatagtttatgaagcacttctgcatctataagagaatgtgttctgttcacccattcaaagactaagaaaccgaggctcagagaggcaaagtggctagcccagtcacacagccagttagactgtggggaggacttcagcctacacaaggtcagcgtgagtttactgaacgctgcagtcaggccctgtgcttgatacattcacatacatgactctgtttaccataacgacagccctgggagattcctgtggattgtcccattttatagaggaggaaatatagacccgtgacttgcccaggccccacagggagggagtgtggagttcggtagctcagccatagccaggctcagccaggtcagtgggcgtgggtccctgcccaacttgctgagggtctcaagggtgtattctgcccacctcctgagtttggggtagatagcccaggggactggataggggcagctcggagtctgcccatcgtggctgtgggaacactgcctgctggggacagtgcctgga

SEQ ID NO: 61312 - DNA, 1037 bp, Homo sapiens
cctggtcccttcctttaaccagccccataaaaagggagtggggcaggagggagtctggctgcagactttgtaatttggcttggaggtggctcctgttcgttctaaccaggctgtaattacggctggcacccgacaccccctcattaccggagcctggaaggaggactctaattatagcatactgggtccgggctggagtgggttgggggagggagaccacagtggaggcctgtgtaggcagagagagactctgagctggctggggggatggggcagggccaggattgtgggggggctgtcctgggctcctcatttgtcttgctttcagagtcatcgttgggagggatggggcatagatcgaatccaggccacttccttggggagaacaggacccagaggagcccgcccgggagactcattcattcatgcacgaaggatttattaagcatctactgtgtgccaggctggcactgggttacagcagtgggtaaacaggtgccatccagccagaaatgatgttcaaggagaaagcacattaaagccatcttgctgctggaaatatctgaagaagtccacattgatggcaaatggccaccatcatgagccttgattaccctctagtcaccccagtcactcccctgaaccccctgggcctcacttggcacagcagggccccaggaccctcccccagaaccctgtcagactgttggctgcccacgcaggttaaatgtgtggctgtcactgagcctctgccctgggaccacacagtcgatgggggcacagacattaaaggaaatacacaaataagtatataacttgaaaaggtaatgagggtaataaggaaaagagatgccagacgaagagccagggccctggtttaggtgggagtggtgcagtcagggctctctggggaagtgaactttaaggtgatacctggagaaggaacagggtttagccaggtaggggtgggaaggcagcattccaggtgtctccatggaggcttgcagcctgggcatcctacgttctgaggtgtcccc

SEQ ID NO: 61313 - DNA, 1704 bp, Homo sapiens
ttggccgggtgcagtggctcacgcctgtaatcccagcactttgggaagccaaggcaggtggatcacctgaggtcaggagttcgagaccagcctgggcaacatggtgaaaccccgtgtctactaaagacacaaaaattagctgggcgtggtggtatgtgcctgtaatctcagatacttgggaggctgatgcaggagaacccaggaggcggaggttgcagtgagctgagatcatgccgctgcactccagcctgggtgacagaatgagactctgcggaagggagggagggagggagggagggagggagggtgggaggcagggagggagggagggaagactggtgagtccatgaagttagagggttctgggtagcttaggactttctccagggtcacagagaagccgcaggaggctgtacaccactagagggcagggtttctctcttatgagatcactctggtgttaagaggaaagtggattttaggggcaaaaggaaaggtagggagcccagagagaggaagggtccaggcgggaagacctgggcttggagactgcagcgggtggtgggggtggtcgtgcagtgtgaggcacatcttccaggttcatctagcagcaccaggtccctccagcagcacggactggaagtggggtgaaggaaagggagccaccaggcatcctcccagatgggacctgaacaactgggtgcttggcggagtctaagattgcagctcaaactcaccccatgccaaccctgggtcagggagaggtgacctataaaatagcaggtctgagtcacaggtggggagcctgccattgccttagggggacagcagcattaacaaaggcccaccctgagaaaggcactgtggtcccagcctgggtggggctctcagggtgtccccagagatagctgtggatgtaacctggctgggcatgtgtgtgtctgagggggcttgccacctgtcactgagtggggggccaggctggccccaggccttactcctggatctcggtttgggaggggcaggtccacagagcaagggaagccaagtgctggagtcaggaagctgagaccccgtcccctccagcaagctagggagctcctgagaggacagaacaatagctgtccctgctgggttttggtggctgtgacctcgaacacgccctttcactcttctgcctcgttttcgcatctgtaaaatggaacagcttcgcagggtcattgtgttgacaataatgtgcgctgtctcgttggaacacacaggattttcagtgccaggtggtgggaatatgcttattatctgcaggagcatggatgaaagggctttgagctccttgtctgggagaagaaggggaaacagaatatcccctcctcagggcccaggcctccatcacagtgaccccatcggacctgaaacttggaaaaggaaccaaaaattagccccaagactgagccaaaggaacccaaagccagaggaagggtctggagggagggccttgggggtggaagtcagggtggccagtgacccagtgactctagtgccctttccagctctgtaagcagcgtggcccccatagccaggcccgggctcatcccagcactgcacctgccctggggcctcgaccccagcctcccatccacttcttcacctgcctcacagtccttcgagggagacgtttcacaggagcagatggacacccccttc

SEQ ID NO: 61314 - DNA, 1051 bp, Homo sapiens
cggtgagcccgccccacttgcctgggcaccccaggacaccccaggcccagaggcacaggcctagctccatgtgagacttcacacagccatggtgcccccttggattagcatttccccaagtgctggccacatgtcccagcctgactttgggaccatctccactgcattggacagcaccgagtgccctgtgagccctcactcccttttccactttccatctttctgcttctgttagggagcaagttcccgtcaggtgggggttcttgagccctcccaaacacctgctaatctccctgtttaacaaagagggcaggtctctgcctcacagccctggcaccccacggcaccgacccagaattcaatgcaatcgttatttttacagttcccttctgtttgtggaaagtgatactggtttccattcacaataatgatatggcatttcctgtgttgaaataaattgttttaggttaaaaagaaaaagttgatagtattaagtaaataaccatccaagtggtgctgggatgtagaccaaatctggagggaaagaggagagcagctgaaactgggaaactcgaggaagcctggggtcccttccttctcggatatgtggggagctctcggtactcccagaggaggaggcagagccctggggctccccacatctcccagaactgggcctgcccccagggtgccctcgagtctaagtgaggggctcttgctcacttgtcaccaggtccctgttgatagtgcaggagccctcggggtgaaaagcccttcctggggcttaagacaggcagatgggacccccccttcagtcacctgacagagccagcctaccccagactcagggggctcccgagtagccttcctgggttttgttttgtttttcccgtctctttctggatcctttgctttctccttcttcagctctgtttatttccctgcctctccctgctcatttctctctctctcttttccctatgtgcctgttttgcttctttctttttctcttcatccccctctctctgtctcactctctgtctccctgaca

SEQ ID NO: 61315 - DNA, 1062 bp, Homo sapiens
ccaccttctgttttgtgtgccagagccgggacagccattctctccccagcatggggagcagaaggtgcttgtcccgagcccacagccggctgcccaggctgactagatgctctgatctctgaccccttattctgccctgggctgctggtgagatggaggcagaggctttgagggttagccccttctccctgaccctctagcctgggctcttctgccctccaagctgagggttctcagtgtcagcatgtcagccccaggccaaggtttcagagctccccggcctcagggacagcctgttgctcctgactgttaagacacaccgtggccacagaccctattcatactgacagtcctcctattcctctcatcctctgtgcagcccctctgctcccctacccccgcacatgtgctgtgttctctcccttgggttgtatgtttgtgcctacgctgtttttctttaccctgggtttgtgtctgtgtgtgtaaatcgtgcactgggctatatcgtgttgatgaccttatacatctatctgtaccctctttgtccacctgccaggtgcatctggctgttcattggcatggggttatgtggatatcatgtggatttctctgtgtggcacacatgtgttctgggttcctcatttccttccatggtgtgtatgcatgcatgtgtgttggcacattgctctgttctgcacacataactatgtgtgcacatgtctctgcgtgcacatgctcctgtatgccatgctcttacagtcgatggggcgtggacggagtggagcaagtggtcagcctgcagcactgagtgtgcccactggcgtagccgcgagtgcatggcgcccccaccccagaacggaggccgtgactgcagcgggacgctgctcgactctaagaactgcacagatgggctgtgcatgcaaagtgagtcacagggaaggtggggccctgggggtggggactctggagccatgtaagggtcccccaaacccggccccatgcctcagtgcccagcctgcagcacggcagtcctcagggcctctgtccccccaccacatccat

SEQ ID NO: 61316 - DNA, 1047 bp, Homo sapiens
tcctcagcggtactggctacatttgagttgttcaggagccatatgtgactagtggctgcatacgggacagtgcagccataggattttctaccactgtagaaagctccaccagacaaccctacttcagaccctgccactttgaccttgaggcttcccgcctggccatgtttgcctgggggaggaaagtgtagccgtgggttgcctccctgggcccatccttcttcccacatgctcacctcttctccaccgcattgttgtgcatctcattccacttcttcagctccccgtccctccacttcccaccctcagagcatggaatggaagaagagttcagaacagctacttacaaagataacagagccagaagaccttatctacatacaaagataacagagccaggacctttggtcctctggaaattgctacagactcagaggtttcagccccagcactcacagggcaaattatgtagccccagtgactctgagccacagaccctgtctcatcagcagcaagcaatgaattaacacatggcatgaacatgtttgttcttttgtttctcatgccacaactaggagggcagtaaggcagggacttcgagcccattttaccgatagagaggttcaaggctagcccgaggttgccagcctgtgtaggcagggctcagactggaactcagcaccgggccggttggccctgggccctgccctttccagggacccagggcctccctgattgccccagggcctggtctctgctgccccttatgtggtcctcctgtccccgcagtgctggaggcctcaggggatgcggcgctgtatgcggggctcgtggtggccatcttcgtggtcgtggcaatcctcatggcggtgggggtggtggtgtaccgccgcaactgccgtgacttcgacacagacatcactgactcatctgctgccctgactggtggtttccaccccgtcaactttaagacggcaaggcccagtaagaacccgaggatgtctggggtggttggcagaggcaggatacccagagggctctggtggt

SEQ ID NO: 61317 - DNA, 1031 bp, Homo sapiens
gcactggatacaggtctggacccaggtctgccactaacttggcatgtggccatgagcaagccactccccttttctagacttcactttccacctgtacaagagggtgcatgtggattagactgtggctgggcctccttggggcttcctaaccatgaggctgcatctgcatttgcctggggccttaggtaagcatggtgcaccccctgaggcctgaagggtggccatgcaggccttgcccttgggaaccgacccttcaagggagaagcccctgcctgaacagtgggagtctgtccagaggaggtgggagtgactcaaggctcaatgagctcacagtccaaggggagggaggctggagggcagatgcccagcactgtgcccctctcactcttggcccccacccttgcagacacctgctggctccctggacactctctgctctgcccctggcagcactgtcaccacccagctgggaccttatgccttcaagatcccactgtccatccgccagaagatatgcaacagcctagatgcccccaactcacggggcaatgactggcggatgttagcacagaagctctctatggaccggtgagtatcccaaaccacagcccatccccatctgccttcgtcctcaaggtctcacaggggcaggcagggcaggcagcctgacagccacgaccatctcccagaccagctgcccttttgccaccatttgtggcaaatcagcaactcaggattggatatgcaaagttcaagaatactgctcccttgaggagcatcatgctcagagcactggtccttgagccaggcagactctcagaccctgctcttttcccattgtgtggggataatgctccacctgcccatctcaccgaacagcaggagactcaaagccagggcatcagcttggtgccatcattgtcagcacctggtatctaggacagagaatgtgctgcgagatgcttgctgactgaccaagatacactttggtgtcaaaactcctttggagaacctcaaatgctggataagtg

SEQ ID NO: 61318 - DNA, 1172 bp, Homo sapiens
gtttctcctccaattcagacccaagaggtagcccccgagggcatgtacctggtgggaagcagctcaggtacccttgggggttgcagggcccttacgcaggtatttctctctctctcctctctggggtgcgtgtgtgcgtgcgcgtgtgcgtgcctatgcttttctctgtgggcacatcaggatgcccctcggagagcatgtgcacgtgtccccacctgagcgagcgtgtgtgtgtgctcctctgcgtcccaggtttggacgtctagggtttggtgtgcctgtcttctgccctccctgagcccacagggtcagtcaatgtatcttctacgtgcctctccctctgccttctctcacagtgcccccggctccagagctcaggggtaggggttctcctgagggtgcaggggatccttctcatctcctggaccctccagggcactctggtccctattccccagctcctaggcagctgagccgggtcccttaggggaggtgaccaggagctttggtgcagggagctcttggtggggcaaagggctggacccctgccaggtctgtggacatggttatatgcccgggagaggggggtgcagggccccagggatggcccccaatcccacctctgtttattctgtaaactgcaacctataaataacctttagcattcctattgtaacaaaattaatttttatgaaataaattatatttcctagtctaataaaatccgggttgcatttggctgtcttcctgttggtaattgggaatgactccgttgctcttctcaaaattccatggaaggtggaggtgtcactgtcagttcagagctatctgacccccaggagatgagcaagcccaactgcctcattttatagaagggaaaactggttcagagaggggtaaggacttccctagagtcacacagcaaggaggagcctgtggtccatctggatcccggtccttgtgcatccggatctgttcaggagtttgtcatgtgagtctgccaggggctaggtaatggttgagagggatgacacagagatgaagccccagcatccctgtccgtctctgaggagttcagaagggggtatccccaagggtgctgaggctgtgaggtcagttcagaaacctcacctaggatatatgactattgtgcaggctgaaagggagtgatg

SEQ ID NO: 61319 - DNA, 1025 bp, Homo sapiens
gagattcgttggaacctgggaggcagaggctgcagtgagccatgatcgtggcactgcactccagcctgggcaacagagcaagactctgtctcaaaaaaaaaaaaaaaagaaaagaaaataccccacatcccacgtgttccactcacccaattctaattcattctgaggggcctgggcacaagcattttaagttctctagataaggctaatgtgtagccagataagaaccgtgatccaagccaggtgtggtcgcgtgtgcctgtagttccagctactcaggaggctgaggtgggagaacagaacagtgagcttgagcccaggagttcgagttcagacttggcaacatagtgaaacaccagtctcaaaacaaaaaggactatgattcaagtaaaatgttaccacatagggagaaaaagcagctgtcctctgcctccactagagtacccattaacccattaaacaggcaaaggctacatcatgagagacttaggtgagccttctgggagaacttcctgccatgcaagtcgagttgtcaaacctggcagtgaaggggacagtttcccccttggagaattagggccacatcctgtgggaagtctaaggagttggcctagtctacctcgagtgtggggttcctcatgggactccctacaaatgtaggtggttggagggttcggtgcttgtctaacggaaatgctctgggcttgagctccacccgcaagcccacagttccacgccagccagtggtggcccctggaagagcctttgccctttctcttggtaatgctcccctttgctgggccagggggccaagggatatagttaggagatgggggctccacagccaccctcctcttccttccaatttcccaggctcctggaaaaggagtgatagggccaactgggctcaacatgggcatcctacacctggggtggcacaaagcaagagcaagtgaaactgggagagcagaagagaggcagtcctgaggccctgacccagctgggtaacctctctgtgctgtgtc

SEQ ID NO: 61320 - DNA, 1026 bp, Homo sapiens
tcacctaggccgagcgcccgctcgcccgcccgggcttcccgggagcgttacctcgctctgcctgaggcgcggggcggacgagacgctgggggccccatccccctgcgcgcccctctgcgggacggctggcggcctggcggggcactgctctgtctcgcacctggggcctcttccgcgggcttcctccctgcccctttgggggattcgtagagttgccacagcagccggtgccatgacatcggcagagggcagcttcgccagcactgaaatattcatgccctgagcgcccggcggggctcggcgccgctcccgggggtccgggcggggccgggcgggagctcgggggtcctggcggcctgaggggtgggggagcgccgagcgcgggcgggcgggcgggggccgggcgaggcgggaggtgagggagggagctgcgggaggcggggtctggacggcgggggccgagcggggcgggggccgagcggggcgggggaagcaagggaaagttgatcgcggacttgagcggcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgcggcgccgctgcacacacgcacacggtacccggagccacgcaccgcctcttccctcctcgcttccctctccttcccctcgccgttcgcccgccgcgcggcggggaagttggtggtgaccgcggctgccgaaccacttgttcccagcg

SEQ ID NO: 61321 - DNA, 1050 bp, Homo sapiens
gtgccggccagtgcatttgcccacaagcccatgtagctactgggcacttgaagtgcggctagtctgaattgagatgtgctgtcaataaaacacataggattttgaagacctagtgtgcaaaaaaaggtgataaaatatctcactggtagtgttttatattgatgacatgttgaaatgataatattttggatatactgggtgaaatacaacatattattaaaattaatgttatctatttcttttttgtggctactagagaatttaaaatcccccatgtgcccatattctatttctgttggtggctgtgttctagagttaggtggcctcggcttagcttctgccactgaccagctgcataaccttctaagcatccgttttccaatctgtaaaatggagataacagcctctgcctcacaggcctgtgggggtttagtgagctgagccgagtcagcactcagaagagcacctgatctcgtagctaaggcactgagcagcgtggactcttcattcccacccacagttgaccgagggccttccctgggccaggagctgtgctaatgtcctgagaagtggtggagaccagggcaccatcttcgccctgggaacctgcagtttggtcaggagacagacctatgcagcggcagctttaatacctcggtggaactctgtgaagaggaggcacaagatatgctgatgttgacatgcagtgatggctccctgggggcctgttagactgttttatctacttctgtgtgtgttcaaaaatatccatgataagaagggagaaaagatccttgggagggggtgcctcatccactcaacgcagggtggggagactccatgaggagagatcacaaaagccaggcattgcaggaggagtaggaatttgccggaaagaggggcggacaggcagaaagaacagtgtgtacagagactctgcagtaggagaggagccacattcatgcatctgcagtagctcagcgtggccgggcagagtgcacaggggaggcggggtgggggcgggggtccggtgctgaggccgcagaggga

SEQ ID NO: 61322 - DNA, 1810 bp, Homo sapiens
tcctccagctaggctccagcccatctccaccgccagccccaccccacagctggttctgctgctgtcctggggaaatgtgggcctgcttctcaaggcccgagctggtgtgtagcctaactcaggcaaggaggttctgcctgggagttagtgtgcaggctgctagcaggacgctgggtgccgggtgcaggtagatgaagggtcctgagccctgcctgcgtgggtactcatctgcaaactgctgcaggcatctgctgctctggactcgtgccttagaagttcccaaaactctgatggccacgtgttccctgtttttaagtgagatcctgtcctgggtcttcagcatctggtgccatccagctgacctaggacaagagaacaggtcctgttttggggtgatatctgatacattgatgggccgggaacggagtttttcatccgaagactaaactcagcttcctctctcctaccaggctgtcgagcattgcaaacgccatgtgtggaactaggaggaggaatattccatcttggcagaaaccacagcattggtttttttctacttgtgtgtctgggggaatgaacgcacagatctgtttgactttgttataaaaatagggctcccccacctcccccatttctgtgtcctttattgtagcattgctgtctgcaagggagcccctagcccctggcagacatagctgcttcagtgccccttttctctctgctagatggatgttgatgcactggaggtcttttagcctgcccttgcatggcgcctgctggaggaggagagagctctgctggcatgagccacagtttcttgactggaggccatcaaccctcttggttgaggccttgttctgagccctgacatgtgcttgggcactggtgggcctgggcttctgaggtggcctcctgccctgatcagggaccctccccgctttcctgggcctctcagttgaacaaagcagcaaaacaaaggcagttttatatgaaagattagaagcctggaataatcaggctttttaaatgatgtaattcccactgtaatagcatagggattttggaagcagctgctggtggcttgggacatcagtggggccaagggttctctgtccctggttcaactgtgatttggctttcccgtgtctttcctggtgatgccttgtttggggttctgtgggtttgggtgggaagagggccatctgcctgaatgtaacctgctagctctccgaaggccctgcgggcctggcttgtgtgagcgtgtggacagtggtggccgcgctgtgcctgctcgtgttgcctacatgtccctggctgttgaggcgctgcttcagcctgcacccctcccttgtctcatagatgctccttttgaccttttcaaataaatatggatggcgagctcctaggcctctggcttcctggtagagggcggcatgccgaagggtctgctgggtgtggattggatgctggggtgtgggggttggaagctgtctgtggcccacttgggcacccacgcttctgtccacttctggttgccaggagacagcaagcaaagccagcaggacatgaagttgctattaaatggacttcgtgatttttgttttgcactaaagtttctgtgatttaacaataaaattctgttagccagatctgggcctaatgtttctgtgacccttcagctggaagagtttgttcctctctgatgagctctgagcccatgacacctttggggcccagcactcccatgacccatcttggccagagaatgaaagcaaagtggataaaggaagatcccacctcatcctcccca

SEQ ID NO: 61323 - DNA, 2635 bp, Homo sapiens
gaagtgtgttcaacattctgtcttctagatagtggaccgatagtgagcccctcactttgcttttggtccttcatcctcctccccaaaatgaaccctgaatgatgaaatgattgtaaccgaacacatcatcaggacagctcttcggggtggggaagggactttctgtctcctgaactgtgaattcctgggttttgttttggtggggttagggggaggtgggggtggtagaggattggggaagggggtgaatgtaaaaatagggaattaacttggatattagaagccacacgccatttggaattcaggaggcagtggcccttgatgtgctaacccaccctggtctctgtgtcccctttcctttaggggagcaagaccaagggctgtgagtcccagcattgaaagtactctccttctactctttccacagaagcacgaggtcccagcaaagtctgatgtttactgtgaggtgtgtgaattcctggtgaaggaggtgaccaagctgattgacaacaacaagactgaggtatgctgtcctcctggcagagggagggcctctcctgcccccccgagcctgaatgtcccagtgggaaagtcccacaggagagagggcttggcccagccttgacatgtgtacagccatgtccccatctcgtggaaggcaatcctcaccagtgggacctctaggctggcgggggtccggggaggtggacaccattgccctgctttgtagtttggtagttttttgtgggtggaaacggcacccaccattgactcatttcctggccatgttagtattttcagaatgtcccccaacccttgtccggcctcccgtcttctcacacgatcctctcgtgtgtttcagaaagaaatactcgacgcttttgacaaaatgtgctcgaagctgccgaagtccctgtcggaagagtgccaggaggtggtggacacgtacggcagctccatcctgtccatcctgctggaggaggtcagccctgagctggtgtgcagcatgctgcacctctgctctggcacgcggctgcctgcactgaccggtgagcgctgggtgtggtgcgggagaggatggtgcccctcttgggtctgggagggccctgccagcgttgagcccgctgccctcttatgtagttcacgtgactcagccaaaggacggtggcttctgcgaagtgtgcaagaagctggtgggttatttggatcgcaacctggagaaaaacagcaccaagcaggagatcctggctgctcttgagaaaggctgcagcttcctgccagacccttaccagaagcaggtacgccccgggctgggctgcggtaggccagcatggcagaacctgatgaagtatgccaaggctggggtacattttgatggaaaaccagctgtttctgcctccgggcatggagtccaatgaagttttacttggaggtgatttgttggcttaagatgagccactgggggaagcaacctgaagtagagaggccaaatgtagatagggtgtctggaaagggaggccccaggacccagtgggctgggaatgccaggagctctcagggaacagtgtatccagggcctgcctggccttttgtgccccactatgctcggacacccccagagctggacctgtgtccccactttcctttatagtgtgatcagtttgtggcagagtacgagcccgtgctgatcgagatcctggtggaggtgatggatccttccttcgtgtgcttggtgagcctcactgggtggtgtggtcctctcgggcagctgtaacctggggggctgcagagacccggaagggttgctctgagacttggccgtggggtggagtctctgggttctgctgcgggagagccaagaaggtagggagccagccccccaagccccatcgctttcctcagcaaccctgatgttctgaaagagcgtggtggagctgtgatcctagctccttctggaaactgttttcttagttttgaaagcgatacatcgggcagctctcattctccccctttcttctttccttttctcaccatatagaaaattggagcctgcccctcggcccataagcccttgttgggaactgagaagtgtatatggggcccaagctactggtgccagaacacagagacagcagcccagtgcaatgtgagtagctcagcagacagtgtcaccagcctgtcttgccctggggtagcctgtgtgagaatcctgctttaatgggaacccagtgatcaactctccaccctgcttttatgttatcagaaagctgaggcccagagaggtggttaggcttactcatggtcccctagaaaagacagggtgaactacactcttgtagtgaagggtggggtggattttatttatttattttttttagtatttttttgcttctgctttgttgcttttgtcttcatttcccttgtgacagtgtcagacttgtacaaggtcactccagggattgtacaaggtctgtgggattcattgcccagagctttgcccaggtcctgtcccccgggaacatgtttgcccttgctgaagccgggcccgagtcctcactcaaggccctgagaactggcccctgcccagcagccctagggcactgtggccctggcctggcctggcagccaccagttg

SEQ ID NO: 61324 - DNA, 1494 bp, Homo sapiens
tttatttatttatttatttttcattcttaaggtgtggcagagacagggtatttgggatatacttttcagactcccccggtcttattaattctcgaaccttcttgatattaaaacaagatgagccatagtcatggtctagctcttttcccttaacaggtcctgtttttagcacttttgttcctgctgctttagggtttggtgctggaaggcaaatgcactcaggctcagagctagttgctggttgcatttatttccacaatatacagagtctatacacttgtctcactcttggccatcagagtgtcatggtcaggatgtctagactatctagtgctctgtgtttggtgtctaaatggtgaaaggggatcaatctggagaccttgtggcttaaaatgattcatccatttggcgggttgggttttcatgtgcactgtgtgcagcttgaacatagaatgtggttttttaaaaagccagcatttccccttaatgcatcattttaaatggtcctgccgctgaaaaatctggtgtggttttatttctaacacatttggctttctgttagtttatgggcatggtagttccccctctagaaaaaagcatagcttagttcctacctagagtgacctgaaaagacacattctagaacagaccaggtgtccttggagatgtggaaggtgctggggagtctccctcgtggtggccctggatggagactctgtttgatgttccttaggagctttgtgtggtctcctccccgagatgtaactggcacatatgcactgcttcagacacgagccctttaacatggaaactggaatctgccccgttgtgggagggggagagggaggtagccttgacctgggcccagggtgctgtccagctccctgtcctctggctggattgggactgaggagcagtgggcgtaggcttgctgctgactggttgttctgtgctctcttcagcaacccaaggagatctgtgcgctggttgggttctgtgatgaggtgaaagagatgcccatgcagactctggtccccgccaaagtggcctccaagaatgtcatccctgccctggaactggtggagcccattaaggtacctggtgtcactttgtgtcctggtcagggctgtgcaatgccacactactccctgctgtgtcacatcacatcttacgagtcacttgtttctttcggttccctgcctggctcctaaaggtctttgagtttgtgatcactggtttatcctatcccctatactaatgcagcccccgaccctgagttcttttgaaaacattttatttccttggttgtaaaccctaatgttcgtgggatcattagcctgtgtattttcagcatgccattcaaaggtgactttgcagtgcctggcttcagcctcaccttctcacatgcactgtctgggtccttccccatcctgtggccctgacagactggatgttcccagcacacccctcagagtgtacggaagcctcactggg

SEQ ID NO: 61325 - DNA, 1061 bp, Homo sapiens
cctgtgtcttgttctgtggtgctgctggtcactaacctgtgggaaagccttgtgggcccggggccagtgtgggctcctgagtatggagacccttcatcaagcattttctggggctcttgctacacagtgttttgagtgtgatttagtgtgtaagacctggagatggtgcacacagagcaggacagcccccaaatggtctatccctgcagggccaggaaagctttcagggcccccttgtccgcaagatagcaggaacaaggtaggttgctaagatctgattgcaagagcatttcccctgaacctcttgggacatccttacacctggttaactgcttgattgttgttttaatttttcttaactgttgtgtcctttcctttctcttattttcacctccgatttcctgtttttttgttcaacagcaggatcaggtatgtgtcggggaatctgcttgcagtagtggtctgctgcttcctctagttactttgctttttttttttttgggtatggcatgattagctctgacagatacaaggaatggttacgagaggcaggctccctctctgttaataggctggggagggcttctgcatctctcccctgtaattcagcccttgaggttttgggggtctcatctccccttcggggtccagtaaaatgaagccagcagagccttgtgctctggtcacagtccacatacagcatacgtacatgcaggccaccagtgtgacaatggggaaccatgggtggcccaggaggtgcctcagcctccttcaacgtaggccagttaggaagtccagtgtaggtctggcttccccagggcaccttgtgtctgtcacaacgcaagtaggcattgcatgtctttagtgctgtttttcataaacacagaaatgcttctgctgcatgagcaaacatttgcagacagccagcagactgttcctggctgttggatccagagaattggaaacaatctcttgattgtggcttctgcccctctgggtaacagggtcctttgggatctagagccacatcagatggcatgctacaagaaccaaatgcccag

SEQ ID NO: 61326 - DNA, 1013 bp, Homo sapiens
gagtctactggaagtatctagattgtctgaaaataagcagttaaaaatcattataacttgactctactggatttaagctttataatgccatctgagattgtgtaaatggctttgaaaggtaagctccagttcctaagcagtgtatctcctagctgccttctctccaaattgccactgaatagttgctgtgtgatcctggggcacgtgaggttataagataaaggagacaggagggtggaatctttaaggtcccttaagaaacattttcaaaacgtcttttgcacacatttcctataaatgatagagtaaccaaattgtcattttcatcttattaaagctggcccagagcagacattcataaaattctactttagaaacttgcttgatagtcaccagttgacactgttggaaatgctggggggtttttgttggttgggttttggtgcattgttgcagtgatttgtttagcaatctgtttctctctcctcagtgcaagaactatatcagccagtattctgaaattgctatccagatgatgatgcacatggtaggtggcacggaggccccttgttagcatttttctttgtttttcaggtttcgtcatttctaggaattttgaaaattatatggtttagtttcccttttttaccttagagtgctgaattgggctaaatcgacccctctggctaggagactctccacttgcaatctcagtacctcccctgttacgggagaggcaggctgaagcatcttgatcccaggactgccctggtggcttcctggcaatttgtttgcctctgcccgttcaggccagccatcaggtttctaggtctggctttaaccctgggatctgtagaagtcaagtgctctctaactaagccaggcctgagaatggctgtgttgccacctgagtcgggggaatactgcctcccggagtttgtcccgtgcatggcagcagcgtccgctgaagctgctgcttgagctggtaactcctgagctggctttggatgcat

SEQ ID NO: 61327 - DNA, 1125 bp, Homo sapiens
ttttatttttgagacagggtctcgttctgtcacccaagctggagtgcagtggtgtgatcatggttcactgcagcctcaacctctgaggcttaagtgatcctcccaccttagcctcctaagtagctgggagtacaaatgcacaccaccacacctggctaatttttgtattttttgttttgccatgttgctcagactggtctcaaactcctgggttcaagcgatctgcctgcctcggcttcccaaagtgctgggattacaggtgtgagccactgtgcctggccaacctttttatttatactaaaccccctttttataccatactgttactataatgaacacttaatcgattttaagcctatcagtaatttgagagcctgtaaagcatcttaggaactggtcagcaagtgccccctaatgctgcagccctgagtatataaggacgttttcctaggaatttgagtcctcttaagttgcaaacctaactgcctcttctgtaggataatggggacgtttgccaggactgcattcagatggtgactgacatccagactgctgtacggaccaactccacctttgtccaggccttggtggaacatgtcaaggaggagtgtgaccgcctgggccctggcatggccgacatagtgagccttgtgtccttgtgcattggggatgttctgggcctgggagttgggctgtggaggctggagtagggcgttcagacaacatccttctcttttttcccagaaagcagcttgaataggtagtgcagacttgaatctattttggttaatggcatctggatatgtaacaaaactgggaacaaaaagtaggagactgtttctgggaagattttgtttcctgccaggcaccctgtgtattaggaacactgtagaaatactttttgcccccattttttttttttttttttgagactgagtgttgctctgttgcccaggctggagtgcagtggcgtgatctcagctcactgcaacctctacctcatgggttccagggattctcctgccttagcctcccgagtagctgggattacaggtgtgtgcaatcacgcccagctaatttttgtatttttagtagagatggggtttcaccgtgtttgtcaggctg

SEQ ID NO: 61328 - DNA, 2216 bp, Homo sapiens
gtgccaatcagaagattggctttggtgtggtcttgccttgttaacatgcctgggaggcaggggatgcgcaggtgaacggttcagtgtgggtgtgccttcagaggtgggtggggcgtttgtttctctgtcccacccacctctctgccatactgatgtgactctgatttcacctgagcctcagtttcctcagaggtgttgtgagcattgatgtgaaattgacctgtgccacatggggtgctgtgtgggtatgagcaaaggttctgtgtcctgtaactcacagtgtgttctggtgagtcacacctcttccctccctgccgtgccccagcgctgctcatgcagggtggagaaccaggatgtgacaggagcgcggtcatgatcatatccctggttagagagaatagcgaaaaggccatggggagttccagctgtgtggggtgtgaatttgtgtcctgcaaatacaaatttctcgtattctttctcttagaaatcccttccctgcgacatatgcaaagacgttgtcaccgcagctggtgatatgctgaaggacaatgccactgaggtgagcggcggtgagtggggatggtgcttgagccacgggcacgtgcactggttcctaagagagctgtgattccgggtgtctaaagaggaatggtgtaggcctgagggtggcaaatgtcttccacaaaggatcaaggagaaaagattttagggtatatgagccgtatactgtccctgtcacacagtctctttttaaaaatgtaaaaagaatgtaaacaccattccttgagttctgggttgtacagaaataagctgaagggcctactttgctgaccccgggactaaatgcccaaagttaattgagatgttgtattgcatgccactaatacctaggtccattttggccatctctgcttagaattccctgtgcctgcgagactgcaggtccagggattttcattttgaatgctcatgtctgcttttgcctgattgacctaatagagccataggtaacatggccaagtccttttccctgagggctggctgttttccaggcttggtttttctgggagctattgagggcctcttgccttcagcccatttatttccagggaggaaagcctatcgtgattctgaccctggtgtcctctcgtaggaggagatccttgtttacttggagaagacctgtgactggcttccgaaaccgaacatgtctgcttcatgcaaggagatagtggactcctacctccctgtcatcctggacatcattaaaggagaaatggtaagtgatggggaataggcttttccttgaaggtgcttctggggcccaggagaggcagtggcccagagtagattgattaaaatggaaagtctgttcttagctctggaattcctcaacagcattttgctacaatttgacatccagaatagctcctttggcacagcaggccactctgtatgtaacttgccctggggttagcgagggtgcggctgctggggactggtcggactgctgaaggaatgtaaaccggcataaccttcagagatgtgagttggatacatcatgtccaatctttaactgacccctttgagcaggcacaaaacctcacttctgtgaatttatttctgtgaacttataatcaaggaataattcagggaatgtattggggtctttcattcatcaagtatgtattgtacacagacacaaaccctgtgtcacagactgggtttttagcaaagaacacggagctagctttgtggaatttggaaaggccttgacaaagaagaggtgtttaagtaactgaagagggccagtggggcaggactttcccaagacaggaccaaggttctggtgaggaaggcaggggttgtgtcatacacagcctcctaggccatcttcaaggattgcaagtgcagccttggagtgtcatgattgtaagggcatttgtcaaagggtttggtctaggtctaggtcccattgagggaagctgcaagtccggaagctgacaggaccctcaggaggtcattgctttgtgagtgagatgtgatgtggacagtggaaatggcagatgcagattctcttttggaggattaaatggactggacttgctcatgagggggatgtataggagaggaagagctataaatgtctccctggtttctgagaagataaaggtggagttatttgctaaaatggagctagttgggcaggatagaat

SEQ ID NO: 61329 - DNA, 1075 bp, Homo sapiens
caccttggcctcccaaagtgctgggattataggcgtgagccaccgtgcccagcctgtttttcttttttaaaaaaacccttcattctacagttgttatccattttacagaagtcaaaatcttccctgtatttgaatttgttagtcttttctcctatggtttcttttgttacttatggaaacattttaaggttatgatgataccttattacttatggaaacattttaaggttaaagttctgatactccctgatactgtttaaaggtagctagagaggatgaacgtgaaccagatacatgagtcccttctagccctgtgacagacaagccagcttcttgaccgggacaggcgtgtatctgtgtggctggtgtcccatacagcttggtgaggggctgagtagcagagtccagctcaaggacagtcgccctcagccctggggaaataagtcaggtcgacctggtttgctacaaaatgggccacctcctcacgttggttttcattttagctctagccggcccggtccttggactgaaagaatgcaccaggggctcggcagtgtggtgccagaatgtgaagacggcgtccgactgcggggcagtgaagcactgcctgcagaccgtttggaacaagccaacagtggtgagtgccgctgccctccagtcccagccgcagcactcctcttgggtccccttagaacagctgtaactcactgccatattgacagagcactttttcttgccttgttttgtttacttctcactgtgactctgtgtgggaggcaggacctattggtgaatgtacccattttacagcagaggagatggaggctcagagaggttaaggtttcactctcctgaggctacctggtttcttgtggcagacaggatgaggtcccccatgcctgcggctccaggtgcctgccccatgctgcctctgggcctctgtgcagatcccacttctcaccttagataagaggccagtgggttggcagtgcccattcccaccactgggcacatgggcgcggctctatccttggtcactcactccaaaaagtaaatgctgagcttttcaggtact

SEQ ID NO: 61330 - DNA, 1038 bp, Homo sapiens
gggacaagatgataatgtggagtggaagtttcacattatctcattgctgacagtagccgtacgaccttgggcaagttgcttaaactctcccgtatttcatcatttgtaaagtggcattactcatctatttcactgggttgctgtttagctttaataaattaggttaatacagaaaagggcttagttagtattctttgttgctgtaccactaataaaagtaatgtattgtcaatatctttgtccccaacagcacagcggcctattttctgcccttgattttgtgatttcctttggcgtctttaatttcaaaggacgttgtgactttaacaaaattaaattgacttattaaaaacatacatgctgggtataattagtgagtcaggaaaacaagccagggtaggtagacagcagttaggagggagttggcaggcagttcatagtctaggtagccaaactaggtttagctgccaggggatcttgacatcagagcagcccagcagatcagagctggttcctggtaacccgaatgcttgggtctagatctgttgtcactaatcctggacctgaggttgtctgttccagccccctagttcggtttccccattcgtaaatggaggcgagctgtttagagtagataatagatggacgtgggaagccaggtcagtcagtagaatggagtatagagtacaaggtttgtccctgccactgctgtccccaggccctccccaaacagcctggtagcagctcccttagaagcttgcagaggtacatcccatgtgtgagttccttctgccttttttctttttaacacaaatagtagtatattctactgactgttttgcttgttgctccttaaattgtgaaacatttgaaaagtggaaaagtgattatcataaacatgtgtacgcaacacccaggttaagaaatggaacctgataacccagctgcccccgtagagagccaccttcctggacttgtttttcctccccgttaggtctttttccttccatacatgtgactggaagcttcagcagtgtg

SEQ ID NO: 61331 - DNA, 1022 bp, Homo sapiens
gctactacaatgggctaatttttttgtatttttttttttgtagagatggggtttcaccacgttgcccaggctagtcttgaaccctccgcccgcctcggcctcccaagtgttgggattacaggcgtcagccaccgcggccggccaacaatgtggagatttaaaaggtattttacatatataatctctgacctattcaattagtagggcttttcttttatgacctttcccttccctttctccaagttcttcctcactcctccccatagcccttcctttcgcccctcccattgccccctcctattggcctccccttcgcgcaggcgccctcagaggcgctgagtcagggcgctgttgagctcgggcaggcccggatggggcggggttagcgcctgcgctctggacggctttggggcagggcagatttatatctgcgggggatcagctgacgctccgcattgcagactgcggagtcagacggcgctatgtacgccctcttcctcctggccagcctcctgggcgcgggtaagccctgggaccctcatcctggggaggaggtgcctcgcagcgtccatctgccccagaatgggctgtgccgggcctggcccctctgctccccctgccctagttggcaagggggcgcgcgcactgcgcaggcgcgttcgctggctttctctggctttctctgggcggctgggggctgcggggggcgggctgcgaaaatgcccccgggaggacggcccaggccctgggcagcatctccttcggggctcgagtgggttcctgcgcggctggggccccgaggccttccctcaggctgcgcttcccactgtgggggtgggtgagtcttgtagggtgaccccttgggcagctgtgttgtgcctgtgctgggcgcacgtgatcgaggtgggctggagccccgtcccgcaggacactttggccgttggcttcagttgcctgtttgtaagggtagcgaagctgcaggaagcacatgtgtatcatctatattgacgtttgcatatgta

SEQ ID NO: 61332 - DNA, 1008 bp, Homo sapiens
ctctgataagatgctcgccatgcttctcccatgctggacttgggccacgtccttgggcatgaatcttggtctatgtccaggtcggttctgaatgagccagcagactcctcccggggctgcccggctacatggttgagggcatcctggacaccagcttcagccacagctcctgaccaggcaggtgcagtgaagccgggaggtgtaggtcagttcctacctctccaacctgaggtcctgcacttcctgcagctgttggaagggatcgtatccaatgggagcaagaaagtgtgctcccccacagccccactcaggcataaagggccgaggggcagccaggcctgtcctggctagggctggctcagagtctgtggcagccccacccctgccaggctggcccttagccccaagatccacctatggcactcgcccctttacagctacgtggacatccactgacactcaggtgacacacctttgcctgcttctactcagtcttggcagcagttggacaaaaggaaatcaaagatcggttctttcttgggagaggaagagcaagctggagccctggggtgctcagatgctcttgggagtaacatagccccatagccccggggctatactgggtgcaggggggtggaggtggtgggggagctgcagccaggcattcattcacttcccgttctttcattcctgctcttcttttgctcactgactcattcagcagcctctgggctgggcgtttactctcctgtcaggcaacacactcctgattgggtggccttggccttcccaagctgtctctggctgtccccaagtgaaacggaatctgggctggacaggccaccggatggacaagctcttctcatctaaaaccaaggcagttgacattgtgggctaaatgataagaacaaaattaaaaaataaaaaccaggcaggctggcataggagctccatttccctgccctactgtgccagtggcctgggggctcccctgccgcctctctccac

SEQ ID NO: 61333 - DNA, 1104 bp, Homo sapiens
atgctacaaaggttattcttttccgtgcacaggcctttgatgtgtgaggtcaagggagaaactgatggaggtgggatggatgaacccgatggttcattagcattttaaatgacctattaaagagaccttcagtgtctctggggcacagtctgtctggagagtgggtctggggtcctggctgctaaccagggccgagatcctcaaaagtctggtggagagacatcctctgcattcctcgtgtacagacaagggtgttctgaccacctgtctctccgcaggacaagggtgtcccccacctgaagacggcaagctgggtcctgagtgatgcccctcagctgagtgtccaaggctggcccgaggagcccccacggccccacctttccccatggagaaaggactcactttgccccaggactgccgggactttgtgcacagcctgaagatgagaagcaaatacgcccttttcttggtttttgtggtgatagtttttgtcttcatcgaaaaggaaaataaaatcatatcaaggtgagggttgcaagcccaagtcttcatcttcctttcaaggtggggtgggtggggacagggaggtaactgcagggctctctgtggacctgcaaatgcattccttcaacgagccatccccaggccccttctatgtcccaggcagtggctcctgcacacgtcctcatgactgcacaggggtgagacttgggctctggactcaaacagcctgggttggagcccccccatgttggccctctacagctgtgaaaggttagacaagatacttaacatttctgagtcttcggttcctcttttgtaaaacatggctaataatgggaccagcattgttgtaaagattaaatgagaaaatgtaaaagcatttagcccactgcctggcacatagttggtgtccagtatttgctggctgtgactattactgttaatttacctcctggccttgcattagcagcacatcccctatagaagtcttgatgtcactgagcccatggaaaggcaaggtcctagtatggatactctgatgggcaaggctgccaatgtgcagctgccaagttgtgtactgctcaactccaggggcatgtc

SEQ ID NO: 61334 - DNA, 1063 bp, Homo sapiens
ccacctccatccaaggctcttcctaggggccctgctaatgtggacagtagactttatccctccttcttactctgggccaagacctcccactccgccctctgaggatggtaccaagaatgggcctttgggacttctcaggacattgacaatgtgcacactgcaggttgacttaatttatttattttttgaaaagaagagacagaaaataccttattatctgcagggactcaaagctgtacccaaatcaagaaagacaaaataacaatagaaaccattcacacactccgttcatgcatggacaccagaagacgattcagaacacaagaggagaatgagctggagcgccagcaccacgatggccccaggacgttgtttaagatctgagatcccttggtttctctcttgttgatctgagatgctacatcagggcccttgctgctgtattacctctgcccgggtgtttgagacaggtcacaagcgcgtggatgtttcctggaagtgtattcccctggggctcagcgatgctctgggaacccttggggtttggggaaggacagtgtggtgtgactattggcttgaaacgttatggatatggttggagtcacccatgtggatatgattttcagcttggagctgggatggagaagatggaagcactggtggccgggcctctttttccagcgaggccagccctggcttctcctctgttccagcttgtctgccagaagccttcccctgcaaggtgcccacctgcccggagacagagggagcagctgaggcctctctccactggccgccagcctccctagcacaaggggaccattcagcaatgagtgtttactcatgttctttcttgttgatgagttctgcggcccagcatatagaaatggctcagaacgttccaggccttggtgagacacagcagcgtccaatgctcacaggctgtccccactctgcctgttcccatcttcccctcgggacctgtttataaattgaggaatggatgagggccctggagggtccttgggagtagttagtggagggcaggattctcaggtcccca

SEQ ID NO: 61335 - DNA, 1049 bp, Homo sapiens
agccagatctcaagggctgatacctgaggcaaggagagctaaggggagagaaattggggctgagtggaagcagatgcctgcacaagccaagtgtgtcttattgatctgtacaagctgatagaaggaccatctgctgaaatccagggctcctgagttggtgggtttgcttgtgaagcttctaggacaaggcgcagccagatggaagggagagggtccagggcttcctaaatgcagccgcatcacctgtcaactcgctgcagtttcagagacagtggaagctgctctttacctcaaaagcacaaagcagaattggcaacttcacttgtctcaagagctccaagatcctttggtctcgtgtcctttggcaccccgtaactggactggggacaaatttgttacgtgtttccaaggctacagacatggcgccatcctcacaggcctagctcatgtcatggatcaggtgctttgctggggggatacaatgacccatgtggtctgcgtcttctgccattggcttgaactgggcaccccctgaagtctccatctcagctgtatattctagtccaaattttcctggctcccctgctccctcccaggtcctgcacactgtctttttgccaacacctcagccctgtttgctatttcatgtctgcatggtacgagacaccccttcacggcatacactgccatggtatgtacatatgcatccacgtgtgtgtatgtgtagcatgtagctcattctgctcagcctctggcgccgttccacattgctcccagccccattgctgtcactgtcgtcccagatgtccttgccatggccacagacaatctgccgtctcctggaaacgctggggctgcccttcagagagctggcagccccagcagtcagggcctgctttgcagaatagaatgtgaacccaactcctgatggcctacttgacttatttaattaaagatgaaatcatgcaatgagcaaaacctgcagcgtgtctctgccttttcctttgcatttgttctcagcagcaattgggtcataatttttttttttt

SEQ ID NO: 61336 - DNA, 1041 bp, Homo sapiens
agcgtctgttggactttacagaagagcctcatcctgtctgcccctcactctgccctggaatcaacatcttccgagtccttcttgggggaaatagcagagccccacttaactccataaactgcttcccattccgcagcccagttctgattgttgaggtgtcgcgtcgttccaggtcccccagtcccctctttctcctgtcctctctctgtccttcacctccccactccagccccggctcagttcagggaaatgctgttccacatcagccctctgctctctgaggcagccgcgcctctgactcggagctacttgaaacttctgctcttgctaggattggagtctacctatctcttccatttgtcccagctggagttctggaactttcctcctcggggtgggggtgggggttgttaaggatgctggggggcctggggaaggaaggagttcagaggaagggtgtcccctgtcctcttgatgtcaccctccgctcctgggacacgtgctctctctgtctctgggtcttctggctgtgcacgtttgtgtgtccttgtaaatatgttttaggaagaaagcaaaagggactgaactagcctctggtaggattgcaggggtccagccttgcctgtttccgaagcccccacactgcctttcgccctactgagactggtcccctcaaaaggtagacaaaacagcagctccctgtggagctgaagggcggcctcaaagtggctttttgttagacaaggttaaggtttcctcatgagcaaggttgcagatcggtccttcctcagctccttgatttgtgaccttgaccaaggggcctgccacccagcccctccagtgccctctcctcgatgcctcgctccttcctgcccccactcccctggcttaggcaggtaggggaattagggccatgctggaagaagcttaaccatgtgttcaaagaacggtttcttgcttgcttggtcctggaactccccttggctgccccaggcctccttggcccatgggtgctgggggaggtggatgtcagatctggta

SEQ ID NO: 61337 - DNA, 1076 bp, Homo sapiens
atgcgagggcccctgcccctgccccacggagcaggctgccacctccaccgccgatggcaaaccaggtgaggacagtgctgggccaccaggctaggggtgctgaagggccacctggcacctccttcagggctctagggtggtagaagaggtgtgcagagcaagagggaagtggcaaaaatgcagaaagcttgagggagctgtgaggtcagaggcccagattaacacagagcaggaggcgtgggctcagccctcgtttctcccctgggtgcctggaaggtgggcagagggagggactcagccacaaggaacctgggctgtgtgtttttcatgccaggaaggagtgggtggtgggaaatgggagaggactcgagaggaagcccccgatttccaccttcccttctgctgctgcctcccggacccctgcccagcctcctggcctgtagggcaggatcccagactgagatcgagcctgctgctccactgcacattcgccctccatgccttctctctgttctgcagagacttgcaccggtcaggacctggctgacctgggagatcggctgcgggactggttccagctccttcatgagaactccaagcagaatggctcagccagcagtgtagccggcccggccagcggtaggaagcttgctgctctgcctggaggagggagggaaatagggaaggggctgaggacacaggtgtatgctgggccagtctgcccttgttccttcctgccagactctgggccctacaatctgggccccaaaagaaccttcaccccaaagaagtcggcttccaccagagcaggagggataccagttagctagtaggaagaacttaacatgggtggagggagcttaaaccctgacatgggtagcccagggaaagcaggaattcttttccctgcagggctttcagaacgggttttgaatggttcaggcatagtcctatgtggaggtggaaggaaggacctttcgccgttctcgagtttctcaatcccatggttagattccaagctgcccagacccagaatagagggctggggctgatggcgaggcggagagatggagggc

SEQ ID NO: 61338 - DNA, 1031 bp, Homo sapiens
atatcgtgtgtttaggaacaccaagaaggcaagtagcaagtagccacaaaggggctccctcctgaccacccctccctgcttcccaccccacacacctaaaccactgcgagtgtggggatgcgctgcgccgacgtctgtgggtaagtgtgggtgtgtgagaagaacccaaaagtgggtcaggatggatttcataattggggtttgggtcctttgccagataaagtgactaaaaacaaaacaaaacatataacaacaacaacaacaattggggtttgagaatgggagggtgggcctttccctgacctcccctccaccccaccttctaactggagctggagcagtgtcagcagagtgatgggctcttgaacacccagcgagactccaagcctgggaagagagggagagaagagccctctttgcctggagaggctgtcatatgctactccagtctagcagcagcctgagaggatgggaagccagcaccctcccgtccccttctcaaaaaggtcagaaggctacctggagcacagaagagctctgtcctaccctaagccccaagggccagagagagtgctctgctcatcttcccagtgaggggacagaactagctgtgtgaccttgcagcagccacttcacctttctgggccttgattttcctggtggtttagtggggaggtgaaaccaaatcatctgcagaggctttagcatgctgtcactccaggaagagcctggcaatggcctggccacccacatgtataccctgcttatcctaccacaccaccgccacaggctgggcagcaggtctttgggtttaaggaagagattctcttttttctccagagaaagtacctgtgaccagattaggggagggtgtatattagctggagaccaagaaacctgagaaatggggcctaatggcatcttggggcaagcaccaggctgaggacacacgtatcatctctcttagcgtgggctgctgtaacaagataccagagatggggtggcttaaacaacagagatttattttgtcc

SEQ ID NO: 61339 - DNA, 1011 bp, Homo sapiens
tgcaaaggtcccctcaggcatcgttggggacatgtgtcacaagcctttcttggggccaggtatggtggctaatgcctgtaatctccgtgctttgggaggctgagatgggaggattgcctgagtttaggagttgaggccatgattgcactactgcaatccaaggcactccagcctgggcaacaaagcgagagaccctatctctaaaaaacaaccaaggctttcttgggattgtactgacattttaagaaagagcaattcctacatcctaacagaggaaggtacgctctttactctttgacgctccttattcaggcactatggctgcattttcctgggatgaattctgatgtcattttgggtcctgccttataaatgtggtaatcacaaagtccagtccctcttggagtatgtatggttcatccctcactctgacacacttttgaaagcttttgtaaagtacaggatcatagcaaaaagtatttattttaggtcgctggcttgaatccaagtctaataaaggtatttgataagtaatcacttgtacttgttctgttggcagtagaagtgtcccttgggttgttctgtgtgtgtgtgcatgctctgtgtccctcagtggtttgtctgaatcacttgtgagtcaggagccttatcttctatttattttagtcagcgctcctaacaaatggcgttgattagatatatgttacgtcaaatttaaccctggtgcaacaaagccgagatccctgcatggtcagtcactggaagtcagaagcagcctggtcagactctgtgagtcagggtgtggccatggggcgtttgctataagttcttggtcatatctggtcagtagatgaatttcggatttgacttttcagaacctctttctctggtgcatttgtcaggggagactttagaattaatcagagagaagagctggctgttcttttctcactcccacccccatccctcctctcctggatcattattcagagtaaacactgaaaagaaaaa

SEQ ID NO: 61340 - DNA, 1051 bp, Homo sapiens
tcacaatgaattactttgctttttgttgttgttaatttggttaagaaagaaaatagactgaatggggaaagaaatctttaggaatggctcaaagccaactgggttttcatggaattaaaactgaagccttgtgtgttggtacaagtcaggtgtgaggtgctttgacatctgtaagagtggggtgatggcagagagcctgttgggtggccgtatgagcagtgtggagctcttaccttgctatagaatttctctcattctggaaagtaagttttcaatttaactgcttttccctgaaatcttctgaaccaccccagtgatgatatgaatgtagctccctctggtgttgacaaggacttgctatatcagtaatacccttattaattcaagcccaatcacttttagagctggacctagctaggttcttggagaccatttagtccaattccccactttaatctctgacatgaaatctactaaggtaaagtgacttgccagaggtaccgctagttagtagcagaatctgaatcagaaaagaaagactcaaaactcacaaattgagcattattttctgctgcctcccgtaaagatgcccagtgtttaggtagagaccattagatatttgaagttgggcatatctgcctgatctgggataatggccaattaaagcttgtttcattaatggtggggcagtgagtgtgccaattagtctaaaaccgtagctagttaataattagatttttgtatcgaatataatatcaacactaacagaaatacttattgactatataccatctgccagactatgtgccttaaagatgaaacagtcattatgatacaatccctgccttctaggagcttccagtccgtgaggggtacagatagttaatagacaattagaatataaaaaccatggggtgagttatggacaagtgcctttgaccacagatagttatgatgacgtatcctttagtatagtatttaatattttactccttaatcactagttccagaaaaataatctttcacctatgttcaatcaagagaattagct

SEQ ID NO: 61341 - DNA, 1080 bp, Homo sapiens
gtgcaaaactgatttacttctgagaagagactacttcttaaaaaaacaaaaagggtacttctgttaaatctctggtaagtaaatcagtaaattggatcatcgaattttttcttgctctttgaccttagtctttgtgcttggtgtacttagaaaaaatgtccataaataatggcatttctaacctgaaccttttatggtgtagtggtcccaaattaaaatatgaaaggaaaacactgaaaaatgaacagacctgtacatagtgtgctgtagtttaatttgatggtttttaaaatgggagtattgaaataaatgtggctatgttggaatttgatttaaactgtggagctgtatggctatattgaagaaatgagtagttgagtattcattttaaatttgggggtagttttttaatttgaaggatgctatgagaccaaaaacaggagttttgtttcaatttttcagtgaaaggctcttgtagctctatagattttgaatgaattattcagtgtttagtaaattcggaagctccggctgtgtccctggtgactttcctttgtgagatgtaggacacagaccgtgcactggctctgagtacggagtctgacaaatgtgcagctcttcttcagtcacagcagcaccctcctgtgcctcagtgtttccagcaggcctgacgtcaaaccaaagaagtttaaagggactagaaagaggagagaaaatacgcgtgaacaaacattaatgcctgattattgcctcacgtgtcatcagttggaaagtaatttgcttactggtgtcccagatgtaattgtttggccactaagacaaagagtgtttatcgggcaaaccatcggatttctatcctgctctttcatctccctcttgataaatctcaggggtgggttgaaacagtttgtgtttctgctcataaagcaggctttggatcctgtttcattgtttctaattttttttcttcttagtaccccatctaattccaagtatttgaggtagttaagagtgaggacatgtatacaaaagaaatgttacagtcagagatttagaaaccataaggatggtatagggaga

SEQ ID NO: 61342 - DNA, 1053 bp, Homo sapiens
ccccaggaaattcctgttacttcactctttgcttctccctgctgggtggaaggtcaataccattagaactttcaggcgccagcctgggtggccaacctaatggagtaagatagttccagctccaagtaatggcaagcttggagcagggcccagtgtaattaaacccctgcagtaaagaatttgatgttcgttggtcttcattcatctcagtgaatgggcttggggcaggaatatgatgatatattccgagcaaagaaaaacagtggctctagagatttatgccgttgccttgaaggttgtttggttccaaattaaatttagataattcagtaagagaaaagtttctcttggtagatggcattgtgaggtagggcagaatttagagcgtttctccattcattaaaagactgtccagtggagttacttgtaaattatatagtctacagtagagttaaggattatttgaacccttatgactcataattccaaaaaggactttcgatcgtgtgacccttaggtgtcctgtctgtaccttgtcttgctccattgccttctgtgtgttttgtttcccagtacttggtgttttggtgttttcttggcaagtaaactcaagttgactagagtgctaggctcccaaagggtaaggcagggaaagcaaagttgtagaacttcctttttctagctgggtattagagcaaatttatgcaagagaaagttgaagaataaagagaaagaaaaaggaagaaagagcaatggaatatcaaagtgactgagatagtaagctgggaattttaaaccattaggccattttccccttatgtttcctagtcatttccaggtctagaaaggtacttgtgtgcactttcaggcctttagaattgagtctggctctactagttaagtcttgatttggcatgctagtgacagggcatttctttccctcatttttctctctctagtcactatattttatatataaaaaaatataagaaatatatatataatataaaaatattgtatataacatatataaaaatataaaatataatatat

SEQ ID NO: 61343 - DNA, 1095 bp, Homo sapiens
catcagaaacgtgagaggaaccagggtctgtctttgggaataaatgtaagttgagtagatgccttgctaactagtgctttcaagtaactatggaggaatagtgaagtttttagaagagtaggctgaaggattctttgtgctcatctaaggtaagtggggtggtgcatcctttagtgaggggagatgctcttcactcctctttaatgggtaaagatctttagacaatgcatgagaagttcttttctctggtcagtataaaagcccatgcttgaatgtttgtccacgttttaagaacctctccactttcttgtaattatgtatgaataaatagaatttataagccaggagaaacaaaacccttttttctaaagcttatacagcttaacacagtatttcgttaataacacatagtgacttgcaaatcaaagtcagcttttctgaacattcttaaagaataatggaaatgactcagcagagcctaatttagcttccagtgctgctttaaaagggagagcaaagatggcatttgtctagtgctgcacagtcatgtaaaaaggaagagggggaagcttgtatttattccatactactgtgtgccagagacttcatatgtgtttcatctgcagagcaaacctgagacagaagtattgtctgttttatagatgatgaaattaagcttcatagcaactgagtaactcacctagggtcatgctgctgataggtggcagaatttgaacataggcctgtctggttgcacagccaaatgctcttttcatcactttgccttatttgaataacttctttagatgaatgaacttcatatcacctgcccagaaacagttctacaagatttggccataaaaaaagaaagaaaatacaacgagtataggggaagcatgcatattttctctttttctttgcatagaatatcagaaagtgaattggtagatccctcacacataatctattttgttagcagataattatttaggttttgtgggaacatgtaaaaagtttgtaggtcctttgacttacaggtaaaccaggccacctcccttattttacagaggaggaagccgaggctagagaagtgac

SEQ ID NO: 61344 - DNA, 1016 bp, Homo sapiens
cttatcgtcatccaaattgcagtgttttggttcagttggaaaatcaaggttacagtttgcgttcacagaatgaaatttcccagcagtgttctgtgattgtcagagtgatgtaatttgatatattaaaaatcaacaattttttcctcagctttgttttttagactgaaaatgatttggagttttggtgaacctttatattttgacactacaggagccagccacaaggccaaatgtgtcagctgccagtgtttgcttgacatacaggagaacattaaggaactctcaggttgggaggagggaagtgttgaccaggacatcagacggaggtttcttgtttttgtttttttaaacactatttttaaactcttaagtagagggactattttaatattctaggtatagaataaatagcttttataacagtcttagttctaaatgaagcagaacccgtctttgtaaacactgagaactagaccctgaatgtacaagcagggaaaagaatagacaagtttacttggtttatcagaagccataaaacctttagagcagattaaaaccttttctccttttgtttgtagatggctctgagagattcctctgcgaatctgtttttagctatcaagtggcatccacgcttaaacaggtgaaacatggtaagcacatgagtgttgcgtacttgactgtgagaataaatttgctagggggtggatgaggctgtgacaaaaatccccaaactcagcaaggctattttagtggacttcctaaattaaagaacattctaggtcttaatctagtcataatgtccacattgaggcttaaggttggggccgagtgcagtggctcacgtttgtaatcccagcactttgggaggctgaggcgggtggatcacttgaggtcaggagtttgagaccagcctggccaacatggtgaaactgcatctctacaaagaaaaaattagtcaggcatggtggcgcatacctgtagtcccagctacttgggaggctgaggtgggaaga

SEQ ID NO: 61345 - DNA, 2522 bp, Homo sapiens
cggggcccggccgctgtcaccgggcaggagagaacgttgcttacgtgcgcccggagtccattggccaaggcgggccacactcccgggtctggattgggtcgtggcgcagagaaggcgtggcctcgccgcgctagtccttataggctgctccgcgctggtgctagggcgcagcaggccaagggggaggtgcgagcgtggacctgggacgggtctgggcggctctcggtggttggcacgggttcgcacacccattcaagcggcaggacgcacttgtcttagcagttctcgctgaccgcgctagctggtgagtgtcccttctgtgtgtgggtcctagagctcgcggtctggtctggtctggtccccagactgacgcctggtcggtccccctcttgtcttacagcggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgacccgggaggaggggtttgaccgctccacgagcctggagagctcggactgcgagtccctggacagcagcaacagtggcttcgggccggaggaaggtgagcggtgggcgggtgccgacgcgactcgaggggccgggaaggtggggaagccccggtgctggaaggggtcagagccgccttggcttcctatcccatcgggacccagattgcttgggggcagggggaattggagtataaggtgagtgaggcggaaactgaggcacggagtgggaaggagcgttggtttcttaaggaaacagcacctcccccgcctgtgcgtttcgttttgaagccgctctaataccccttcctgtgtgctctcctttccagacacggcttacctggatggggtgtcgttgcccgacttcgagctgctcagtgaccctgaggatgaacacttgtgtgccaacctgatgcagctgctgcaggagagcctggcccaggcgcggctgggctctcgacgccctgcgcgcctgctgatgcctagccagttggtaagccaggtgggcaaagaactactgcgcctggcctacagcgagccgtgcggcctgcggggggcgctgctggacgtctgcgtggagcagggcaagagctgccacagcgtgggccagctggcactcgaccccagcctggtgcccaccttccagctgaccctcgtgctgcgcctggactcacgactctggcccaagatccaggggctgtttagctccgccaactctcccttcctccctggcttcagccagtccctgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattcctgtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaacagttggttgagtctctcatcagtaccatgaagtgaaaaggagggagatgggtgctagtgaaaggcaggtctcatcaggccctggggtccacctgtgtgttcctccatccctttccgggactgcctgccagcctggtgacagaggtatgtgtaccgtgtgccatctgtgccaagaacccttggccctgtgctggctgaagctactaggagaacacactggaaacccctgaaggtagggggtgag

SEQ ID NO: 61346 - DNA, 1204 bp, Homo sapiens
catccggccttgcccaggcatctcgcctgcggtctgaggaagggaacagaaggtcatgagttcagggtcagacgcagccgctcagcacaggaggggtggaggggaaatgagagttgctggtagcaggctccctccttctgcagcccggcgaatgggggcgctgggctctgttcccagcgtttgccagaggtggccacttcagccaagcccagagaagtgtgggcagaagcagtgaaggttcttctctgtgtgggtgccctgcccaccccctcctttgcctgtgtcctcccggcctggatccatggctgactctgcctggaggccatttgtgcctgcctctgtgctgccgcaggagggcaggccgcaagtggggttggtgggggtcgagcgggcagcacggtgcagcggtgcagtggcaaggggggctacttgtgtggcataagctagaggagccggtgccgcctgaatgccgagctaactgttgccactctcctccccagactatgaaatccctggagaatttttggtgacatgcactgagccaaggtgatggactgtatatttgaggaaagacaaacaaagaaacaaaattaaaatggaattggaggccgaacgctgcacagctgccctctctctcacccagtaaatgcagaaagctcttaggacagacagaaaacctgccatggggctgcttccctccctcgcagggctggcggaggctccgcatcgcctctctcctaggatacagaaaccatggcaacgaaagtagaatgtaaaactcgcagcagatatcagtgggaagggctgggggagggggcacccagctgcctttcctccctcacaggagccaccaccagccacctctcaggagaagccagaggccctggccaaagataggaggaagaaagagaactctccatagaatgtaatttatagatgcgtgtatatgtatatatatctatttatatgtaaataggcatatatgaagatatatatatatatagtctactttttaaactctgcagggatttggttaagttgttgagctgatttcttccatgttttagaaaatgaggcctgtttggggaaggtaccctggtgatgtttttgctagacattagctgtagctgacagcataaggagagtcgcatcagagcttttcacagccccccgaaaccccagcctggttttgatggcagcagta

SEQ ID NO: 61347 - DNA, 1063 bp, Homo sapiens
tcctctcagctctacctcaggtgcctctccaccgcagctctgttctcttctatcgaattcccttccttttctaagtctgccagctttactgagaaggtaacattaagctgttctgtctctttttgtgacattgcctgtcagcctctgtgccatgagggatgtaagcatgaagctgtcacatcccccaggccagaagagagaccctacttgccagcaactggaaatctttaatttccaactcaagcagaaagcttctatgtgacccagggcacccccattctcctttgggctctctttctgtactgtagggaaattagagtggctgattccctgtaactgccctgaaaagcttccagaatcttctctgagaggtacaagagagagcctgtcccatctcctggctagtgctcctgctcatctctggtagttgaataactggttattttgcccttaggatctgccaggctcagcctgggccaccagaacttccagaggaactgaaataataaagagcttcttgaaaagctctaggaaacagcatactgcctcctcctcctgccccgccttgaccaatatctcttcatctttcggtttctcttgccatccccttggtagctggcatggacctggtatctgggatggcctgaaatctcatggttactactggttccagagtctgctgagcgctgagtctttgccttcctgagccttggagctcccccgctacccagccctcctcctccccagcccccaccacaggttccctcacttccctggccagcccacttctgtggccagacacttcatcagccttgaaccttcactctctgtcagactcggcacaggtgcttacacacattatcccatttcatcctccgccaccgtgacgaaaccagggttcagagagatttcatagatcagccagggtcacactgctaggaatggcagagctgagatttgaatctgggcctttctgaatttgatgtctcttctatgcttttgcttgcatccctgtccccgatccccaccccatcagacacgtgcagcccaggatagcagcgta

SEQ ID NO: 61348 - DNA, 1036 bp, Homo sapiens
gcatgggaaaaggacaagttaagagttgaaaagggaaggatcgagagcatgggcagaggatggtcttggagaggtggaagggcagagaggggagagtcacgagagaggggaggctcagagcaaccttgaaaggatgagggacctcacactgttggcctttgcagcaaaaagggatgtgagggggcttgaaactcctgctgcaggaggtgggacaaggaggcactgagttaaactgcaaagcagtagctgggccctaagctgggaggtcacagactagagatggtggagccagtcagtccctttctgggagtttctgtccagtagctggcagcctggtaagccattggctttgactcaggctttgtaacaaatgtggaaggtgccagatttcccagggagctcacgagagcatttgtaggcctcagtttccccagcatacaaagagaggattggctgggatgatcctgaggttccttgcagctcaggctatccaatgttctgtgaaatggttgactctgggctaagtcatgaaggccaagctgggaaggccagcccacaggaaaaggagacggattgctgagggattctgcattcagagtccaggagtgagagatgttctggtgctggcgaggtccggggtggggttgtacccttcaagtcagtcaaccttcatgagccccactgtgcacttagcccccttccattcactgtatttcacagaatcttatttacccctcagagcactcctatgagagcagagatcgtctctccactcaggaaccagctaacctggcaaggccacatggctagccagcaaagacccagagctgtccatctccaatcccaggcccttttctgactcactgtgagcaccgtaggtacacagagcccagaaactcagctactcacttactaacaaagtcacggtcagagacaacactgtatatttgctgggcattgggctgagttttttgctggcattcactcatttcctcttttagcctgtatgatggagatagagttttgcacagatgag

SEQ ID NO: 61349 - DNA, 1048 bp, Homo sapiens
gattacaggcgtgagccactgcacccgacattttcttaaatatttttgatctgcagctggttgaatccatgggtgtggaacctacacatatgaaggaccaactggacccacctcatagggttgtgagactaaatctacataaagcacttaactttgtggctgtcatgtggtgaacgattagtcaatgtcagctgcttctattatgaagttgataatttaaacaaaatttagtgtggctcaagtatttattcacccaaaagcaataggtactgtgctaggcacagggttccaccctcaagaagctcagagtctaatgggggagaaagataagtgtagaagcagttccagttgggtgtgataagtgctaattagaataagaggttctaggagcttaaaagtggaggccctaatttataccagtggttgggaaagagtgaggccagagtagagacaggaatactttttatctggcttctgctgtgagtctcagctgtcttcattttttcccaaaaggttagaaccttcagaaattggcaccttctaggccctggcactgtctcttccttggctattttagaggttacaaaccagtctttaggcataatttagcacagaattttccaaacagcattgtgaagaacactgtatactgcaatatgatgatggttctgtggatttaaaaagaaaaaaaaaagtattccatggttcaaataagtttggaaaatgccagagttatatagaatttcttcttgcagcactcctgctgccaactttttaatatatgaaggtgcattattaatctctggaagagggatatagtttccaaatttgatttactccagaccatcttttaataacttacagagttaatgttccttggaataatttgaaagatccaggcaggtggccactgcagatttactgtattagaacatagtccagttcctccagagtaaaaaatgtcacatttcttttttttctttttctttttttcattttttctgtttgcccctcctaccatttgaaaaaaacatcaaatttaattaag

SEQ ID NO: 61350 - DNA, 1048 bp, Homo sapiens
actaaaaatacaaaaattaaccaggcgtgatggtgtgcacctgtaatcctagctactcaggaggctgaggcaggagaattgcttgaacgtaggaggcggaggttgcagtcagctgagatcatgccattacgctccagcttgggtgacagagtgaaactccatctcaaaaaaaaagaagaaatattttcattaagatattcagccatcactgtaagctttctcagattttacgtgtgagagggaagcaactagccagtttgcctttctcagggtagaattcaagagttttgttcccctgctgtttatgaatttgatattccttgactaatgtattcagtttctgttctagacatgagcatgaatttctgatttgcagatgtgaatcactgcctatgcatatcgtgctgctttttgttacaggtcctgccttaccttgctgtctctcctcttgcagggtctgacatttcaggaggtggagaacttctttactttcctaaagaacattaatgatgtggacactgcattgagtttttaccatatggctggagcatctcttgataaaggtaatgaaactcaaaaagtgtttttttgaaggtatgaacattggatctgtaatctcttaggtgactgcccctcctgaacagtaaaagataagtttttcttggcatccttgaaatggtgttttgatttgttgacattgtatgagccttgcatttcaccctgagatgccaagttcagtgaatatattttcttgtgctaaggccgtagtctgggcaggtgcctatctttaaatgactaaccttgaaaataagcatctaagctgaggcacagggcatgaagctgcagaacttcccctatctgagccagagtcattatatatacaatgtgaagctaaagtcactatacaacttaagttgcgtctttgatgagaaggaatgctttagtttatttcttatattaagactttttttaagacaatatgactctgagaataacaccccgctcctttggcttacttcatagaaattcagttacagtttgtacaagc

SEQ ID NO: 61351 - DNA, 1379 bp, Homo sapiens
attttttagaagagtaatcaatattattatctttaaagcaaaattaggaatgcttccattcataagatatcaggatatcgggatattgctgagtctgggtctgatcagtaaatgttatccatctgttccgttaaccataaacatctagaggctaggaatacctaacttcctgggaatgcagcccagcaagtcccagcctcatctttcctagaccttactcaagatgctgttgctctggcttgactgtctctgacaatagtaagtggcagatctgggataagaacctatatcttctgtttcttagtttttgcagatcttactgagaattgtacctcaaaaatatagtcccagtcatcagctattttctgccatcaaacacagctgatcattccgtgttccacgtcaaaatactttccattgaccctaggaacattctttctgtttccctcccagtttgaacgccatgaccctgtggatgggagaattactgagaggcagtttggtggcatgctacttgcctacagtggggtgcagtccaagaagctgaccgccatgcagaggcagctcaagaagcacttcaaagaaggaaaggtaggtagctttggctggaggaagaagagaaaccgtggtaatgtatggttattatttaatatgaaggtattaacataatgatgagagtatttcatgaaccaatgattacacctaattcatttctggtacctgaggtccgtagggagaaaagaaataagcaatgggtgaggaagaggagagcgtccagaatcatcccaggtttcttgttcaggaaagggtggcaccaactgaaattgagaattttaaaggagagaccggtttagatgggaaaataaagaattcagtcatgggctggtcatggttcaagaccagcctggccaacatggtgaaaccccatctctactaaaaatacaaaaattagctgggcatggtggcgcgtgcccataatcccagctactcagaggctgaggcacaagaatcacttgaaaccaggaggcagaggttgcagtgagccaagattatgccactgaactccagcctgggcaacagagtgagacttcatctcaaaaaaaaaaaagaatacctaaagagagtagtgaaatcaaagtcaaggaaatagaaggttcaagaactgaggggtctaccatgtcacatataacagcgaggatccagtaagctaaaggtggtaacatccattggttttggtgaaatggcagtaattggtgacctttgagagggctgtttcattagagtagtctagttggaaggcatccctattcgatgaaaagtacagaagcagagaaaggagagaggtggaagaggaggctctggaaagtgggaaatcacat

SEQ ID NO: 61352 - DNA, 1049 bp, Homo sapiens
aatttttagcaatttcatgtggaaacatgaactgcatagattggttggaatattaaatagcagttaattctgccagagtttaaggcttattcatattgatcaaggtctgaaggaaagataaccaacaagttttatgtaatttaaaatgctctgcgagttgatggaaagcacttagtataggctctggtacataataagtgctatgtaaatgtttgccgttataaatgttagaatatggattgttctttaaccatctagagaatttttctaagtaaggaagatggcccatttaggccttctttgttttggaactgaattattatttcccactttctccatctctccatacctaatgacatacatttaagctggttaaaaaaaaaaaagttaagtgaactggatttactcaagattattccttccacaaggggaatgtgattaaattagaggtaaatgcccccattctattccaaattcccaagcactcagagaagttaaagtcagtactggaggactttttaaaacaaactgagctgatgatctgctgttttgttctaaggatttaatcatcgtcattgattgatattgaggaatatgttttaatattttatgtttccttgtttaaaataaagaaactgtaggtcaatatttaattactttcttatctaatgaggaaagattcccaagaatataagccaatgaaagaagttgtaggctgggcacggtgcctcacgcctgtaatcccagcactttgggaggctgaagcgggtggatcacctgatgtcaggagttcgagaccagcctgaccaacatggtgaaacgctgtctttactaaaaatacaaaaaaattagccaggcgtggtggcaggcgcctgtagtcccagctactctggaggctgaggcaggagaatggtgtgaacctgggaggcggagcttgcagtgaactgagattgcaccattgcactccagcctgggcgacagagcaagactccatctcaaaaaaaaaaaaaaaatacaaaaatacaaaaattagctgggcatggtggcat

SEQ ID NO: 61353 - DNA, 2121 bp, Homo sapiens
tagagacagggtttcaccatgttggccacactggtctcaaactcctgacctcatgtgatctgcccgcctcagcctcccaaagtgctgggatttcaggtatgagtcaccatgcccagattaaaaaattttttaaattagctggtcatggtggcaaatgcctgtagtcccagctccctggaggctgaggcaggaagatcgcttgagcccaggaggtcgaggctacgtgagccatgataacaccactgcactccagcctgggtgacggagtgagaccctatctaaaacaaccaaaacaaaacgaacaaacaaagcttaattgtctagcaagggacagctaaacttataattaaccaataggttacagcactgtaaaagaaatcttgcaaattttctccctggctgttttttacaattgttatcattaaaggacttcatggttttcctgttcttaagggggaaaatattttctttttttttcctttatgaaaggagaatgacagtgatacagtgtggcccattagatcctttgccattcacctgcctgtgtttggactgttctcactttgtgtattaaagcttccttaagctacatgtttctgagcctcagtctcccaatctttattgcatttttcctaatgcttgtcagtcaacttaatctgaattctaatttctatatattgtgttccaatctctagctctccttttctaaaaaatgggcactttccaatgtaatgtttagtgtattaaaaaatattaacttggccaggtgcggtggctcacacctgtaattgcagcactttgggaggccaaggtgggcggatgacttgaggtcaggagttccagaacagcctggccaacatggtgaaaccctgtctctactaaaaatacagaaattagctgggcatggtggtgggcacctgtaatcccagctactcaggaggctgagtcaggagaatcacttgaaccaggaggcggaggttgcagtgagcctcggcaagagagcaagactttgtctcaaaaaaaaaaaaaaaaaaaaaaaatatatatatatatatatatacacacacatatacacacacacagacacacacacacacacacacacacacacatatatataaactttttccatggtgcccaatgtgaatgagctcatcacctatgcaatggctttctgaatggtgagaattaaaatggatgataagattaagccaatcaaagaaggggtgggtcatcagaaaaagtgagatcaactgggatttgagctctggagactgaagaataatgtgttactaattttacagatggtgtcctcaaaatgtaggtttttagtgtaggcagaaatttgagaatatgcaacttcataatttagctcagttcatccaggtaaaagcagatataaccttaactgttttatcgttctaatataatagacctctgttcctctcagttaaactctccagcttttgtggagcatagcaagacttttcatgatagattcattgaacatggccattttcctaactgaggcacaattgattttttcatatctttttttttaacttctgcctgtacaccaatgattttttcgtatattgcatctgtgaaattgttcctatagaaaacttcaagtagtaactatttttaacagcattgcctcctggttataaactagcagtttaacatataattgcttacctaggttttctttttcttctttttattaggaatatatatgtatacttacagtcagtctgtaattatgggcttgttaagtcattcatagaaacagtaatatacaattttgtcatgactataatcatgccaataatatatatctgtatagagtaattttaaaaccctctagcctatattatgatcttggtgttgtcctattatctcttcaaatcccaggtccctctaggcagtagctattatgcctacttcaaaggttattatgagactcaaatgagagagtgaatcggaagcattttgtacattattatccctcaacctatttgtgccccatacatagtaacttcaggccttatagtttgtccctactgctcctgtttccgtaaacctttgcagaaatctggtttttacgggcaaaaagaggtt

SEQ ID NO: 61354 - DNA, 1029 bp, Homo sapiens
tatcctctaaattcatttaacagcacagaaatgaatatttgtcaagtctcttttatttctcattatttttcttattattggatgccttttctccctccccacccataatctctgtatctgttttgtatcaatctaccacacattaacatgaatgtgtttttttattaaagctacatgactaatgaaatataaactagttcagtcatttctaagcatgagagagtgggagagagagagagagctgtgcaaaataaaaacaaaagtacattctaggttacaagctatctttttaaataaataaaagtgcattctagggaaatagagcaaccaatgcaaagaaggaaggaaaaagatggtgcttttgggaaacaaaaacaaaatgcagtagccaggtcatgaagtattttgaatggtgcaccacggatatttggacactttatcctaaaacctgtagggaaccattgaaaggtataaagtgagaagtggcataatcagatttggatttttagaaagatcactctagcaacactgtaaagtatggattaacaaagagggaaaataggtagttattgcagttgtctaaggagaaaatcataaggtagtcttaggaaaggggagagagaaaagggagtcgatttggcaattggcagtttggcaattggtatgaaagagtagaattcagttaatcccattcactgagatagagaacacaggaggagaagtaggtttgcttaaagaaatgctgagttctctcttggacattttgggtttgaagtattcatgagacacctcaatagctttctctacaggcaattggatatatgaatttggcaatcagtgatgtgggtggaattagagatacggtattattagcatataggagttggttgatacattgggaattgatgagctcactcaaggacagtgtataatttacttgaagcaaaaaagaaagtgagggacagagtgctatccttatatttaagttgtacagaataaagtaaatgagccaagatgggccagagatca

SEQ ID NO: 61355 - DNA, 1049 bp, Homo sapiens
cctatggtaacattggttttgttaagcattgtttcacttaaagtctcagtttcctagaacctagtgaagacttactgtatactaaaaggtcagtaagtgtttgccatgttgaaaagttttacagcttccctactccttttttctttttttttcttaactaaatactgtataggatttttttttcaatacctttacatgaagcaaacacagcttccctattctaacttccttgcacagctggatagataacttctctgtctagtgaaaagctcaaggctaagtaagtatcaggaaaggttaagtgcttagacttcaaagggttttttcttcatcgcatacagaggaatgtgacacatcagcctagaaaatcacttgaaaagatttcaacaataatagaagcaaaagacattatctggtcagctctcaataaaccagaaaattagtcataaattaatcgtaatacctcagtttctaaatattctagttagcgacgttttccttttgtctagttgtacgtagagggctctatcttcagaataaccacagtactcttgttttttgccagttaccttgccacagtaaactgtagcagatcatggagttcaaaatataacttcacagaatgaagaaaatgtatgtccaatagcatttaagtattatgcttccagagctttatttggaaatggtaacattactatttttaccctatggaaaacagatacttctgaggcagtgaattttattttgttcactgatttatattgggtatttttatatgtaaaatatactagatatgttacaacaaatacacacacacacacacaaaggcatagtgcttacctttgtgaagtttgcattcttataggaatgttccaatatactcctcagagtatagaagaaagaagtagacctcatctaacaatgtttgtgtgagagttagtatgtaccagggttcaagtcatatgccttgccttcctagtatgcatatatacccagactggtcttctttgggagtatttgtaacataatctgggaatgtaagtgattta

SEQ ID NO: 61356 - DNA, 1041 bp, Homo sapiens
agccttgctggaggaattcaagaaaagtctcacaatcttcttatgaaattttaaaacccttttgttgttgttgttctttttttttttaattttattttcgggttcttaacatgtagtatttcatattatttaggaaaacttgccgattgccattaagtagatcacactgataacgaataaagagctctttttagccattgcagagataatatgtaatgataataagcttatagtaaccatcctatgtaatttcattgtcttaggattttcaaacactagcaagactgagttcaatatgaattttaagtctgtttggagaatatacattacatttctaagtgttttttctttatgttcagaatttattcgagtagaaacatgggtcgcctgactagattgtccctagaagtctgccagaaactgcagcttaactgcctccctcctattttaatggagactaactaccctttgactgtctatggaccagaaattcccagggcatgggcttgtctaagaactatgcgaaatgccagcattctggctctaccttatgtcttaggcagctttacccccaggtcggccctaaggttaaattgtcctagagttgtgcacattccccaaaactgtatgaggtaaagtctttcctaagcttagaccactcccagaggtctaaagaactccaagaaactgaaataaagattagggttgattacctctttgaagaggcaattttcctcctctcgtttcactaccaaattcatagtgttcccaaaaccatttgtatgccaggattaactattggaattgacccttaaatttaattgactatatagtattggtgagagcataaattattggcaaaaccttttcagcgtcttgatggtgtttaccagacactttcaaattttggtccagcaattccttttctacatgtttaggctaataaaataatcacatgtataatgatgttgacggtcaaaaaataaactagaaagaactcaggccaggcatggtgactcacacctgtaatcctagcacttc

SEQ ID NO: 61357 - DNA, 1013 bp, Homo sapiens
tctttgttcccaggaaatctatgctgaggtacttaagcataaagtggcatgatgtctccaatttactttcaaagtggcatgttgaaaaaatacaaggcaaattgtgtaatatgtaaactgttggtgaattggtaaaaaatatataatagtactttatactaatctttcaacttttctgtgagtttgaagttatgtcaaactcaaattttgttaccaacaaaattagatttgcccttatgttaccttctcagcatcagcatggcccggatgattgttagaaaaataatgttaggtttgcttctttggcttaacttcctcatttcactctatccttagacttttgtctgtttctcaacctgtggcttccactatgttatttattttaattatagcaatttccccataagcttattacatcattattattaaatattagcttctatacacatttattgttatggctggtaatggtcagcctttggggacctattctcattttgtgtattttttcctgttcacatagtttacctttgcagtatcttgggtaacgtaaaaaatgcaaatttttttcttttattttgagaaatttaaatattaacttcctggtggagggctttgctgttctagttctcatccagtagctttttttgtctgaaatttctgttcagtctcttggtagaagatcaagtgtagtatgagatctaaccttaataacatactggactatactcatttttgttgtcaactcaaagaagtaatctctaaatgctatcaagcaggactatgccttctgtgagccgcaaaagaagtcagcaaagttcttctaagtagaagcgccatcaaaacctactactgtgtaattgttattcacctgtggactttaacctgtccatagctactgtttcttatgaacaagtaaatatctagtagaggctattttgaatgagtttattgagaagatcatacaaactgacttcacgatgattcgtgtggtacttgtattttcagttggt

SEQ ID NO: 61358 - DNA, 1054 bp, Homo sapiens
ctgttcttcagatgcagtttattaatgctgtgaaatacttagactgctgtgaggagtatccataatgtctctttccagtctctgagttccaccactactaaagtttgttaatctaacccatgtgtttgattattcaagttgagaaaataaataataatgtaatcattaagtgtgccaaaggagggtgtagtttacttagttgtctcaaatattcagactcctattaaaatatctttacatccatttttattttagattatgttgtgtttgaatttgggatcaatgaacccatttgatttatcattgttgatttgaaaacataaacatgactaaccattgcatttcttacaccttcatctttagctttttcatcataaaacaagattcaaaaatcactttgctatcagagaactttcttcagttccaggccaacttcttttttcttatattttagcacattctagcatgcttaaggtcacataaataaagttctataagagtatactaaacaagttatttctccttctcttctggtaaaatgagttctcaacttagcctgaccatctatttataatctttggttgtagagaatgtgtgaggatagtcctttatttgcatatttgtttttggcatgatgtattttttaaaattctaaacttgaatgaaaaacttcaccaattacagattaatctaacatttattaattaaaaattataaagaacattacactcttgaagtgatgcacatttcaaaatgattgaaatatgcatttgagtaagtgaaagccttaaaaaaaaagtgcacctgtatcattggcttggactttcctcttcaacttcaagttaacttagtggatacaagctaagccccaaggtaaatattttatggtagtgaactacttcaaaaatattcagtcctgattaacattttccagaaattgtgaacaatatagatacccagtgtgttcctgtgcagttgatacaatgtaacatataatgattcatgacatgggctctggagtctcctgccacttaatagtattgtcacctttggc

SEQ ID NO: 61359 - DNA, 1050 bp, Homo sapiens
accaacatggtgaaaccctaactctactaaagatacaaaaattagctgggcttggtggcaggcgcctgtaatcccagctacttgggaggctgaggcaggagattcacttgaacccgggaggcggaggtgcagtgagccaagattgtgccactgcactccagcctggtcaacagagtgagactctgtcttaaaaaaaaaagaatgtaattaatttgcaaaagtgaattgaggaacaaattcaacatttcatatcctttcacacctgctggaattttgttttatttttagttacagattttgccatcttccttctttcccatccaaagttctttaaattatttttaaaacatttactcagttttagctcctctttcaaattagcaactttagttcttttttatataccataaccctaaaaaaaaaaatctggctttggtatctgaaatattttccaaggcatttccattttgagtatctcagtactctgtttggcagctgtgtgtaaatggttagtagatgttataaagtatgctgaattggtatgaaaaacatagtcttgtggattgctgaacttctttatgtgtaatagagtgggatgaagagtgtggactttggatatagacagtcctgtatttaaatataggctctcccacataactgatgggtaaccttgagcaagagaccagttaacctctctgtcagttacattctcagtaaaattgggacaataggtaaagtatctagctctacaaattatagctgttttgcatgactttgagccctttactcagtttaagaaaggagttctctgctatcatatatatgattttctttcttcgtttacttgaaaagctgcagactagtataccctctgcgtaattgttctctccacagtcctttccttcccagtttaattagctataaaaatctcctgtgctatctctgtaatgagcaactagcccgggttaaataccgagtccattaactaaagagaggcccccagtttgatttcacatgtctcagttgtcctgtgttcacagtgattcatct

SEQ ID NO: 61360 - DNA, 1032 bp, Homo sapiens
gcttttgttttaatgtaatatgtcatagattctttctaaatgcaccttcctgtgttgaatccttcttgtgaaaagaaaaaaaaaaaaaaaaaaaaaaagcaccttcccctagtatccatgtattctgctaacaatttgtcaatacagtcatttcatgaatttggattatttatttaatgaaaactatattttttctttgtttcatttatcatcttttatgattttaccatctagttggcatataaaacaaagcaattatttctaagtggaggctttattttacattattgttaaatatttctttcatgtaatcatttagttgctctcttttatttgcatgatttatttcaagtggtttgtagccttctttattttcccattttctcttaccccttttttccttcagcaaaccaaagatagaaattatattttgtatttcctgtttctattgcatgtaatagacaactttctccacatcaaacatcaccatgtttttttataaagtcacagaataaaatttcttggtatagatgaaattgttccttaagcaaggaataccaatttccgcaacgttggattcagtccccttatgtcttctaaaagctatagtttatacactattttcaagcaataaaattgtctattgaaaccaattgttcattatcatcataccaccatgtatttcttttttagagaatagatttgttattctttcctacctattgattcccctttcccccaacctctccctgaacgtttcagaaatactgcctctgaattgagtttttccattatttgtaactacagtcccctcagaaccttgacagtctctcaaacttggaagaaaaaatttatgtgtattttatttccacctcctttatgttatctacaagaatatttgtttacatggaacaagaaaacattttacatcaaataaaaatgaaatattatccacatttatctgtaaagagataaaagtatagtcaaaaccaagaaagggaagtattgattatagtgtttataacagacaat

SEQ ID NO: 61361 - DNA, 1025 bp, Homo sapiens
aatatttgtggttttgtgactggtttatttcacttagcataacgccctcaagattcatccacgttgtagcttgtgacaggatttcctttccttttaaagctgaaaaatattccattatctgtatataccacattttgtttattcatctgccaatggacttttgagttgtttccacctttcagctattgtgcatagtgctgctgtgaacatggatgtgcaaatatttatttgagaccctttcatttctttgggatatataaccagagatcatgtggaagttctattttatattttttgaggaacttcttcatgtagaatatttgacaaatttcattgctgttgctctgctaagctgtatctgtttgcttatttgtctagtatgatggacgttcaagattaatctagatttcttttttgcatatccagggcccatgcagaatctccaccatgtgtagacaacctaaaaagtgacatcggtgataaagggaagaataaagatgaaggggatgtttgtaaccatgagaaaaagactgcagatcttgcccctcacccagaagagaaaaagaagaaacgttctggattcagagacagaaaagtatgaaacatagtcttataagttgatcagaagtatatcttaaagtagaataatgcagttcaatctttttaatcatatgtttcagatggttcatcttcactttcaagttatcacttctttgctattttctatcatgttctaagccaaaagtactcttggaatgtgaggttaaaggaggtagttaaaaggatctaggaccaataaccatgattagcatattttttcttagttctttcagttcaactgcctaaggtgattctttttttctggatcttcctgatgctaaatgttatcatatatgttaagttgagtctttgtggtatttctgatatcgggttgtagagacagaataaaatctctttggaaacataacttctagaagaccaagtaactttgaggacagcacaaacttcaaatgactatcaagatt

SEQ ID NO: 61362 - DNA, 1047 bp, Homo sapiens
ttgccaacatggtgaaaccctgtctctactaaaaaaacaaaaattagccaggtgtggttgtcgtgtgcctgtaatcccagctacccaggaggctgagacaggagaatcgcttgaacccgggaggtggaggttgcagtgagccgagattgcgccactgtactccagcctgggtgatagggcaagactcagtctcaaaaaaaaaaaaaaaaaaaaaaagaataagaacttcccagtaattatcttggatgctgaattagttggctattgatggggcaacaaacaacacccaaatctttgcagcttacagttacacacatttatttctcaccagcattctacaggtcagctgtgctcagctggctcagctgggcttgacagtggtttattccaggctgaagtctgttcattatggatgccagtttgaaggatcagtgtctctttgggacatggtcttccctcgatggagtgcaggaacacaagaaaactaacagcagcacctcctaaaagcacttcatggaactggtccacattccattggttagagcaagacatatggcaagacatacgccaaaaacttaaagagaaggaaatttatgacctggcattcatatgcagaaggggaagaaaaaagtagaaaagtaattttgcctaagggatgggggatggaagagtaagtatttattgaacagtaatatgcactaatacagatgtttcagatttaaaacaaaacattaaaagaatttttttttaagtgaagtttgaactatagagaatctggtagggaggagggcttccaaggacctgggtgtgaaaaatatttaataaaaacttcaaagcagtgtcagcattataaggtagggggcagcaaagtctcccctcctaggttgaagtctccctacctaactccgagacattgaagtatggaattagtcctccctaggttcaaattctagatctatcacttcctacctttgtactcttgagcaagttatattttagatctgtaaaatatgggtaccagttatcttttttcatttcagctctaaa

SEQ ID NO: 61363 - DNA, 1056 bp, Homo sapiens
taagtagagatggggtttcaccatgttggtcagtctggtctcgaactcctgacctcaggtgatctgctagccaaagtgctgggattataggcgtgagccactgcgcccatccaaaaccactttattttgaacgtggtatgtaaaataaattaccataattataactaattgctattactgggtgttaactttaaaattataattaacactagttttgtatctttatgccttattctggtggttcatcattaaaacaatttttttttctgtagaaacggggtctcactatgttgcccagggtggtctcaatctcctgggttcaagcattccgcctgccttggcttcccaaaatatggggattacaggcatgagccaccatgcctggccaatcatgctttaagagcacgatagagtggatacctgtagataagatacctgtgggtaaaacaggtaacagaatgtcagttgaaaaagcaaaaaaaggtagctgtggaattggacaactgtgagaagtgattgacattaaatataattaataacctgtcgttgaaaagttaaatattgccacatcgtgggagaggtgttttagttctgtttatgaggcaagaaatggctagaagtagactcagcttttttcccccaaactaacagggtgatcaattttttgcagatcataaatgtttcctagactaatattaagttcaagatgggttttactatgagaaaattgaaactttagtgtaatatttgaaaaagatatcctcaacagttaaggatacaaataatgcttgcatttctcttcaaagtgatttaatgttgcttatttaaaacttgaagtgcttggccaggtgcagtggctcatgcctgtaatcccagtactttgggaggctgaggcaggagaatcacttgaggtcaggagttcgaaaccagcctgggcaacgtggtgaaaccctgtctctactaaaaatacaaaaaattagccaggcatggtagcacactcctgtaatcccagctgcttgggaggctgaggcatgagaattgcctgaacccgggagg

SEQ ID NO: 61364 - DNA, 1032 bp, Homo sapiens
ggctacttctcgggtctggcgggatacctgtctctccctgatgcgctcagcttttggagaggagtccgtagtcttgcttgcctcccgtcctccactttccttcaccccaacccgtcccttctcccgtcccgggagaacttctcccagtgccgggttcgcaacttggcgccgacgcccccctcctcacaggcgactgggacactctggtagccttgactggctctcctggaatttgtggatgtggttagaagtgggtgcgggagttcacagatggatttctaatacggagaaatattaaccactgaatcgaaataagtggaaaatcagtgaggactcaaaggagaaatacaaagtgcaggctactcggactgttcagtttttatcttttccagcgccttcccgttttcattacgttctccctgttttgttttcaccgtcgcattctggccggccataggctgttttgagaaagagctagatgttattgactctatgtgaatgttgggagaacagtttaaaacaaactgttcttcaagttgccttctctgtaatcttatggttgatggtttctttaccttccaattttccatgtcttaaaaaatacggtggccattagtaaatataagtagaataaatatcttatagctaagggactagagtaaaatattttatttttcctgtggtaccttagaaacgcccattttcttcctatttatcaataaatgtttctatctcacttgtttgggtggcttctttgatatgcctttgtttatattagaacatccctttggggcacgtagggaagtgatcgagcagtataagaaaggagtttgcatttcatgaggtgaaacaagttcggtgtggatagctgtaggagagtttaggtttcattggaccatatgacaaataataaacgtcagtatcttgagacaaaggtgttggccagaatgacccacctactgtgtttctggtgtggaccaggtaatgagctttttgaatattgccttatcctaaaaactttagaacccattg

SEQ ID NO: 61365 - DNA, 1156 bp, Homo sapiens
aaggcacgggacttgaacctctccccgactcgcccccaatcgcgttccctcccttcttcgttcttaacagccctgccccaaggctccctgaacggagccagatggaagttgtcccctttccctcctcctccgggcgggttggggagttctgagttgccgcggccgccttgtgtgtgccaggagagtggcagtgccatgctgctgggagctgccccggagagcagcccaggaccccggcggggccgcccctcgtcctctctcgtccccgaggggtcgggcaggaaggaaaatcaaactttattcccctctgtgacttcctctgtgtgtgtgcatggggaaccggctccctcgagatggatgctgcattgcttcaggaggcaagcttcatcctcttgggtccttaaaggtgcttttgggggtcctttcgagggctactgtataagcgtgttcacgcgtgcctgaagcgggaagggtggtcagcaggcacaggagaagcgaatatggtaagttgttgacagaggcagagatttggtggttgtattaaccagttgttgctgggtttcattggctggcagaaaaagaggatttctgtttgaacactcttgggtgagtgtgtgtgtgtgtgtgtgtgtgtgtgagagagagagagacagagtgtgagagagatttcttttttcaattgcaagagatgaatttggcatggagttcttaacctaacaagtcaggaggtttccttcccttggactttctagacctatatgtgttggtctctggccagctctgagggaaagaatgtaggttttatttgctggggctgagttgtatagtgtgattattggaggatcactgcaaacagcttgataggagaaactacaatagtaccttcaaccctcaataaacacatcgcctgccttgttctgatcataactcttaagaggaaactgaactggagctcttcggagaggatactcctaaggccaatgacagcatcaaaatcgagtgcctgaaagatctatgaaaagacctaatgctctgcaaaagcaaggttgtattgttattattagtcataggtatggaccctatcctcattcttgtgagaagattgtacctctttttatttggcatactggcatattgctttgctgaagcttttggg

SEQ ID NO: 61366 - DNA, 1066 bp, Homo sapiens
aaaaatgaagtgctgaatttgtaactgaaagcacaattaaaacgaagtgttatttctaaagggcaggaatgttatgggaatggtgacttgtacatgaatttagaattgtaagattttgaaaaaaattgaacctgattatttaaagtgtataaacattttatttttctacaattcttctgaagccatcatgtatacagctgtttccataggatagtctgtgattctttacaagaaattccatttaaaagatattgaggccctaaaaagagagagacttggccaaggttacgttagctaatacgtaagttttaggactcccactcatctgagatattctcacctcttattgtgttcttttcattgtaaagtgcaaatgctcctttacatctctctcctcccttataaaatttactattgtccattatgaaagtattgctatttcaaaaccccatgaatgggaattctcctgtaagtaggtgttgatttgagtacatatattaggtgaatatgggagcaaacaacttaccagaaagaatagatgttctggtaaaggtccctgagagacactaaggttgaatcttgcttgggagacatcctgtgtatgtgcagcagatggcagtctgcattggaatggatcacaagtccagtttgtgccacttttgttccgctgtatggtatggtaaattacaaccaggggggcataaccagttacagcactgcctaattttttaagtgagaaattcatcttttccaagtttcgagaatgagtccaaagcaatacagtagctcagctagttggtaagtgcaattatgaagttataaacttagtttgtctcttcccccttctccattagtatgtcattcaactgagtaaataagagtaaaggtacaggggcttattcaatatttttagcaccatctagtgtaatttttttccttctctccggcttgtgactgtaaccaaaactgatgtaaaatgtttgttgcctgcttttctgtatggttagtgaaggtggctgctatttttaagtatgattcttcgaagaggaactgcctttcattgtga

SEQ ID NO: 61367 - DNA, 1352 bp, Homo sapiens
accatgttggccaggctggtcttgagctcctgacctcaggtgatcggcctgcctcagcctcccaaagtgctggtattacaggcgtgagccaccatgctcagccctttattctttttttttgagacgaggtcttactctgttgcccaggctgaagtatagtagtctgatcatggctcaccgcagccttgaactcctgggcttaagtgatcctccgacctcagccttttgaatagctaggactacaggcacaatccaccacactgggctaatttttaaattttttgtagagatgaagtctcactatgttgcccatgttggtcttgaactcctcggctcaagcagtcctcctgccttggcctcccaaagtactgggattatagggtgagccaccgtgcccggactctttattctttgattaatgccataccatggctcatggatatattagaattactaggataacatgttaggaaaactaagatgttactgtggaagttgtgcactttaaagaatcttaaacgtttgccagccgtagtggctcatgcctgtaatcccagcactttgggaggccgaggcgggcggatcatgaggtcaggagttcgagaccagcctgactaatatggtgaaaccccgtctctactaaaaatacaaaaaaattagctgggtgtggtggtgcgcgcctgtaatcccaactactcgggaggctgaggcaggagaattgcttgaatccgggagacggaggttgcagtgagccgagatcatgccactgcactccagcctgggtgacagagcaacactccgtcccggaaaaagggaaaaaaaagaaccttagtgattagagttcagtaagaccttatattgaggaaacaagagtatgagtggtgaaatggcttttttttttttttttattgagatggagtcacgctgtcgtccatgctggagtgcagtggcgctatctctgctctctgcagtctctgtctcctgggttcaagtgattctgctgccccagcctcctgagtggctgggactacaggtgtgcgccaccgccccctgccgatttttgtatttttagtagagatggggttttgccatgttggttaggctggtctcgaactactgacctcagatgatctgcgtgtcttggcctcccaaagtactggggttacaggtgtgagccactgcgcccggccgaaatggtttttttcttagtagctcagcatcttaatacagaactggaaatgggtcacgcatcttctcattttcctattcaattcttttcctactaaattacacaattctttgtttcatttaaaacacttaagctgagagtggttctaaaaagtggattgggg

SEQ ID NO: 61368 - DNA, 2004 bp, Homo sapiens
ccaacgctttgggaggctgaggcgagtggatcacctgaggtcaggagctcaagaccagcctggccaacatggtgaaaccccatccctactaaaaaaatacaaaaattagctgggtgtggtggtgtgcgcctgtaatcccagctactcaggaggctgaggcaggagaatcacttgaaccgggaggcagaggttgcagtgagctgacatggtgccattgcaccccagcctggacaacaagaacgaaactgtgtctcaaaaaaagaaaaaaaaaaaaaaagcaaacatttggaaatataatgtgactggaaaagtgtggtcagcattctgggcagcaccaatctgacatgacctcatgagggagtaagatgtatttgagaagcagccactggtttgttacaactggagtatgcgcaagaatagctggagattaggctggacaatagtagttataccaatgataatatttttcaagtatatcatgtgccaagaattttacatagattatctcatttaattcttgtgatacactatgacccaggtactgtttttatcctcattttatagatagtgaaactaagttacccactgagttaaatgatttgcccagagtcacagctgttaagtgacacacagtaaatgacttaaccatgatcacacagctagcagatgtcacacctagcatataaacccccaaacagtggcttcagatcctgtctcttaaccactgtttctgtggtgagggatcagactatgaagggacttctgaagaaattgaaattttgttctgtaggtcagtgtttttatgttttgtttttaactcagcccacagtagaagtacattttacactgtaacccagttatgtgtgtgcattgtacacacataaaactaaagaaaagtggctgggcatggtggctcacacctgtaatcccagcactttgggaggtggaggcaggcagatcacttgaggccaggagtttgagaccagcctgggcaacatggtgaaaccaacctaatacaaaaattagcctagcatggtggcatacacctataatcccagctactccagaggctgagacgtgagaattgcttgaacccaggaggcagaggctgcagtgagcagagatcactgcattccagtctgggcgacagcaagactctgtctcaaaacaacaacaacaacaacaacaacaacaaaaaacaactaaaaaaaagtttcatgaaataatattttttactatgtattttatatagtttccattctgttttgttaaagaaatattagttgagacctaaattgattttacatcttaagccatagtttgaaaaaatactgcttgtctatagatgagcctctgaagaatttcaagtgggagaatcaggtgatcaggtaggtaacgctggcagcagtatgaaggccgggtggaaaggatgggaccagagaggtagaaagaccagtaaggagcatctcactggaccaaggaaaagatgcctgactaggacagtagcgttgtagatagagaaaagggaagagagaagagagatttaagaagtagaactgatagaacttggtgattgaatgtagattatcacttactaccagtagaaaggccattcaattcacggtctgtttgactttattactcaggcactgaaactttatttcttaacctttgctgagtgttcctttttacaatcatgttaaatatgctttttttctatgcctctaattttgtatttaaaactgtactgacctgctaaaattttaaattttgacctgatttaaaatttgtgattttttttttattttttaaattaaattaaaactttcctagagacaaggtcttcctctgtcacccaggccggagttcatggcaccattataaatcactgtagcctcgaactcctgagctgaagggatcctcctgcctcagcatcccaagtaactgggactacaggcatgcactgtcatgcctggataatttttttttttttttttttttttt

SEQ ID NO: 61369 - DNA, 1108 bp, Homo sapiens
agcagctaatactcttaaaacagtttcgattgtgctgaaacaagcaggactaaataaaatgctcagtaaaaatagtaatgaaaaagattgtaaagctattatgttaaaagtaatttgaggccaggctcagtggctcacgtttgtaatcccagcactttgggaggctgaggcaggaggatcacttgagcctaggctgcagtaagctttgattgtaccactgtactccagcctgggtgacagagtgaaataccctatctctaaaaaaaaaaaatttaagaaattgatacagtggcatctacctggcatgattggtgggggtatgggccatgctggacactgcagaagagagaaaggaactatttcaaagaggtgctgccaactgtagattctttctgtatatatatatttccaaagaaggcagatttttggaagtgtttattttggaactagtcttgtgtatttccattctgtccccactgtatcctgtattttgcactgccagaattctgatagctgccgtgaagcagggctgtggcaagtggccaagtgtgataaaaacctatttttcattttaaaacaatacagatgtcagaatactttaaagaagtatttaaagatagattgagtagaatggaacaaatagtaaaaatctaatgagaagattgaaggtttttcatttgcttttgatggaattacattttttggaaacagaagaataccaggttatgtctttcttgatctgttagtttctctctctttctccctttttcctgatctgtgaatgctggtgctagacactgctgaatagacaggaaaaatggattttctggtgtttttttttcttttttgaggggacccctagggtatactttgtgtgagtatctgactagatatagatatagatgtcaatagtttggttttgtttatttattttcttgttttaaccccaaagaaaatgaaatcttgttttctttttattttcagctgtgacttaaacgttaaaatgctgcctaagcacagttgagatagtaaaacaggattttagtgtaacatattacagaattttggaatattcatttacttaatggacagctgaactccagtcagt

SEQ ID NO: 61370 - DNA, 1112 bp, Homo sapiens
tctcgatctgtcgcccaggctggagtgcagtggtgcgatctcaggtcactgcaacctctgcctccctggttcaagcaattctcctgcctcagcctcctgagtagctgggactacaggcacatgccaccatgcccggctaattttttgtactttttagtagagatggggtttcaccatgttggccaggatggtcttgatctcctgacctcgtgatctgcccccctcagcctcccaaagtgctgagattacaggtgtgagctatagcgcctggttaatggctttctttttaatgattctagagcttttaacatgagaaagtagaaaatgaaaggaaactataatagatttcttgcctaaaatgggtgttctttgtaagatgaaaagtagagacaatctgagaccctgagttatggatccgaaggtcacatcacagccagcattagacagtcatagcactagtggaagaaaaggcagaaggtaaactactgatgggaatgctgtcaaaggagctcacttggaaaggccattccatcacctaaggtttttttttttttttttttttttttttggtggaggtggagtggtcctttataaggaaattacattatgttcaatcagacatacaaggacaaaaatcttttatttttaaattgtgaagtatgtcatgtctataaaaagtagaataatataatatacaacctttagcttgagaaattgaacattatgattataattgctgcccccaagtaccattccttaaacctctctcccaaaagtaacattctcttaaatttgatgtttaccatcccatgagtgtgtttatcctttatctacacctatcttatatagttttgtaagaatgttttaaaaccttatttaaaaggtattaaactggccgggcgcagtggctcatgcctgtaatcccagcgctttgggaggccaaggcaggtagatcacctgagatcaggagttcaagaccagcctggccaacatcatgaaacccctgtctctactaaaaatacaaaaattagctgggcatggtggtgggcgcctgtaatcccagctacttgggaggctgaggcaggataattgcttgaacctgggaggcagag

SEQ ID NO: 61371 - DNA, 1002 bp, Homo sapiens
tgcctcagcctcccgagtagctgggattacaggtgcctgccaccaggcccggctagttttagtatttttagtagagatgggacttcaccatgttggccaggctggtcttgaactcctgacctcaggtgatctgcccgcctcgctagtgctggttttcttgctaactacacaaattatacttctgtagtaattttcacaaattattttaccgtgaaaagtataggtatggggagaggagatagtggtatgtgaaagggccttttgtatttttcttgttttggaatgatttccaatcattttcaaacagaacctctaaaccaaagagtttgtgtggcttggcaaatgaaccagaattttttttaatttagtacttcaaggtttctaaattttgtaaacttgtttctgaaactagtgaaagcctgaaactagtggatggcctaagacttttttaatttaaaaaatgtttcttatttcttcattgtttgttagggttctatcagttttttatattccggacacacagagatggggtgaatttgttttcctctttcatcatttgtgtgtgtgtgtgtgtgtgtgtgtgtgtgtgtgtgtgtgttggagtctcgctttgtcgtccagcctggagtgcaatggcgcgatcttggctcactgcaacctccgcatccctggttcaagcagttctcctacctcagcctcccgagtagctgggattacaggtgtgctctaccacacctggctaatttttgtatttttagtagcgatggggtttcaccatgttggccaggctggtctcgaactcctgacctcatgatttgcccaccgcggcctcccaaagtgctgggattacaggcatgagctaccacgcctggccaatttttttcttgtttaatctaaaaatatttctaaaaaaatttgtttatgagctgttacttcagttccccccgccctggtctttttttttttttttttttttttaaagagatggggtcttgcttgttg

SEQ ID NO: 61372 - DNA, 1335 bp, Homo sapiens
ccaatttttatatctgttgagcttatcatgtgattgtcaaatatctattattactattttttttgagacagagtttccctcctgttgcccaggctagagtgcaatggcatgatctcagctcaccgcaaactctgcctcccgggttaaagcaattctcctgcctcagcctcccaagaagctgggattacaggcatgcaacaccacgctgggcaaattttgtatttttagtagagacggggtgtctccatgttggtcaggctggtcttgaattcccaacttcaggtgatctgccccccccttggcctcccaaagtgctgggattacaggcgtgagccactgcgccctgcccaaatatttaatactttgtttctggaaaaagtattttagagtttcttacggtcaatctggatttattctaggttacaactaattttttttaaaagtgctctcttgtcctaagggtcactgtgataactagtggctaagaatgacttaaacaaggtcttttcagactttctttcttctttggcattatatgctgaggtacccacattagcaggctcaagagggcctttacctttgacatttactttacttttttctattcttttaggtctttcactaccattcctacagtgattggcaagataccgtttctacctcactctccatgtaccatgccagtgacatcttagctgctagagtgtggagctggcctgtgggagtcaagtaagtgccttttttactatttggcatggtttttgcttactttgcaaagccatgtagaggagcttcttaagattagtttttaaaaaggcacttgcttgatccttgtgggctggctctttgctccagcctgctattgaacacttggtagctaacatggggctgagtttagtgaggtgactgttgcacaatagaatatttttactatggtacaccctaagggataatatatctgatcttagcctgattagaccatattggtaaacaaccccaataaatcagaactatgctacctcacacagttactctggtctcctggaaatttaatagggtgtggatgaccaagggtctgtctgctggtgtaaaccaactggattgcatggaaacagggcagctctcctaggaaagccaattaccttggcatttatcttaattaatttggcttaatatatggaagaagtaatggttgaggttaatcaggtatgggtttctatgtttatcattaaagttgctaaaacctggtatcttacttttgcaggtcatcttgtaaattttgcctatataaattaacacatcccctgtatgtcataacaaccatgtaagggagag

SEQ ID NO: 61373 - DNA, 1101 bp, Homo sapiens
agtggtaggatgttattactattattggattctctaaaggttttataggctgggcgtggtagctcacacatgtaatctgaacactttgggaggccgaggtgtgaggatcgctggaggccaggagtgcctaaccagcttgggcaatatagtgaggccccattaaaaaaaaaaaaaaattagttgggcatgcccctgtagttatggctactcgggaggctgaggtgaaaggatcgcttgagcccaggaaatttgaggctgcagtgagctgtgatcacgccattgtactccagcctggatgacagagcaagaccctgtttcttaaagaaagaaaggacttccagattcatggaagaattattacagttaaaataccagtcagggtaatggaaattgaggaccagagttattcaaggatcacagagcaaatcagtgttctactactgaaatcagagggtaggtctcctgcctcctttcctagggttccttttgctaggtctcacaacatattaggcgatgcttgttttccctactatttgaaaggtgcacagtctatttcctttctctctctctctctttttttttttttttgcccctgaagtaaaagcaaagactcaatgatttaaaccacaaagatatggttgttaagagtatcggtcttaattggagtttggatgcttttattgtttgaagataactaggggattgcttctttttttttttttggagatacagtctcgctctgtcgcgcaggctggagtgcagtggcacgatctcggctcactgcaacctctacctcccgagttcaagcaattctcctacctcagcctcctaagtagctgggttataggcgcccgccaccacgcccgcttaatttttgtacttttagtagagacgggctttcaccatgttggccaggctggtctcaaactcctgacctcaggtgatccacccgcttcagcctcccaaagtgctgggattacaggtgtgagccactgtgcccagccgggattgcttcttaatgagtcactaagtgcttatagtatatactcagaaaggttggcttagatggaataaaaaaagaagttagagccttgttcataa

SEQ ID NO: 61374 - DNA, 1003 bp, Homo sapiens
gtctgcatacttcccagttgtaacctctgtctccccatgctcctgaatgccatgaatagattactccttaatcaccaagtgcattcccacctttttcttagccctttcactttgcagatccactgactattaggccctgacttgttccgtttgttcctttctcatcatctcactctatccatccttcaaggcacagctcaagtcctatctgttcagtgacttcttccttctcctttccaatttatagaatactccttagccctgccacacattttatacttccattgtgttgaatctatctttttatatacggatgctttagtttaaacttcagattgtaacctccttgaggaaagggcttggattacagattttacttgtattctctgcagtgtcttataatagatgttcaacaaatgtatatgttgatcaattgaaatgataatagaacccttaatagctgaagatatgtaacgtgcatctaagactcctggttatttgagcttcttgaagtactttatacatccaactaacagtcttaattcagaaccaggaatgacatgtttaggttagagttagatactgatttctagacaggaagcttagtaattgttgctacatactgatccaagtaagaatagttctttatatccagagcctgaatgaaagagccagtggtgagacagtgagttgattacttctcactgtttcaccactggctctttggttcatgctaacaatgtatctcacctagattatattaacagctttctaattagtctccctgcttttgttctttcttacctctggtcgtaattcagcagtgggaatgatgacatcaggcagaaggagacttattcagtagcttctgatctcactcagtaaaagacaaagttcttcaaggggcctacaggtagtgacaataaactggctctctggagggggaaaaggttctgatttgtagcatttgcctgttttactggtataattactcccactctgg

SEQ ID NO: 61375 - DNA, 1050 bp, Homo sapiens
aaaaaaaatcaaaattcagtatttgaaacacttctggtccaaagcatttccaatgaggaatactcaacccatatttaataattactgccagattgcttttcttagccaacttaagagtctttccaaggtcccttctggttcatgtaaggccataaaatatatagtcttcttatagttgttagttataggatttttctggattcttaaaaagactttaagagttctatttataaaattgataatcttctgaatgactgtgttaccttagtacaaaataaaacaaaagtctttcatcaaagctctagtacctggaaaatattctaatagactagaaggtaaattgagttgagacaaattttaatgtatggctttggggatggcggttgggaaataaaggccgttttggcaatagatttttatctttaaagtgggtatccacttggttgcaagaggattaattataggaatctcttcctcttgtagtctctcagcttgaaaagataaatatagagcaccagtgctcagagagggaatgctgtagagaacgtgtgggtagctgctgtagttttacacagcagataacatctagaataaagaacagatgaaaatactcattgaggattagtgttcttgaaacatcatcaaatggaacattccccaagcctggcattcagagccattcataatcttgctcatcttgcatgtctgataatatctcctatcgagcccaacatacttttccctaatcccactttactctctgcctgctacattcattcccagtgccagacatttgttttatcctttggaagatacatctctgcttttctacattcctgattacaatctgtcttttcagtactccaatcaagtgtcatcgcccttcataaagcctctttgctttctctagaccacattgatcctttttcactcttaactcctagagtactgatactttgaattcttcgtgttggttcccgagtatgtatttgtgtagcagtaggaagttttttttgagtgcctcttgtatgggaagcactatgctacata

SEQ ID NO: 61376 - DNA, 1073 bp, Homo sapiens
cagcactttagcccattttcaaattgggttgtctttctgttgttttaagagtaaggatgccttttttaagctcctttttagttcattatgaatctggcatctattcatttagttaatctatttgataactcatagaatgttttttcaaagaaggcagttttgtgcccttttcagtgtccttcagttattttaaatgctgatcagcaagagattaaactataattctttaaaaaatgagatagagactgttgatgtgaaaagacagatatgtgaaagaaattataaagcactgctaatatagatcaaacatgataggatctggtgaaccgaattaaagctctagaattcctgtgggaatctgattgagcaggtaatctacaacttctgagtgtgtcaaacaactgcccttggtttctggtatgctccttaagcacacttccttatcaggaatataagaaacacctgtgcttagttttgcaagattttgtacataacattttgattatgtatttgttttacctttcctcaccaggaatttgggtttaaagaattcacagttggtttaactagatcatgtagctatggtgtaccaacttttgtaggagcaaatgaaagctattgaatatattcttaccttgattaaatgataggcaagagcatccatgagacgaaaatggcccttttgagtgttttttctacatttagtgaggttaacataatctttcactaagagcatttatgccagattaatattaaatggaagaaaataatagtgctgaaagaaatgtagagagggttggaaaaagcacaggttttggtgccagactgaatttcagatcaaattttaactctccatttcctccttgagtgacctcggacaagggaattaatctctctaaacttcagtcttcatctataaaatgggatggattaaatctatcttgaggctgggcgcagtggctcacgcctgtaatcccagcactttgggatgctgaggcgggtggatcacggggtcaggagttcaagaccagcctggccaacatggtgaaaccccatctctactaaagatacaa

SEQ ID NO: 61377 - DNA, 1067 bp, Homo sapiens
cattcttaggaaaatatttccttctaacccagacatcttttgtttttccccagatggttctgttatatcccccagagaccaagggttggccctttatgcttattaggaaagaaggattatgaccaacacttgcatcctgggtatgtttaggataaatgttgctaagctgctttagtaaatagatcgtaaacagaaactgagccacacctcctcctgccattattatcttagtaaatgtttgcttaggattttgattatttaaatgctgtagttctctcatgtacttaacaaatctgtaacattttgtcagtaaagagatttattaatatgcttcctttgccttagctcaatagtgcccttttgatgattttttaggccaggcatttagcagtctaaatggtggacaatcttggacattgttgcgtgctgtcaacataaagctgtttggtgtttgagatggtagtgctaggaaaaatgtgttagcatttgctaaaagagctttcacaggctggtcgctttcaatgtttaaaaaaagtttatgtaagactgttgatacttcactacagtgttcccaaaagctttctagtcttgttagtgaagcgtgtggggtatatgaattgtggtttaaactctaaatggccacagacatttttcttgaatatgactcttaacttgctttctctaaacttcagtttgatactatagcggttgttgataccatagtagttgtgtagttcaaattctccagtcatgagttttcattcttggatatggtagtgtctttgaggtcaggaagaaagaacagaagtcactaatgttaatagcagaaactttaacattataggaataaaagtggtaataatagatgagcagaaacctcaattcaagaaatacttgtttcaaaaaattattattctgtaccttctgtgtaaaatgcccattgctaggcctgggccccagactttaaagagcatatagtctagttgtattgggtcgataatttgaaatgtaaagagagggggtaagggaagcagccatgtatgaattccttagaaggaaagttggcg

SEQ ID NO: 61378 - DNA, 1780 bp, Homo sapiens
tctgttgtgttgccatttccccctagaggttctctgcatttttatgtatcattcagctatttttttagacttaagtaaataatactcagaaatgaatatgattcttataaccatcgttttcatgtgttctttggatgcttgcatatttactggggagagtgattgtgtgagaatcctatcagtaggatttaattaggacaaagtggaagataagtcaaacatgtcttgcctgcaaactttcacacatataagtgtgcctaataatgaagaaccattaattttaagagtatgtggcccatgggcaggggctgaactatagataaattgcagggattgattatacccattaggggagacagaaaacaccagggaacccaagttaggaaaagtctttctcctgaagatgtaattagagtggcagcttgctctttgggcaactcctgaggtgatttctagggggtgcaatgctataaatgctgctagggattttattcaaggtaggaagtcagggaaagggggttaacaagttttggtatcgaatggacatgtgagaacatgtgagagtgtgtgagagagtgaagtgagagagtatgagagagagggtgagggggagagagagagagaggaagagacttgatcatcatgttgtatttatggcattgccccgtcattcactgtctcgagaaaagtgaggggttttgggctgggcgtggtggctcacacctgtaatcccggcactttgggaggctgaggcaggtggattacctgaggtcaggagtttgagaccagcctggtcagtattgtgaaaccccgtctccagtaaaaataaaaaaaaataaatgctaggcatggtggcgggtgcttgtaatcccagctactcgggaggctgaggcaggagaatcacttgaacctgggaggcagaggctgcagtgagccgatattgtgccactacactccagcctgcatgacagagtgatactccatctcaaaaaaaaaaaaaaaaaaaaggtttttggagcccctttaatatatctttatgggggggagatagtaatattcactagaattcattcctttattcattcagcagatatttactgaatacctactgtatatgaggcactgttttaattattagaagcattttttttctgtacttgtacatttaaggtgctatgcaagtcatgtttctacttctagaagcttgtgcaagttatgcagattagtgtattatgaacttagaggcaaatgaaaaaaacttcaacaaatacagattaattttgcattatcacctagaggggtggatgctttcattggaagagtggctatgaggaagtcatgaaagatttatatgtgtatgatggaatttgagaccaactaattagacttgaaaataaccttagttctgcatagtatatttctatatgaaattctcttggtgcctggcagcagctgattctaagaagctgaggaggatactgttctatagtataactaaactctgcccctctttccagaaatccagccatttgtgttttgtaggttatgctgtagctcatcattttcatgtctctcccttaatagtttatatatatatatgtatgtgtatttatatgtatgtaaaacatatatatgttatttatatacataaatatataaaatatacatgcatcttccttttatcccactcttaatataggaggtattttctatatagtttacaaattctttctctatattatggaataactatgtataactatatagttgatcttttggc

SEQ ID NO: 61379 - DNA, 1039 bp, Homo sapiens
ttattgtggtaaagtatacataacataaaatataccattttaataattttgacgtgtatagttcattgacattaagtaccttcatgtagttgtgaaccattaccactatccacctccagaacatcttcattattctgtactgagtggctatttttaatgtttctaggtggaagggcatcccagcttttcctgcctgtgttttgtttccttgcatccagtttttctttgctgtttggtggtagtggacctacttctcctcttctcatttattcactcaacaaatatttgttgagcatcttttgtgtgcacagtatagcgtgaaacctagtggaaaactatagttatagtattcgaatataagactgtctcataccagccacactggcgttgcagtaatttttcaaaaaccaaaaagaaaaggcctccataaaatacttgaattatagtcaggcttaaaatgaaaaaatatttgagcagaagctccaagtcacatcacatatctggagaattagaagtttttttgtggttgtaaaaaacaaagatttttcgtacaggcgttttaactttaagtagaggcataaatgttatctgtgtctatgtaaatactacctcacttttcagttggataaatctgacttaaatgctctgattaagttgaatgtttgaattgtatctattagaacagtatcctaagcagcaagcccaagtctgttattttcaggccttcttctggttctagggtatgtaataagacttcagtgtttgaaatgtctgaagttgtctccaaacagagattacactagcccttatgtgtttggggattctgtgctaattgcataattgtaatgtttagcagccatctgaaatgtaaacttaatgccaaatttcttataattgcttccatggaaggtaacccagggttcagaaaaaaaataacttatttggacttctaatccctgccgactctgagatatcaagacatgtagttattatgtactgaattggggaggtgactaatttatgatctctatctagaagt

SEQ ID NO: 61380 - DNA, 1036 bp, Homo sapiens
ttacaggtgtgaaccaccacacctggctaattttttgtgtttttattagatacagggttttgctgtgttgcccaggctggtcttgaactcgtgagctcaagcaatcttcctgcctcagcctccaaaagtactgtattacaggtgtgagcccggccaaaatcagtttttaaaagaggtttacatggccgtatggtattctctttcttttttggaaacaatactatttgtaccatgttgtgttatcaatctatgtttggattgttagcatttaagaactacatttttcagtagattgctctaggttatagccactaacaattacttatacataaaaattttcttttgagtcattagccaatttggggggcctctcaggagaaactgcataattcactgggtgaatgcaagttcattgctcttggaggctgtgatagcataatcattgcttgctgtattcatggtcagtacaccttctgatttgtttttagtagtagttttgccatattcaaagaagagctcaatctgaggagactccttgatttgaccttactttggcatagctagcatattaccttaagttagtgtttgccatctattttgttccctgacattctctgttgacgttttatgccccgccccccgtgtccagctcccctcctcacaatccctgccccctgctgccatctttagcactggaaagttaagagttttgatctcagagttcatcaactcaagcttttgctttttatttgtaaaagaaccatgtgaagctgggctcagtggcatacacctgtagtcccaggtacttgggaggctgaggcaggaggattattcgaactcaggagtatgggtccagcctggataacgtaatgagacctccatcttgaaaaaggaaaaaaaaaaaaaagaaaagaaccatacgaaagtacataagtgtatgaaaaagctacttaacatttcaaaaagcagtaaatggcacattgtcaagtgagtggttttatcagtcagggtctcacaaggaaaacagaaaccattt

SEQ ID NO: 61381 - DNA, 1266 bp, Homo sapiens
attgttaaggtttagtcaggaagcaggcacagatagtgatagtataatgtcataaaactgttccccagtgtattaggtgttttttttttcctgcagtaataaattaaaataacaaatttattatcttgcatttctgtaggtcagaaatctgacagaggtcccactgggctaaaatcaacgtgtcttcagggatgtgttcctttctggacctgtgagagcagaatctgtttccttgccttttctggtttctggagactacccacatttccttggttcatgatttttttctccatcttcaaagctagtgttttctgttcctttcaggctgccatctctctggttctctggagctggaacaggttttctgattttaattgattaaataactgtgattagattgtgcccacctggataatcctgggtgcaaactttttcatttttacatcaaagtccttagccacatctgtaaagttccttttgccacgtaaggtaacatattcactaattttgaggattagggcatggacacattttggggtccttatttcacctaccatactaaggaaatatcaaagagtctggcacctaacccagtttaggagcccaggaaaagcttcgaggagcagatcagctgggtctcaaactgggtgaagcgggagtatgagtggctgctggctgggtgtcaaatgagtgagggaaaggcatttgagctaaggggagctacatgagtatatatagaggtgtgaaaaagaatgggttttaacattaatttttattttttaaagaatcacaaatcagtaaaaatgtagtatgaaatggtagcttggggatgagtagggatggagagaaaggtttgattatggtgggactttgcatactgtgctttacagcttcagtttatcctgtagacagtggcatgacattgaaggatttgaaactggcgagtgacttgattagatttcactttaggtagatcatattcagctgtctggagggggaataggctggcggtaaagagactgaaaaggcttttactatatagttcaggtatctttatatataattcagctgattaagtttttggcttaggtgactgagtcataccatcagagataggaaaatacagaaagaaagctatgagaggtgtaaggtaatattaatactctccccttcacactccccttccacacacacacacgcatgtgctcaaccaaagaatgaaccttgattaaagtcagcctaaatttctattttttttctctaaaa

SEQ ID NO: 61382 - DNA, 1040 bp, Homo sapiens
gaagatgctcaacatcattagtcattatagaaatgcaaatgaaaaccacaatgaaataccactttatacacactgcatggctataataatgcgacagaaaataacaagtgttagtgagggtatggggaaattggaaccctcattcattgctgttgggattgtaaaatggtacagctacttaggaaaatagtttgtctgcctctcaaaatgttgaacatgtatttcccatagaacctagcaattctacttgtaaatatgtatatacccaatagaaataaaagcacatatctacacaaaaacatgtacatatgttcatagcagcattagtcacaatagccaaaaagtgaaataaccctaatatctgtcatctgatgaatggataaacagaaggtggtatatccatacgatggaatattattcagcctagaaaggaatgaaataccgacacatactataacccagatgaaccttgaaaatatggtaaatgataagaagccagtcacaaaagaccacataatttgtttgaaatgtccagaataggcaaatccatagagaaaaagtagattagtggttgccagggcctgggtagaggataatggggagtgactactagtgggtatgaggtttctttttagggtggtgatatactggaattagatagtggtgatggttacataactgtataccaaaaaccacttaattgtacattttaaaagggtgaattttatggtatataaattatatctcaaaaggattttttaaaaaatagctgtggaaggacaaaatggaaaattaagtctgccagttattttaatgttctgaagtattctttggctaagtgtgtgtgtgtgtgtgtgtgtgtgtgtgtgtgtgtgtgttgggtgaatttggaagagaggaagagagataactgttgtcatcatttgttaaaacaaatttgccataatctcttaccatagcaggaacaccagggctacttgatttagatgaagtcactcagagcttctctcctgctgccctctcctaaccttcccatcatc

SEQ ID NO: 61383 - DNA, 1064 bp, Homo sapiens
tagttacattatatgtagagcctccagatactttaaaatagattatgttttacattccttcctatcctttcagaaccatcaccttcatgtccaaaacagtgtgatgctattcattttagaatattattgaggacatcacactggtggctctttgaagggatgtgttttggactcaggtgtggaactgccacatgccacttattcaactctttggcatctaggaggctttgcatatgccatgtgccacttattcaactctttggcatctaggaggctttgcatatgccatgtgaatcctctcttcctaggagagtttacttagtggagcagtgttgggatttctagcctggtttcttctgaggaaaaaaacatgtcaagttaaaccttccaggataaagagaggattttgttggggggagctgttgtatctgaagtgttaatatagagcaaatgcagtttattttctcaaaggaagggagagagatcatgccaagaaaaacgcatagagtggggtggagtggagttgggaaagaaaatgtgacaagtacctaaaatcaaatgcctataggaaggattttccccatgattagctccaaatgttggggagtggggaggatgttgcttgtttctttctttatttctttttaaaaaattgttttactttgttcttgactctttagtttcaaaagcagattaaggaaaagcttattaggaagtctagagccataggcactatagaaattaccagcccccaaaagtcaatacccagttactttacctttttggctgttccacgtaattaaccctgctgcttgatccaagtgaagccgggggaaagccgggcaccgttggatggtgtagctccttgcttaacccctcatgttgtactgcaaagatgaatgcccacttacctggatctctcaggggatgacattttccaaaagaagattttcttctgctccctcttgagaacaatataaagagtatgtaattcagagagattactttgaatttcactaaaagggaagtacaaaggctttgttttttcagatcctatcaaatta

SEQ ID NO: 61384 - DNA, 1052 bp, Homo sapiens
ctgcaattttcatcttggtttaatttgcaagaaaaacattattatgtacgtatagctacttgttttaatttagtgtcaattgtcaatgtcgtagtagaaatggatgaagaaaatccttttggaaaggagatttttatagaaatcaaaggagtattgcccagcaactcttaataggtgtttactgaatatatactatgggaatgtattgcacgctttagagattctaaagaataacatatccttgcctacaaggtgttgcttaccaatttgaggagatgaagattgtccgtagaatagggactgaacaagcactgtgtgaaaaaacggtattatgctgtgcaataaaatttcaagaataggataatacataaaggaacgatttgctgtggagatcatttcattatatgtgagattgatgtccagagatgtcatccagtttagttaatgtagttctggctagctgtttgtggaattctggctagtttgtttttttaatgtccttatcctgtttcttgtgttatacttgaacacatcaacatagagtgagaagttactgtttttgttacctaaaaatgagtcacatagtaaaaagagatgggttgagaatcagatatatttgatttcagatcctggctgtgctcattcttagctctgtgtgctctgtgtgcctcagttttctcattggaagaactggaatgtaagttactaatttacagatttgttgggattaaattattttgaagcatggctgggtgccatggctctttcctataaccccagcactttgggaggctgaggcgggcagatcacgtggaggtcaggagttcgagaccagactggtcaacatggcgaaaccccgtctctaccaaaaatacaaaaattagcagggcgtggtggcaggcgcctgtaatcccagctactcgggagattgaggcaggagaatcgcttgaacccagcaggtggaggttgcaatgagccgagattgtgccacttcactccaacctgggcaacagagcgagacaatgtctcaaaataaataaataagtaaaaat

SEQ ID NO: 61385 - DNA, 1020 bp, Homo sapiens
gtacctatgtaaatctccctgagtcttaataaaatattttaaaggttcattctggattttatatttgcccagagtgcatttcttcatttgagaatagcttgctttttggattgaatgaaaaaaatgtttatttttcaaacccagaaaatcctaggttatttatattttcttaaaattttccttgaaaatgagtttttaaaatttataccacctctcttccatttctatttaactatagacagctagaggaagaaaaatagtaccttcaaaattctgtcctaaaatctcctcattgagctcattaggtatatttcttattttccacattaccataggtgactatattgccaagtttttcaccactctagcttccaataaaattttcctcactttcctgtaagttttcatcatcaccttcctcaggcccaccctgcctccacctgccatcccttctcagtcagtgccacacatttttggtttttgatatggcatcatcccacttccagtaatattgactctgggttatcaagttaaaattgtttcatattcagtatgttttaagaaaaatgagtaaattttagaaacttttccattaaaactgctaaaaatttgaaatgtgtatatatgtatgatacggtgattttaaaaatcttacttttagagatgttgaaatattagtgtataacatgatataatttctgggacttatatcagcaatatattagtgggggaaatggagtgtgggtacagtttgatcgtggctcctgatgactgaaaatgttggtggcttctgatgaggcatctattatgtggtgtctgtttcttggcacaaaggaacagtgtagttaaaaatgccactctggggccgggcacagtggcttatgcctgtaatcccagcactttgggaggctgaggcaggtggatcacgagttcaagagttcaagaccagcctggacaacatagtgaaaccctgtctctactaagaatacaaaaattagccgggtgtggtggcgggcgcct

SEQ ID NO: 61386 - DNA, 1048 bp, Homo sapiens
aacacaacacacagtttgttcagggatcttaaggcaaaaagaccctccccccagtgccttccagttgcgatgtgtcttttccaagcacagcatgatggtgatgccaaacaaccacaaattgtccacatggtggccgagatagttgaaaccttttgctttctgatggttcagtgtatagactttgtttcctgcccacagttatttaaaatattgtataaagttatctttagcctatgtgtataaggtgtatatgaaacataaatgaattttgtgtttagatttgggtcccattcccaaagtatctcaatatgtgtgagagaatatttcaaaatccaaagaattttgaaatctgaaacacttttggtcccaaggattttagatagagaatactcaaccggtaatgcaaaacagatggaaaagcctgttggtcatgtatcaagatttatttactgaatgacttaatgagtccatatatcttccaaaaaccctgtctgtagattacagcctctgaattgttctttcaatttgaaaggctgagaatcactgataacaaaagcaaacatcctgtaacagaatactgaatacaagagagagctgtgccttcctaaagaaatttttgaattcatttgtgtttggatgatcttttttaaccttgccgtcatgcatttttaattgatataatttacacacaatgaagtacacaatctaaggtgttggattattttttaaatagtttcactgaggcctagcacggtggctcacacctttaatctcaacagtttgtgaggccagaagttcgagaccagcctgggcaacatagcaagaccctgtctctacaaaaaaattaaaaaattcgctgggcatggtggaacacacctgtagtcctaggtacttgagaggctgaggtggaaggccggaagtttgaggctacagtgagctatgattgattgcaccactgcaccccagcctgaacgatagagtgagaccctgtctcttaaaataaaaaagtttcactgaagtgagaaaccaaaaattttagtgtattttc

SEQ ID NO: 61387 - DNA, 1092 bp, Homo sapiens
aatgtgatgtaacgtccagagctgtaaacgactctgaagactgcagaaacctaaccctttaattatagaaggtaatgaaaaatcaggtaaaacttgggaaagaagtgtaagaggatctgttaatttaaataccagctctctcttttttttttttttttttttttttttgagatggagtcttgctctgttgcccaagctggagtgcagtggcacaatcttgtctcactgcaacttccgcctcctgggatcaagcgattctcctgcctcagcctcctgagtagctgggatcacaggcatgcaccaccacacctggctaatttttgtagttttagtagagacagggtttcactatgttggccaggctggtctcgaactcctggcctcaagtgatctgcccgcctcagcctcccaaattgctgggattacaggcgtgagcccctgcgcccagcaaataccatctctcttgatgtctgcactatggatagcatatttttgtgatttttttttttcctgactgtgaaacaacacgattgttgtaaacaatttgcaaactatacataaattataacctgcaggtctatttagtctatgttcttcaggtctatacatacatattttttaaacataatttaggttcttgctacacactgtgttttgtaactgacagtgtgatgtttcaacacctagacccaaagaattttaaaccttaaaaatcccctaatctaaccttctgaaattggaggaggtacttgaatccaagtggcaggggatggaaaagtaaaggcagttacacacatgttcaacaaatgagggtcaaatcaaatggaagagtgcaacaagggactttagtaatggtcaggtgaaactggtaatcctgatcctggtaaactggtaaaaacctaatttgtaagcatgccatggaagtcttttatagtatggcattctgcaactgcctttaatccaagtggtacaactgatttggcatggctgctggaacggatctccaaacaaatgttgttcctggcacaggcttcttctgagcaattctttcacactgctgacattggagttttttgtttttttttaatatat

SEQ ID NO: 61388 - DNA, 1024 bp, Homo sapiens
tgaagacataaaggtggtcagtaagcatatgaaaagatgctcaacatcattacttataagagaaatggaaatcaaagccacgatgagataccatttaacatccactaagataggtataatcaaaaagacagataggactgggtgaagtggctgccacctgtaatcccagcactttgagaggccaaggccggaggattgcttagagcccaggaggtcaaagctgcagtgagtcttgactgtgccaccatactcagcctgggcaacacagtgagaccctgtctcaaaaaaaaaaaatgacagtatcaagtgttggtaaggatatagagaaattggaaccctcactgtaaatgtaaatgtaatgtaaaatattgcagctactttatataaatactcgtatggcgattcctcacaatgttatcagagttcccatgggaccccacaattctactcctagatagctatccaagaagaaggaaaatatatgttcacacaaaaacttgtacataaatgtctatagcagcattattcataatagctaaaaagtggaaacaacccaaatggtcattgactgatgagtggataaacaaaatgtcatatatccatacaatggaatattatttggcaataaaaaggaattaagtaccaatatgtgctacaacatagataagccttgaaaacatcatgctaagtgaaagaaggcagtcacaaaaagaccacaaattgggccccgtgcatgcttagaaaatacagaagatggtagtgatgttagtaatggagttctttctttatatgcaaataagcatctgctggtctctcaactgtgtaaagttgtgacttagaattgcttgctaagagactggtccccatgtgatccctaaacagacaggagaggtcagctggagtcatagacagagtgggctgaggaccattctgggttgagtgttttcagttttgaattatatgtgaaaatcatcttaactctcttatttgatcttcccttttatactgcactaagacctttaat

SEQ ID NO: 61389 - DNA, 1104 bp, Homo sapiens
ttgtgaaatagttttattgttatcattgttgcattatttttaatttaacagatgaagaaacagagacttagaagtggaaattcaaggtagtgagttgtggaagtgggcccaagtcttcccactccagtgttttcccccactatccaatgtccagggtttaaagccacagaccttatttagtatattggtagattagaagtagtaaatgttgctgatatgatgcttcaacaactttactgtatcagggatatagaaaaaaactgatcccaagttgtggaagctgttataggtgtgtcttgcattagaccaactgaaatagtttacactgctaattggagtatccgtataagcactgaattttggagacaggtttggcaaagttgctgaaacatgggtactctggtcttagaaaagaaatttttggaacattattgaaaggggttcattttttataagcattccatgttgtgctaagggaaatgtaacagggagatacaagtggtcatatccaaacttaaggcagagtgaggctatttataataagattttagccatggacaaatatatagatacagtgttccatctaaagctgtttgatgtagttaatgtagtttagtttgaggtagctaataggtgtttgtttcttaatgaaattagatcccaagattttcttaaagggaactaggttaataaggaaataactttccctctctttctctttctctctccccctgccactccctcccttcctccccctcagcattccccttcctttagcctgatgtctaactggctgtgaatatttgggggctattgacaggttatttagatttgacaatcctcccaagtttctggaaggagtatactgttgagtttgctcttttgaactatgaaagatgaattaggtatagttgaataatttatgatcatagtaaggaatttaaaagtaaattttgacttgaatttaataattttctgaggacataaaatatcttttttatcattctaatttttattggcttaaatcttatgttttggagaaataaagttacagtgttttgtaacctgactctaaattgataacactagggattaagatcaaag

SEQ ID NO: 61390 - DNA, 1026 bp, Homo sapiens
tctatgatgctataaactggcgacaggatccaaacctttgttgtttttatggtagtggagggagatgtgtttacaactcttattgtcatttctcttacccggtattgtgcatttacagtttaggttgcttagtttaggggttgactgttagatatgtttcctctgtataaagtttagtttgatagagctctgatttcaaccttagaaacattaattcgtaagcataacaaccactgaaagagcatcctgcaaatttacaagggtgcctaaaactaaagaagcccagaaaatgaatcatgagaacactagaatccccaacatttagtcagtataatatttgcagtgttatcagaatcacctcccaaagctgttacgtgaatttatagacagtgtgctcatatttgccaaatcttctaaatttggaagaaaaatccattgtgattactcatttgtaatatggaaaggttaaaaaggggaaaatagaccaaaatcaaaataaggaaaatattagctggctctctgtttccagtctcttaaagacaaaaaactaaaaattagtaccaattaatgtataagttaaaaagcagcacttagcactgtgttgtggccagaaaggtagctgtgttgcccccagtcaagagtcagtatgtacccagataacagtactttctacgtggccaagagccagaggaccataatgccacctggctatgctacatattcctttccctccttaagctccttcaatgcagtgggtgggtatctctcttcctcttgacactgcttggtccattaaatagccaaatggtgactgtccacatctgtgccagcaccactcccaggttctgacttactccattaccactgcagggtgccatcattagatagtttgaataaaaagaatttcactgttaaaaaaaaaaaagtttacattgctgaatccactcagttttgctgaactatttcattcaaaaatttctagtatttatgatagtgtttgaaattgtcatatattcaatatccaca

SEQ ID NO: 61391 - DNA, 1051 bp, Homo sapiens
tgagctatgtgatccatttgatcttttataagccagttcccagaataaccttcaactaaagctaaagggcatgttcttaaaccttctttgaaaacattttaaatcacactaataatagacccccatgcaagaatggtaataatgtgactttaacttacattgaaatccaattatcatatgtttgtgggtctttttcattcagatgttacagtggtttatcaaaatgggttacctgtgatatctgtgaggctaccatcccggcgtgaacgctgtcagttcacactcaagcctatctctgactctgttggtgtatttttacgacaactgcaagaagaggatcggggaattgacagagttgctatctattcaccaggtatagtcaccatcattattaattaccatctatccctcatttcaccccacaccatttctagacacatacatacaccacacacgtagctacaaaagaaccctatactgttaacttcagaaaacttttttcttttgcttagcacttaccaggagagaaagggatttctctcccagtggtactcagagtataattgatcggttttagcaaatgtgtatgcacagggaatctcattcaaaagcagctcacatataatgccatgagcaaggatgaacaatcaatcacattttatattattgagactttttatcattactttcggtgtagaataaatacttccagtagttaaaccctcatctctggaaagaaaagtttgccaaaataaagaagtatataatttgaaaagaatataaactaaggcactaaaaattaccattttatgtatttaatttatttattttttaatctttttaagtttttttcccattgtgttttccccatttttactttaaaatttttcaaacctgcagaaaacttgaaaggtaagtacaataaatgcccatttacccttcacctggattcaccagttaacaattaccacatttctactcatctggcaatataattagtagaccagctggtggatgtataatactttgctaaccccagcgtctatctcta

SEQ ID NO: 61392 - DNA, 1042 bp, Homo sapiens
tactggttcgcaccccaggggtgggggaccactgctgtaggacattccttcttttcaatcctgcttttaagaattgggtttaggcctggtaaggtggctcacacctgtaatcccagcactttaggaagccgaggcaggaggattgcttaagaccaggagtttgggaccagcctgggcaacacagtagcaaccagcctgggcaacacatctttttaaaaaaaaagaaaaaaaaaaaagaaagaattgggtctaacatagaaaagttctgagtgaaaccctgttattaaattcctctataatctggtccccatctaccttttaaaatgttttctttccctcctacatgttgcctactttctctccactgtgtattccttcatggtttcctgaactatgccccgttcttttccatctcactgtttgcccactttcctctgcctaagatgtctttcttcctaacccctgttttctcaagtcaaaattgtcaatattgactcttccaataagcctttaatgatcatactctttctgtctctgacccctgaccaaccaaaaatgattaatctcttctctgaattttgcttcgtccttttctttgatgctgtgagggaaggcactgtgattttgtattccccattgattccttctatattgagtgaattaaatgtgttcgctgggtagcattttgattgtgcagaggccatattcactttctttaagctaaatgagagggagctagctgggagaaagtatagaaaagtatccttaaatagaatggaaagatattctttaaatacagttgattgttgaacaaagcaggtttgaaaaaacttgcaaacgaaccacataacctagaaatatccaaaaacattaagaaaagtatgtcatgaatgcatgaaatatatgtagatacaagtctatcttattttattttatttttgagacggagtctctctctgtcccccaggctggagtgcagcagtgcaatctcagctcactgcaacctctgcctcctgggttcaaattattctcctccctcagc

SEQ ID NO: 61393 - DNA, 1025 bp, Homo sapiens
gtctttccctcttacctgggttttacttttccccactgctaccacacatttttgtgaaaaatcttagataaattattacagaaataatcaaaaagcagagggaaaagtagaaacagacaactacaaagaaataaaatgaaaaaaaaaaaaaagtaaaagtaggcctaaaaatgtcaatgtgctagtgttaacaggatggagcaaacacaccatcttctcacttgctttttataaaactttctagagaaatgtccatgcctaaaatagttactgtaatcaactgaggaataatttatacaggaagaagagggttggaacattccttcagtttactcatttgaagaaccgtggctgtggataataataataaccatgcaagatagggctgggatttattttaatttttgtaaaacttacctgagcaattgcatccttgagttgattgtatttctctaggtcaaaacgtgactttttggctcctttatggaaaaatagtaagtattgtctgtctctggcttctggataaacatattcctaaaaaaatgaagaaacggaattatcagtccttagcatactatcttcacaaaatatttactaactgctgcttagattcaatacatatgtatgcgtgtgtgctgacatgtgctgtgttaagtatttaatcaccacctgaacatttctactgtgaaacatacagaacagtacacacaaaatgtacatcacagtgaatcatcacacaatgaacatgctactcatcaccaggttttataaaaatagaactctgccaacaatccagaaactccctcttgccccttcccaattactcatatctctttcccccaaagtaatcactctcttgacttttatggtaattgttttcttattttctttataacttacctccttaagcatgtattcctaagttccacaacttagttttacctgttttatgaattttatgaagatggagtcatacagtatatatttatatggctaccttcactcagtattaggtttgtgaaatt

SEQ ID NO: 61394 - DNA, 1921 bp, Homo sapiens
acttgatgagcatacaatagcaatggttgataagagagttgttcctttagagtgcaaagtttgtgttcattattgtctttgtattttggaggctgtactttgaaaacaatacataaagcaatattctactcttacctgtacctgtatcttaggtccatttgtgtctcatttcaagcctcacattgaacattggaaactgtaagaaatgcacatagactggcaaatatacatgtgtatacatacatgtatgtacatacacgcacacaagtgtgtacacatatgtatataggtatataaaatctgtgttttcagcatttagccaagtttttaagtagcatctgcctttatccggttttggtgttgaacttttatcccatgatgaaactttgttatagacctagcttttagaaactaattaaatactgattagattaagggggaaaattaatatattacttttctctcacagtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgattttttttttttttttaatggaaagtcctgcataacaacactgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatcttttttaaaaaaatgtttgttttctgtgtggtgtttttcgtatttaaatccgaatgtatgatgtggcagtaacaggttaacttatgtaatttctttagtacatagggcttaggtttatactcttggtttccactcacactaatgtcacatggttaagaaaaacttaggctctctgaagtttcagatatttcatgaatcaagatgtgcttccttcaaagagagctctaaaatactttactgtggttatgaagttattatgggccaggcatggtggctcacgccttcaatcccagcactttgggaggccgaggcaggcggatcacctgaggctaggagttcgagaccagcctggccaacatggtgaaaccccatccctactaaaattacca

SEQ ID NO: 61395 - DNA, 1005 bp, Homo sapiens
aggctgcagtgtgctctgattgcatcactgcactccagcctgtctctggtggggggtggggaggggtacatatgtagatatagatctatatatatagatatctatatatgtagatctgtatagagatatagatatctatatatacatctgtagatatagatatctatatatacatctgtagatatagatatctatatatacatctgtagatatagatatctatatatacatctgtagatatagatatctatatatacatctgtagatatagatatctatatatacatctgtagatatagatctgtacatagatatatagtagctgtcctttgtttttcatccctgttttcataggaactcttgttgattttaaatatttttcatttctctgtaaatacctgaccatgatctataaaagtccaaaaaatgaggttcatagattttttttgaatagtaatctttatagttcttttctttcatgctttgtgtctttccttcaggtagcaaattatggagttggaggacagtatgaaccccattttgactttgcacgggtaagtgaaaaagaaatggagaaattcactgaggcttatgcattacattgtttgtctcaaaacaaaacaaaaaaacagtctcactctgtcacccaggctggagtgcagtagcacgatcttggctcactgcaacctctgcctcctgggttggagcaattctcctacctcagcctcccgagtagctgggatcacaggcatgcgccaccatgcccagctaatttttgtatttttagtagcgacagggtttcgccattttggccaggctggtcttgaacttctgacctcaggtgatccacccacctcagcctcccagagtgctgggattacaggcgtgagccactgtgcccggccgcattacattgttaaagaaaaagttattcttgacacttgttaaagatggtaaggcagacttcattcaaggggggaccattgcgataggtatagggaccac

SEQ ID NO: 61396 - DNA, 1064 bp, Homo sapiens
taacttttcaaaacttaagcagtaagcagaatttttttcttataaaatattagcattatgtagctcagactaaagaccccatgacttccaccatagtcagttcctataccttacctggaaagaacgttgttttgtttggtatggttttttaaagaattttttgaagttctcaatgtaggtggctttcaatatagcctccttacattaatccaactgttttcatataagcattataataaatttgattagttttttccttcccaacctctaacagtagaatgtgacatttaaaaaaaattacaatatccattaataaagatgatactaagcaagaaaatgaactaaatgccttcagtaaaggtttattgtcctatatattaaatattatggctttaaaaataacagctattagtctccatgtaatgaaacattatcaataaaactaatattcctcttattcttagtgcctggctctctggctatgaaaatcctgtggtgtctcgaattaatatgagaatacaagatctaacaggactagatgtttccacagcagaggaattacaggtaggtaatcacattatccttaagtcatttttacacttcaggagatgcttgagaggagatttcctgacactgaacaggcagtcctcaatttgcatgatagtttgggaccttaaaaagtgaccctgtaagctgcaaccatgcaaagtgattttaataatgggaaaaattgtgattgttctgtgacttttaaatttcttgtcaaaacatgaaaactcttatctagggaaatgaaaaatatagatcactaatacttactaagtacactgtaattttttttctatcccccaggcctcactttgcctgtcaagtggccagggtgggttttaaaaaatagtgggtttttttcctttttatttatttatttttaagcaaacagttttcctttatttgtaatagtgaaacataggacttttttcatcacttctctttttctgttacttttatgtctataaatcatttgtcatcaaaagtagctgtcccaaaataattcttcttcactc

SEQ ID NO: 61397 - DNA, 1036 bp, Homo sapiens
acttattttttctttttcagagctatccattttttattttgcccttaaaaaaattcctttttttttttttttttttttgccacaagcatttaactgtgaggtatttaggaaaacctagttttttttttcttctagaaactttttgtctctgggtgctttccagttactttgtgccatttagagcaatgccaggcattcatttaatattttcataaacatggcttttttttcatatttaaacatttgaactttattttgatgagtgaagggttaaaagagatacactacctttctccttatttaagacctcgcctctctcacccagaaaataatcattaatactgtatttaaaattctgaacatcctgtttgaggcaaaatatttgcagagtactgcttcttttgtatgtttttccagagatactctgtatatgcaagcatgattattgtctcttatctgcataggaatagatattaaaagtattattactgtaatatattcatcatattcttaactttatgtttagacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaagggtaaataatgttttctttctttctcctcaatttactgtacctttgtatcaatttttctttgtaaaaaaataggataattgatatacgaataatgccacagattttttaaagatattttgcctcagcataatggagttactaatgatgctgtgtttatgccagtttttccatttgttatcaacacaagtaatgtacccttaactgggttttaagcactgaattatgaaaattattgtgagatttttattcaccattaacaaatttgtgtttcactgtcttcctgataaacttttctctgtattttggagtcttttaatctcagaggctactcaa

SEQ ID NO: 61398 - DNA, 1181 bp, Homo sapiens
ttctcaaagtaaaagcaccagttgccacctttaaataaatagctgtttctgtctccagaactgtcttttttgagacagggtttcactccttttgcccaggctggagtgcaatggcatgatctcggctcactgcaacccccgcctcccgggttcaagtgattctcctgcctcagcctcctgagtagctgggattgcaagcacccaccaccacgcccagctaattttgtatttttagtagagacgaggtttcactatgttggtcaggctggtctcgaactcctgacctgaggtgatccacccacctcagtctcccaaaatgctgggattacaggtgtgagccaccaggcctggcccagaactgtttttatataggtgactatatgtcctgatttacttgggggcagtagtaacttatacctattattttggtataataatttttattagtgcctcctttcactcacaacagcaacctggtttggaagataaattataatgtctcctatttttatattactatattctgatgcttgaacaagcatgaacttacccatggacatgctttgtttctcttctaatagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatggtaaagtggaaaagccaattgtgtgtatgtgaatgtgtgtgtgtatgtgtttgtacacagttctggagagaatcagttattttatatttaagcctatgtgataaaaatcagaatgactgcataaaatattacagtatgtcagcttaggcaacatagaccccattacaaaaaaatttaaaaattagctgggcatgctggtgtacacttgtagtcttagctactcaggagtctgaggtgggaggatcacttgaaccaggagttcaggggcacagtgagttatgattacaccactgcactccagcctgggctacagaataagaccctgtctctaaaaaacttttttttttttttttgagatggagtctcaccctgccacccaggctagagtgcagtggcatgatct

SEQ ID NO: 61399 - DNA, 1057 bp, Homo sapiens
aatggtttttaattccttgtgagatttaaggacaatgaaagatgacaaaaaaactttagtgacaatatattttagcaatggcaaaataacctcttttctgacaaatctaaactctcttatcagagttaaaagtttagacaacatttgtgattagccttctgttaacagtgaaaacatttgtattttctgcaaatagcatttatccatgaagaaaattagaatagaagtatgtttaaacagaaaattctagactcttcttcagacagctcaggcttttcaaaaagccttgtgctttggcaggagcccaggagaggaagtgtctacatctgctacattctagaagccttccccaaatcactgtaaggtagccaaaagagcagtgtatttccttactgtgtggttctggaagtaactggaagtttgcagcaaactcgagggaggagactagggagtacttccagtttttgtggtgatctgtttttattgagattcaagttagggggcagtggggttattttttagctcttgtagaacggggagctttcaatttgaacctgagccttttggtttagctcacgtcacataggaagacgagtcagaggggcctgcacaaagagaaacaggttgacaagtcagggtaactaatgggagcctgttactggggcaaactatactgtaatgtaacttattctcctgtaaggtaataagaaagacaaagttcatgtttgtaggggagaaggagcaagagaagagtgctagcagggcatctgggaaagtgaggtaaagcctttctgttggttagtttatatcctcatctgccatgaagaatcctcactagaaaagacggtgctatcatggatatagaggaaaaacactaatgggctttgctgccaggtttaaaaaaagaaaagaggccatagacatgtcttaggctaagtttttttttacatagaacacagttgataagagaaacaaaactgaagtctgggtcctttgagagaaaatactagtttaaatggacatggctgtttattcgttttggattctctacaactta

SEQ ID NO: 61400 - DNA, 1018 bp, Homo sapiens
actggaaagttatttgaatgtttaagatcctgtttatttacttatgttattttgttttaatccactgtggcccaaggcatagtctcaaaaggtcttgagaacatgtgccctctcttttttaaaatccatttaagctgtagtttttttaaactacttttgaaaaaaaatgtatttaagaagtagtagtgtacaatcgcattctaatttgagcatattatatgactttttattttaaatcctgatagataacgtagaataagtaatataatgaagcttatgttttggaaaattaagtctatgatcctttatcctaccagagttaggaaaacaattaacattcttatttatttcaaatctcacacaccaaaaaaagaaaaactatgataaaatatggttttagctatctgacatactagactcagaaagagaaagaggttaaaaacacacataccacttggttcctagtggtgaaacttttgctgatgcaggtgtgtgctagttcctggtccatctgggccatgtatgacttgagattatcaagtgttcctttcagggaagcctcttcgccaggttcgtgtgtttcaaagtccaagtcatcatcactatctaaacattcaaagtcttcatcatccagatcatcagaatctgactcattaggccttggccctacacagatcccaagaaagaaagagccacttagtaattattattattattattattattattattatttagttactacacatctcaaaataattagaatgttacccacagaaaaagactaatacacacagtcagtctacttcacaaaaatcccttctacaaatggtaatgctggcagatatgtgtgcatttaatgttgtggaaaagcgtacaagctgaatcaaaagatttagcttaaaaaaaagtgaattcaattaattaaaatatttttcttaaaaaatttttaaaaatacctaataaatgaatacattttgatgtaaacattcaagccatacaagtattgtctccaatc

SEQ ID NO: 61401 - DNA, 1126 bp, Homo sapiens
ctcatgatccgcccatctcagcctaccaaagtgctgggattacaggcgtgagccaccgtgcccggcctcattaaatatttgagagtgactgaatgctgtgtgtttaaatagggttttaccttggctcccatattatattgttcttttttggaattactgtacttacaaatcagtaataaaaagataactcaaaaaataattataatatgtatatatgtacagaactgcagagagaaagattgggatacccggaaactgctaaaagatgcttacctctggggagagagtgagattggagacaatacttgtatggcttgaatgtttacatcaaaatgtattcatttattaggtatttttaaaaattttttaagaaaaatattttaattaattgaattcacttttttttaagctaaatcttttgattcagcttgtacgcttttccacaacattaaatgcacacatatctgccagcattaccatttgtagaagggatttttgtgaagtagactgactgtgtgtattagtctttttctgtgggtaacattctaattattttgagatgtgtagtaactaaataataataataataataataataataataattactaagtggctctttctttcttgggatctgtgtagggccaaggcctaatgagtcagattctgatgatctggatgatgaagactttgaatgtttagatagtgatgatgacttggactttgaaacacacgaacctggcgaagaggcttccctgaaaggaacacttgataatctcaagtcatacatggcccagatggaccaggaactagcacacacctgcatcagcaaaagtttcaccactaggaaccaagtggtatgtgtgtttttaacctctttctctttctgagtctagtatgtcagatagctaaaaccatattttatcatagtttttctttttttggtgtgtgagatttgaaataaataagaatgttaattgttttcctaactctggtaggataaaggatcatagacttaattttccaaaacataagcttcattatattacttattctacgttatctatcaggatttaaaataaaaagtcatataatatgctcaaattagaatgcgattgtacactac

SEQ ID NO: 61402 - DNA, 1047 bp, Homo sapiens
atagtaatggtgggattttgccattttttattctacttggcaaactttctgtactttgttttgtgaattactagttaatcagctatatctttaatttaattttttttttcatagaggcagggtctcaccatgttgcccaggctggtcctgaactcctgagctcaagcagtctgcccatctcatcctcccaaagtgttgggattataggcgtgagccatcgcacccagccaattatatcttaataagtaattaagtaaaagaaaatggtggaaaactttccaaactggaaataggcccttaatggtggaaaagattaggaatcactacatctagccgcgtcccctcatttgaagaaactggagctcaaacaggcccattaatgataaaacagggcctaggacttggggcacgtgattcctgagtagtagattatttgctgcctccctgaaagttgctggtgaacacatttttttcatgacaacttgtgagtaatgttctgatagacctttttttttttttaagggactgatagaaggttctgctcagtaccgggaaaggctagaaatggcagagaattacttccagctctcagtagactggccagaaaggtgagttattgttaagactcctactacaaagattggtatttaggtagttctttttattttttatttattatttattattcttatttatttatttttttgagacggagtctcactctgtcacccaggctggcaacctccgcctcctgggctcaagcgatcacaccactgcactccagcctggatgacagagtgagactctgcctcaaaaaagaaaaaaaaaacaacgaaagaaattttgcatcctcctctatgtaattttactcatcatgatatcacattttccatggcattatgaagtctttataaacataatttttaaaagctgcacaatatggccaggcgcggtggctcacgcctgtaatcccagcactttgggaggccgaggcaggcggatcacgaggtcaaaagatcaagaccatcctggtcaacatggtgaaac

SEQ ID NO: 61403 - DNA, 1025 bp, Homo sapiens
tcctctctttactatgtctgagatcatgttcaatatatgtataatttctgttggacaagaaaccttttgtaaccctgttcataatcaaacaaaaaataaatgtaaatttctggttttgtaatcagcaggaaaaggaatctctttgaagagaacaggaatctttattgtatattattttctttccttttatgtttttagtaatctataatgattgagaaacttgggaataagtttatatttttcataaaattcaaaaagtgttataattgtccaaatgcccatgtatccagtcatctagttctagagtgtggctcaatggaaaaaaagtaatgtgttataataagatacgggaaaaaaggaacttagtaacaaaaattctacctatctcatctaggctcatggatttgagatcttatgctccaaatgtagcccacatttttctgactgcaagaaatcccttgtgactgcctcaccactctgggccagtttccttgaaagtctgaaaaagaatgattactttaaggtaggacttgcaatatatttgcttttaagtattcaatccagggaaaatcaagccagcgacttaaagtcctatagtccatatttaaatgtatgacataattatggaagctagacttaaaggagacctttctagttcagtggtactcaggtgctaatgaaggaggtatctatgaactgtttccagtattagagaaaaactaacactgttggtattaaatgatgaaagtgattatctgtaccagataaaacaacttgcaaaaacttgataatgcaaacatgaaaacaccagataggaaaattagcaaagatgtggattttaaaaattattaaaagatacctagtaaatttctcttaaaatattcaacttcacaagtagtaaagatatatatatatatatatgaacacagtaatgaagaatgtctttcatgtatgtacaaaaggatatgaatgatattctgtgctgtcgagagtatggtaaaaataacactcctataccttgctgg

SEQ ID NO: 61404 - DNA, 2299 bp, Homo sapiens
cttgtgataccatcacaagatataccccccatgtatacatcacaagtatacatcactgtgatactctcagtttagtgcgtatctgttatcttttggcaacaattgctacatatcttactgttaattttattgaactcttattcattgaaatacatatgatatttattggcaagaacactgtcacattggtgtagcacatctaaaaccaaccctttatccatcctctagaaaaccatttttactgttttcttatcttgtttaatggcattgccatccacccagttatccaagctagtcagtaattcaaaatcataatcagttcctcacttcaccatgttcagtcagatgctaaatcctgaatgcttctaaaatatgaccccttctctacatctatttggcttcagtgtagaccctctttatctctacatctggaaaacaacaacagcctcctaacttacctctctggttcctgtctttctagttcctaacactgttgctggttatgtttgtaaaacacaaatttgattgtgtcactctcctgcttaatatccttcagtagttcccattgcttcaagatgaaatttaaatcaaagtctaatatagacaaaaatagttactttaattggagttctctagttgaagaaacttgagatctggggtggggagaagaagagttggttgggctgttcttctacctattgtttgccatggcagctcttgagacactctgtaatgcacttgtttgaccttcattctgttaatgtgggatattaactgtacattgattttcgtgtgttgaaccatccttgcatcccaggaataaatctcgcttggtcgtggtgaataatctatttaatgtgttgttgaattcagattgctgatattttgttaaggatttctgcattgatactcatcagggatattgatctacagctttctcatattgtctttgtctggctttggtattagggtaatgctggcctcagaaggaatttgggaattccctcccttttatttttttggaagattttgaggaggattggtgtcaaattctttaaatgtttggaagaattccccggtgaagccagcttttctttgttaggagcttttggattattgattcaatctccttactagttatagatctgttcagatttttgtatttctcatgatccagtcttgacaggttgtgtttctaggaatttgtcaatttcttataggttatccaacttactggtataccattgttcatagaattctcttatccttcttatttctatgacataagttgtactgtcccctctttcatttccgattttagttatttgagtatttgctcttattcctggttaatcaagttaatagtttgtcaatcttttaaaaaaaacccaactcagctgttttgtttttctattattttttctggtctctatatttctctctgctgtaatgtttattatttccttccttatgctaggtttgggtttagtttttgttttttttttttgaggtataggttgttgatttgagatctttcacaactacaaacttcctttttagcactgctttcactgaattccttaagttttggtatgatgtgcattcattttcatttgtcccaagatattttctaatttccctgtgatttattccaagagtgtgttgttgtttagtttccatgtgtttgtgaatagtgcacatgtttgaaaacttctgctccatccaaatctagcgtcctggtattcccagaatactctatacatacatactctatacatcatgcctctgtgcctttgcacatacttttccatttttctggaaagctcacctcttgtcattcctccaggcaagcatagcacagatatcccctcctttatactcacatagccgttactgcacactcctgttctagagttcattatcttgttttgagatcatttggttgtcttgttttaccctgagctcctcaggagtaggcttcttcttcaggattgcaacccctgctccccagtacttagagcaatcagtcaatgaatgtgtattcagttgaatgattatgtgcattttatttgcagtaacaaatttatctggttacatggttgcttttctcttgtttttaggaggtgttcctgctcatatgtttggcgtgacaaagtttggggataacattgaggatgaatggtttattgtttatgtaataaagcagatcacaaaggaatttccagagttagtagcaaggtattgtagttattttaattattctaaaggaattctattactgaaacaaagtgactacatt

SEQ ID NO: 61405 - DNA, 1435 bp, Homo sapiens
aaacaaaaaagaaaagaaaaaggtataaacagtttgtttaaaaccttatggttggcacagattttataattaataatgtctatttatatctattctaactatattctaacagtagacctatcacatagatatgatttatcttctttactggataggtgagaatcagagtagttaatgatttgtctcaagtaaagctaaaaccaaaaccttattcatctgattctcaatccagtcttctcttcactattccttgctacctttctgtgacattaacctgttaaactattcctctaagcctttaaaagttccagatttgatagtcacagcagcatatttgaaaataagtgagaatttctttttaggctgtgcagctgtggttaggtctagtagttagtattgtgtcacatgattctggatgcattttttttttcccattgcatttttttcccattgtatttcctgctgagccatgttcactcacgtatcactcatgtgcacacagccctagggccagctaaatataagccaggcttctatacataataccactgagctagaactggaagcagattcttttggttttccaaagattgcctccttccctttcacttctcctgtgtcaaattacttctattttctatttattacttctatttggcctttgtcaaattaattctattttccatttttcctcaaatcaaagtgaattttcaggtaatacacagacaattttagaaaggcagccttcccttcagcatcatgaagtctttccttcttgcttctgttacagagaagagggatttcatgggaagaaatcagaagcagctacagagaaacagaaattagggtatcctcccattgctccattttactgcatgaaagaagatgtccttgcttatgtgtttgacagtgtatggtgcaaggttgtgagctgtatggagcagttgacacgtagtcactgggaaggatttgcctctggtaaggatctttgtgaaaataatgtaaaaatcaattgtttatgatttctaaaccctaaccagtctattagatgatatgcttcttagtgcaaaaggtgcgtatgggccaggcacagtggcttatgcctataatccaaacactttgggaggccaaggggaaggatctcttgagcccaggagtttgagaccagcctgggcaatgtagtgagatcccatctctctaaaaaaattaaaaattagccaggcatggtggcattcacctatagttccagctacgcaagagactgaggtgggagcatcacttgagcccaggaggtcaagtctgcagtgagctatgactgcaccactgcactctagcctgggcataagatgagagactctgtctcaaaaaagaagaaaaaaaaaagtgggtatgagagagaggaaaaacccaaatgtttttccctaaatgttttttc

SEQ ID NO: 61406 - DNA, 1049 bp, Homo sapiens
gatgctagttgcaagctccaagttgtgacctgtacttctgacctaccagaagtctaccagagagactaggtctctctgaacctagtcctttaggatttttatggaggtttcattttgtaggcatgattcaattgttggccatcgctgattaactcgaccttcagcccctgtcttctccctagaggttaaggggtggggctgaaaaagtgaaaaagttccaaccttctaattacatggttggttcccctgccaaccactatctccctacccaatcctcagactatccaagagcccctaaccaccggtcatatcattagcatacaaaaaaaaacaccactttgggtattataagagttttaggagctatgtgcctcaaccaggggcagagaccaaatatctgtttattatcatctcatgatatgatatggaatgacccatatatttagtctctgcccctgatttcagatcatagtgggtctgacttatgtttgtatttcccacaaaaactaacaggtatttagtaaatatttgagaatgagtagatcgataaaaaggcctagtctgtgatgattagacagagcttgtactttctctttgaatataatgatttatgaagaaaaatcatgtgcaagtagcacttttttaaactgctttattaaagcataatagatatataataaactgcactattttttcttttcattttattttttatttttatgtatttgaagggtccaagtgcgggtttcttatgtgcatgtatttcttagtggtgaaatctgggtttttagtgacctcaggtggtacactaaaatattcactcaaatagtgaatattgtgctcaataggtaatttttcaaaccttgcctccctcccaccttcccacctttcggagtctccagtgtttcttattacactctgtatgtccatgtgaacccattgtttagctttcacttataagtgagaacatgtggtatttgactttctgtttctgagttatttcgctaggataatggcctccagttccatctatgttgctgcaaaagaca

SEQ ID NO: 61407 - DNA, 1070 bp, Homo sapiens
ggcaaatttttgggaagcactttggagtaggtgtccttcaggcttgccttcactggtgactaaaaaagtgactgtgatggcaggtggataatggacttgctttgccaaatgtccattctagtaaattatgtttatgattgaaataatgtcccacttttaagaacagattctcatgcctgagctagagtaccatctggaaactagtgttacttattgaaaggtttttatttttgctttatttccccctaaatgtagtttctagtctaaggctttttaccccgttagtcttgtcttccttgacatactgatctttacttcattgtgggtttctgatttggctactagagatcttgatgacaagctacttatgaggcctgggtccagtaccatcctttcaactcgaaattggccaaatcgagctgtggagtttagtacatcatctctgtcatacacagtgcagtccaccaggagacgcaatccaccaccacgaactcttcatccgatcagcacgagccattcatgtgctgaaacaccaagatctgtggaagaaatcctcagaggagcccgagtgtaggtttcaaaagcagaacttctggaaaccgtggtaaaactaacacattttacatacagaattaatttaaatataagactgaaatctatgcctagaaactaatcattaagtagtcttatgacagattgcccatgggtttagatccaacacaaaattttttaatgtggttaaattttattttattttatttttttagatacagtctcactcctgtcgcccaggctggagtgcagtggatgatcatggctcactgcagcctcaacttctgggctcaagtggttctcccaccccagcctctcaagtagccgggaccacaggcgggtggtgccaccatgccaggttaactttttgtgtttttagtagagacaggggtcttgtcatgttgcccaggctggtttcaaattcctgagctcaagcaatctgcctgcctcagtctcctaaagtgctgagattacaggtgtgaaccaccgcacccagcaggggttaaataattttaatg

SEQ ID NO: 61408 - DNA, 1019 bp, Homo sapiens
caaaaggatcggcaaaaggaaatggacaattttctggctcagatggaagcaaagtactgcaaatcttccaaaggaggagggaaaaaatctgctctcaagaaagaaaagaaataatggaatttttctcttcaaaggtccttaggtgtaaattgatgccatcgtaggcaaggtgcaggcaggatttgaaggcaaaagtcaattcagctcttgagaaaaggtgtctttccagcctgaatttttcagattgactagaccaagcagaatctctcaacctgatcttagtatttcctagaaagcacttgacattgtgtgaggtctcacctgaaggaacttggtggtgacatttgggagggtggagggaggcagtgtccttcctgacagcacttgcctccatggatcttctgtacacagaactcttatctaggatgtggttctgttcatgctgctttctgcgatgtgcgtgtctgttagaataggctctctacccagctagaacaccttccagacacttgctggacagctatcttccacatacttcccagtttacatttggtcttaatgatcttgaatagatcctctcttcattttactcagccaggttttgtactgatgtacaggtgttaaattacttcaagcatttttgtaagaggtgtatataattcaataaaaaaggtaaaacatgatgattaagttctgggggctttgtaaatgatcccactaaaatgtgacctaggaaaaatatgaatggtgtttaggatgagagaaaaggggaaaacaatagccctggtcagctttataatagagagcctggtttccctagcatgaagagatgtatgttgtagtcctgccactgattactgaagtcctgccattaattgctgaatgtcttcagttgggccactgagcttgtctgaatctgttcccttttataaaagagttactacatcaaaacaaagagtgaaatccaaatttgtcaaactgtatgtattaaacatgtccagttttttggttaaaaaaaa

SEQ ID NO: 61409 - DNA, 1090 bp, Homo sapiens
cgtaaagcgcggatgcgcggcgtggccacgccccttcagtgcttgtgacgcaggcgccctgggctttttgggcgcgaaaaagaagcagtcctgggttgtacccggcgcagctgggagcggctgcttcctccggggtcgtatctccgcccggcatggggctgctggacctttgcgaggaagtgttcggcaccgccgacctttaccgggtgctgggcgtgcgacgcgaggcctccgacggcgaggtccgacgaggctaccacaaggtgtccctgcaggtacacccggaccgggtgggtgagggcgacaaggaggacgccacccgccgcttccaggtatgcagggtcccgccccgaagccgaccggctgcgcgggcctccccctagccttttggctaccgggccccgccccgggggagcgcgctgagctccgcttggcgccttctgatctttatttctcgcgccgccgtttcggtgggaggagcaggggtgatttacggatactctttgccctcagatcctgggaaaagtctattccgttctcagtgacagagaacagagagcagtgtacgatgagcagggaacagtggacgaggactctcctgtgctcacccaagaccgagactgggaggcgtattggcggctactctttaaaaaggtaaaggactctggaggtttctttgtgactgttaccatcattcaatcaacaaacctttattgactgcctctaagatcttgtattttgtgttaattttgtaggaattaggaattttgagtttggccttgaaatacagatacacgcacgcttactgaaacgggctttaaatttcctgttaatgtgattgttgcactgaaaagggccgatttattttttttgccggatgcgctttattttacatatccaaatgtaagtcctgattccggatcacctctcactcttggaaatttcacttaaatttcccttccctggtccctagttagcagttaatgaagattggatttaaaaaggaggactccggagaagcttaggcatagaaaatctggttcaataatttcaactcaagcaactgttgtattgcagcaattcaacaccc

SEQ ID NO: 61410 - DNA, 1072 bp, Homo sapiens
attttctatgcctaagcttctccggagtcctcctttttaaatccaatcttcattaactgctaactagggaccagggaagggaaatttaagtgaaatttccaagagtgagaggtgatccggaatcaggacttacatttggatatgtaaaataaagcgcatccggcaaaaaaaataaatcggcccttttcagtgcaacaatcacattaacaggaaatttaaagcccgtttcagtaagcgtgcgtgtatctgtatttcaaggccaaactcaaaattcctaattcctacaaaattaacacaaaatacaagatcttagaggcagtcaataaaggtttgttgattgaatgatggtaacagtcacaaagaaacctccagagtcctttacctttttaaagagtagccgccaatacgcctcccagtctcggtcttgggtgagcacaggagagtcctcgtccactgttccctgctcatcgtacactgctctctgttctctgtcactgagaacggaatagacttttcccaggatctgagggcaaagagtatccgtaaatcacccctgctcctcccaccgaaacggcggcgcgagaaataaagatcagaaggcgccaagcggagctcagcgcgctcccccggggcggggcccggtagccaaaaggctagggggaggcccgcgcagccggtcggcttcggggcgggaccctgcatacctggaagcggcgggtggcgtcctccttgtcgccctcacccacccggtccgggtgtacctgcagggacaccttgtggtagcctcgtcggacctcgccgtcggaggcctcgcgtcgcacgcccagcacccggtaaaggtcggcggtgccgaacacttcctcgcaaaggtccagcagccccatgccgggcggagatacgaccccggaggaagcagccgctcccagctgcgccgggtacaacccaggactgcttctttttcgcgcccaaaaagcccagggcgcctgcgtcacaagcactgaaggggcgtggccacgccgcgcatccgcgctttacggcggccgcaaaatgaggtgtggcgagtcaggcgcgg

SEQ ID NO: 61411 - DNA, 2090 bp, Homo sapiens
atgttggtcaggctggtctcgaactcctgacctgatgatccgtctgcctcggcctcccaaagtgctgggattataggcatgagccaccacacccggccaaaaaccctaaattatactaaagaaggtagattatttttaaagaaaacaaccagaatatggtattttgaaaaaaactttgttctttaacttaaattttcaaagcaggatgttttaagttgtgataaaatatacataacataaaaatttaccatttttaagtagcagtaagtacattcacattgttatgcaaccatcattaccattcaccttcagatgttttttcaacttgcaaaactgaaaatccatactccttaaacagtaactccccattctcctttctcccaactgctggcaacaaaccatgtgactttctgtgcctgtgtttgactactctaggtacgtcatattggtggaatcatacaatatttgtctttttgtgagtgttgtcttttacttagcatagcgtcctcaaggtttattcatgttatagcatgtcagaatttccttccttttgagactgagtaattaaatagtctattgtacgtgtatcccaccttttggttttttttttaattcatctgtgacacttggtttgtttctgcctgaataatgctgctatgaacatggatgtacaaatatctgttcaagtctactttcacttattttgaatatacccagaagtggaatttctaggtcatattgtaattctttggaagtgtttttgttttgctttgaggaattaaccatattagtttccacagcagctgcacccttttacttttccatcaacctgtgtacaagtgttcccatttcatggcatccttgccaatacttactatttttttggttttgataatagccatcctatcaaatgtttttaaatgactaatatctttggaataatagatgaaactagtactaccctgaccaagtattttacagagctgtgaatcagaccttcattgggtagtgctagcattggtatgagtgccagccataaaatgtcagtcacttggtgttttcccccccaagttttgattattattaagatcttattatttaaaaagaattttaagaaatgtcagttgtcacagatgtttttctgacagaaatattatttcttatgcagattgaccttgtacaaataaaacagatgttcgctcagatgtatcagaagactctgggcacaatgattgcaggtgacacgagtggagattaccgaagacttcttctggctattgtgggccagtaggagggatttttttttttttaatgaaaaaaaatttctattcatagcttatccttcagagcaatgacctgcatgcagcaatatcaaacatcagctaaccgaaagagctttctgtcaaggaccgtatcagggtaatgtgcttggtttgcacatgttgttattgccttaattctaattttattttgttctctacatacaatcaatgtaaagccatatcacaatgatacagtaatattgcaatgtttgtaaaccttcattcttactagtttcattctaatcaagatgtcaaattgaataaaaatcacagcaatctctgattctgtgtaataatattgaataattttttagaaggttactgaaagctctgccttccggaatccctctaagtctgcttgatagagtggatagtgtgttaaaactgtgtactttaaaaaaaaattcaacctttacatctagaataatttgcatctcattttgcctaaattggttctgtattcataaacactttccacatagaaaatagattagtattacctgtggcaccttttaagaaagggtcaaatgtttatatgcttaagatacatagcctacttttttttcgcagttgttttctttttttaaattgagttatgacaaataaaaaattgcatatatttaaggtgtacaatatggtgttttgatatcagcattccttgtgtaatgattccacaattaaggtcaggctaattacgtatctgtcaccttgacatagttaccattttttcatgtgtggtgaaaacacttaagatctactaccttagca

SEQ ID NO: 61412 - DNA, 1013 bp, Homo sapiens
tttcaggtactcagcccagtgagactcatttcctttttgaagttaaccagtttctggtggtctaatacacagatgtctaacaaagtgaaagtttcattctcatggatattaggactaaggggagtattagtaacactttggtattaacaatggaatgttgggccaggggcagtagctcacacttgtagtcccagctactcagaaggctgaggtgggaggatcacctgagtctgggaggctacagtcagccatgattgcaccactgcactctaggctggatgacagagtgagaacctgtctcaaaaaaaatcaaggagagcatctgaacactcttaactcaccccatgtttctgtgatgattacagagaaaataatcaaaggcaggctataagtgataaatgaagctggaggggtacacttcttgtgagatcatgattccatgtctcaaccatctctaacttgcagtgcagtgtgccctgaaccgccctgccttctttgctgagaggctctactatgctatgaaaggtgctggcacagatgactccaccctggtccggattgtggtcactcgaagtgaggtgaggcaggcctctctctttttgtcgggtcttacttgatgttcaatgttgatttcttaaaagttccccagttggttgtcagtccctcaaaaatgataagaaagagctctctttgccacctaaaagaggtggtataaagaacagaaaattcactttcctcatgctgtgggagaagcttgcattagtgaaataggccactctaccctaatgaagataatactaacagattttacaacttgagaacgtcaatggagaatacaaatttatgggaagttagacatttgtctttcgattttcattttgcttatataaaaattagatgaaaggcctatgtagattaatcctagtggatatcaacattatttaaatttagcatcctttattaataataaaacaatttttaaaatattcataattgtctcaagtatagcctca

SEQ ID NO: 61413 - DNA, 1094 bp, Homo sapiens
ttataaagcaattccatttctttttttgtattttccttaaaagatttaagtgacaaaatttggagaacacatatacttagcttgtatttgtgattaaataggatttaatcaaagatctcaaatcagagttaagtggaaatatggaagaactgatcctggccctcttcatgcctcctacgtattacgatgcctggagcttacggaaagcaatgcaggtactactatatgtcatttattatgaatattttgtcctatttcatatgtaaaaccgtacaaattatgacagttctgaatttacagtggtaattaaagcaattctttatttcacatcatccatctgaatatatagtttttagttctacagaacaaagaaatatttgacgaagatttaattacttgcagaaatttcatttttctttgtataatcttcccttcatttcatgtagggagcaggaactcaggaacgtgtattgattgagattttgtgcacaagaacaaatcaggaaatccgagaaattgtcagatgttatcagtcagaatttggacgagaccttgaaaaggacattaggtcagatacatcaggacattttgaacgtttacttgtgtccatgtgccaggtgagtatagtatgaatgcttgtgcgttgatagagggaacatactttaaaagccttttgccagtgagcattctttattccttttaatatttagccaccttgcaatattgccatctttaagagggacaacacagaaaccagtgtacagatttctttgtagttactattgagatttattcctgtaaatctggcttttgtaaggaattagagatttaacctctaaggttgtatggaatcagaaaccaattcgaggctctgtggctgggatggggatgaaactgtacatttgagcttatcactatcctgcccattatgccccaccatcaagtgaagatgtgcaggactgccatagaggtgctacaggaagtgaggactatgtgaggagacccagaaatgcagaaaaatgttttagggttcccagtaataactgtgattagcaccttctttattttgattccccaggtgtgctggagaattg

SEQ ID NO: 61414 - DNA, 1025 bp, Homo sapiens
atttgtatataccctttactcagattctccaaatgttaacttcctacataaacacaatgcaatgatcaaaatcaggaaataacatcgatatagtactgttacccaacctacagaccttatttcagtttcaccagttgtctcaatgatgtcctttttctggttcaggatcaaatccagaatgcaatgttgtatttattgtcatgtctcttaagtctcctttaatctgaaatagttcctcagtctttgttgttcatgcccttgatgcttttgaagaacactgtcagttattttataaaatatttcttaatttgggtttgtctgatattttctcatggttaaatccaggtcatgcctttttggcaagagtaccacagaaatgattttgtgcccccagtgcatcatatcaggagacacttattattgacttattccattactggtgataattaattttgatcatttaagttggtgcctgcaaggtttctctgctataatgttataggttatacaaatatcctgtttctttatacttttgccacctaattttagcacccactgttgattcttgcctgaaacagttactaccatagtatttgctaaatggcaatttttaattttcatatagatttatttcatgtataataatcagggtccatataggaaattaagagagattactaaaattatattgctggtttgaaatctcactgggcattcatgtgctacttcactaaagccattttatattcttctgtttttaaatcaaacattgtcgctcatctcacaccattcagggatcagtcttcttttttcttcctattctaccaaaaaggaaactatagtaagattgtgactttaatttcacaagtttggccatcttgtctcctggaagtttggtgtctggctatctgttggcaggagaaaaatctgtcctgaagggggataggtctttcctgtctgttccataatgagctctggtaataaaatgctcatatccttgccttaaaacccaaacattggccttc

SEQ ID NO: 61415 - DNA, 1334 bp, Homo sapiens
ttctgacaaccattccaggtggactcagaatttaatctgattcaagtgtgaaaaaagtattatttatgaggatcttatgtagaacatggaatattaaaaaggttcttatgaccaaagttggttttagattcagtaaattatatttttaaaaactatcctcataagtatcatagtgtgaatgttcttgtatgtttccatattcatagtcatcaatgctgttttgaaaaattaaaacatgtaagacctgttgccgtattattattattttttttaacattataggtggctttcctggaggacagatgccttctcagtatcctggaggacaacctacttaccctagtcaggtattttgttcctaccttttaagctcactctaggtagctagataaagaaggaacctatcctttgctgaggtttccatgggtcggaggaaatggcccattatagtaatggaagactaaagtctttacttctgatagactccatactttctttggtccatctgctttaatagtgtcctgatgactttgagaagacaagcataggtctattctcataggtaatgattctcacaactttatcctggagattaacctggggtcttggttttagttctttttcctcttccttgcccttaccagcagttacacctatgaatttgggtggctgggtgattggtatttctgacagtgatttatgtagggtggttttgtttcccatttttacctttataacttttcactcttttttcagatcaatacagattctttttcttcctatcctgttttctctcctgtttctttggattatagcagtgaagtgagtaaggttttctaatgtttactaatcactaggtcctttatatgtgcctttgtttctgattctcatgtacttgtctctcactacttcttaagggctcacctgtatctattttatctttgtgttcctgtaataataggtagggctttagacatagtagccagttagtctgttgactggattttctcattagctgcagagtttcctatatgtcaaatatttgccctactccgtatggcttctttttttttttttttgagatggagtttcactgttggcacccaggctagagtgcagtggcacgacctcggctcactgcaccctccaccttccgggttcaagcgattttcctgcctcagcctccggagtaactgggattacaggcgcacgccactacacctgtcacatttttttgtatttttagtagagacagggtttcaccatgttggccaggctggtctcgaactcttgacctcaggtgatccacctgcctcggcctcccaaagagctgg

SEQ ID NO: 61416 - DNA, 1052 bp, Homo sapiens
cacccaggctacagagattagaacagtgttctaatcctgcttatttttggtgttattgggaagtgagacaagaaaccacaatacaatcctctctgtctctctcttgagtactcaaggagtaagactacatttgttctggggaggtggaggttgaaccatacctgttatgagaggacagctgcaaactcgtggtgttttttctaaaagtgatataaaaagtgagttgttccagatagagagtaaggtatcactctgtctggcagaataattatattcccaatccctcctgccttgtctgccaaatgtagtccccaaaattggtgcatcagctctcattcctctccctaccttccttacccattcaccatcctaggtgcaggaatatcagttcctttcctccgataaccccaatcatatttatagtataagaactatttctctctcattctctcaggtgcagaaatgtctattactgtggtccagagtgccagaagtcagactggcccgcacacaggagggtttgtcaagagcttcgtcttgtggctgtggaccgtctcatggaatggcttctggtcacaggtggagtggtggtgttgaggatctctgccataatggtcatagttgattgcatttaaaggaagatacaaaatcatattgttatgaaaaaatgaggaagtggggcaaaggatggggcacgcctgctcacaggttggcagagtgaacatggagggaatattgatcattagtgagggggaaattttgaagccaggaaagcattaggttacttcttatttcttctttcctacaggtgattttgttctaccctcaggaccttggccatggccacctgaagctgtacaggactgggactcctggttttctatgaaggggttacacctagatgctacattggatgctgtgctagttagtcatgctgtgaccaccttatgggccagtgtaggacggccaaggccagacccggatgtcctgcagggatctttgaagcggctgctgacagatgtcctgtcacggcccttgactctaggcctagg

SEQ ID NO: 61417 - DNA, 1768 bp, Homo sapiens
gagtgagactctgtctcaaagaaagaaagaaaaagaaaatgttatcttgcctgaggcaggtgggtagagtagataaatgctttttgtagaatggcagtgattctgaaaatgcaatgagaatgtgaggtgattaaaagtggaggacagaatgaggttagttgttggaaattgggccctaaagtgtgaagggcaattccatttactcttttggtaaaaggacatgacccttaaaccctaagataatctaatatcattaggtccaatttcttcattgaaggtaatatataggatatggtatacagatgagcttgactatttctgttctgtggactgaaaccatccattcacccatgggataaggggagacattaagagggtggatggaaacataaggatgaggagatagaaagtacaaaggaaaatacaaatttgttcctccattaacctgaggacaggtttttaagagtcatgttgtaagatatggatatgagctggataattctgggagctttttgtttatttttgccacctgcatacacctcagctgcatgatgattctgaggtttttcctaacagatctgatctagaaggatcaaatgtcagatcatttttgtaacaaaacatgatccctggtttgaactttaacagtttcctcattcacactgccagcgtttttaatcctctgttatttctctgtacctgaagacaatctggggattaataactttttagcctctcaatctctatgaataccttccttcctttcttttttaatcgaagtgaaaatcatataacataaaattaataattttaaagtgagcaattaaatggcatttagtgtattcacggtattgttcaaccatcaattttgtcttgttccaaaacatttttatcaccccaaaagaagaccccataaccattaagcagttactccccattttcccttccacccagcccttagcaactaccaatctgctttctgtctctgggtttacctattctggatatttcatagaaatggcatcatacaacatgtatacaacattttgtgtctggctttcttcacttagtataatgttttttgaagttcctctacattgtagcgtgtatcagtatttcatttctttttatagctgaataatatacatcttcatatgtatatttatatcccaatttgtttatccatttatccattgatggacctttgggttgtttctaccttttagctgttgcgaatagtgctgctatgaacattcacatataagtatttgtttgagtatctgtttttaaatattttgggcacatacctaagaatgaaatttctggttatatagtaatattatgttaactttttggggaactgccgtactgttttctatggtggtggcaccattttacattctcacctgcagtgtacgagggttcaaattactccatatcctcatcaacacttgtcattttctgttttttttttttataatagccatactagtgggtatgaagtaatatctcactgtggttctgatttgcattttcctaatgactattgagcatattttcttgtgtttattgtccatttgcatatattctttgggaaaatgcctattcacatgttatgcccaattttttagttgggttgtttggtggtttttttgtttgttattgagttgtgggaattctttatatattttgaatactaaccccttatcagatatatggtgtgcaaatattttcttccattcttggggtgtcatttgactctgttgtt

SEQ ID NO: 61418 - DNA, 1198 bp, Homo sapiens
ccccttataaggatctccaatgaccagtttcagtcttccttctccctacctctccaaagacgttttgcattttttggtgacttacagaaaattagatgagcactccttatctggagatagtgaaaatatgactgtagtttaggtgaaacttgggactcttggtggtaaagaagaagatgggaaacctaggtctaggaatagattaatattttgtcttgaatttggacatgaaggataaaagtttttctaggcaatcaagatcatgtctcctctccagttcttggtgttggtgttctctctcttatactgggactaaattagagcctaagtcactggggatggctagaaaaaaatgaaagggattccctttctaagtggagagcattctagactctggaaagttcaaagagcttactgcaattctttccagcttctcctgtgagtcccctgttttttcctttgtttctctcagtttataacctgtgaacagggagtagcctggggctctttacaggagatttagaaccagggaagctgtgtctgggcctggggtatataaactcaaacatgaacctgatgatgtatatagatgcagatcaaagacctggcttctcacccaccttctttcttttctgccagaaagctaactcatttgtatcatgaacattgtgctctagacacagaggagactgtgacattagggatttttaccaccactcctcttcctcaaactgtgtgatccttttgctttctgaccagttcagccaactcccagattgccaagagctaatcttcctttagaggaagacctcaccttggaaatgcggaaaagtaaagcagtacctttctgaccttaagtggcttgcttccattgcagcaaaaaggcttatgttttaacttcagggagatatctattataaattctgggatttaagaccctagagttgtctcaaatcacactttccttccatacctatttaaaaaaaaaaaagtcattctttcaaggtttaagaaagtggtgtcttggccgggcgccgtggctcatgcctgtaatcccagcactttgggaggtcgaggtgggtggatcacgaggtcaggagttcgagaccagcctgaccaacatggtgaaaccccatctctactaaaaatacaaaaattagctgggcatggtggcgcgagcctgtaatcccagctactc

SEQ ID NO: 61419 - DNA, 1133 bp, Homo sapiens
cagcataccatttattaagattttttaaatgcaactcatgatgaatacaaattgtgaaaagttcagacttcgtaactttaaatgtttaccagagcaagtcatagtgatagtaaaatataagtattcaacatcaaagtttttctatattactattctcctttatattcattgacaacttctgaattagaaaagtcaatctctgatgtcttgtatcttctgcagttcagccattattaacagaactcaaaacatttgaggttctcagataaattttgaagcctgttaaatttgaagttggcctgaaacttttgcacaaagtgaattacccctattttatttagggtttttgcctattgcaactgattttcctttatccacagctattctacataatgttatgcagtgtttggttgaatccttaacacttttcttccaccttccctgcatgtagtttgtactttttacagtttggggttcctgtgtggatttgatttgccacattccgggacctcattgcgagtgattctgttccccagtttgatgatgttcaaagaagcaggtaagtgagagctggggtcagatataagcagaaagtcagaacttttttatttaaaaattttaaaaaaattttttgagggtaagaaagatcttgcagtcttttaggaccactgccctaacaacttcagataggctagctgtaagtagaaagaagctaggactgtggaattgaatttcctggatcagctgcaattacaaggaggataagagaatggttgagctgattcttttctattttcttttcctagaaatagtatgtatttttagtcattaactagtattttggttttgtttaatatcccagaagcatttattcctctcttaatacaggtaaagtgctcctgatgactctctcactcagagagttatcttacccttctttcagggaaagtgaattttacaagttaattctgcatgtttcccctacaactgatttcattctgtaccattaaatggccatttattttctcccttctacttaatccaagattggacattgttgagttttgtttgaacaatgtttgttatgctgaaaaaggacaccaggcctgggggaactcatcctgtgtctagat

SEQ ID NO: 61420 - DNA, 4176 bp, Homo sapiens
aactctgtcagtataaatggaattttttaaggctatagatgttagtatctgtaggtatttggaacatcagtactagaatagaaaggaagttactggtagacaggagaagtcctttcaggtcccccacaaagaacagagccacagaactgttctacttatagtaattcatcaagtttactgcccttaaatttcactgtagtcatatcagctcttgcagcttatgttttgccttataaattacaagtaacaggtaaagcattgctgaccccttctagtttatgtcttagggaaccaactggtaatgagtattgttctcactgacatgaaagaaaagacttttctgtttgcttttctgctacaattctattataattttaccctagagcattttcctgtgattgtgatggatgtgatataataaacataatggaaaattctaaggccatcaaattactgattcaagatgggtaattaatactggagtgcatttgcatgggtgctgaggtgtctgtgtttacagtaggtttatgtgttctgtgctctgagtgatgttgtcatagtgctgtgtgtaaactgtgctgtgtcaggaattgggggtttggatggggctctctaatttgggtactatttatgttaaattttaaatgatgatgtagtatgggatactgtgatattttaagtgatcattgccttttctgctgtacaatatgacccttctcatctctctcattcattttgcatgcctctgctcacttctgtacagccacagttgaggctattgaggctgaaaaaggtatgatcagagtccttgtgctgggcagagatctgtggtgtgtgggtgggcatcagagaatgtcctgtgggtgtgttttactcctagcttttacagcccaagatgaatcagactcactgattcatcaagtttagaagccttgcagccctctttttttaatttttcatttttaaatcagaagggctgatgtctatggtgacagtctttttcttctttccggtgtaatatgcaatcagaaagtaatgtttctgatttctttagagtatagcatgttatgctatacagtatagctttataaagttgcctgttttaatggaaattgccaaactgacctgcaaatagagatctgttccatattttgcatgattctatgctactcagattttttttccctaagtgaatcctcctctaggtataggtgtgagtttgtttttacaaactagtgtgcctgactgagaatacaggaactgtcactataatgattttcttttttcttttttggccgcagtttgggctatagtttatggataagattatgttcatatatatatgtgttggcttggtatttcacattcctcagtgtttgtagccccagccatttgtttggttcatgtgccagactaagacctaaggattgcagatattaagcaaccagattataaccagtggtttgaaaatatttcctatgaacactttaataatggaggatgcatcattctagatgaagtgaatgagaaaccatacaattggtggagaattgccatttattttgatttgagtttccaaagactgtgcagtatggccaatgaattaaggagaacatcttctaaattacgagattataaatacttttttgctatcagccatacacagatctaactcttggaggcacttccacctttttaatgttatattggtggcgatgggctgaccttgacctccaagatagttctgatctactgtattttaacctttctttaactctttctcctcccaagctcttggtacagatttgtatattgaggattaaccttgtttagcctcctcacttgcccctactctcattgctgccttactgtgatagtcactggtgatcttagggactgatgtaggagataattggtatagtagaagtcagactgagaccctgagaccattgcctggaggttgattttgggggcaggagagggttaacattttttttgtatttttattttttggaaggctttgctaacacttgtcacctataaagctatgatgtttatatttaggtttaaacatttcacattttaaggaaagactgaaatgaggataggattcagttaaagtaagatttatgtgttgctacttacagctactaatttctttcttcttaaaaatcattaattatgtttttgaaatctcagaaatgtttttcaattactgacttatcaaatttgcattttattaagcaatacgaggattctctccaccacatagaatctgcagttttgaagaggcaaagggtttggataggatcaatgagagaatgccacctcggaaagatgctgtacagcaagatggtttcaattctctgaacaccgcacatgccactgagaaccacgggacgggcaaccatactgcccagtgacccactacttcccagggactctcacatctcgggccccaaatggacagatcacccgaggagctggaggggtcggccaagctgactgtaaatttcacagtctctctgaagaaaccattgtgcttctgagaccctagcccccttcctggatggaggcttgagggccctgggacatgtgctatctgataagattgggtcatcgctgccaaggtggagagcagtgagcaaggggcttggggcaatttccagtggagggcatccacacctccattttatgcttgtggttcacacatttaagtttacaaatcagatttcttttccccttcagtagaattagattttgtttttcaatcatgatttcaaatgcaatcctaagagctaatgtggacttttctttttccatgaaatgtctttaaaggatgaattagcatggtcttaaaatacatttctgaggttactagctgtattttgaattgtgagcaaaatgccgagaaacccagttggcatttatacaaaatgttgacctcaggtctatagttcttaaatgtggctaattctgtaacatagtcttggtattttttaattatgaatgcatatcctatttccaggcaggctctcttacttgaacacaaatccaaaaactaatttagagtcttttttgcccagatcttttaagacttacaccccagagatttaagaagaaaacctctaaatttcaaaattatgaagaattacagaattactcatttaaggtactttaaaagaagtttgtacattgtcaaagtaaattttaattcaaatcatgtctgtaaaacttgacgtattttgtgtatgcatgttttcattttgcaaatatttaatatatagacctatgatgtacaggtacgacatgtataggttacctagatgttatgagaaattttagtttattgtgagtactcaagttgcttagagagccaccagggtgatttgctgctggctttctatcatttttatgttttaatgcaaaggaaattttaaaatgttctggaagtgtttttgattaagcaatgcagcctagaagcaatggttctgttcaatcattcagatgttagtggaagcataaaagtcaagactgcatgttgaaacctttcttttgatagttactgaactgcttggttaaactaaatggaaccatgtgctaatttttcacaattattgacctgtattgattgccactgtagtttggtatttccctttactttggtggcctgcttccctcatgccctggaatacaactcagagctccaggcagcggaaccatctattgttttgtttgccagaaagtgcaccctgtatggtctcctgtctaagttggaaatattatgcatgtgcaggactattcgagtattttataaacagtagcacacaataaattccatgcatgggccgctgctcctatctctgtgttgggttttatttggaagatgcaatctgatttgtccttttgatgcaaatcagaaaatcctgttactagagctgggatgtcctccggagattatctcgtggatagttcatggtaatttgattaattaaattctttataaattttgccttaaaaaaaacttttgttatatacttgttttacatgagcattagtaactgagcactagaggactttgaatgcctactgtaggcctcctaagtctaatatttaagatcactgtttattgtcttttaattgaaagaaaatatgttattgtctagaattttgtta

SEQ ID NO: 61421 - DNA, 1001 bp, Homo sapiens
tttacattccttgccctccatttttcttattatattgtaaacattagaaaaatgaactaaaaagaatttcatgaatgtacattaaaacaagatcttaaacatttgataaaactagtaaaaatgttaatagaaaaggatgaactttaatagcttcaaaaatattatactcttctttgttcagaaaagaaaaataaaaccaaaagggtatcatacttaaataaatctacagtatagtcatctctcagttatccttggatataacattacttttatattgtatccgcagcaaaccttgctttcagatttcacgattagcccctgctaattacatgctttgttgacttctgtttattcttaatttgtacacggcttgaagctcattccttcaactttgaaaccaccctcaactgcaggggaggtttgaaagacagcagctttgctggagggactctctattctcagcatggactaagttactggaaggaattgagtttaaggggtctaatttgggaccccttaaactagatagcttctagttttgctagctcttgatagtgtggtttgggcatttggtcaaaattattttcctagcataagataaatccactttgaaacaaataacaaaggtcatacaaaagctgcatgtttgtgattattttttaaaaagttatcctacattttaaattttagtagataatgttccctgatgttagtgtgtataactgagagttaggtattgcaaaaggaaaaaattttaattctaagacctcgtgcctatttgtcagaaaataaaaattgtcgtttcaagaactttaaaagttaatttacatgatgtttcttgagtgtttttacaaactgcacaactctattggaggtggattttctgttcatctttattttatgtatgttttctttctgggaaatttgattgggagctagcactgtaatgctaccctcaccaggatctatatgggaaatatatgtggccaattctatgttag

SEQ ID NO: 61422 - DNA, 1798 bp, Homo sapiens
tttttagagtattcttgatgaacttgttcatccatataggaagtcccttgtgctggagccataaattgccttccctggggttaattcaggaagaccaggttaaagggtacaaatgaataggtcagtctttaaaaatttgtttgcacaactgactacatcagacatttgaacttcagagcatatgaaataccatattttctcaatagtatgatgccccttgatgaatcttaccacatatttaataaagcttttcaggaaaaacaatatatgcctcaatggtaaggcacaccctcatacctgaaacacttaaaatatagaaaaattaatgtcttgaaattgaggaaaatatggtaatagcaatgaatgtcatgaattttatatatggcctatatctagaccctatgtcttcttttaaattaagtacttgttggaagtatctgatatttgttatatctctctgctatagggaggagagtgaaagtgtgctgacactcaagggcctgactcccacagggatgttgcctagtggagtgttagctggaggacggcagaccctgcaaagtggtaatgatgttatgcaacttgctgtgcctcagatggactggggcacacctcactcttttgctaacaattcacataatgcatgcagggaattccttctgttttttagttcctgtctcagcagctgacctagacagggtactgtattagctagtgtctcattaatacctgatcagggcagaaaactgatagaatgggtattcctttcaattgaaaataatggtcagttcctcagcttttcatgaaatgatatgggagcagctcatatcataatgtctgaaatatttatttattcatctgtctaattcacccttttcttttaaaagccccagtttcagaatgtgaatcagggatattcctgttactaaaatggaaatgtaattccaagtttcttttttaattttttaaatttatgtcattgtattggactatgcttatatttaaaactacttaatttagagttaactacctgcttaggccccagaacattacttatgcccttcagttaccaaaagatttgtgcaaggttttgtaccctggtaaatgatgccaaagtttgttttctgtggtgtttgtcaaatgttctatgtataattaactgtctgtaacatgctgtttccttcctctgcagatgtagctgctttcctaaatctgtctgtctttctttaggttagctgtatgtctgtaaaagtatgttcaattaaattactccatcagacacttgtctgtcttgcaatgtagaagcagctttgtagcaccttgttttgaggtttgctgcatttgttgctgcactttgtgcattctgaacatgaatgtaacattagatattaagtcattgttataaggggttgaatttaaatcctgtaagtcaaaattgaaagggtgttattaagtgtgcctttattttgcatgaaaataaaaagaattatacgtaaagcattcctgtaatctggctcattgaatattttatacttaaaaaactttttttggcgtaaatatttgtgtaaatactgggttaactttttaaaagcccattacagattaaatagaagagagtgatgtgagtattagtgaccatacacagtaattcagtctagatttcttttcctgtggttggaaagcaaaaatacatgatgtggaaaagcctgaatttcttgtagtcacttttgacagccctctaagggtcattgtctattaaaatagcaacagatctgatgttttccttagtcataattag

SEQ ID NO: 61423 - DNA, 1007 bp, Homo sapiens
tgcattgttgaaatgctggtatggcccttagttcaggattacctgcacagtagctccttcatgccattcattttagaccaactcaaagcaaagaagcttattctgtcatagtctgatgggatattgtcagcctgcatgtcaaatactttgtgatagttaaataagactacaggactgttagaaattcttgtctgttagtctgcatgccataggctgtcatgaaaattaaacagagactataggattattatcagtttttgccctctggtttgtaatgcaagttgggctcaagtttgtttgtttttttttccccattgctgttttactgattagccagtagagtgaaatattaaagtttgtggattactttttatttctatatttatcagaccccagtattagaccaatgctgagctaaacattgagagagcaagacattttttagcatgagttcatctagtcccctccatgtaagctggtggcaggggtcttggtactggtttagatgagtgtggaacaggctaatagaatattgtaagcatgcatgccctaaacttgagcctttctctctatttattccattgaaagtaggttcagctgcagcccggaaagaaatcataagaaacaaaattcgagcaattggcaagatggcaagagtcttctctgttctcaggtaatgatatattttcttgattatttgttttgcagaaattacgtttattgtaccttgttacaagcattgtcccgcatctaaaagcaaaatggggccgggtatggtggcacactcctgtaatctcagcattttgggatgccaaggcgggcggatcacctgaggtcaggagtttgaaaccagcctggccaacatagtgaatccccatctctactaaatatacaaaaattagccgggcgtggtggcatgcacctgtaatcccagctactcgggaagctgaggcacaagaattgcttgaacccaggaggcagaagttgcggtgagccgagactgcgcc

SEQ ID NO: 61424 - DNA, 1369 bp, Homo sapiens
tctctctttctacattcattcttcagtaccactgccaagttaaatctctatctttttatttgtcccaaccaccttttctccatcattcacttccttttttctggactctccatctgaagaacggctcatatatggcaataaaaaaggtacagaccagacagagtaacattgttttgaaatatgacttcataagttatcttcatgtccatgtaagttagcacattcattgagtaatgtctatgcagagtcctcttgggccttgtgcaaatttagcttaagttttatctgtgttagtgtttggtatttttagaagtcatattccaagatatctgtctttctgtgcatggaaatattttccctccttttcattcctgttttaaaatttcattcttttgcttatttgtaatgttttgtacttttccctgcatgattagggttgtttgattgtctattatttcccaaagaaatgttactgtgaccatttactttaatatgatgcatgatgtgtttgtagactgatttaaaatcctgatttgtacagtgtttttatattcctgtgaatttttcatttgatatcagtatagtttacatgtcatttggttttatagatatagaaattaaatctgaaaatatgaatgtacttattacagccatcctccccaacaccctactgcttatccccagtctagctactttaaaattctgtcaattttaaaacaaaatgtttataatcatttattagaagagaatcagacttaccttctatccttgaacaagtcacttaataacctcagtttctttgtctataaaatgaggagattgcactttatagtatctccattgtctcttcaaattctaatattctatgattcttatatttttagtttttgggggtttttttgtggtttttttttttggtattttaaaaatacctgtttagagtgctgtggtacccaggtacccacacagttttggacttgtaaaagctgtagcttcagtgctcataatatttaccctttagaagatcataaacatgtcatggagcctatttttttcccctaaaatatgtcttttgtttctgtctttcaagttggatttctttttctcttttcttgcagtcagatccagtcattatcttagtttttaattatatgtaattgtggactgcttgaattttaaatgagatgttctctcccagaagacttacagttgttcagacctctgtatacctaaggccccttttgaattagtgtctttagcctttccttaaccttctcctcaaccatggtgcttccatgtgtgttttcattgtgttgaagcacggctctaaggaaccacacttttgggtccagagtgattctagttgcta

SEQ ID NO: 61425 - DNA, 1054 bp, Homo sapiens
tgggaggctggggcaggagaatacagtgaacccaggaggcggaggttacagtgagtcgagatcgcaccactgcactccagcctgggcgacagatggagactccgtctcaaaaaaaaaaaaaaaaaaaaagagatgagtgaggtttccctatgttaccaaggctggtcttgaactcctggcctcaagcagtcctcccacctcagcctctcaaaaagcgctgggattacaggcatgagctaccaggcctggccaagtcttttgtttttccttccttccttccttcttcctttctctttctttcttttttaaaaaatagtatttagttttccaaactaagaccaagaactcttgctctatataattatttactatttcctccatttaaggttatatagtttttctttgaaaaaattttgtcattatcaagttaaattaatacatctgtattttatgttcttattactattacaactggtgtctcttattttctatctgtgtaaaagaatatactatatatttgtgggtttatcttatatctaacaaacttgaatcagcagaattattttctatgataattttaagtttgttttctattacttttaaaaatatgtcatttataggggattgatattgttatttattttctgtatttttacctttcttttattctttaaaagttattatgagtattgcaatagtatgttaaataggcatgatggtagataatgctttagtcctcttcttataataataagaaaaaaaggttccttgttaagtctaattatagtacttggttttaggtacctatgatttatatgaataaagatactgagtcatattttgagatggaaccagaaataaatataaaattttattatattctaatgagaagattttatatatcatcagtatttttcctattagtatgataatttatccacttgttattatcattcttgcattccagggatgaattgaatttgatcattaaagaggcagtgtagtttaatgaaaaggatcagtggtttaggtgtcttgtcactaccgttcacta

SEQ ID NO: 61426 - DNA, 1042 bp, Homo sapiens
agacagttatatatggtcagctaacatgtaacttttttttcccaaatagtgacagaaatgttggtaaatgttctgagtatttgctctgatgatgaactaatgactgaaggtgaagaccagtttgatggtatgattattcatcttactatttttttttttactgtgaaatggtatttctttactgcctagcctcagtacacactattttgcaaaaaatagtcattgctttcagagactatgctatttgataagtaacaagttactttttttggatattaagatttgaaaataatttcagtgatttcatttttttattgtaatatggggaagaagatgaactttgggaaaggagaaatttggaagaaagaagataaggaaaggaaaattgaagtgttaaaaggatgtagttcttggcaaatatggacactggttagagaaaagaggataaaaatactatttgttttattagaacaatattcttagtgcatcagaagcatacctgaactcccaattttgcttttcctgccttttagacactaaaatagactgcttctaaattagtgtgattgtgttctaaaagaccacttgctaatttagtttcagattctgaaagcatttttttccacagaaacaaagttatacatggttgttgttacgtaagccaacaagcctatgtacctaatgcatgtttatagtaaaaagtaatactatagaaacaattcattttattttgttttgaaatttttatttaaaactttattatttaaatgtttaattaaaacctgagtacataaaaaggtaaacaatatataaactgaaaacgattcccttccatattcccctcatatctttgttgtagtatactttttatagttgtaatcaatatttcaatgtttccgtgtattaaacatggtctgtatattggtaagatttaatagctacgtatttctaagtccattgataaactataatgtttggctagatgtggtggctcacgcctgtaatcccaccactttgggaggccaaggcaggaggatccctt

SEQ ID NO: 61427 - DNA, 1304 bp, Homo sapiens
ctgggggactgggagaagatttataaatagcccaatgtcttcagctgttggattttctttttttttttttctttagcttaaatcttttatgaaggggtggagagattgctttgcttgaaatgggcccttctgcatatcttaacaccatttttgggcattccaccgaaattcttggggaaatttagtagccttcattttagcaatattagtcattttaatagctgttctatactttaagagaaatcataaagagaaattcagattgtaacccaatattccttctcttatataaaaaatatgtataaaattttagtagtgatgcctttctaatttagaggaacacttgttagtacataataggctttttgagagaaaataaatgctatttaagaaattctgtttctgtgtttcatttgtagttctatagaattcttaggattttgttacctatcatgttcttttccattttaagttaatttttttcataagaaaatgcctcagtttccatatgtggaaaatgacattatgagagtacagacatgattataaaacattttgttcagtatccccctctattttttctcacctcttccatattacaaaatgttcctttctgtatgagatacgtcacttctgccaaggcaatttgtagttctgaaattcagaattaatacttaaactgtgtatgttaaacaggttttctgcagattgcatttggtgttcttcatttactcagtaggtccaatgttaatacggagatagaattaccctttagcatttgagaagggggccagttaagggcttaggtgcaagggatgcattacacttacaaccttctatctttggtgtatgagaaatagttcaatcatagcatcatcagatgaattaaataattcatcctgctcactctcctgccttcaggctagactgcaactcaactgttttaatgtaatatgggaaggatggaggggccaggaagataaggtaggaggaaaatggacatttcatagattctaatttgattctctgatagtcccacataaggaaatatttcgttatatctaatctaaatatttatgctatgagtatttaaacaaggaaagaaatagagataataggtttttctcaactaatgcacctgtcaaaaaccagggcatcatagggttttagagctcataagtggatataacagtcatttagcccaactccttttgagagatgagataatttaagatgaattctgtggatcccttacaagtgaagatggagaacagtaggcttttatcagtattcctgtatttgag

SEQ ID NO: 61428 - DNA, 1036 bp, Homo sapiens
ggaggggagagaacaataaataaaaatccaaaatgtgaaactaagtaatatgtaaccccattccacaacttgtctcttggaaaagccattttgtaaaacgtgctctgagttaagtgcatcaagcaaaaccaaacatgattttctcaaactcccctttcttaaatcttttcccttattgaggatgttttcttatttgtataaagctgctgctgctttgatgattttatttgcactgtctacttgtttagtttatcatgtttcttgttttatgttcactgatctaggttctctttccctttcttatttccttcttttacctccacagtcttatcactgccccatgaagatttgtatttgagcttttttttaattaattcagtttcatctcatttgagggatacattcttctctttatttttactgcttttttcctttgccttccgttccagagattttcatttccccaccttccctgaaaatttgacctgtctatagtaattggatttcattttattttgaatacagtttattgacagaaagtgccaaagggtcttaatctagttaagtgtgtgccaaggacattgaagatgagattgggtatgtttatgtagtttacatctttggaagatgatattaagaggccagcttctcttctgtcttgacatgtctggaattcagttgactatgccatagcttcaggatcagactggagtggatgtgccaagaggaaagaacagaaggttaaagactttaaaaaggacatttagagagagaatgaggtcattgctaaataagggtcatggtgtaagttcaaaagaggaacagaggaagtttttttggatgatgagaggtgatggttaaaagattaaaacacttgcctgagaccaaacagtagcatgctggataacttgggtacagaatatgctacaagaacttacactatagatatcttatgaaatatgacttcatttttgagaagaaacatatctaagttttgattccattctttctctctctagacagggtctcgctctgt

SEQ ID NO: 61429 - DNA, 1047 bp, Homo sapiens
taaaatggtcacaccaccaccagtaatgtaattttcaattagttttttgtttttctaggtaaaattaagtattcggaaagagtctatgaagcttgtatggaagcttttgatagtttgcctcttgctgcacttttaaaccaacagtttctttgtgttcatggtggactttcaccagaaatacacacactggatgatattaggagagtaagtatatattttacttccgagattgatttctatttatagtacattgttgagtagagcagaagtttcaaacttcacttcactgccaagattaggtaatagtaaaaattagtatactgatatcttaaggaaataacttctgtttattcacaataatatagtatgaactgtattcaaagttggtatcgttttcctatgcacattttatccttactttttgatgagttacttctgttctttcttttctttctttcacagttagatagattcaaagagccacctgcatttggaccaatgtgtgacttgttatggtccgatccttctgaagattttggaaatgaaaaatcacaggaacattttagtcacaatacagttcgaggatgttcttatttttataagtaaggaaaaatatccaagattaatcacattttagttgttaacatagcatatgcttcatacagaaaagccattattttacttaatttactctttttcccccacagctatccagcagtgtgtgaatttttgcaaaacaataatttgttatcgattattagagctcatgaagctcaagatgcagggtaagaattctgtttccctgacccaaattaacacctaaaatataaatcaaacttagtaaccatgattgatgctttacgatgcatattaagctatttgttttgcagctatagaatgtacagaaaaagtcaaactacagggttcccttcattaataacaattttttcggcacctaattacttagatgtctacaataataaaggtaagatattgttgataaaaaaaattgttaaacaacttagtattttaattgactttttttaa

SEQ ID NO: 61430 - DNA, 1066 bp, Homo sapiens
agcatcattttaatatctacattgttttccatctaataaacaaaccataattaattaattccttgtgttagacactgaagatgttcccagtttttttctttacaaatgatgctttaatgagtcatattattcatacatctttacatacttgcctgattatttttgtaggacaaattcctagaggtagaattgtggggtcaaatttctaccaatagatacctgtgttgcacatttaatatgttctaagcatgttctaggcactgaagacatatcgattaatcctcacaataatattaatgaggtaagtactgttgttttattcattttatagatgaggaacctgaggcttagagaggttaagtaacttgcccaaggtattattagtaaacagcatagccaggcaatgtgactcccagcatatgcttttaaccaccttccctagtagatactgaaaccttacctggtgaatttatgttggttactgttgtttatatctccttctccagtgtttccaatatacctttttttctgaggtgtgctaggattctcagagtggaaggaagttctagactctgtctgtcctgcttcccttaggaattttgctattttgagttcttcttcctcctgctgatagttgattattagcctcgtcaacttttcccaaattgtcacagggcttcaggcaaatcagaaaatggcccattttaacaaaaaaatttcaggcatttgaccaaaacaataaaataaacagttttatgaagcttatttggtaactaagttggtgtgcatgtccttgtgtaagattgttttgcagctgactctttttttttttttttttaattgagatggactctcactctgtcgcccaggctggagtgtagtggcgtgatctcggctcactgcaacctctgcctcccaggttcaagagattctcctgcctcagcctcccaagtagttgggattacaggtgcccaccaccactcccggctagtttttgtatttttaatagagatggagtttcgccatgttggtcaagctgatctcgaactcctggcctcaggtgatc

SEQ ID NO: 61431 - DNA, 1080 bp, Homo sapiens
catcaattgtgttgaccatacttcaatttgatcaatacttactttgctttcaattgttagggtcaaataccttgatgtcatatcagataccaaaagtgaccatttagagagcaacagaaagtattgagttagaatggatattttaactgccaccattgtaattttgtcatcttgaaacttaaaacacatccttggagtcctagagacgatctttataaatgtagatttcagtttgtcactgaccacaaatttcgttatttctgttacatctttttctagatcttgagcacatgaacacttggttacacatcatcctaatcatgactgttcatagactacttccttctcagacatttcttgatagcatttgtactatgtcttatgtaaaatacgttttaacttaagtaaaatttgttgttttagagatttttttcccttatctaataatcttcttgtttcagtgtgtggtgacatccatggccaattttttgatctgatgaaactttttgaagtaggaggatcacctgctaatacacgatacctttttcttggcgattatgtggacagaggttattttagtatagaggtaataatcataaactgtcatttgatttgctgttaagtgttaacacagatgctttcacttaatcctagttttcacaagtacctgtgttaggtttttttaataactctgcatattctgaagtttttatgaaaagctactatttattcctgttctgtctttcaaacaattcaaataaatttctttgtataactctgtttatataattataattgccatttttttcccagtggaatttatgagctgactgaggggtctttattgccctgttaactagtggccttaaaaatttagtgctatttatctctcttgcccctaaaggcattaaaccatgtgaaaaaagattacttgaattctgtctgattaaataaagtatattgtgatttttttattgcttgagccctagtgcttctgtttctccttgtgtagctattaagactcaagtatatcctatggaatctttgtgtatttggaaagtattaatttgtttttaaaaa

SEQ ID NO: 61432 - DNA, 1060 bp, Homo sapiens
agggttcgagtccagcctggccaacatggtgaaaccccgtctctactaaaaatacaaagattagccgggcatggtggtgcacgcctgtaatcccagctgctcaggaggctgaggcaggagaatcgcttgaacctgggaggcagaggttgcagtgagctcatgttgcgccactgcattctagcctgggcaacagagcaagactgcatctgaaaaaaaaaaatacacacacacacacacacacacacacacacacacacacacacaattagccaggtgtggtggtgtgtgcctgtagtctcagctacttgggaggctgaggcaggagaattgcttgaacctgggaggtgggggtttcagtgagctgagatcctgccactgcattccagccccggcgacgatgcgagactctgccaagaaaacaacaaaaaaagagattgtgtgtagggtttgtgggatagattaaaacaaaatcttataataggaattctgaaggcctcaatgaaaaggatggagggagaacagcaagaaggaaattgtatgagggaaagaaatacagagaaaaatttagaagtatagatgtagagactgtattttggatagttgccaaggatggcaatgatgggaagcatgatgagattaactgaccttaggcatctgaatgatactttggagtcaagttattcacttggcacagactgtacccccgttgaagtcagaggcctcatagggctaagagggcagtccttgcttagaattggggaacaggatcagttaattctcaggtttccttgcccagtggtagaaacagtaagaagatctctgtaccaccaccccctttttcccaattcctgatcagtctgtgttcttggtttctttttccaacttcctaaattaaaatgtttttcagtccttgtttttttagccaccatacattaaatgtgagtgaaaataccttgcgaatattattggttactatatagagatgcccttcatgtcaaaatttggataaaaggaagattttcaacagaacagtttggtcaaaatgaatgttaccaaatca

SEQ ID NO: 61433 - DNA, 1345 bp, Homo sapiens
tttttttaaccctcaagacaggatcttgctctgtcacccaggctgtagtgcagcgccatgatcatagctcactgcaggttcaaacttctgggctcaagcgatcccccaactcagcctcccaagtagctgggactacaggcacacaccaccatgcctggctaattttgtttattttttatggagacagaggtctcactatgttgcccagattggtctcaaattcctgggctccagtgactgtcctgccttggcctcccaaagtgctgcagttacaggtgtgagccaccacgcccagccatgatcagccttttgatgtctccttttgtcaaaagaaaattgtccttgtgttggtataaagacatatgctacaggagcagcattctgaagacttcaatttcaactatggctctacttcttactagtgaaacccctggagaagcaacttaatgtctctgaacctgttatctatcatttgtgaaatgggagataaaacttgcctgaccctaaccccagcactttgggaggtggaggcgggcggatcacttgaggtcatatgttcgagaccagcctggccaacatggtgaaaccccgtctctattaaaaatatactaattagccgggtgtgatggtgggcgcctgtaatcccagctactcgagaggctgaggtagggagaatcgcttgaacctgggaggcaggggttgccatgagctgagatctcaccattgcactccaactggggcaacagagcgagactctgtggaaaaaaaaaaaacaaaaacttgcctgaccaaactcaaaggatgtccctgggaatcatgtaggattatgtatgtgaaagtacttggtcaactatgaataaaacactataaatatattgtcattgctacataaattagtgtcgttaaacaagtattttggaaactataatcattaattctgtaaacatttcttaatacctatgtttttcctgtttgttttttttttttttttttttggttttggtttttttttgagatggagtctcactctgttgccctggctggagtacagtggcatgatctcggctcactgcaacctctgcctcccaggttcaagcaactctcctgcctcagcctcccaagtagctgggattataggcatctgccaccacgccccgctaatttttgtatttttagtagagacgggatttcgccatgttggccaggctgttctcaaactcctgacctcaagcgatatacccaccttgacctcccaaagtactgggattacaggcatgagccactgcacctggccagttcttaagttttagataggttttgataatggtggaacttagaatggata

SEQ ID NO: 61434 - DNA, 1705 bp, Homo sapiens
ccagcctgaccaacatggtgaaaccccgtctctactaaaaatacaaaaattagcctggtgtggtggtacacgcctgtaatcccagctactcgggaggctgaggcaggagaatcgcttgaacctgcgaggcggagattgcagtgagccgagttcatgccactgcactccagcctgggcgacagagcaagactgtcaaaaaaaaaaaaaaaaaaaaaaaaaaaaaacaataaaaacaaacaaacaaaaattagcagggtgtggtggcacgcacctgtaatcctaactacttgggaggctgaggcaggagaatcacttgaacctgagaagtggaggctgcagtgagccgagattgtgccactgcaccctgcctgggtgacagagcgatattccgtctcaaataaataaaaataaataaataaaataaatcttcagtaccatgtgtcctagtgaaagcaaaggaacagaaagagagagagaaaaagagtgtgaggggatggggtgagagggagagggagagggaacactatggtaacaagttaccttaaaaggaaaatgccaagttggaaatacagcttagtagtgaggcaaaagcttcaggttccagagctattgaatgaattggcaagagttgtaaggaaaagtttggtaaaaggaccttgatttattaaacaaagcgtgccaatcatatgacctcatttcaccataaaaaatgttttttatacacagagatgaaataagctgaagctaattgggcatcgtctgtgtatggtatgtaaaatttattttggaacatcacagtcgtgaaatagcaaatatttattaaatgtctgctgtatcacaaaactgtaggagaacaacaaaagtacaaaatataaaatacagacttggttcatgaataaatattcatgaaaaattaacaatatatgacataaggacaggtatagttaataattgccaggtaagttgctgagcccgcaagttgtcagttcaaaggaggtagtgatgactctggactggaatggtctaggaagggcttgtgtagaagcaaaggggccttgaaggatggttaggattaaaatagaggattgggaccatttatttgtgcagtgtttattgagtaccagctttgtaccaggcattgtgctaggcattgatgatacagaagtgaataggatattaagtaagatagattctcttgtagtgccggcattctagtgggggagacactattataaataaataatgtaatgaatttggtacaaagcgctactggagctgtaaagaagggattggctatcttactttgagggaaagcgtcactgagaggataatgtttcgaggtagtccttgaaggatgagtagaatttcaccagaaagtggggctagagtaggtgtaacagaagcagaaaggcatggagtttgaaaaaagcatgaaatgtatggcaaaagtatgtgaagtgcttggcaaggagtgacaggaatgaagttagaaaagatcttttgtattacaagttgaggagctaaaacttaagctgttaagcagtatagcagtatatagtacctggatgattaaaagcacaagctctggagtcagactgcctgggtttgaatcctagctctactacttaataaccttcttgccatggacaagatacttaacatctccaagccttaattttcttatctgtaaagtagagctaataaa

SEQ ID NO: 61435 - DNA, 1052 bp, Homo sapiens
aataacgagtttatggaatccttaatacagagaaatcttaaaaaaaaaatagtaatgcagacattcattctatcaagaaatcctggagttttgtgggggtgggaacgggacattggctacctcttcattttctgactgtatttctgtgttgtgtgttcatttccctgggcacttttcaccagactgttagatggggtaaccaatcacattcctgaacaatgagtttatgctatccttacgtttgtgaatcttcttattccttgtcatatatatggtaatgttttttctgtactgctttaatgcagtgaaaataagattccaaacataaggcagattccttaggggtgagttgtgagtccaaggcagtcatatttgcaggttattggtgtggaataaaagccatttgatttagataaataggaaaggagcttgttaatatagaaaattatagttaaataaagcttatggttatcatatttctggtgcttcattgtgccctcttcatagagacaactttcatttctttatggaatttgttaaccagttggaattcctgtatggattatatgttttaaaatggtgtgtaacagactaatttgcactgctcatggagtctcctgcatttactgggaaattcacctttcttacagatccagaaattcacttttaaatttcatcttcaggattcttccttgtcttttattcagtaattatactataatgtgatacctgatattagagaatactggttgcctgatgataaatgatgtgagttcagcttaagtttaacttgttaaaatccaaatttcttttaagtccacaatgtggtggtagttttgtatcgatacattttcatagtagtgatattatggagactgtctgttggcattgaatgcaagtagtctttttctccctggaattttttttttttttttgagacggagtttcactcttgttgcccaagtggagtgcagtggcgcgatctctactcactgcaacctctgcctcctgggttcaagcgattctcctgcctcagcctcccgagtagctgg

SEQ ID NO: 61436 - DNA, 1034 bp, Homo sapiens
actccatctcaaaaaacaaaacaaaacaacaacaaaataaactactgtggcagcgttggtaccctgcatcactgccatggttgtgctattctcatctcaacatagaattggtgggttctcctaagggtgtcaggaacctctaaaaagatgtgattctttgggaggggatatttgaaattccaacttccattccccctagcaaaaggaagcagctgctgtttaagggttttatctgagccactttaaagatgaatccatggtattactctggatactagccattccttaggattttaaggtcacattttattcctggatgctttatgtccccacctccacctgagccctcatcctctgttccctactatactcccaacttctactctttgttttatccacctatccctattacctgaccctttgtcttccctgtctcccatccttggggggacatgtagccctgtggtcatggttctgatgacatcatcagggcagcccccctgcccaggtattatggcctgtcagcattccctgtgccctccaaaccttaggcctagaatgcggagctgccaacataacattcacccttttgaacagatggagtcaggcacactaacacagccttctgtcctcaataacacagccattattgccacttgctcagtcgtcaatgtaaaccctcagagtcagctgaactattttaggccaaacatactgtttttgtaaagtatttttcattaataaatctataagacagttctatttaattccttgtcattcttccctttgtatgctcttgctttctttgtattggggctggaagtctggataaatatatgaagtggcttttgactgagtggaagtgaggagccagagacgagttgaaggatatacaatcaaggtgggaatcaatgggtcctaaaatagggtgcctttcctttctagtattgctgctaggatgtttcccatccctttcctgacagagcattcagtactcagtacattatacacttccttcctcccctccttaggaa

SEQ ID NO: 61437 - DNA, 1035 bp, Homo sapiens
gtctctattttttttaaaaagaaaagctgcgtgaggttttggtatggtggctctaggagtatagtcatcacaaagggagtatacgtttgccatatattgctatatattagggagcccttcttttgtaggtgtgtgtatagtggatgagagattatagtggagggaggtagaggtatggcaacatccatgagactgtttcatttgcccaggttggaggtatgagatttgattttgatgtatattaagaattttaagaaatggaatcaaaagcacagcttgattcattctttcccttgtatgtatgctcttggaggagtagggaattgggctacacagctaggcatggctctctgggaaggagaatggttttctgaagatgctcagtctttgggtttcttttctttccccaggaacttcaaggagtgtccagcagtttctggctatgtgtgacaggggtgaaacttcccaaggggccaagtacacaggaaggactttgaactaccagagcctcccccatcgctccagaacagacaactcctgggcaccctggtcagagaccaaccagcatattgggaccagattcctgactactccagggtgcaatcctcaactaacctacactgccacactaccagaaagaagcaagggccttcaggttcctcacactcagtcctggagtgatcttttccattcaccctcccaccctcccattgttcatcctgtgtacccaccatctagcagtcttcatgtacccctgaggtcagcttggaattcagatcctgttccagggtcccgaacccctggtcctcgaagagtagatatgcccccagatgatgactggaggcaaagcagttatgcctcccactctggacacaggagaacagtgggagaggggtttctgtttgttctatcagatgctcccagaagagagcagatcagggctagagtcctgcagcacagtcaatggtaaaggttattcctttcctttcctggagctacacctttctttgtaaaactgtactgtgggccgggcgc

SEQ ID NO: 61438 - DNA, 1076 bp, Homo sapiens
tgaaagtatgagccatcagaagaatattcttggtaacagaaacaggaagtataaagactctgaggtagcaatgagcttggtgtgtttgaggaatattaaagttagagtgtaaaagctccaggaatgataggaaataaagtgaggagcagcagggccatatcacacaggaccttgtaggccacagtaaggaggagtggatgggagataggaaaagcagattgaaggctgttgcagtagtccaggtgaatttaaatataaaacccataggtagaaatgatagtccttggcaagtaatggaattgtggatgggaagtgggaaatcaaggtcattgccaatgtttgaatatgggtgatttaggaaaatgaggtgccaggaggaggagtttggaaggattttggttcaattttggatatgttagtgtttcagatgttaaaggggaatatttctgggtatttatcataaaagtagataactaatagggagtagagcaggacattagcatcagtaaatacaaacttgacaggcaaaagaggaagctgtggaatgtgtagcagtgacaggagagaagatggggtagagttcttgattctacatttaaacatatatagtttcattcccagtacttagaataagtgaaggatttttttttctcattctctcaggctttctgaatttctcatatttcgtttttatttttaaatttctatctcaatctctctaattctactgttagcattaaggagtttgctaaagacctgaatgatagggttgggaaggtgagggatatgaggaagactggttaagggataaggatctgaagtttgcagtttcttagagggctagcagggagagcaactgagtaaattgggtcctgttccagaacaaggcatgtaggcatgtttgtgctctggttccctccatttccctttgcttgcctcactgtgtttacccaactacatcctgctttgtgttaatcctcatctctatgtttttttgtcttgtctcattataaggattcatcaaacgtgaggaagcctttggaaaccgggcaccgttgttccagctcctcttccct

SEQ ID NO: 61439 - DNA, 1020 bp, Homo sapiens
ttaatggcaaattgttcttttcctaggagagttggcttcctttcttctgacttctgtatcattcattgattcattcttttaaataaatgcttattgattctgtacaagattcctagcacaaaaataaacaaataaataagtgcttattgagtgtgttctaggtattgtgctaggtgctggagctacaatggtgagttagatatagtccctgcttttatggagcttacagtctacagtgagggacggataaataaacaaacagttataatgtgttaaggatttgatcctatgggaacataatagaagggatatttaaatcaggcttgaggtatcatggaaggcttcctggaggaagcaaaaagaatatagcaagtaaaagggacctgagcaaatattaactgaattaaaagaagcttatttagtatggcaggattagaaagtctggcaaggggagatgatggagagtgttgacaagagaggatacaaagaatattatggaccacagacagccctgtatgtcacagtaagtagtttggaaggatagagataagtcgatgtatttgagacccagttaggaagtaaacatcagtgggagttggtgcctgcctggatgttgggagtggggataaaggatgatactcaagttttatgggtagataatgatatatttgagggaagatatgcattcagttttacatatattaagcttgagtggaggtatctggcaggcttttggaatgagatatataagctgcaaattgaaatctgggaatcatagccattgaaaaagaggaaaagacttgcagaaagagaagaggagccaggacatatccctaaagagcatcagatttaaggtggttcttctgaagaaccctaaaaggagactgagaaaaaaagattagagagactgaagggaaaccaaggatgtgtggtaccatagtcaccaaggggagagtgtttcaagaagaaaggaatagccgggcgcggtggctcacgcctgtaatcccagcactttgggag

SEQ ID NO: 61440 - DNA, 1167 bp, Homo sapiens
tgaataatatcagcttcagccagatatatatatatatattagaatcaaatcatcaaatcaagacatgaattggccatggacatatgtatcaaatgtaggtcaggggcatatacagttttggaatggaaaacttaattagttggattggggatagccccttgggagtcaccaatccagtttagagcaactgaacaatctagaaagattttgaaaagaggtaagcatttagtggttgtttagaaatttaaatgatttgagagaagctaaggggaaaagagcattacatatgtaaaacattcctgaggagctcctgctctcagagtaaaagaggtcaccaggtgagatggtaagagtactgtactgaaaatcaagaggatttaattttaatcctggttaaactactaaactctcagaccctggaactcattttcctgttatataaaatgaggaggtttgatagatgattattatgatcatttctattctgaactagactggagataatttcctttgtcaccacagatactttagaaaatcactgtgttagaaaacaaaactcactgtgttagatactttcctctgtctataagtcttgagcctaagtctgacagaagctgattatgtttacaaaaatgaaatgaagcaagatggggacactcagtaaactatctatattctaaaattcttgtttctttttttttttgagacggagtctcgctctgtcacccgggctggagtgcagtggcgtgatctccgctcactgcaagctacgcctcccgggttcacgccattctcctgcctcagcctcccgagtagctgggattacaggtgcctgccaccacgcccggctaattttttgtatttttagtagagacagggttttaccatgttagccagggtggtctcgatctcctgacctcgtgatctgcccgtgttggcctcccaaagtgctgggattacaggtgtgagccaccgcgcccagcccctcttgcttctaaattccaggagcatgttcctccgttgaattcaaggatgcatatttattattaaatgaaacaacagctcctgagtttgtgctgctaggcttagaggttaggccctaggggaagagatggcctcaacttgtatttgtgttttcctcttcaggctctgcagatggcatgggga

SEQ ID NO: 61441 - DNA, 1046 bp, Homo sapiens
tgcatgtgagactagctgattttgtttcctaatttgcaagtagaatgtgattggaatgcgacttcacaggtagtgaagaatattggcaagggctccacttaatgttactgtgcaactttggtgagggtgtttaataaagaggattaacgttacctatttacctgagtgtgagctgaccatgtgccttttcttttgtgatcctctgaactactgactctacttgtgcttgtctttctgtttatttttaccattccctgtgtgaatagctagaaatgggaatggaatgttgagttctttctgtaagtgttcctgtcagtcaaggcagcttatgactagctctctccatttgtttcagtgaacagcctatcccgctccaagtattgttaagccaagaggcccaactggaatccggcatggatacagagtttggggccagttctttcttccattcacctgcttcctgccatgagtcacactcatcactatctccagagtcatctgccccacagcacagctcccccagtagatctgccttgaagcttctgacttcggttgaagtagacaacattgaaccctctgcattccacaggcaaggtttacctaaagcaccagggtggactgagaagaattctcatcatagttgggagccattggatgccccagagggtaagctgcaaggctctaggtgtgacaacagcagttgcagcaagctccctccacaagaaggaagaggcattgctcaagaacagctgttccaagaaaagaaggatcctgctaacccctccccggtgatgcctggaatagccacctctgagaggggtgatgaacacagcctaggctgtagtccttcaaattcatcagctcagcccagccttcccctgtatagaacctgccaccccataatgcctgttgcttcttcatttgtgcttcactgtcctgatcctgtgcagaaaactaaccaatgcctccaaggccaaagcctcaaaacttcattgactttaaaagtggacagaggcagtgaggagacctataggccagagtttccc

SEQ ID NO: 61442 - DNA, 1676 bp, Homo sapiens
cagtgaacgtcttagttgacatctagggtgttctgacactagttggcaagaattgcactgggaaagagcagttcaattccgggcataagaacctaaccttctgctattactttgttctttccttgagggacttcctccgctcgcactgtcatataagtaccgcgcgctaaccgattgcaccactggagctccttccttgagggacttcctaagggtcttggtgttagaatatgtggccattaatggcatgcctctctttcatggccttggtaacatcttggttaaggcaaaatggatgtcctgcttgttttcagataattcttaataggaatagacagttggaataagggtagaccagtggctcagcagcaaggatctctgtgtactgaagggaaacaacagtacacaggaaaatttggaatgaattgtaatgaaaatgaaaagtgctggccctttcagggaggagtgacggctttgagaggtccctgcaagaggcagagtcagtgtttgaagagtcactacatctggaacagaaaggagactgtgctgcagctttggctctctgtaatgaagctatctgtaagtaactctaactgctatggctgtggcacttttgactaacttcacaataggtattattagtgttgtcactcagacaggataaaaacagtttttgtgtctcctcactcttgctctcccaaactgagtcgcgttagctgtttttgccctttgatttctaagtgtacctggcactggcactgtggcctatggatatttaccagaataacctcagcaaggaatccatagatgatttctccagtcatgcctaccttcttatttcaggataaagttagacctcagatgtgaaattagtctgctcttttgctagtcactggctagtgggttggagcttatagaaggaaaactgaataaattggctatgacttcccaggcctgtgactttttaattcagtatttgattctttctgattctcccctaccttcatagtatgcagcaccataaacttacagcaagagactaaggcttagaattggtatcagcttcttgtatgtgacccacaagaagctgtggtctataaagacagatgcaggtttggatcttatttctgctgttggccattgggaagagaggggtgagagtagagtgtggagaccagagtcagacaggtcagatgcaaaggacaagagtggcaatctctaagatggaggcactggtttatcttcttgatttattttagttttgtttttttaatttggattaacctgtttggcctccatggcttccatcaatgttccttatagccagaggcagctgtgtgccctggacagcatatgcatggtccatgccttgcgttcctgctacatattttgagttttactgcatatctttgctcattttttttcaattttattctttttatttttatttgtgttttgtgttctgtttctgctatattttcttttgcattttagctaaactaagacttgccctgcatggtgccagctgtagcacgcacagcagagccctagtcgataagaagttgcaaatcagtattcgaaaagcacggagcctgcaggatcgcatgcagcagcagcaatcaccacagcagccgtcgcagccctcagcctgcctcccaacacaggcggggactctc

SEQ ID NO: 61443 - DNA, 1022 bp, Homo sapiens
ccatctaaatagatcttacttttcacaactttttcatcacttctgcttttcccccgataggttttataaaaccctcacagtttttcacagtggcaggcaaagtgagggcttcagcagggtagggaaagggatgggaggaattttacatgtgtctgggtgatctggaagttgggtgttgggaagaatggcttgatggtatagcatatccttctcacacttgtgtctaggaagttcttgccttatggagctttgttgtgtccatctcttttccttctctttgctactgttctgtttcctcactttttgcatatgtgtttcctcctcctctcagggagggagccctccatctcaagtgacactcgaacagattcctcaacggagagctatccctacaaacattcccaccatgagtctgtggtcagtcacttctcttctgattctcaggggacagtcatctataatgtggaaaatgattccatgtctcagagcagtcgggacacaggtagggacttatacagagggtcctgcttgcctgaatcaattcctgcatagatctcctaagaaaaagaaactgtgaggccaggcgcagtggctcacacctgtaatcccagcactttgggaggccgaggcgggcggccaaggtgggtggatcatgaggtaaggagatggagaccatcctggctaacacacggtgaaactccgtctctactaaaaatacaaaaaaaaaattagttgggcatggtggcaggcacctgtagtcctacctactcgggaggctgaggcaggagaatggcatgaacccaggaggcgaagctttcagtgagctgggatcgtgccactgcactccagcctgggcaacagagcgagactccgtctcaaaaaaaaaaaaaaggagaaagaaactgggggaagtcagaaatgttcgttacgcaaaggcacaatggcacagaatttgggcaattcaatgggatacaaagaagcaacacagttttgaatgaaccgtgatgctccattgcacatac

SEQ ID NO: 61444 - DNA, 1039 bp, Homo sapiens
gtgtcatgatctcggttcactgcaatctctgcctcctgcctcaacgtctcaagtagctgggattacagacatgcaccaccacacccagctgatttttgtatttttagtagagatggggtttcactatgttggccaggctggtctcgaatacctgacctcaagagatctgttcacctcaccctcccaaagtgtaggaattacaggcgtgagccaccacactgggcctaaagatagggtcttgctatctagtctaggttgttctcgaactcttgtcctcaagtaattctcttaccttggcctcacaaagtgctgaagttaaattctgatgattaatctaaactaacaaaaatcttaaactgaagggaagagaagcaagtcagtaccttacttaagaaatgctggtggagtctgctgagagatgatgtggaatggttgaatatgtgactgtgctttcttttctcttctttcccctcagctgtttttcagagtgacggatgaccgggccaagcaatctgaactgtacttagttggaatgatctgttactatggcaaacattattctacattcttttttcaaacaaagattcgcaaatggatgtattttgatgatgctcatgtcaaggaggtaggagtagtcaagtcctttttgaagtgtttggtgactacaaaaaaaaagaataatcatttgtctttagtgtttcattttcataattttgaatgggacctccccacatttctataaaacatatatatatatatattttttttttttttaattttttttttttttgagatggagtctcactctgtcacccaggttggagtgcagtggcttggtcttggctcactgcaatctctgcctcctgggttcaagtgattctcccacctcagcctcctgagtagctgggagtacatgcgcatgctaccacacctggctaatttttgtatttttagtagagacagagtttcactatgtttgccaggctggtctcgaactcctgaccttgtgatccgcctacctcagcctcccaaagtgctg

SEQ ID NO: 61445 - DNA, 1016 bp, Homo sapiens
tgtgtttttagcaggacggtgtttcatcatgttggtcaggctggtcttgaactcgtgacctcaaatgatctacctgccttggcctcccaaagtgctgggattacaggcgtgagccacagtgcctggcctattggactttaattggagacattcaaatagttttatatcttggccgggcatggtggctcatgcctataatcctagcactttgggaggcccaggtgggcggatcacttgaggctaagagttcgagaccagcctggccaacatgacaaaaccctgtctctactaaaaatgtcaagaattagccaggcatggttgcgcgtgcctgtaatcccagctattctgaaggctgaggcatgagaattgcttgaacccaggaggcggaggtttctgtgagctgagattgagcccctgcactccagccaggtaacagagcgagaccctgtctcaaaaaaaccaccaccaacaacaataaaaacacaaatagttttatatccttattgctgaatctgtgctatattgtaggaatgcagaacagtaatttaaaaataatttttgttctccttctttcctctcccatccctccccttttcttaggctcagtactggccagcaaagtgggaggaggagtggggattctatgagctttggatctggggacaggtagaggtacttactgtgtttatgggacactgagcctggtcaggggctttggtatagggggcagaggaagaaagtcaaatgtgtgagttaggaatgtacattaatgtttgatttagcagtaactaaatacaaaccatcatcccccttctattccccatcttgaagcaatcaggctatttgtatgctggaaagacgagagaaaccttcaccaagcatgtttggtgagctgctgcagaatgccagcaccatgggggatctgcggaactgtccagtgagttaaatcaggggtggggtttggagtgggaaagggaaccatcgatcagtggaattgatgcaaagccagtgggaaa

SEQ ID NO: 61446 - DNA, 1050 bp, Homo sapiens
attaaattacatatgtgatgatattaagacattaataacttttggggtgtgtgtgataatgatattattatttatttagttatttattgagacagggtcttgctctgtcacccaggctgaagtgcagtggtgcaattatagctcactgtagcctggaactcttgggcttaaatgatcttcccacctcagccaactgtgtagctgaaactacaggcatatgccactgtacccagttaatttttttttgtagagacaaggtcttgccttgttgcccaggctggtctcaaactcctggctttaagccatcctcccaaagtgctgggattataggcatgagccacagtgcccagccttatggtcatgtttcagagaaaaagttattattttttagagatatattttgaaatatttacaaatgaaaaatgtttggcacttgtttcaaaatgatctgagagtaagttaagtggatgggtggtatagatgaaataagattggccacaggttgataattgttgaagttgaatgataaataaagggagttgatttagctcttctgtctactcttgtatgtttgaaattttttacaataaaatgttaaaatcctatgttattatttttgagtgccaaaagggtaaaatgtttttcccctcttaaaagacaactttcaacattcttttgaatacagaaaaccaagtgaacgtctcttttccagtagtcagtgatcctcaaggactagctcctttaacttacttacagagggtagtgtttacaaagaagccagactggccaattaagttctatgattcccaggagatgtagcgaaagcagtgattatgagagccaaaattgggaagtccaggttgagaagagaaaccctaagaattgagttaatggcagggtgtaaagtttgtcacacctttgcagaaggtattgcagggatgaagtgggctgcccactggagcactttccaaagaccttgagctcaaaaagcaccaaaattagtgacaacctttctccttaatcctcaccttctctactcatgacttcttt

SEQ ID NO: 61447 - DNA, 1081 bp, Homo sapiens
cttaaggagatcacacttctcttagaaatgtctgaaaattgagagtcctaacaaagataaaattccacactacagctcacatttctacagttcacatttctaatataagttttaaaatatttttgcttttcttgtgtggataatgaatataaatccttattcttcagctttaacccgtaaatttcctcttccggatcacatttgatgtatatcatgtcatattttaactgtattaccttcactttatgttcaaattaatatctttcccagaatatgaccatttatttttcttgttagatacctcaccttttttcacatttgttttaatatactagaatgaagttttcttttgggaataaagacatcttctgcagtcattacctatgtttgtttgaactctttactttaaaattaaatggtagctttttatagagtaatgaaatattttccttttctcatcaggttttgtggcacttggatatcttccgacgtagctttaggcagcttacaactcacaagtgcatgggagattcctgcatcttttgcgctctcaaggtaagtacttccaattagtttcttctcactaccattgggtggccaaatggtcaatatcaaggtggtttggttaatcaggatgatgccaaagaatttgttactgaattatctacctgtggtttagtgcaaaaatggatatgatttgtttgcttgcttcaaagaattagtacttggcttgggtagtctcttttactgaaccttttttgcttatgcagctctgtttgatgtgatagaatactatgcaagtatgcttctccttttttttttttttttttttttttttgggatgaagtctcactctgtcacccagtctggagtgcactggtgcgacctcagctcactgcagcctccgcctcctgggttccagcaattctcctgtctcagcctcccgagtagctgggattataggcgtgtgccaccatgctcggttaatttttgtatttttagtagagacggggtttcgccatgttggccaggctggtctcaaactcctgacttcaggtgatctgcctgcctcggcctccca

SEQ ID NO: 61448 - DNA, 1047 bp, Homo sapiens
caaggcaatagagggtgaggaggatcatgttggattcttgcttctctgtctgcctctccttccagttggaaaaatcttcagtccataagaagcattatcaacaagcctgaagaacacatcttaccctgatcctggatgctgttggagttgagaattacatccacttcaccaggactttatggaggctgttcaagaaaaatagaaggaagcaatacttaaggatttctctgtttgcattagtcctgtgccatgttacattttggagattgtttggaacaagtgagggagggctctgtcatcttgatctaggaggatacctgagtcccttgactacacagatgatatttggaaggtggtaaagtcaaaatcttccaaaataaattcactaaattctggattccctttccttttagaactttagcagacagaaattcctgccaaaaaggcacaaatccttctccatttttttttcaggctaaatgtgaacaataatgtcttggaagagaaattatttttcagggggtcgtggtagtgtacaagggatgtttgcacctcgaagctcaacctccatagcccccagcaaaggcctcagcaatgagccagggcaaaacagctgcttcctcaacagtgccctgcaggtaagggtcatttctttatttttggtgaactttgacttttaattgctgatgctgtatttctgataactctttttaaataaaatgtttgatagtctctgtttgaggttagtaacctgagataatttttacatttatctgtgtgatctttggcaagtcactttatctctttgaatctcaattacctcatttgtaaaaaagagggattaataatgataagagaaataataataactgtaactactattatttacatgcctaaagggaggtaaatggaccaggtgatctttcagacagagtcttgctctgtcgcccaggctggagtgcagtggcgcaatctcggctcactgcaacctccgcctcccaggttcaagtgattctcttgcctcagcctcccgagtagctgggacta

SEQ ID NO: 61449 - DNA, 1048 bp, Homo sapiens
atttgggaagtcaaggcaggtggatcacctgaagtcaggggtttgagaccagcccctggtgaaatcccgtctctactaaaaatacaaaaattagccaggcatagtggcacatgcctgtaatcccagctactcgggaggctgaggcaggaggattgcttgaacctaagaggcggaggctgcagtgagccaatattgcgcgactgcactccagcctgggtgacagtgagattctgcctcagaaacaaaacaaaacaaaacaaaacaaaacccaaaaaacaaaactaggtagtgagagccatacagataaaactataattcccctcctcacatatcttcagtaaatggtattggagaaggattacattgtttaatgctatatctacaatttaagtgaaatgtttttggtgttagtatttctctggaccacttgttactgcctctcttgtctggtcctttatgctctcacttctagttggtgacacatctagaacaggtctgagaacttactgctttaccctacataatactgccattcagagcctgagaatcttttctctgctactgcgtttttctccttttgctccctgtactcaggagtgtgtgtcatagggcaggctgagtttcagttagctcctaatgtggatattggaaaccccacctgcctgccaagtccttttggctgtgagcaaagtggaggcttggtacttgtcattcctttgcagcagttgagctgaaggaatgctgcatggcttgttggaagttgcttagtggccttgagtggggtgtgtatgagggtgtgtgtagaaaggtgagggtcttatagtctgtgtgggagatatgggttcttttctagtgtcatgttaatcatcaggcagtatttattgactgccttcttatgactggcactgtaataggagcttttggaatagaataataaaatatataattaagtcattgtttaatagtcaaacatttctagatctgccacttaccagtgttgaattgggcaagttaatgtctttaagcctctctttacttttctgtaaaa

SEQ ID NO: 61450 - DNA, 1055 bp, Homo sapiens
atcagtatgcttataaaacaacttctttcaataaaactgttttataacctcaggtaatacatagaagggtgtgtgttggtcctctggggcctttgtgccctgcctgcaaatgcaagttctcggttgactgatcacatgtttgggggtgggactctgcctgctgtttgttcttggtgatgtaactaggtctcttccccgagagaggggtggagatctttccctgttgtggactttggggttgagaacccttagatcccaagcattttaaaattgactcagtagattccaatggctcagtttaaataataattttctttaatagtgtggctcgtttaagacagttggaggagttttgcctattaaaatgatttgatttaatttaagcccagtcttggaattctgaattagggattccaacaataacattgttttgattattctgtaaacaactacaaaaatgttgtcttctcgtgctccttttgactgcagtgcaaaggaatttttttgtgggggactggcccttctttggaagcagcagccaccctgcaaaccttattgtttaatgacctttgtcatcaggaatgccccaggaaacagcttcataattgtttttcttaagcctcaggtgaagtttgtgataacgtcctttcaagttacttttggttagtttcttaagtttactttgtttttaattggaagctccacctttttaactttgtcatgaattgtcagtgctgagttcctggtagttggtaaaaagaattgccttctctctgatatcctgttctgcgggaagtccttgtggtttagattcacagtttctcattgttgctagctacagtcgtctcctccctcctagccttccctccccacagctctagctattcccatatccctccccattcttgtatcacttgccccacagataccctcgtgattagaggtcttttgctggaggttgactgtgctgtctggtaagtattgtagttgttgtggtaaaaacagatagatagaagattcaggaaccggttagtttttgtgaagttttctttctt

SEQ ID NO: 61451 - DNA, 1856 bp, Homo sapiens
aatgatttacaaatattttctcccatctcatgggttgtcctttctcttttcctttgattcacagttctgttttttaaaaattttattatatattttctaagacatttaaaagaataacacagtaaacatctttataatcgccatccagcaaattaaatattagtaaattggtttgctcccgagtttccccttattgattacaagtccctcaccaaaggtaaccactaatgaatttgatttttctctgacatagtttatactccttagacagcctgttagcgtattagaagcttgtgatgactgaagtaaaaatactgcaaaggtcctggggaaggctaattagggtgggatgagttctttcttagatttttgtgatgctgttttcaaaagcccagttcagcaccctatcagagatacttgcacataataggtgtatagaaatgtttgttgaataactatttggaacccatgtacttctgattgaagatattttgtaccactattatactatttttttttttttttttttttttttgagacagagtcttgctctgtcgcccaggctggagtgcagtggtgcgatctcagctcactgcaacctccacctcctgagttcaagcagttctcctgtctcagtctcccaagtagctgggactacaggcgcacaccaccacgcctggctaatttttgtatttttattagagacaggttttcaccttggtcaggctggccttgaactcctgacctcaggtgatccacccgccttggcctcccaaagttctgggattataggcatgagccacagtgcctggccactattatactattttttttttttgaatcagagtcttgctctgttacccaggctggagtgcagtagcatgatctcagcttactgcaagctctgcctcctgggttcacgccattctcctgcctcagcctcctgagtagctgggactacagatgcccgccaccacgcccggctaatttttttataattttagtagagatggggtttcacagtgttagccagaatggtcttgatctcctgacctcgtgatctgcccacctcggcctcccaaagtgctgggattacaggcatgagccaccgtgcccggctattatactattttttcatgaagtgaagtttacatatctctgtattaggattactgtatactttaccaataaatagactgctatggcagaataaaggttttcttagaggtagtaaaactgagggcaaacctgagttgggaacattttagctctaaatacatacagtacatttagctgccttggctaatttaacttttagacagggcaaatggaataaggcagatgttgaggtgctacattgttggttcagaaaaatggttgtgagttttgaaagaaggcatgattctggtaagatctgactgtgggcaaggggctgttgaaacaaacagtgcagtgtttccagggcagtggtgaaggacttgacctccgttgtagctgaaaatgaagtccttctctaacaaagccatagtagcagcagcagcagctgttgccactgccacctgcgttcagtggctgtgtgaggtggctagaccaggaaatgattccatggcactaggcatgtataaggaaagacttactttggctctggcaaagtggttgtacaggttgtgggtgtcactttaaacatacaaagatctgcttgctggaggaggggcagcttcttgaggatcaggtgtgcatctgaaagggatgagctcatccttctaaccagacctgctctagacgctgactgaatgttttcctagttccaagtcctgcagctgggagaagcaggaaatgattgacacttcaggcac

SEQ ID NO: 61452 - DNA, 1079 bp, Homo sapiens
gggggtggggcggggctgaggccccccaggctgtcgttcgcccttttgggggctaaaggccggaaaataaccgaggtggtagttggccgctgcccttgtaggcccggggtaaagggcctggctgaccggttaaagatgcttggagctggggtcggggctccaccacctggttggaagggtctggggctggctacaggcgccggcaaggggctgggtgggagcacagctgcctctgggggagcactctgggcccgaggtggtgactgcaggccttccccgttgagcatggctgctggttcgacccgtgccagttcctgggtgctggagtctgcgcgctggcgctgctgttcaaagagctgcacccctcgcccagagacctcactcagctgccctcccagcccagagccctggccctctgatgctcttgagcccgccctggcaagctccatgtccagatagggactgtcccagtcagattgattggtgaggctgcgggcgtcagagaaggcttcttcgtccagctcggactcactcgtggggggaacgccgtcctcctcctcagcgcctgtcccagcagcagccccgaagctcaccagggtgtacttcttggctctctgccgccgtttcttaaacataagtacccctttggagtgggggttgggggctgcagtgagcagggatgcaattgtcctgcatttggtcttggcctcttttatgctcttctcttggaggctctctgcacgttgcagttctggggaggccaagaggtaaaatggtcaggggggcttcccagcctcttttagtcctgttccccaaggctttcaccccccatcccagcaagctccctcttgcactgacccgacccacaatgtcccctgtgacaaagtcctctgacttaggggcagagtggagggtgaaaggtgaaaccaaggacagttaaagataaggcagagtccagttggctgccctgacactgctctgaccacagctcttccatcccattttactgctattctgctcctatcttccaagagatgtgctcttatccaccccacacacattcctcacctgcctcccat

SEQ ID NO: 61453 - DNA, 1149 bp, Homo sapiens
ggtcaggagttcaagaccagcctggccaagatggtgaaacccccatctctactaaaaagacaaaaaaattagctggtgtggtggtggatgcctgtaatcctagctactcaggaggctgaggcagagaactgcttgaacctggaaggtggaggttgcagccaagagggtgccactgcactccagcctgggcgacagagagagactctatctcaaaataaattaaaaaaatacaaaaattagctggacgtggtggtgcatgcctgtaatcccagctactggggaggctgaggcaggagaagtgcttaagcccaggaggcagaggttgcaatgagttgagatcatgccactgtaatccagcatgagtgacagagcaaaactgtctcaaaaaaaaattaaaataataataaaaaaagggaagggaagggcgcccacggggctctcagctacacagggccagatttatgttcctcaatcccagttatccaaacttctcaggtagcttagctagagcaatacaacccaacctgaagactctgctgatttccctccctagctcaaaggaaacagaaacagaaacataccttggggaggtgtttgctgatagcctggtactgggccattgtaggctccatagggaatggcgggggctgtggaccctgattgcccaccatagctggactgatgataccctgggtagatgggctggggctgcccaaatggtggcacaggtggaactgactggttgacgttcattatgaaagcattcccaatttgatctcacctgtgagagagaggagaaattagtcaaaatgaactttctaaagagagcaactattcagggcaggaagtagagataaaaagaaattgaccttatcagacagtgatcagtttaataatcctcacacttccacaggatcttagtaattttctgccccagccagcattcagattatctcctaaaagcaaggattttgttattctgaccatccaccctttgtcactgtctaaatagtataaatttcaacttcagacagatccactgaaatggagcagcagcctccattccccagtggtatgatttctagtgtctagtcacacagtcttgtggctgatgaactaccttgatgttacaggtgaaagaaacaatgt

SEQ ID NO: 61454 - DNA, 1168 bp, Homo sapiens
acttgaaatcccagacttgggaggctgaggcagaagaatcatgaggcagaggttgccgtgagccgagatcgtgccattgcactccagcctgggcgatagagtgagactccgtctcataaataaataaataaataaataaataaaattgatctgatgaaagtagaaaggttaggaatgtatgggggtttgtgttttgttttgttttttttctctcctttgcctttcttgtagatcactttttctcttccctctacccttttgtactttgtcttcttttttccaggttacaggtactgctgacgtccagccctgtggattattgacccatcttagtacctgggttcctttgcatattcttcattttctgtgaacttgagtttcttgctttactagacatacatcttcaataatggttgcagtcctgttgagactaccctaagggagaaatgggaagaggaaacttcaggattatttgcatctcttttgacttgcccctttcctctagaacaggcacttagtaggactgattggttaagtttgggcatggccagttatgaactgaaagatactaaaagggaaaccacataaatggtgaaaacttcagtggtacagtgacccaataaacccatcttagcatgaaagtccattaaaggagggcagtcatctctattagagtgctttttaaaattttttaatttttttttttgagacagggtctcactccgtggcccaagctagagtgcagtggcaggatcacaactccctggagcctggatgtctcaggctcaggtgaccctcccacctcagtttcccaggtagctgggactacaggcatgcgccaccacacccagctaattttttgtatttttagtagagatggggtttcgctgtgttgcccaggctgatctcaaaactcctgagctcaagcaatctgcccaccttggcctcccaaagtgctaggattacaggagtgagccactgcacctggtcaggagtgttgtttgtgtttggtaaataaagagtaaaatataactgtgggaaaggggtatgataatagaaaagtcactttctgacactttaactgggtgtccagaacacacattttaagcattgaatgtaagcctgggtaagtcaaacaagtggggtacatagaagataacaagtacac

SEQ ID NO: 61455 - DNA, 1029 bp, Homo sapiens
cagctctccagtgggactttacatacacactgccctcataaactgtcgttcactcttccccatccacacagcagaagcctaccaaacaaaagtactggggacttcctcctaaaactgtccaagtaagagcagagaaaccagtgaggctttccttctcttaacatctaacatcagagaattcccacctgctctacccattaggaagaatgccatccttctagatctaaggggacaagacccagtcactgctccacagaaggacaaaggctactatactatgtatgtacagtagtgacagagtgcagccctcagacatctactggtgctgctgctcactcttggtttcccttccttctctgcccagctatagagtaaaacagccccccaaaagactcctagaacctcaagttccagttcagaatcaaattatatgtaagttctccaagaagatgaacaaaaagggaaaattatcagaaaatgctaggcaaacatttcatctagattgacctgcctatctggcagacacaaacccttcctcaggaccatgaaagtttctacttacagggcttgggatggcatcagggtccaggcgcttaggaggcagtggctgaggaggcccaggctgactgccaaaggtgggtgctgctgggtaggggcctccataattagactgagggccccgggctggtccgaaggaacctgagacaaggacacaaggttgatgaactcaaaatcccatccctatctcttcttaaggcctcaggaaaatgactagactcctaaaaacatagaattatgaggcacactaatgcctggcaaagacattcagaaaaataccatgttatcagaacgacaagaaaaaataatgtcttacaaaccccatatcctaggaataataccctgaagctacccatctaattcaccacttagcaagtaatactaaaaacaaacaaataaaaaacatcaaaaaccacctgagtagctgaagcctctagcttctaagacagaccttgggaaagactcaccatt

SEQ ID NO: 61456 - DNA, 1013 bp, Homo sapiens
agatgaaatgtttgcctagcattttctgataattttccctttttgttcatcttcttggagaacttacatataatttgattctgaactggaacttgaggttctaggagtcttttggggggctgttttactctatagctgggcagagaaggaagggaaaccaagagtgagcagcagcaccagtagatgtctgagggctgcactctgtcactactgtacatacatagtatagtagcctttgtccttctgtggagcagtgactgggtcttgtccccttagatctagaaggatggcattcttcctaatgggtagagcaggtgggaattctctgatgttagatgttaagagaaggaaagcctcactggtttctctgctcttacttggacagttttaggaggaagtccccagtacttttgtttggtaggcttctgctgtgtggatggggaagagtgaacgacagtttatgagggcagtgtgtatgtaaagtcccactggagagctgcttttttcaggaagagggtgaattgcacccttggagccatcagaatcctcaggccctccttatcagactcagaatagagactaggactgtactgccaagtaggggccactttatagttccacctgtaacatttgctatgtcagttaccttgccatgcttagccattgtcatattccattctgttctcgtccctcttcctcctttgggtaaccaacacagtgagggagcctgttggccaaggagaactcaagaggattaagcagcctctccttccttccccctccttcagtgagaaggagagtctggttggacatgaagggaggcttctttcagcataagatagtccttagaatgggaggtttggccttttagggggaacactcctcttcttcttccttaaggtttcttccattcagcctcagcccctccctgtgtaactcctgcttgcctcctgtttgcccctttccttatctttctacatcatagtctgagccattaaagcctctgtgttggg

SEQ ID NO: 61457 - DNA, 1028 bp, Homo sapiens
gtgacatttgcctggggcatcagtaactggcacagaatcccagggatacgggaggaggtgttacagatatttggttagggaaggagctggaatcaagattcttagagcaagagtgaagggcattagagatggggccagaaaggagaatcctagataatcttggctttctccctcatatgcccatggcagcccctagtctgatatggccggttttgcatttcctcttctctttcagtgagaaatgcagctctgggggtgggatgtaggaagagggaactatataatttttactcatagggacattttcctgtgatttgtctttactccctttcatcattgtgctccctactccctctgcagacagaatatctgcgccatgcgccttcttcctccggttgttcttcctcatctcctggctgaacctactgtggttttcctttatgtctgatcccttcccctttgcgccttaggcttcaccgtatgttgtggaccatggggaatctggccctttgcgctgcaaccgctgcaaagcatacatgtgtcccttcatgcagttcattgaaggagggaggcgtttccagtgctgtttttgcagctgtatcaatgatggtatgttcatggaagctgggatttgggggaaggtcttgattgtatcttccttgttctctattaaatagttagagagatgagggtccatctttcaggagctggggaagtagggcacatgggaatgagggatagtggtgtgagctcagctagggccagaatactaagattgaaactggatcttcgagtaacacactgccatgcttcccacagttcccccccagtattttcagcacctggatcataccggcaaacgtgtggatgcttatgaccgccctgagctatccctgggctcttatgaattcttggccactgtagattactgcaaggtgagggaaggtagcatgggaggagcagtgagtggaggataatgagacagctgagaatggctgttatcatttccctcaccccttttttgtccc

SEQ ID NO: 61458 - DNA, 1014 bp, Homo sapiens
caccttttccaccacccacaacttcatgacaccaagctacatttcttcagtcaacccagacaccctatcattaacctcaggaaacacctcagttctgtaactctcacctaggtagaaagtctaacagtgacttgagctcctcacagaggagcctaacaagaccagtcctgatggcattgtaggagacgtcaatcatgaagataaaggcaggagggctggggaacttattgttctgcagaggaagaaaatgttggggagagggggaatggtaagcaggccagttgactatagagaagtcagcatcaaaaagggacaaaaaaggggtgagggaaatgataacagccattctcagctgtctcattatcctccactcactgctcctcccatgctaccttccctcaccttgcagtaatctacagtggccaagaattcataagagcccagggatagctcagggcggtcataagcatccacacgtttgccggtatgatccaggtgctgaaaatactgggggggaactgtgggaagcatggcagtgtgttactcgaagatccagtttcaatcttagtattctggccctagctgagctcacaccactatccctcattcccatgtgccctacttccccagctcctgaaagatggaccctcatctctctaactatttaatagagaacaaggaagatacaatcaagaccttcccccaaatcccagcttccatgaacataccatcattgatacagctgcaaaaacagcactggaaacgcctccctccttcaatgaactgcatgaagggacacatgtatgctttgcagcggttgcagcgcaaagggccagattccccatggtccacaacatacggtgaagcctaaggcgcaaaggggaagggatcagacataaaggaaaaccacagtaggttcagccaggagatgaggaagaacaaccggaggaagaaggcgcatggcgcagatattctgtctgcagagggagtagggagcacaatgatgaaagggag

SEQ ID NO: 61459 - DNA, 1028 bp, Homo sapiens
gtggggcagaagagtcagcaatccgcgttggctttgtcacctacaataaggtgctccacttctataatgtgaagagctcattggcccagccacagatgatggttgtgtctgatgtggctgacatgtttgtgccactgctggatggcttcctggtcaacgtcaatgagtctcgggcagttatcaccaggtaagagccagattgtggaggtaaaggttgggggtggcatgggtaccaccatagaaggtcatggagttgaacagaggtattggacagtagatggaaaggggttgtggcccaggagttgtcagattctagaggcttgatgactcttcagggaatcgagaactgaggtatctggaatctgtatagcaattttggttgttttccgtcacctatctctttagcttattggatcagattccagaaatgtttgcagacacaagggaaacagagacagtatttgtaccagttatccaggctggaatggaggctctgaaggtaaggctggagtatcgggcaacctcctctaactccattttcctctgaccatcttatcccctgggatacaacctctctttcttcagtagtgggtgactgtccagtgtgttagactgtctgacatagctggtgcttaataaatgacaagggaagagatggatgaataaagaataaacaagtagtcctctcttttttcctaggctgctgagtgtgcagggaagctctttctattccatacatccctgcccattgcagaggccccagggaaactgaagaacagagatgacaggaagctgatcaatacagacaaggagaaggtgtgggactggaaaatgggggaggggaaggatttttcattacagaggaagtggggactctactttcttgatggtggctaggaccagacactccaccctttcaaataccatatctgtgactgccaacctccactgctgccatacttctctactccatctgatgccaaagctgttggtagactcttgtatttatttattttttaaagaagaac

SEQ ID NO: 61460 - DNA, 1031 bp, Homo sapiens
agaatatcaatgcaggactgattccaaggcccatgttcctaactgccacattctcgggctcacttcttcagactatgcagtcttctcttccaacactatttcttcttttttggagacggagtcttactctgtcgctctggctggagtgcagtggcgcaatctcggctcaccacaacctccacctcccgggttcaagggattcttagcttcctgagtagctgggattacaggcgcccgccaccacacccgactaatttttgtatttttcgtagagatggggttttgccatgttggccaggctggtcttgaactcctgacctcaggtgatctgcctgcctcagcctcccaaagtgctaggattacaggtgtgaggcaccgtgcctggccccaacactatttctattaatgagtcagccactgcatatataagcagatattcccagccctgctgccacctgctgccccaaatcccacaccatacctgaaaggaagcatatttgtagacagagccaccagtgagctggggcacaacagagagtgtggccacatccacatactggttagggaagagaaagagatctacacagcagccttgggccacacactctttggccagggtctgataggcacctgtctgaggctggaacagagtctagggggaaagaaaatggggagaagaaaatgttcaaatatctcagctccgccctatttgaaaactgtatatctagcatgggatattcaaattcatggaagacttcagatctacttccaaggattttccaatagtaaaaaattttcttttatattatttttatttttttgagacagggtctcactctgtcacccaggctggcatagagtggcatgatctcagctcactgcaacctctgcctcccaggttcaagcgattctcctgcctcagactcccaagtagctgggattacaggtgtgtgccaccacacctggctaatttttgtatttttagtagagacggggttttgccatgttagtcaggctggtctcaaacttct

SEQ ID NO: 61461 - DNA, 2155 bp, Homo sapiens
agaccagcctgactaacatggcaaaaccccgtctctactaaaaatacaaaaattagccaggtgtggtggcacacacctgtaatcccagctacttgggagtctgaggcaggagaatcgcttgaacctgggaggcagaggttgcagtgagctgagatcatgccactctatgccagcctgggtgacagagtgagaccctgtctcaaaaaaataaaaataatataaaagaaaattttttactattggaaaatccttggaagtagatctgaagtcttccatgaatttgaatatcccatgctagatatacagttttcaaatagggcggagctgagatatttgaacattttcttctccccattttctttccccctagactctgttccagcctcagacaggtgcctatcagaccctggccaaagagtgtgtggcccaaggctgctgtgtagatctctttctcttccctaaccagtatgtggatgtggccacactctctgttgtgccccagctcactggtggctctgtctacaaatatgcttcctttcaggtatggtgtgggatttggggcagcaggtggcagcagggctgggaatatctgcttatatatgcagtggctgactcattaatagaaatagtgttggggccaggcacggtgcctcacacctgtaatcctagcactttgggaggctgaggcaggcagatcacctgaggtcaggagttcaagaccagcctggccaacatggcaaaaccccatctctacgaaaaatacaaaaattagtcgggtgtggtggcgggcgcctgtaatcccagctactcaggaagctaagaatcccttgaacccgggaggtggaggttgtggtgagccgagattgcgccactgcactccagccagagcgacagagtaagactccgtctccaaaaaagaagaaatagtgttggaagagaagactgcatagtctgaagaagtgagcccgagaatgtggcagttaggaacatgggccttggaatcagtcctgcattgatattctggccccaccacttactagctacatgacctaggataaatttcttaagtacttcctcttttgttccttcatctgcaaaatggtgttaaaatacttaagtaggatttgtcaacagaattaaataattatatgtaaagcactctgtgtggtacctggcatgcagtctaagtgtttaaaagctattattgtcatcatcattatcatcctcactgttatgatgatgataattaggtggccttgtagagtggaaggggtacagggagattgtctgcacgatgagctatgtctagtcagtgacatgactctggacctgggggcctgcaggtggagaacgaccaggagcggttcctgagtgacctgcgtcgtgatgtccagaaggttgttggctttgatgctgtgatgcgggtccggacaagcactggtcagtcctgattgaagagcaggttggggggctaaatatggaagggaggcatgtggcacttgtcatactttttgccctgaccctgtccatgtggcctcaggtatccgtgctgtagatttctttggagctttctacatgagcaacacgacagatgtggagctggctgggctagatggggacaaaacagtgactgtggagttcaagcatgacgatcggctcaatgaagagagcggagctctcctgcaggtggcaggcgggaggcggggctgggcaggaagtgtttcattcgcttggtatagaagagggtgaggaatgggtagagagcactaaaagaagagacagggcacgggagtggctcatttctctcttccagtttaatagtgtagcaaagggcctttgtgagggaggggtgtgagttccccctttctcctttcccctagtgtgccctgctttacaccagctgtgcagggcagcgtcggctccgcatccataatctggccctgaactgctgcacccagctggctgatctatatcgaaactgtgagactgacacgctcatcaactacatggccaagtttggtgagggtagaagcagggcagggtgggattggggctgagaggtccaggatggtgagtgggtagttgtgatggtgggaatgcacacatgatgggcagctgaccagtgactatctttgctttcccatccagcatatcg

SEQ ID NO: 61462 - DNA, 1315 bp, Homo sapiens
tatattggctcccaattgtttcacaaagtatacttccacacccatattctccttgactccctgccctcaccaaaccactggtgatctgactgaaggaggagacgctgaaaaggctctggacaacaccctgttggacgcttgctcccacccagaggaagaggttgagcccattctccagtaaatatatatccccattgcttagacgctcttcagaggctcgaactgctggtggttcggtagtactctcaacgggagactttgtctagacaaaaggaagggagcaaaaggttaccaaggaccataagacaagtctgcccccccgcaccacacacaaaattttgaaagctaagtcctcagacaccaccccttctggggtctcagtaactctctcagtgtgaaaattacatcagctaaaatacataaaaacaaattccactagtgtctgactgatactagcctatcctttcctcctcctaagaggccctttgctccgtgcaagatctcatactccaaccctcaatcgcaccaaaggtaagagccgagggtagaagaagacattggtctcagtcacatccatggaggtaactagctgtcggacataggcacggtcatcagtagtgacttcagctccaggctgcaggacatcactcttcaacacacagttcaggtaaactgggagtagcttcatgcactcaggaaggatcaactgaggggattatcaaaataaagtcaatgatcatgagaaatccctcccaaatgcaaacatttgtcccaacaaccccacctcccactaatatacttgccccacctgtcctgcagaggaggggctagcacagttctttctgtaacaggccaggatctgggcacactgggtgatgagcgtgtcacgaacagccttcacagggctattcaggactccccgatatgctggatgggaaagcaaagatagtcactggtcagctgcccatcatgtgtgcattcccaccatcacaactacccactcaccatcctggacctctcagccccaatcccaccctgccctgcttctaccctcaccaaacttggccatgtagttgatgagcgtgtcagtctcacagtttcgatatagatcagccagctgggtgcagcagttcagggccagattatggatgcggagccgacgctgccctgcacagctggtgtaaagcagggcacactaggggaaaggagaaagggggaactcacacccctccctcacaaaggccctttgctacactattaaactggaagagagaaatgagccactcccgtgccctgtctcttcttttagtgctct

SEQ ID NO: 61463 - DNA, 2227 bp, Homo sapiens
gtattttagctgatgtaattttcacactgagagagttactgagaccccagaaggggtggtgtctgaggacttagctttcaaaattttgtgtgtggtgcgggggggcagacttgtcttatggtccttggtaaccttttgctcccttccttttgtctagacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttggtgagggcagggagtcaaggagaatatgggtgtggaagtatactttgtgaaacaattgggagccaatatagttagtgtgctagtaccctcaaatatcagggaacacttggggacaagggcagttgctgtcattcttcccaggtttgcctgtttcagatgatgcatacatgtatgctgccccaccttgactgaactcagagtgccttaccataaggataaatgaattttgtgttctagagtgttctgccagttctggataatccactgtccaagaaggttcgaggcctcattgatagcttacgggcacagagatcccggtacatgaaggtaacactgatctgaaccctggatttcttaccttgtcaagtcctcacctagaagtgggggttgggtggggaatgagtaagtgactgcctaatgagatttctgggcatgtttaatttcctttggccttgccttatgaaccctgaattctggccgtagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattgggggtttggaggcacccagaccctggcaatattatgtgtccctttggaccagtctcccaagaggagaggggcaggcaggaaagagtggggatcctaaggttactacagggggctcagtgtcatccacaacttcctatattagggataaaacatataggtgcacaagagctggggtatagcccataggtggtggagagaaaagtggtcagtccttcttgggcctggaggttagcagtcaagtttctctgctttcactgctcgctcgctctctcctgcaatgattgatgatcactccgtggatagagaggcacactgtcagaggtgaccggagaactgagttgcaaaatatattaagatctggtagaggtaccagcttcctttccagctggagaggccccaacactggatggttctgtagggagcctagggagcctggtcatcaacttgcaatacctcacagagccagttcacatcccactctgagctcccacgagaaacactgcttctccaggcccggggttgttggggagagaggcagaggcagctggagcgccgttctctcctgctgggacaccgcttgggctttggtattgactgagtggctgacagttatcttccaaccccaactggcttgggggcaggacaagggctaggcttgatggtggccaggcttgcctgctccccacctgggatgcccctgctctggacctctcatttctcttcattggtttatttttcaatgcatctttaatttgtaaagaaataaaataaattaagatgtaaccattagcctcatctttactcccgaaagctcactttgcttttagtcctggccgtcggctgagcgagctgcgcatgcgccacgtgcccccgtggcgtagggcctcgtccggtcacgactatccgctgggcggggtcggtgctggccgagggggcgccggctgccggagtggacatggcggccggcccca

SEQ ID NO: 61464 - DNA, 1089 bp, Homo sapiens
ggcaatgtggggctcaaagacggggctgtccccgggagaggccgcgtgggctttctcggcatccagccgagccagttcgtagtcacagacgaaacactcgaagccgttgaggtagttaggcagcaaaggatcattcactccccactcccgatgcttcagactatccagaagaaattggttggtgatgcccccaggttgcttgtatgccaggtatttcatatactcctcatcattcttgtccagaaagtcaataaactctgccagcttctgaggagactcaaaatcatcaatcaggatgacggagtgattgttcggcatccagtccctcacagagggagaaccgcggtacacgggcacagcgcccaggtgcatgggacgccacagtttttctgtcatgtagtcgttacagatggcattttccagggccaagtggaacttatagcgggacaagaaagccaagagctctggatcctcggtggtggccgtggctgtgtcctgtagccgcgcggtaggcagctcccgattctgcaggcatttcccgtaggagtctacctagaccgggtacagtaaggctgtcatgagggtgcggccctggaggcctggacacctggagtcctggacacctggagtcctggacacctggagtcctggcctcaacccgccctctccttttccttccctccggcccgccctcactcaccgggatgtggcgcatgagctcgcgcacgtagcggtcccggtccgctggcacgtcgcagtgtgactgcagatagagcagcggcgcgtagccgcggcggcgccactccgcgcgttccatgggcggaggcaccgggcggcgcagataggcggtcccgggcagccactgcagcgacagcgggtaatccgagtggcgactgaaggtggaggtaagattgaagaggcggatgcccgggccgtggctcagcaagaagttgttgaggggcgactcctcgtggaggagcgcccagctctggtgcgccaggcgcggcagcggggcggccgacgcgcggaagtctgtgccgtagaagagcagcgcgcgcgtccgcgagtccctcagcgctcggcggttcc

SEQ ID NO: 61465 - DNA, 1054 bp, Homo sapiens
gatcctcctgcctcaacctcccaagtatctagggctacaggtgtgcaccaccatgccctgctaattcttttattttttagagacaaggtcttgctaggatggtctcaaactcctggcttcaagcagtcgcctctcctcggcctcccaaagtgttgggattacaggcataagccactacgcctggccagaaaaagccaaaaaaaaaaaaaaaattagggctgggtgaggtggctgatgcctgtaaacccagcactctgggaggtcaaggcggatggattgcttgatccaggagttggagaccaacctgggcaatgtggcaaaacctcatctctacaaaaaatattttaaaaaaataaataaataagtaaaatagaagtttgacatgaaagtatataatataaaaaaatccaactccggaaaaccagaatacaactcaccaaatgttttgcttctccaccaacgtaacaatttataaagcaagagatgagaaaaagagattattgggaaatgtactgaataatgaggagtctggggaatagaacaaaagttgtaagtcgtaacctgacccatcttacttcactggtaatcaagtacagtcgaaaggatgaaataaagaagtgagtagtttaaaaactctgttggaccagcaccttgaatcaaatggatgttttagggttctgtttcccactgaaccaagaattgtatccctccatctctccttgaggagaggccctatgttagaccttggctactcatcattaagataaaatcttaatagataaaactggaattccttgaatccatgaaaagacagtgttcattaagggtttgtgcagtggatgctccttatgtcccatggtagaataagatctccttagctccgccaagttaaaggctcttgcaagggcacttagagatgttgcctcttcatgaagatttcatgtaggtaatcccaaaatttcgtctgctctgtttcattgttgtggatcatggcagtgagagcttccccctggtccagaccttgccaataatcttgcagccacatctctttcca

SEQ ID NO: 61466 - DNA, 1026 bp, Homo sapiens
cgcggagctcggggaaggctcgttggcttgctggcagccacctctttcttttacttggccggggctgcggcgacgctgggttcgaacagcggcgggttcatacttgtcagcagattaggaggagactctgggttcgtacgccgactgaggcttctccttgatgggctccgggccccgaagtctgggggcagtacggggccggggacatgcaggaaagggccctggtaagtggacactgttctggtggtagccggcttggtctaggggcgattggcatagggcggggttgggggggggggtggcgaatcaaaatttgagactttaagatgttgggttgggaaagattcgtgttttactttaataaacctgaaagaactgtcgtttttcactgcctataggaccactacaaagccgcaaagaaaaattagacttgtttcattttataacaacaacaactgctactactgctactagttagataccgtttgctcatttataacaatctcagttggtaggatgaagcttaaacacttggcattcatcgtctttttcagtcctctcgccagtcttacagacttggaccttcagttgtgatgcttaatcagaattttttttgagatagggtctctcttggttgcccagactggagtgcaagtggcacgttcatagctcactgcagctttaaactcctgaactcaaacgatcctcccgcctctgcctcctgagtagctgagaacacaggtgcaagacaccacgcccagctaattattttttgtagagacggggttttgtcatgttgcccgggctggtctcgaactcctgggttcaagcgatcttcctgcctcgccctcccaaagtgctttacatgactgagcctccgcgcccagccagacttgtttctcaagtgacttcttctggccattttcacaactcattccaaagatgtgcagcatattctcaaagcatttccaaataagctccaagaaatgtttttggtaatggaagcagaaaacaagcctgtagctc

SEQ ID NO: 61467 - DNA, 1275 bp, Homo sapiens
gtaaaacacgaatctttcccaacccaacatcttaaagtctcaaattttgattcgccacccccccccccaaccccgccctatgccaatcgcccctagaccaagccggctaccaccagaacagtgtccacttaccagggccctttcctgcatgtccccggccccgtactgcccccagacttcggggcccggagcccatcaaggagaagcctcagtcggcgtacgaacccagagtctcctcctaatctgctgacaagtatgaacccgccgctgttcgaacccagcgtcgccgcagccccggccaagtaaaagaaagaggtggctgccagcaagccaacgagccttccccgagctccgcgccgattcgtccagcccgtaggggtcacgcgaggtcacgcacggaaccgcaaagcctgccgggagcttggtgcgctatggcgacacccagcctgcggggtcgtctggcgcggtttgggaacccgcggaagcctgtgctgaagcccaataaacctctcattctagctaaccgcgtcggggagcggcgccgggagaagggcggtgagcagtcggagtcaggacggccccggagcggaagccggagcatgagcaggggcgggtgggtaggagggcaggaaggtgggtcttcttgtgactgaaggtcccccggatctgcccctccagaggcgacttgcatcacggagatgtcggtgatgatggcttgctggaagcagaatgaattccgcgacgatgcgtgcagaaaagagatccagggcttcctcgattgtgccgcgagggctcaggtgaccgatggctcctggggtgctttctcaggaaaagaatgggggagatagaagtaatgattctccctgccttttgctaggaaaggccctttcattcatttgggaggtatattattcacgccaaagtgggaaaggttacagttttgaaggctgtgtgatcttgacggatttattcattgctctgaactttcgagttactgtacgtaaaatgaggctaaccaataccaccttaaagaatgttgtgagtgtcagatgaagtaatgaatgggaaaatcattttgaaaaatgtaaattgctgctcaagtagacattattgtgtgaaatagaactaaagagactaaaactaaataatgacaatagtttggtttcctgtctaggcttaattgttagctgagatagtagcttctgaacatagtctcatttgtaggtcccaacgcccttttgttgaaaagaggctgacatagatctctccaggctg

SEQ ID NO: 61468 - DNA, 1930 bp, Homo sapiens
agcgatgaagattgttaacatattggtatcttcctggtcaggttaaaatctgggaaaacatgccatattaccccagtcccccgacttcagtcactgacttgtaaaataaaggggttggccaggtgcggtggctcgtgcctgtaatcccagtactttgggaggccgagtcgggtggatcacttgtggtcaggagtttgagaccagcttggccaacatggtgaaaccccatctctactaaaaatacaaaagattcgctgggtgtgttggcacccgcttgtaatctcagctacttgggaggctgaggtgggaggtaagtttgaacccaggagggagaggttgtggtgagccaagatggcaccattgcactccagcctgggtgacagagtgagacttcatctcaaaataaataaataaaaatcaaaaaaataaaataaaggggttaactcttctaaaaaggttctttttaattctatgattttctgatctattaatgtgactagcaattttgtgagatgtagtttgtcatgttatcactactttttggttaaaacactgtggaaaaccttgagtggtaactttatcttagtccaggtgattccagttgcagcagtagctaggtgccctgcgataactctctccccttgagggtttccagtgtgggaagttgtcatttaggcgcgccaaaagtggtctggcctctcgtgcttcttgagatcccttccgggctctggtctatcttgtctccttagctgggggcctacagtcatctagagtaaaagggatggttaaaaaaaaaaaaaaaaggcaatcggagacaagaatgccagaggagagacattaaccatgtaatttgaatttaaaatgctcatggaatatgggaaattcagtgctgagccatgtgagcagggttacttgctagggtcctggaacgcacctgtctggccaggagtttcttaagatatctctggtatcttctgttctagaccttaggtgtagccggctgtgggctggggattatccagctcccctttcccatatggagccttaagggttagtgtatcctgatagggggatccctaggactttcatccaggtctcttctttctttcatagtgaagatgaggcccaggatgttgtactggcatgagtgccaagagaccatggcccttttcatttcctattctctttcccctgatcccaaccattgtttgcaaagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggtgaggccaaaggactgatggtggggagcggggtcctgatactccacactgtctgctgggtttcccatagaacaaaggagacattgtatttggggcagtggtaagaggaagacaagggagggattgcctgggattccactccctcccccccaccccccgccctggggaaggaatgaggctagggagagagtgcctagggcattgtggtctctgacagggtctgccaaaggttatttgctgagttgtggctgtgtcctcttcttcacccccaggctgtattcgtgcctggccaatggcagtgcggatgagtttcagcgaggggatcagctcttccgcatgcgggctgtgaaggacccattgcagataggtgagtgggccatcatgccatgtggcacatcctgctcctcccatcccctggcttatgaagtaagaacacaccgcaagaagctggagcatgttgtctgaataactgcagggccagggtcaagggcagagacccaggtcctgacagcactccctgaccatgcccccatttctccccagggttccacctgagtgct

SEQ ID NO: 61469 - DNA, 1053 bp, Homo sapiens
gatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtgaggggatggaaggagggagggctgggtgctccttagccacaactgggaggggctatctagctctagttgggagtgtcaggaccatcagcaggattgtgagaaccctgttgcaggcgccgaactggtctccctgctttcagtctactcacttttctgcttccacgagattttcctgaaatgtgatggtgtcactctgctgcttaaaacccttcaatgggttcctgttgcccttatgataaaatgaaagtggttggcatgacctgtgagggtccacttgatctggtctttgcctgctttgccagcctcacttggctgctctgtcctttgcactccagtcagctgaatcactcatgtatctgccatgctctctctcttgcctccaggattttggacagattgacctttctgcctggaatgctcttccccattagcccgtgtttctccttcaggtctcagggatcttaaagatcacttcctctagggagtctctctgatactgtccctgtgccccaagatatcccacctgcttccccttgacctttccctgtaatagctggcatcacggtggcatgtgtgtttatgtgtctgtctttctaaccagagctcctatggagcggcacagggcctggcatgtagcaagtgttcaaggaatgttggctgcatgagtgagcatgatgtcctgctcctggaagttgggactttaacctgtctggtcccatgtcctccttccaggtactgtttgcctgtgctgaggccctgcatgcgcatggctatagcagtgaggcctcccgtctcactgtggagcttgcccaggatctg

SEQ ID NO: 61470 - DNA, 1046 bp, Homo sapiens
aggtcgggtgggttggctagcagatcctgggcaagctccacagtgagacgggaggcctcactgctatagccatgcgcatgcagggcctcagcacaggcaaacagtacctggaaggaggacatgggaccagacaggttaaagtcccaacttccaggagcaggacatcatgctcactcatgcagccaacattccttgaacacttgctacatgccaggccctgtgccgctccataggagctctggttagaaagacagacacataaacacacatgccaccgtgatgccagctattacagggaaaggtcaaggggaagcaggtgggatatcttggggcacagggacagtatcagagagactccctagaggaagtgatctttaagatccctgagacctgaaggagaaacacgggctaatggggaagagcattccaggcagaaaggtcaatctgtccaaaatcctggaggcaagagagagagcatggcagatacatgagtgattcagctgactggagtgcaaaggacagagcagccaagtgaggctggcaaagcaggcaaagaccagatcaagtggaccctcacaggtcatgccaaccactttcattttatcataagggcaacaggaacccattgaagggttttaagcagcagagtgacaccatcacatttcaggaaaatctcgtggaagcagaaaagtgagtagactgaaagcagggagaccagttcggcgcctgcaacagggttctcacaatcctgctgatggtcctgacactcccaactagagctagatagcccctcccagttgtggctaaggagcacccagccctccctccttccatcccctcacctccatgcgactctcctgttccagtggcttcagcccagcaaacaggtcgtgctcctccccagccccgccctcggccttctcttcctcgcccccagccccatcctgggcattcagatagtacgcctggtagtcatcatcctcctctccaactgcaggggctgcctctttggttttgggaagcccattgccactctcatctgtaga

SEQ ID NO: 61471 - DNA, 1047 bp, Homo sapiens
aggtgagagacccccttcctctaccttcccctcccccacttacccccaacctgctcccatgccccaccccaagtgagagcatccttctacctccaccaaggtaagtcagaatcatctgcctgtctcctgtgtttcttccctttctagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtcagaggctccatctcagccttgtatttcagtctctttagagccttgcaccttgatctctattgacacaccagaggtctgagctccttcctgtgccctcaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccaggtatgatgcctgaccctacagtaagtggggaactggggtaggggtagctttctctaagaaagaccaagagccccaagtttctgaatcacctttaggacccatcaggcagcttcatgggtaggtctgtgatgatgaggattttgggttcccctgtattttttcccatgcatgatacttctgtctgcctgacttaccccaacttttatacagtggtttctcccacaggttcccggcccccaagtcgcaactggaacagcgagacacctggggatgaggagcttggatttgaagcagcagttgctgccttgggtgagtcttgagcatatcaacgagctaagcctggttcaggtcttgaaggacatgagacctgtgccttgttgtgaagggctgtatggtaatgggaaggtcaggatgacatgtgtgagccaactagt

SEQ ID NO: 61472 - DNA, 1621 bp, Homo sapiens
cccttcaggtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggtaaatcatttgacctgacttgggtatgggagggggattaattggtggggataagacccttatctttgtggggttactgatctgataaaaagacattattctcacaccccagtggtgcccacactaacccaactctgcccttctctcctttcccctaaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggtatttctacgggcaatctgggaacctcttctggggcatctgggcagggaggttgggcatgggaaagctaagggcccagctcttgattcccgtatcctggagtttacagatgattgttggtcctctcatggcaacattttacccattaatgtgctttcacacccatctttcctttaccttacaactcaaaggttaggtttatttctattttacagataaggaaatggaggcctacggtttagggaccaagatgatcactcaggatagaaaacttagggaaggcctcatacatctaagacttgaatgggagggggctgttaaattagtttggaactgggactataacctgggtcttgactcattttggtcagtatttactcagtgtgtgaagcactcactgctctgataatggactctaagcattgacactgacctctgatgattccctgggaatgagacagctctgagggagacattggaatctcatctaacaccttccatgtggtaaaggcctttcccccttaacactctgtgcccctctcttccaggacaacctgatgttggagaaggcctgcatggcagtggaagaggcagctaagggtgggggcgtgtaccctgaagtgttgtttgaggttgctcaccagtggttctggctgtatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtag

SEQ ID NO: 61473 - DNA, 1004 bp, Homo sapiens
gcagaggtggccacccccgtctcatgcccctccccctgccccccaggagtgaactacgtgcaccagttctgtgtgggggcagccaagggggtgctgagcccgtttgtgctgcaggagatcgtcatggagacgctgcagcggctgagtcccgctcatgcccacaaccacctgcgtgccccggccttccaccaactggtgcagcgctgccagcaggcatacatgcaggtgacaacctagaattatggagcagggtggagcacttcctgggtggtcttggaccagagggaggcagggcctgtttctgtgctttgtactaaggctcatcctgcacacatcctcctccagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgctcttgggctatagcttggggccaagatgtctcacaccctagaagcctagggctgggggagacagccctgtctgggagggggcgttgggtggcctctggtatttatttggcatttataaatatataaactccttttttactctagtcgacctgggcctttcccttctttccaaattccatgtgcagatgaaccttcaactggggaggaaacttctgacacttgctttagtctaggtttttcccactccagggaggcagacaaaacagaaaaataaggatgtttattaaggacatttctagcccacagctagggctcatactcggc

SEQ ID NO: 61474 - DNA, 1890 bp, Homo sapiens
gaaaaaattttaacaccctcagtaagagctttattgctataacttcagactcagtcctctataaatcccagtgtcctccatctacttctcattctatctttcaaatctcatctgttttttcttttccctccaggtgctgccccggcagacatgtggcctcttcactcacacaatcttctataatgagtatcctggaggctctcgtgaactagaccggagcatccgaggtggagagctctttctgacagtgctgcttaatccggtaaggtgctgagaggaacggctagaagattggagagccaaggtgtttgcaggctgggacctttattcaccaaggctaattcagaggtggggtaggctctccaaatctgacatgcaggtaccccttacagatcagcatctttatgacccatctgtccaattatggaaatgaccggctgggcctatacacctttgagagcttggtgcgcttcctccagtgttggacacggctgcgcctacagacccttcctcctgtcccacttgcacagaagtactttgaacttttccctcaggagcgaagccccctttggcaggtaaaggtggagctcagtctgatgagagacatgataggggtggggtgttttttgttgttgttgttgttgttttgagacagaatctcgctctgtcacccaggctagagtacaatggcacaatctctgctcattgcaacctccacctcccaggttcaagcgattctcctgcctcagcctccctagtagctgggattacacgcacccgccaccacgcccggctaattttttgtatttttagtagagacggggtttcaccatgttggtcaggctggtctcgaactcctgactgcaggtgatccgcccgcctcagcctcccaaagtgctgggattacatatgtaagccactgcgcccagccggggtgggggtttaagagaagactaggccaggccgggcacggtggctcatgcctgtaatcccagcactttgggaggccgaggcaggcagatcacctgaggtcaggagtctgagactaacctgaccaacttggagaaaccctgtctctactaaaaacacaaaattagccggacatggtggcacattgcctataatcccagctactcagaaggctgaggcaagagaattgcttgaacccaggaggcggaggttgcagtgagccgagatcatgcattgcactccagcctgggcaacaagaacgaaactccgtctcaaaaaaaaaaaaaaaataggccttatctgattattggccctggcttcagaatccctgtgatgacaagaggcacaaagatatctggtccaaggagaaaacctgtgatcgtctcccgaagttcctcattgtgggaccccagaaaacaggtgaagtatccttagctaacttctcttgccctgccttaaacccaaaggatccttttgtcaaggaactctcttctctctccaggtaatcacaggagtgaaaaaagtatttttaattttaataatttttttttttttgagataagagtctcacttctttgcccaggctggagcgcagtggcacgatctcagctcactacaacctccacctcccaggttcaggcaattctgctcagcttccctagtagctgggattacaggcaggtgccaccacacctggctaatttttgtatttttagtagagacggggtttcaccatgttggccaggctggtctcgaactcttgacctcaagtgatccgcctgccttggcctcccaaagtgctgggattacaggcatgagccaccgcacccggccttaatttgaatttttaagagagaaaaaaaggaactccttttatacccacccctcattgatccagtctcttgaggcagtgattcctaa

SEQ ID NO: 61475 - DNA, 1050 bp, Homo sapiens
agaagattaacagactcatgagttccttatctgatattttgttggagcatgggacttctgaagacttccggggctttccgtcccttcctcacagaaagatcagagctgttgctggctgccagctgctcggtcatgggctaggaactcctttcagagcaggcctgtttttagccttctaggatatttagcctcttgttgatgggagatttgttcctatcatttgcatatactgctccatctctgagctttgcttagagaggagaatttggacattcatttgggtattctaagaaagggaaagggaacaagctgtgaagctaaggtataggactcagcttgtagattctcctagaggaaacttttttttttttttttttgagaacagattatccagtaagcaggaggtaagagagatgggatggggaggagaatggattaatgacaatttcagagggaggagtaacccactgatttctctgtcttacaggtagaggggaagagattgaactttgctgacctttgatgtgaggcgctcagccagggccaaggggagagcctggcaagatttgcagcctgaagccatgggccagggggccatggtgacctgagacaagtggactctgtatagttgccccctgcttccccttctacctcccctaccctatgctaaggggactcgtctccacctcgtaaaggaaactccccaagggaatccctgtcccctattttcctatccttctacccttccaagacagtcctagcctatagaactcctacctcccatcccctgaggtggtccccattcctccctcccttcctccccccgccatgctccagttgtggaaggtggtacgcccagctcggcagctggaactgcaccgcctcatactgctgctgatcgctttcagcctgggctccatgggcttcctggcttattatgtgtccaccagccctaaggccaaggaacccttgcccctgcccttgggagactgcagcagcggtggggcagctggtcctggccctgcacggcctccagttccacctcggccc

SEQ ID NO: 61476 - DNA, 1051 bp, Homo sapiens
cattagcttcacccactttccccaccttctcaggccgacttggccatgtgtttagcgtgctaaagtcgctggaactcatctgtgtgctcattgtcctctgttctgttaccacattctgtcctgtttgacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgct

SEQ ID NO: 61477 - DNA, 1049 bp, Homo sapiens
atcaattttgaatggtttaagttcatgattttgttctgcagccctagctaggggtgagccaagccttatgaaatctaaactcagcctaacagaatagaaaatctataggctttagttaagagtcacatggtcctgagttcaggtgtgtgatttgagcaaattattccttgagcctatttcctcatcttataatgaagaaaatattatccaccaagaaatacagctcgggcatgtaaaaccccagcacaatgcctgattaaaagcgcagcaggtactgtcactgttacccatctttctgttccttttggataaaggagactaatgtaatgtggcatcctggcctctggagggcgttcaggggttcgggggtgggggggggcggtacttggagattctgggagtggttgcttgggagatggtaagacttggaagtgcaggctgggaggaaaatgcaggtgcccaggcctgatgtcctcttacctaccccaccctgccctgcagtcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggtgcacctggttgacgggggagaggggctggaagggcctgggataggtggggtcagaggaagaagagaaggctgggaggtggtcctgggagaggaggtgtgggccgtcccagaggactggcaaagcctggcagaatggttgcaataagttatgcttggaaatcagacagactagggtctggctccgtgactccaaattggatgacctcagacaggttacttcccctccctaaactgtttccttagctgtcaaagaaaggcagagagtggtgcctacctcatttaatcattgtgaggattaagt

SEQ ID NO: 61478 - DNA, 1645 bp, Homo sapiens
gtcctggccactgaatgagggctacgagtgggggtggtgattgagacctgactgagccccttcaggtgagagaagtaaattgggggtggaagcggccttattgggagatgcttgtgagagaggctgctcatacaggggaggggctcacagcattcacgatgtaccaggctcctcacctgttaaaggcaagcgtgttttctgcaacctggttgttgatggaaagggaggcaaaggccaaagaaccataactaatggctgggcttcaggagaaagtggtcattgtctctgcagactgcagagagggagacgggagggaaggtgtgttcgctcttcctgccaagggccctagagacagagaagagggatgtctttgtcataagcgatcacaggggactcctgaggactggggagggctctctgtaacttgggaggttccccagtaggtaaattgatggatttttctcccccacagtgcgaaaacaggagatcattaagattacagaacagctgattgaagccatcaacaatggggactttgaggcctacacgtaagtagagacccatttttttttgtgacctaagtcatctcccaaggccttccctgcttccagacaacaattaggaccctggggaaagggaggttggaccttgggcaaagtatctgagttaagccctctcctaaactgggagcccttccaggtagattccctgagctcacccatggtatcctggcagtgggccgaaagcacagggctgagtggctcagcaggcaggcctggaagatctttgctgtcttgtctggcatggccacaggtagcctgctgctactggatagacaccgctgataaggaaggaagacaagtcactccatagaagcctgataggctgcttttttttttctccctgtaggaagatttgtgatccaggcctcacttcctttgagcctgaggcccttggtaacctcgtggaggggatggatttccataagttttactttgagaatcgtgagtgggttcgtgctgctgatatactcctgcctgcccctttacccctttgtctctgtctcctgctcaccttctcatcccagttgcccacttttcccttatttgaccttcgtgctgcactcctactctgtatgcttgtccccttgtgccccgatggttgtagacaggcacctttgaaggccctgctcctgagctccaagtgccattcattctgcagctgctttgtggcagtgccagtcaccacaatcaagctcacttatttcttgccgggcgcggtggcttacgcctgtaatcccaacactttgggaggctgaggctggcggatcacgaggtcaggagatcgaggccatcctggctaacacggtgaaaccccatctctactaaaaatacaaaaaattagccgggcgtggtggcggtgcctgtagtcccagctactcgggtggctgaggcaggagaatgatgtgaacctgggaggcagagcttgcagtgagccaagatcaggccactgcactccagcctgggcaacagagcaagactccatctcaaaaaaaaagaaaaaattatttaagcctcacctctttccaagacggattggaaggaaaccctttgagattaggttgagatgatctcagcacataaga

SEQ ID NO: 61479 - DNA, 1003 bp, Homo sapiens
tgcagtgagccgagatcatgccattgcactccagcctgtgcaacaagagcaaaactctgtttcaaaaaagaaaaactctagggaggaggtaagtgtggaagttagggagaccatgaagctgttatcatggttcaggtgtgagatgctggtggcctggagtcaggttgtagctgtgcattggaagtgaagaggtaagacatggggtttactttggaggcagaaccagaagattttattttagattgggcgatctgaatataagggaaaaagagaaagagaaggattgaggatgactccaggttttagcctgagtaactgggtagatggtggcatttaccaactgggggaagactagggaggggatttgggaagagtcagacagccagggtggaagcagaaccttccacaattcctccttgcacctcttgtaggagcagaaactctgcttttgttctgctttgctcctctggcttccaagggatggagcatatagaaacatgttctttttggcctacagggctccacagagagctgcaacaccaccacagaagatgaggacctcaaaggtaggtgctggcccttggagggggaaggactccagcagtgacccaggtacctgggctccaatggggcacctgccttttctgtccccagaactgggaatgctggctcctatgcccctaggagagggcttggtataaaagctactttccacgagccaagatatgaggcccctgtctggtgttgctgagttgggcaagaggcttctcttctttgaccccaagtctaaaatagctaagctagagattctccaggggccagggctcagagaactgttcctgttgctgataatgatgtgccatccaagaacaggggtaccccaagtccctgccgaagtagcctgtaagtgctatgagtcataaatagagtgaccaatcactcctggttttcctcggacacagaacttttggttttaagactgtgatgggccaggagtgctggc

SEQ ID NO: 61480 - DNA, 1008 bp, Homo sapiens
gatcacgccactgcactccagcttgggctacgcagtgagacttaatctctcaaaaaaaataaataagataaaatctaatgtcaataggtaatctgaagaaaatggcagaaagtagagagagggccaggtgcggtggctcatgcctgtaatcctagcactttgggaggccaaggcgggcggatcacttgaggtcaggagttcaaaaccagcctggccaacatggcaaaaccccatctctactaaagatacagaaattacctggggatggtggcacatgcctgtaatcccagctacctgggaggctgaggcaggagaatcgcttgaacctgggaggcggaggttgcagtgagctgaaatcgtgccactgcacttcagcctgggcgacagagcaagactccatctaaaaaatgaaaaacagaaaaacctcaccaaactagacagagagaacagggccttgaattaagtagtcaggagagggcttctttcaggaggtgatatctgagctagaaactgaatggtgggtgggaaggaggcagccaggccagctctgaggctgagtgccctaagcagaaggaactgaagctcagatgtggcctttgtaatcaagcagagggaagagcaaagtgagacggggagaaccataggagagtgatgaggttggagaagcagcagggcctgctacagaggcccttgtaggagtttgcattttcttccagcagcaaggagaagctattgggagttcttagcaggagtaacagaatctagttgacactttaaaacaccactctggcctcatgatcaagaactctagggaggcccgggcgtggtggctcacgcccgtaatccctgcactttggaaggccgaggcgagtggatcagcaaaggtcaggagctcgagaccagcctggccaacatgatgaaaccccatctctaataaaaatacaaaaattagccaggcatggtggcaggcacctgtaatcccagctactcaggaggctgagacaggag

SEQ ID NO: 61481 - DNA, 1102 bp, Homo sapiens
tctacacagcgttatggaggccacctcaggcctacctcctccaggccagaccagggggcaagggaggtctgggagttgaacctgagtggccttggggactctggaggaactaaaccatctgttttcttgtctcagccacagagcaacaacaaaaacagtctcgtaagcccagcccaagagcccgcgcccttgcagacggccatggtacctcctgactacagcttctccgcctctgaccctggctgcctcctgccccttccctcttcctcctcttgtgccccctccctggcctcctggcctgttcctttcttggtccccatagaactgactgctttgtgtgccgccctgtatgccccttccccttcattgtcccgcctggccgcgctccatcccgcatggcagaagtgctgctcctgctcctgctcctttcgctggtggggggaagagtgatcagggctctcagctgaacctcccaggcccagcccaggacccctagtgggtctgctgtgggggctgggaaggtgagttgcttaggaaaggagagggtaggagctttcttgggacctgaacatcagttcttggaggcccccttgtaaaacctgcctcagcctctcctttgcaaagccagaaacaggaaagagggctggggtccccacctctggatggtgctgaggtctccaggctcctggagtgcctcatgctggctaagttctctctgggctcctccaggggttctgtgtgctcttggaggtccctctgctagtggtggctaactagagagtcagcaggggggtgactgggaaagagggagaggtgatgttgcctgctactcccctccttgcggaccctcataccacatgacgtggcggcgtggggccaggaactagggaaggcagaaggcgggcgcagtgggcagctctctgggctcagcttgctgagggggcctcctgtcctggctctttctgggagacctcattcttctgcccatgttcctgcctcacacattccccgtgatgaacgctgtgggcggggcccggcctgtgccctcagtcccacagctcctctagtgtacctgccccgtgggaaccccatgtggaaagag

SEQ ID NO: 61482 - DNA, 4326 bp, Homo sapiens
ggtggtgtgcacctgtagtcctagctactcaggtggctgaggcaggaagatcccttgagcccaggaggttgaggctgcagtgagccatgatcatgccagtacttcagcccgggcaatagagcaagaccttatctctaaaaaaataataaaaagacctcacatttagacaatgtggtagtgtgctggttcagaaggagcccagctatgcatggctaagggcaaatccctgaatggagaaggaaattgaaaaatgttgactaacctgagaaacagtctttggaaaagggtgatctcaggttctcatgcaggacaatttaggaaaaagagagcaagccaggagaaggctgagaacttattccccattagtcaaaaatctgctttaagtcaagatcctgcaatggcctttcacaacaagcccctgaaaatcagcagaacaaagactgggcctggtgagtgagtgcctacgcagagttcttgctgccgtgattcagtgcaagttagaaacctgtgctcttctttagcctggggaaaaaccaaagtcagcaaacccagctcaactcagcaaactttcgtcgcctgtatgctaactataaggcatgttgctaggtactgtggaaattgtaaagacacataagataggaaccttcctgaaagcagtaacactttagttgggtaaagggataaggagatatacacacacacacacacacacacacacacacacaccccactacttatatatatgaatataagggaactccttctttttgagggatgattttcgaagtaaaatatcatatttgagcatatttaaaaggccactgtaaggctgtgtgcggtggctcacgcttgtaatcccagcactttgggaggccgaggtaggtggatcacctgaggtcaggaattcgagaccagcctggccaacatggcgaaaccagtctctctactaaaaatacaaaaaaaaatcagtggggcgtggtggcgggcgcctgtaatcccagccactcaggaggctaaggcaggagaattgcttgaaccagggaggcggaggttgcagtgagccgagatggtgccactgcactccagcctgggcaacagagtgagactccctaaaaataaataaataaataaataaataaataaataaataaataaataaaaggccaatgtaaaagaggcctaactatatttaggtttttcttttcctttaaatctaattctaaattatggaccattgtcaatatttgtagcctctttcgttgattataataataatccctgaaaatgccttctaaagaatgctggccgcttgagggcaggagcagtttatcagctgtgtttacctgaaacagccctcagtgtttgctgggcattgttaaatgaatgtgcaaaagttgaacgacagacggacatattacagggggaccttacccccagtgagctaatgatgacattgataattacccttcattttttagacacagtcttctgggatatattttcagtgttccacgtggtcttcatcttgatgcgtctgtttcacatgtgaacgtaaagttcgtgagcatctagttgaggctgaggaatcactgctttcaacattccctgtggcttacatccctgcatttttatgatcactgtagttttaatcactggcactcctgtgtttctattttccacgaattgcaaaatgcaataaaaaattcaaatattgtaaacaagcatggctatactgacaaaggaaggccaacatttaactgctaggtgattttcaaaagctcagcatctttatgtaaaaagcatagtagggatgcagcgaagtcagaagtcaaattttattagagctgaggagagcctgtagtagcttttgctttttccctggtggctgctcacttgaatttcagacagttctagtaatgagagaaaataaataacattacagggtgagctaaccctatgaacccagacctgtaaatttgtagcaaaatgatacttaacctcacagacttgtgtcttaatctccttaagaggctttttttgagcaaggctgagacatctcagaagatactaaatctgtgtctatgaacctgaccacaaaagagttcttccctcccagggtctggagggtgtgagtgcctgtcggtccgtgtgctgtttaaccctctggtgctggactccgggtctccctccgctcttttctccctgatgcagagcccacactggtgcgctaacctgcagcgtctctgtgcttctcttcttacctcctctttccccttctctttccctcttgctgtggtgtgtccagaaaaggaagtcgagttccagcgtgcacctaatggtgagccttgcctgcccacccatcgcccactccatgctgcctgtgcccgcctgccagccacgcaaacctgttctgccacgtgcgtgtgcctcactcatcctcactgcatgtctgtgctgtgtgggcaggtgtggcctgtcctgccaggcgggggccattgcccaaggtcacccagtagcctaaaaagtggacattggaaggggtggtacggcaccccctgctgtggagcttggacagaccccagcgacccagggtaggatgtgaagctggtagggacttggggcaagcaagggagagaccctcactctcttgtcacccagaaggagaggccctgcttcccaggcatgaggagctgcttcctacagactggcagctggagggcaactgtgtggtgggcagaggagctggttgcaggctcccacttgtgagtctcgctctcctggctctgcccccgtgcaaatcccattctctctagctgtgcccagtggtttattctgcccacccagccctcgggggacagctaactcatctttctcacgggacactgggcaccaagggcaacacagcagcctgagtcattatgaaaccatccattaaaaccagaggtgggggccgggcgcgatggctcacgcctgtaatcctagcactttgggaggccgaggcgggtggatcacaaggtcaggagatcaagaccataacacggtgaaaccctgtctctactaaaaatgcaaaaaattagccaggtgtggtggtgggcgcctgtagtcccagctactcaggaggctgaggcaggagaatggcgtgaacccaggaggcggagcttgcagtgagccgagatcgcgccactgcgctccagcctgggcgacagagctagactccgtctcaaaaaataaataaaccagaggtggggccacttgggtgacatcccagccctctgcaggttttgtgggcaccctggagtccttgccccctgtgagggtcttggcctcagctgggatttacaggtagggcagccctctctaaccaaccccgaacaggtcagcatcattcactgagctaggtgggctttgcttcttggtgggaatgagagacagcagagctcccgtgagtttagacccaccgtctcactactcctgggccccctcttctctagcctgtcgcagtctgtggagtcttgttcagtggagtcacttggtgcctggcttgaggttccatgcctagccctgggtttggggatgtctgagccattgacagcaagctggcggtggacggcttcaggtctggtccaagaggcctccaggcaagaagtaggacagtcaggatgctttctgtgtatgtcctaggagagaagacacacattctagctgtcgatgtatcatctgtgccctgtgcagggatggtagccacacatttgtctcactgcctattgaagaacttgcaggcatcaggctgctcctcagtggcccccaaccccactggaactcagtgagatggagtacgctggttagggaactatcagaggcaaagaacatcacatggatatggctccctgccctggagatcagccttcttcctttcttccatcttccccttgcccctcccttgctgtgcccctccgtgtaatgtttttgtttgttcgtttgcttttggttttttgagatggagtcttgctctgttgcccaggctggagtgcagtggtgcaatcttggctcactgcaatctctgcctcccaggttcaagcaattctcttgtctcagcctcccgagtagctgggattacaggcatgtgccaccatgcccggctaatttttgtatttttagtagagacggggtttcaccatgttggccaggctggtcttgaactcctgacctcaggtgatccacccgccttggcctcccaaagtgctgagattacaggtgtgagccaccgtgcccacccaccaccatgtagttttgaaaggcaaggagatatccctggtggtcatggtg

SEQ ID NO: 61483 - DNA, 1047 bp, Homo sapiens
gatctgcccgcctcaacctcctgaagtgcgggggttacaggcatgagccaccacgcctggcctataatgatatcttaaaagattgctttctttttttttttttttttttttttttagacggagtctcactctcacccaggctggagtgcaatggcatggtcttggctcactgcaacctccgcctcccgggttcaaacaattctccaacctcagcctcccaagtagctgggactacaggcgcgtgccaccacacccagctaatttttatatttttagtagagacggggttttgctatgttggccaggctggtctcgatctcctgaccttgtgatccacccgcctcagcctcccaaagtgctgggattacaggcatgaaccaccgtgcccggccaattgcattttttaaaaagactggaagattgctaggagtattagtggttttcccatgccccttctctgttttccaaattgcttgtattgtggctgcagtccttttataatatgaaacaggtaaataacaacttatgttgtggctgcatcaaaggggtgagaaacgaaaaggagaggacaaagcaagatgtgcagagttcgacctttccaggctctctcaaagtcaaggttttgatcaatgttatgagggaggcctgtgaagtagctcagatggtcttgagctttcagcatcatggattcttcttttagatcccatcttcccttcccaactcccccttcctcaattcctactgcttaagtgtccatagggcgatttctttttcactgttcagaagctttctgcaagatgttcaaaatactagcattggtttgagcagctagtctgtcttgtgttcttgatttgggggacttagcttctatttagatttctttgaagctggatgccagtgacccagggtctatggaagagtaagagccacttgtgaggatgactgaagaggccacaaactctcagatcctgagagtgtaggacaacttgtgccttctgctagtcccaggccagaatggccatcctatctttaaaaaagaaagcaagc

SEQ ID NO: 61484 - DNA, 1429 bp, Homo sapiens
ctgaggtgggctgatcacttgaggccaggagttcgagaccagcctggccaacatggtgaaaccccctctctactaaaaatacaaaaagtagccagtagtggtggtgcacgcctgtagtcccagctactcgggaggctgagataggagaatcacttgaaccttgcggggggcagaggttgccgtgagctgggattacaccactgcactccagcctgggggacagagcaagactctgtctcaaaaaaaaaaaaaggaagatagatgatcaaagaaaataaactgacaacctgaaaacaaggaagtagaactggataacaaatgtggaaaaatttctagcctcactagtatcagagaaatgcaaattgaaacaaggtgccatttttggactctagttagtgatggtagtgaaaaccagaatggtcctttctaaaacagcctgtgtgtcaaaaccataaaaatgcttctacctctttttaccctgttaattctacttctgagagtttttcctaaagaaataattcaaaataggaaaaagctaaaagcagaaaaatgttgaacatgacattatttatagctgtggaaagattggaggctgggcacagtggcttatgcttgtaatctcagcactttgtgaggccaagttgggaggattgcttgaacccaagagcttgagaccagcctgggaaacgtagtgagaccccatctcttaaaaaaaaaaaaaaaaattagctgagtgtggtggaacgtgcctgtagtcccagctacttgggaggctgaggtgggaggattgcttgagcccaggaggctgaggttacagccaggatcacaccactgcgctccagcctgggtgacagagtgaggctctgtttaaaaaaaaaaaaaaaagagagagaagaaaaaaaagattggagacaatttgaaaagccagtaaggagccagacacagtggtgcgtacctatagtcccagctactcaggaggctgtcgcaggacagaattgcttgagcccaggaattcgaggccagctgggcaacatagtgagacccccaactcttaaaaatgtttttaaatttaaaaataaaaagattttttaaaagccagtaaatgactaaataattatgggaaatctacttaataaactattcaaaagttattaattttcatgaccgtagggatattttaagtgaaaaataaagtgcagaaatgttttatattaagtgaaggaagtggtatataaaggagtacagacaagccaggcacggtggctcacgcctgtaatcccagcactttgggagcccgaggcagacagatcacgaggtcaggagatcgagaccagcctggccaacatggtgaaaccccgtctttactaaaaatacaaaaattagctgggcgtggtggtgcgtgcctgtaatcccagccacttggaaggct

SEQ ID NO: 61485 - DNA, 1030 bp, Homo sapiens
ctcactttgcagttttactttctgctatatgttttctttaaattgaaaatatgggtcaggcttggtggctcactcctgtaatcccagcactttgggaggctaaggcgggtggatcacctggggtcaggaattcaagaccagcctggccaacctggtgaaactccgtctctacaaaaatacaaaaattagccagtcataatgaccggtgcctgtaatcccagccactcgggagtctgaggcaggagaatggcttgaacctgggaggcggaggttgcagtgagccaagattgcgccattgcactccagcctgggcgacagagcaagactccgtctgaaaataaagaaaagagaaaagaaaacaacatgacatttctataacttaaaaacaacaaattatatttgtatgggttctcttatacatattgatgttctctgcccagtgagaacacagggtgtgtggtagattgatgtcaaaaatatggttggatcagtcttatcaggcagaattggaagtttctgtgtcagaccatgggaaataccataggccattgagcagggaagctatggtgagagtgctgatagaaatgatttggcaagccgggtgcggtggcttcactcctgtaatcccagcattttgggatgctgaggcaagaagattgcttgagtccaggagtttgagaccagcctgggcaaaaccttgtctgtgaaaaaaaaaaaaaaaaattaactgggcatagtggtgtgcatctgtagtcacagctacttgggaggctgaggtaagagaattgcctaagcccagggagtttgagcctgaggtgagccaagatcaagccactgcactctccagcctgggtgacagtgaaaccctgcctcaaaaaaaaaaaaaagatacctgctgtgcccctagaagttgggaaggcaaaacttaatctaccttttaaggtgtttacagtgggagagacacaaggcagctactgtttctatggagtctgctaaggtctcagggaggtgtgcacctggcaggtgctgg

SEQ ID NO: 61486 - DNA, 1009 bp, Homo sapiens
caggggaagtgatccaaatcatagtttataccagagctgaatccggaacctgacttctacacggatgcttcatctccagggcttgactctgggttttttaggtcatttggttatctttctttttttcctttttagagcacaaatccttttaatcaaatgaaagccaaatttgcctgagtgattcaggcagggtatagggcttggaacctgaaaccactctccttttggtctttttccttctctctacaacactttcagatcccactgagtgcaacagcctcgagctttcttgacgcataggctcctcagaaaaaggcaaaggccatggtggatcacggcttgttcccactgggtgagggagcttttcccatgggactggggcaagaggagggacctgggacccaccaggagccctgctgggaatggctgcttggccaaggtagaggagaggtgactggggctacccacagggcccaagacattctgtagatgctttgggggcagaaaggatcctggggctagggcattgggtaggagctcatgctatcttgaagcctcccagcttacactctagactagattttcactgggccttttcccaagatcttgtgtcaacagctgagatacacacacaagccccgttccctccccgttccctccccactccctcctctttccctcattctctgcatgcctgcttctgtgttcttccgcccctcgcaggggagcctgggctccgcgcacaccctctgacatggagctgggggcatcgtgcggtccccaagctctgcccctgagctacatggatggagccaggtgaggaaaaggggcaggtttagttggagagagtgtttaataagtacctgtcagtcagatgtccacgcagcattctgttctgaggggtacacaacagaggtgtaagagggggtgtggctttcagtcgccataggaagggggccgcacctggagtcagctgagcgctgctagtggacccacgcgagatggttta

SEQ ID NO: 61487 - DNA, 1384 bp, Homo sapiens
gtgtggtgggatgtgcctgtagtcccagctactcgggaggccaagacaggagaacctgagaggcggaggctacggtgagccgagattgcaccactgcactccagcctgactgacaaagcgagactccattgcaaaaaaaaaaaaaaattacatccagaatgatgaaaagaattgatgcttcaaggtgacgatccttagcttctgggatcatggcttcattcaggaccttgctgggggtgtgtggagaggggctcttggaaggaaggaatgtcctctgtagagagcaggaaccctgccgttctctcgctgctgagcatctggaacgcagtaggtgctcagtaaacagctgcctaaggagtgactgaatgaggatcacagcccccagggtactctcctgttcggtagcctctgtttcccaaggaagaataggacggtctctcagcagcccgtctagcatccgttatggtgttctcacgttcatgttgtccttatgtaaccttgagtttcgggtagtgcttttattctaaaagcgttttcacatctgtgacctcatttcatcttcagagcaactctggggtggctgagtgcatgaccctgtcctgggcatggtatcggtgccaggactgtgggaggcgcagaggatctgggctggggctcatagcctgtctgtttggtttctagcaacgatccacggtggcatccatgatgcatcgtcaggagactgtggagtgtttgcgcaagttcaatgcccggagaaaactgaaggtgagtgtcgtttctaggctgccagcctccttgacatcatgccttgcaccagtgtggctcctgccccatttcagaaggaagctcccctcctggctggagctgggctctgaaggttgtacatgtcacaggggagggggcccagaggcctgatgtcttcaggctctagccaggacctgcctttgcctgagaccagcctgcccttttctagggtctcagtgaattcacaggaccttcctctttccccagggtgccatcctcacgaccatgcttgtctccaggaacttctcaggtatgttttcccagctgtgtactttgattatgccgaggtgagtggatcaggaatgggctgttgccatcccgggcaccgctgggtttcctcggcgtcctgggccacaccttgaccagggcgagtgaggatcctgttttgaggggctgctgctgctgctgagtcctgctcctgagattcagggggctggactcacatttgtgaattgtttcctagaacttcccaaggagtagcctgcccaacttgctatgtaccttgtttctctggattcttatttaactctctgaagactctcagcactttacagattttagccattctaggatcttggag

SEQ ID NO: 61488 - DNA, 1043 bp, Homo sapiens
gagaccagggtaggtagatcacttgagcccggaagtttgagaccagcctgggcaacatggcaaaaccccatctctacaaaaaaaaaaactttaaaaattagctggttgtggtaacgtgccttagctacttgggaggctgagatgagaggatcacctgagcctagagaggtggaggttgcagtaagccattattgtgctactgcactccagcctgggcaacagagtgagatgctgtttcaaaaaaaaaaaaaaatttttttgtttaaggagaggcttaactataatctatagagaagaatctagtccagaggaaagagttgaagatccttgctaattgaggaagcaaaggtttggacagcagaaaaagagagggggctcctgagccaagggcagggggtccatcccggggatgaccatgatccccctgagacttctattagtgtggaggcaggtgaagatcggcttgtgagtggaagtctgagctgaaaggggttcttgctgatgacctctcattttgcttttggagaaatttacaccgaggaggaggtaaaatgagagacttggggaaggtagagaaggtggggagagttgcctccggacctggaaagagtgggccaagggtgagggaaaggatgcgaggaggccccgtagtgttggtgggcacctggctgcaggtgccaggatttgtttttctgacaggctggtgaagacagcaacagcaaggggagagggcaagcaacctgaaacaggcacccaagaatgggggaaatattctgttctggggtcatttttgcaggccctaccctctgcagtcccgtgtgtctcgagcccctgaggacatcactatattctgaaattacataatgatgctggtattgacagctgagtcattgaggaagtgtagactgtgtcccatggactctgtttaaggaggccaggaagttagcagtaaatacattgaagacaaatttccatccaaaaaaggcggggcacagtggctcacacctgttatcccaggactctgggaggccgaagtgagcaga

SEQ ID NO: 61489 - DNA, 2375 bp, Homo sapiens
attccaggcgctacaagaagcccagcctgtcagctcttgctgcccatgtgctgagagtttatgtagcaaaagcagcaggaataagatgggacttgggggaaatggctggtgtggatttaacgagagagaaagtgggttcagtatgcctctgccctctcttttgctacaggttttgctggcaccccaggttacttgtcccctgaggtcttgaggaaagatccctatggaaaacctgtggatatctgggcctgcggtaagcccattccacgctctcagcttttcgctgttaagggccctcaacttccgatgatggcaagaaagaggcatcgctattccttgcaggtcacacacgtgcctggtgtatgtgaaattatggtgtttgcccctgggatggctgttcccatcacaccctcctccctgcgtacttctgggatgacattgtatccttcttggagagggatttgcccacgccttagaggatgggttgtgcctaaagaaatccctggtgtgacttggtgacgtgaagtgtgaggcatagcaggaggggctggtagcatagcattatcggctggcatccacttctgactctggtatggcccctgcctttctaggtggctctgagccctgcatggtttttcttggttcctcagggaagtaggcgactgacccccatgacctgtgtgttctgtctcgtaggggtcatcctgtatatcctcctggtgggctatcctcccttctgggatgaggatcagcacaagctgtatcagcagatcaaggctggagcctatgatgtaaggaccagagagccgggcagccaggccaggaagggcagatgtccttgctcctcgggctctgtccaagggagcaggcttgtttagtgtgtcacgtgatacgggggtgtcaggggactttgaggacccaggaatgggcatccagggcccaattcttgccactctatgtcccagggagcaactttcttttgcacagccttcttcataactaaaattgaggagtccactgaagtcctttgatctttacttgcaaagaatggagcggcctcattggtgtgctgtgtaacacagggacaaaaggcctggagactccctccactgcagtggcaccttggacacattgctgagcctctgttccctcctaagtatagagctgggcttaaaccagagaatgttggagtccccttcccgctctaatctgatgttctggcattctaaacatgactgttctgtctgtctttccaagtctttaagttgacacaggttctggaatagccgcagggcttctccaactctgccagtcacagctttaggtaccacagagtatcccaattacaggagttgagttgaagacagaaccagtgttgcagggtatgaagctcaccaataccacattcttctccctattcctgctccttagttcccatcaccagaatgggacacggtaactcctgaagccaagaacttgatcaaccagatgctgaccataaacccagcaaagcgcatcacggctgaccaggctctcaagcacccgtgggtctgtgtaagtgtctttgctagtggccaaggagctcaggggtgtcagccttctgtgtgccctcggcaccaccccctccttcttaccagcagagattcattctgggccccaagcaataactgagcaggcgggcagaggactgttgagggccagggtcaataaatgtcaccagggagactcgggaggctgatggggctggtgggccactgctcctctctcccccactcatggctgtcaggctgggattggttctgttcttggatgagggctcaggttgacccttgtggactccaggtagccggtgatagaaagcagctggcaaaacccaaagtgaattcccaagctggggttcatactcagatctcaactccactggagtggtgaccaagatccaacaaatcaacagaaggggtttctgagtcattaaaagcataaaagctgaggcataaagcttctgcgctaaagtcctaggagagtcctctaggctatcagtgtgggttgacgtactctgtttttatacacaattctttcaagctgaaatatcaactttcagacaaagaagaggatttggtagagttaggcatcttgacaaccacgaggcattatttatctgtccattctgtgtttattaaatacctctttggtgctggttaccgtctgggtgctggagatacaaagatgaatgaggcatggtccctgccccaaaagatcatctagggagacaggcactcaaacaggcagtcatgttacaatgtgacaagtaggtacaagaatctaatgagagtacaggagctcctactgttcctggtgggtggtggggttactga

SEQ ID NO: 61490 - DNA, 1051 bp, Homo sapiens
gggcggcaaattcattcccagttgaaaaccactgctctagactgcccccgctccctgtcaggagtttgatgacagggatggcaggatggtttgctatgtggacagtctgatttacgtgtgtgactgtggctgggcgcagtggctcacgcctgtaatcccaacactgagaggccaaggtgggtggatcacttgagctcaggagttcaagaccagcctgggcaacatggtgagaccttgtctccacaaaaaaatacaaaaattagctgggcacggtggctcatgcttgtggtcccagctactggggaggctgaagtgggaggattgcttgagcccaggaggtcaaggctgcggtgagctgtgttcacgacattgcactctaacccaggcaacagagtgagaccctgtctcaaaaataaaataataaaataactttgggtttttttctctacgcaaaatcatcagaagtgctccttaaatgccctgtttggaagctcttaagtacattgtttcttaaaggtatctttgtacttgttttagctgccttactggatgccagacctcagggcagctattgggtcttgtccatcttcattatcctaggcactcaataaacatttagggaaatgaatgagtgcacccaccgccaaagtagcttaggttgtttagttggactctccttcctaagttgccagcacaagcttcttctccaagaacaaagttactgtatggagaaagagaaagaaggaagggattggatgctctcttcttcctcaggattctgggctgtctcctgatctcttggaaatgagttggttgtgttagacctttccagtcaaaagggggtgagaggaacccgttctagcggtgatcctagaaaaaccattgcatctgcctgggcctcggtttcctctttctttaaataggttgaacaagatgatgtgcagagtctaaggttccagtggccgttaagtgattctctgtgaatccgtggccccttgtcacatgccttagtctgcagcatgtggttgtggatgtggatgaggtggtttaa

SEQ ID NO: 61491 - DNA, 1039 bp, Homo sapiens
attcagattctgattcagggggtctggggtaggacctgagtctccagctgatgctcatgctactggtccgcatgcctgtcaatacttggagaagccaagttttgcggcttcggagtcgcatccagatttggggtttgaatctgggatttgctaattagtaactgtgacctctggcaagttatttaactcctctatgcctgcctctgttttgttatctgggtcccttcgtggagttgttatgaaagggttcagccaggaaagggggctaggagggagatgatgaaaatggagattccagcccctagaagtgatctcttcaagacccccagcctcgactcagttcacaagttattcaagcctgaccatttacccttgagcccagtacccattcagctaacagtaagtgtagcaaagaaacggttgcaaataaaaagaaacattgaatcatgactgagcagttcctacatccctgcccccatggtgggggtggggggagccctgccacagtaagctcttggggggcagctcagtcccccacaagcccccatggcaacaggacctccttcccactgtgttattgctgcagatatttttaacagcaacactttttcagtgctttttggagaaagatttgttagttaaaatgtggcatattgttgggtggtttttaaagaattggaaatagccacaacatttgggttgtggctatctcagtccttgaagacatgaaatatcaagtaaaggtttgtaggtgttttggcctgttctgtcttccacggtttttaaagaacagcaattaggtttgttgctgaaatgcagtaaatgctttatactcctttccccagatcttcctgtctatggacatggcctggcccttgttggccttcatgccctgtctttactctggaatgggctgggtgtcagattattttattccacgcatccatagtccctctgctcctgcctcacagcatgacacagttgtgcttagttaacgcatttgtgtaattgctggtttaaagcctgtcttccctcttcg

SEQ ID NO: 61492 - DNA, 1045 bp, Homo sapiens
ggaagcagaaccatgtccacatcacccgcgatgcgggcgggttgaccatgggcgggttgaccacggatgggttggccacggacgggtcagggtataatgaagacaattgagaaatgagcaggaaggacaaaaatagaattctaggtgaaaaaagccctaggtgtctttttatttatttctagaattaaatacatacttttttaccccatagacttcactctgtttggtagccctttacttttaccatctgccctcggctcagaatggaggcaggcggagggaccatatatcctggccgtctgctcagaggccaggtggggcacagtcactcttttggcctctgatttcctagaactgtgcttccatttcatgactgctcccaggtcctaaggaggttggtccgaggaccgattctggggttgagggtgggcagagggaagggggagtcaagactgtgtcctgggagctccagcatccggtgggaaccagggctgttggagatgtggcggagctgcaggtccaggcggctgtggttgccatggatctggacctggcttgtggcaggagaggaggcaattttgtgcccctaattcactattcctcttctctctccactgcgctgtccttcagaactgtgacccttttggctctggcctcttgaactccatcccaaagggaaacaaacgggccagcccaagaacagtgcacagtcgaggaagctagagcaaagagcatgtggtcagccctgcctgtggtcagactcggaggcactgaattcagatggagcatttggtgctaggggccagtcatgcccagtttccccttaatagctagatattctgtcccaggagttaaaagcctgttggaagagtgaaccctgatataaactctggactttgggtaatgatgatgagtcaatgtgggttcatagacggtaacaaatccaccactctagtgggagatgttgatggtggaggagactgtgcatgtgggggacgtggggtatttgggaatgttctcgggtatttgggaacaccctgtactt

SEQ ID NO: 61493 - DNA, 1013 bp, Homo sapiens
cgtctcagaaagaaaaaaagagattctggacaccctggaccactgaaaccctgttgtggtggaaagagcaccagagttttagttgaatacctggattcaaatcccagctctgctgctcactggctcgaagtgtgcaaaccctcaagtcatttcctcatctggaaaaggtggtcataactatctatctggcccaggcctggtggctggtgcctatagttccagctattcaggaggctgaggtgggaggattgcttgagcccaggagtttgaggctgcgatcatgccactgcactcctgcctgagggacaaagtgagaccctaaaatgaaaggaaaacaagttgtctccaggattgccatgacttgctgcattacttcagcaaatcatcacaaatgcatagttagtacctgaactgaaggaatatgaataacaaggtgaccacaaggagaatggatggttgatggcttttgttttttctcttctgcttttagatcaccagaaactagaacgtgaggctcggatatgtcgacttctgaaacatccaaacatcggtgagtgcctgggcatggagcattttgtgggtattttgtagaagcagggataacagatatccactgcttttgtgtgtgggatcacctctgtctgtggaccttcacctggtgtctgtttttacatgagcaggatagcaactgtgtctcagaattctggggcattctagtttagagacctgagtatctgcatcactgcggcaccttctcagggctggggtgtgaggcatcagaataggtttcagatgctatttcttccctttctccttctgtctttgggctgaggtccagggtcctcagcgtgtgaggttccgggctcctagcctgccagcgtccctcaccaggggccatccacagccctcatgcaagggtcaggattttgtttgtggacctgaaagagttttgttcctgctgcggtgtcctgcacactctgggggtttccatggtgctcccatttgtattcccc

SEQ ID NO: 61494 - DNA, 1048 bp, Homo sapiens
cattatctcacactgacagtcctgagtttgaatcccccttttatccctttcctgctgtgggatcttgggcaagttacttaacttccctgggcctccgtttcttccatcatctggaaatgtggacaatcatagcatttacctaatgggatcattgtgagggctgtgggaagatttacagaagctttttgctgtttagggtagaggcagggagacaggaatagcttggcagctatggatgtgaaggcccctgcccgggcctggataattcagggtgaactggactctcttccttttgcaccccctccaaagcctagagtcttaactcaactctcaccattctttatctggccataatagcacaggggtggagaaagagggctctaggctcagaccacctgcatcactgcctgttcgtgttaccttaggcagattactctatctttttaaacctgtttcctcggtaatataatagagctaatcagatccctacttcacagagtttctgtaggtatgaaatatggtaatccatgcctctgcctgacatgtagtcagtgcatagtaagcgattgttatggcgactactgttattagtaaacccttattaagcccctgtttacagaaagaactctagaaagcactacctggaaaggtacccccgcccttcgaagagcttgcaactgaaagataactgatgtaatatatgatgtgagaatcgtgagaagtgcattgggaaatcggggggggggggggtggagtaggagggagaagtcacagtctaccgagaggagcagggaagacttcatgaaggaggtgacttttggcaggatttcagcaagtagaaagagggaaggacagtgggggagggctgtgaggcctccgtgctgtgagtagcatcctctcttcccacgtactggagctctgccttcctgtggaaggaattgacccacgcagctcacttggatctggggacttgtggatttctggttattccaccaaaaccaagtaatcctggagtctgaatttgaagaggtcaaagcttacagccatg

SEQ ID NO: 61495 - DNA, 1046 bp, Homo sapiens
tgcttcaggctcttgggctaggagatttttgtgcattatctcatttgactctcaaaccaccctatgagagaggtactattaggatcccttatttatttattttattttattttagagacagggacttgctctgttgcccagactggggtccaacgaggcaatcagggctcactgcagcctccacctcctgggcttaagggatcctcccaccccagcctcctgagtagctaggactataggctcatgccaccacacctggctaatttaaaaatttttttattttgttgagacaggcctcactttgttgcccaggctggtctcaaactcctggctttgagcaatcctcccgccttggcctcccaaattgctgagattataggtgtgagccacctagcctggcctgtgatcctcattttatgggtgaggaaaggggctcagaaatgttgtcaattgtccaagggtcacaggggcagaactggaaaccaaaatcaaaatcaggattttttttttactttctttctttccctctctttctttcttcctttctttcttttctttctttctcctcttcctcctcctcctttctctctcacatagtactttattgaactataacttacatatacctactatgtaatatattaggccatgtccacataattgtccacataatatgtggtatacacttataccattatgtccatgtagccaccacccggatcaaaatgagactatttctatcacactccagagttccttcatgcccctttccagcaaatactcactccccctagcctccaatgtaaccaatattctgacctctattctcatagattaattttacctattctcgaacttcgtgtaaatagaatcatattcttgtccaggagtgatggctcacacctgtaatcctaacactttgggaagccgaggcaggcagattgcctgaggtcaggagttcgagaccagcctggccaacatggtgaaaccccatctctaccaaaaatacaaaaagttagctgggcatggtggcacacacctgtagt

SEQ ID NO: 61496 - DNA, 2627 bp, Homo sapiens
ctagcgccgcttgaggtgaggagaccccgccccgctgaggtgattctgcagaggggcggagccccccagatccgaggcgggaggcggcccgggggcgggaccagccggctccagcggcccgctccgctcccaccatgcccttataaggagcgcccggcgttagggctcgggaatccggtagcaatcccggcggctcagccccaatcccaggcccctcccttaggaatgggggaggggcggggtttggcggcgcggtggctggggcggagcatctcgaaaagggaccagtaggagtggcggcccaggtctgagctgcgctgccattgggcgcggcgacgagagggggcggggagcccgtgaggctggttacgccgagggaagccccgactccgtagtcgctgcacagtctgtctcttcgccggttcccggccccgtggatcctacttctctgtcgcccgcggttcgccgccccgctcgccgccgcgatgccagtgtttcatacgcgcacgatcgagagcatcctggagccggtggcacagcagatctcccacctggtgataatgcacgaggagggcgaggtggacggcaaagccattcctgacctcaccgcgcccgtggccgccgtgcaggcggccgtcagcaacctcgtccgggtgagcgcgcagggcctggcgcgggagcgggcgcgggaggtatccccggggccccggcccgcgtcgcggctgcctgtggccggctcgctggccgtggctttccgcgtgggttccggagccaggcgccgagggttcgaatggcctcttctccgccctgtgaccttgagcgagtcctgagcctctccgggcctcagtgtcctcatctataaaatgggagcagtcatgaaaaaggctgccttgcgggcttgtcgtgaagatatggcgaggtattattcgtggagtgcctcgcgcggcgtgtggcccacagcagacacccaataaatgagagttgctgggatgtccgagggtccctgccccgcgcaggcttcgcccccacgttgacttcctcgctctcagcgccttttaggcctcctcgatctggctgtgcgggggagggagagcgggccttcccacggatcccttgccttctcttctagggatccttatttgagccacgttgtcctcctttctaatacttctgcccctcaccctgagacccgcctcgcccacccccgctccccagagctccctgtattccgcccttttattcacttgcctcactctctgtcgcctcctcctccctcctgggcattttacttatgctcactcctctggcactctcacacctttatgcagtcattcgtgaccacaagcccggtttttccttccgctcagccctgctgcccttcctttcattccctcctgtggacattttcacctggcgttacctgctgtcaaacggcctcctcccactggggcctttctagactcgggggccctccttggcccctcctcctggcaggaagcaagatggagctgttgggagaggcctgtggaatctgggatctgccgcccctgccggagagaaggctggggcatccgctccccatccacaactttcctggtggctctgcagacccctgtaacccacagctgtgactcataaccgaggtgattcctggaggaggtggagcccacgtctgaaatgggaaaaaagaggtgctgagaccagtctcccaagactcccctggctaatgtcacacttttctttcccaccctgggtgggtgactcagactggtcctgcttgtgaggaacaattttggaaaaagttcatactgctcccccactgagctgtgtaaatagtgtgtgtcagggcagttgggcggcaactgtgggtctgtctgggtggggcttgggttacttttctgatttgagcactttagtgcacttagaggctctttagcagctgaaagtcttcctcagtcttcaggggtccctggactgtctcaagcaatttaggagactggtagctaggaagacagggtgacaccaccgaccaaattcctgatctttcttctctatagctttagtaagaatctattcattcagtaagaatgctgtattcattcacaatgtctacttgtacattgttcttctttttataactaatttgaacagaacactccagagtacattcttatgtagtgttgtctaacatggctgcattccaggcctccatttttcaacaaataggaaacaatgtaaagagacaaggtaatagtgtctctccatgtagtacttcaggaaatgaaatcttaaaaccacatgttgcacttggaacagagctagtgtagtctaggggttgatatctggttaggctatttagagaaaagttatttatgggcttccatgccatgaattaataagcattgaatgtctgctatatggaaaacactgcaataaatcagtgcttctcagcttaagagtgttcatgaaaatcatcagtgaggctttttagaaattaagatgtccagctcccacgggtcaaggcctttgtattttgcttttttttttttttttttttgagacagggtctcgctctgtcacgcaggcgctggagtgcaatggcgtgatcatagctcactgcagcctcc

SEQ ID NO: 61497 - DNA, 1845 bp, Homo sapiens
gcatgtgccactgtgcccggccaggccttcgtattttttaggaagctccataggtgattgtgatatacggccttagttaggaaacactgtaatacacactgtgagacaaatacaaaagaaataaggttataagatgaaaacaatgatatgtagttaagttatatactttccaacacatacaaaagaggggacttgagattggtggtagctatgggttagcagagacaaagtagggaggattgtgctgataaatagttaatcatgaacaaaggtacttgtgagtaagtcacttccaggttacagcaagtagattatcttgattgcagctcaggagacaagttggagagaaattggagatgaagttagtgcgtgacatatgggcagtgtaacataggccttatccaaaaggatgaacaaagagagcaggaggggaaggaggatgagaatagtgtgtgagaaagactgcgtgagaatggcgtgtgagaatagtatagtgtgttttggggaggccagaggacctacccattgcttcacattcttggtgccaactgtgaccgttaaatatgtggattctgtacatgcttcaagattgttcctggaggtcaagccttgtctgatattcctctctttttaaaaaattttattttggttttaaatagagacagggtcttgttatgttgcccaggctggtctcgaatccctgggctcaagcaatcctcccgccttggcctctcaaagtgctggattacagttgtgagctactgtgcctggtctgatatttctttatatggtcctcagttcctgccctcaaaattggcacataggatcactcaataaatattgttgaaggaactatgggaagggagacaaattgggaagcttttaaaattggttggttatgaagaaaatgaaggcctggacttgcgagtggcagggaaaatggagaaggaattaatcagaaatatattagaagaagaaataatagaactggataattgaactctgaatttgctagaaaagaaacatagtattacggtaaaataatgaaactgattttagaacaaatcttctggaatttatgtaatctgggtgagtatttcttgggagttactttgggaggttatatccttattctagtgcttttctttgggaatttctttcagattatttacatacgtatgccaaattagtcttattttggtcaagaaagtgtacattttgactgaagtaggcattcttgagctcaactacttcatttactgttcttgagcctaaatgacttttggatatttccataattaaaatttactagatgaagatgaaattttcaattgttgtaatagtcattcacttatcaagcaggtgtttattgagaccccttccaatgtcaaagcaataagtgtgatgcctgtcacaatcagtatgatactgaattggaagtcttttttttctgagatggagttacgctcttattgcccaggttggagtgcagtggcatgatcttggctcaccgcaacctctgtctcccaggttcaagtgattctcctgcctcagcctccctagtagctgggattacaggcatgtgccaccacgcccggctaattttggatttttagtagagacggggtttctccatgttggttaggctggtcttgaactcctgacctcaggttatccgcccgcctcggcctcccaaagtgctgggattacaggcgtgagccaccacgcccggctgaattggaaatcttaagtggcactgaggaaacagagtatgatggaaagtcagaggaagacgagattacttttgattggagaatcagggaaggcttcacagaggatataaca

SEQ ID NO: 61498 - DNA, 1037 bp, Homo sapiens
tatttatttatttttttgagacagagtctcgctgtttcacccaggctggagtgcaattgcacgatctcagctcactgcaacctctgcctcccagattcaagagattctcccacctcagcctcctgagtagttgggattacaggcacccaccataatgcctggctaatttttgtatttttagtagagacagcgtttcaccttgttagccaggctgctcttgaactcctgacctcaggtgatccgctcgcctcggcctcccaaagtgctgggattacaggtgtgagccactgtgcccggcctatttttatttgtatttgtatatttttgatctccagttggttgaatccatagatgtggaactcaaggatatgcagggctatagctatgtttaaattttaatggaaccacaacttaaatgtttgtttacatccacacagtggaaaattgggcttttctaaagctgttttataaatagagctggtataactctaaatggacaaagtaagagggcaaaagtcctctggtatcagcaacagtagcttagattgggtcctcctgttacagtcctggagtaaggacaacagtaggacaaactacttttataggactcatttgaattttactatttcttagatatttgtttaaaaacaaactagcctggttatttcatacacaggttgagtatctctaatctgaaaatctgaaatctgaaatgctccaaaatctgactttttgagtattgacgtgatgccacttgtggaaaattccacatctgacctcatgataggtagaagtcaaaactttgtttcatgcacaaattattacaactattatgtaaaattaccttcatgctatgtgtatatgaaacataaatgaattttgtgtttaacctttggtcctatctccaatatagctcatgatatatatgcaaaaattcccaaatccaaaaaaatctgaaatatgagatacttctgatctgaagcatttcagataagggatatttaacctgtacttatttaattactcatcatttatat

SEQ ID NO: 61499 - DNA, 1046 bp, Homo sapiens
tcccgaagtactgggattacaggcatgagccgctgcgctcagcctaaatttttttttcctttttttttgagatggagtttcattcttgttgcccaggctggagcgcagtggcacaatctccgctcactgcaacctctgcctcctgggttcaagtgattctcctgcctcagcctcccaagtagctggaattacaggcacccaccaccatggacggctaatttttggtatttttagtagagatggggattcaccatgttggccagtctggtctcgaagtcctgacctgaggtgatctacccaccttagcttcccaaagtgctgggattataggcatgagccaccgcgcccggcctaaatttttaaattaagtgaacatatgcatagcatttatttttatttataacatataatattaggaattatcgtacagtgaatatttcccatccccagctgtcaaatatctggtatagtcaaatttgagccatctcatggaatttataatgggctttgactgaaacaagtgaaatatatactaagaggaatgaatggctaactgcccattgtttgagataacaaaagtgttcaggctattttgggttgtggtttttctgtttcagagtcatttcagctatgcagatcacttactaaattcataatgtgagagtatgttaccttctatctgaaagtggcgttgggattttgcattctcttcttgggagtgcctttttaaaatttaatgatttagaccagatgttgatatattatttggagccctgctggttacaatgtagtctcatactatgagtcagaattcctcattaaaggatctttatttccctgaaccatatggcaagagacaaagatatcacaaagttgatctgctgcttttttgctttctggctgatttgggcccagccttttcattaaacctttaggtcatggttccgacagcggggtgtatttttacataataaaccagcattagggcagtatcaaaagaagtagcagtctttaatgagcaaatatcagagattagctgctttctt

SEQ ID NO: 61500 - DNA, 1300 bp, Homo sapiens
ccatctggggagctgtgctgtagacaggaaactgctgcttcagaaaatatgaaatgaaataacttcaagataatgagcctcatcctgaaagaacttctggtcccaacatacttattaagacatgggggctgggcatggtggctcatgcctgtaagcccagcactctggggtgctgaggcaggtggatcacctgaggtcaggagttcgagaccagcctggccaacatggcgaaaccccatctctactaaaaattcaaaaaattggctgggcatggtggcaggtgcctgtaatcccaggtacatgggaggctgaggcaggagaatcgtttgaacccaggaggcagaggttgcagttagctgcgccattgcactccagcgtgggcaacaagagtgaaactctatctcaaaaaaaaaaaaaaaaaaaaaaaaaagacacgggatcaaataaccattgattaaattaagtatgtgcattgcatgtatgcaaagaggtagagtgggatagagtgttaggtaaaaaggaacttgtataattagacgtaggaaatggggaactcactgccttctttcaagtcccttggtaaatgtagattttatgtcctcatatactggatcatcagtccttggatgatggatttcatatcgaattttcttccccctctcctccctactctcctagggtgtctccctttagactgttggtttctgaagggcaaggagtgggttttattcttcatattattggttctgtgtttaccatagtcccctgctcatggtagttcttcaattaagtgtgttatgttctgatatttaatataccagctagtcattttaggttattttatgataataaggatagctgattatctcttgcctccactggaaggcatgatgtttctcttttcctgccctcaaatgttgctatgtaccaaatatttatacagtctcaaagagaaacaaagattcataaacgatattatattgtgttgggtacatattttgaacttttagattccaaaaaattccatgtcacttctatcagaagttagcacactggattggcataagtgtggggtgtgtgtatagaggagagaggtggtgaatcttagaactcgaaatgttttacaaatgttgttaagctgcagaaaatagagtctttggcccttagagaatttcccactgataaaatttccagttgaatgacttttaaggggaaagtggctgaatttcactgcacttcttaccacagctggccaccatccaagtcaaagtcattccttcttttgaaataagcttaagtt

SEQ ID NO: 61501 - DNA, 1023 bp, Homo sapiens
ctatataagtgaaatcatatagtatttgtccttttgtgattggcttatttcacttagaataatgtcttcaaggttcatccaagttgtagcatatgtcagaatttccttcctttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctccttcctttttaaggctgaattatattccattgtatgtgcataccacatttgtttacccattcatccattgatggacatttggattgcttccaccttttggctattgtgaataatgctgctatttcatcatatgtttaatatcttaagaggcctgaactctgtctctgaagggtgtaagctgctgctgctgctttttctttctttctttctttttttttttttgagacagggtctggttttgttgcccaggctggagtgcagtggtatgatctcagctcactacaacctcaacctcccaggctcaagccatcctcccacctcagcctcccaagtagctgggactactacaggtgcatgccaccatgtctggctaatttttgtgtgtatgtgtatatattatacacatacaattttattatacttaaaattgtcatttcttgttgttcttgttgtttttcttggagtatagaaactataagagcttaataccagagcgagaatagcaaggcacctttaaaatctggtgaaggctgggtaaggtggctcatgcctgtaatcccagcactttgggaggctgaggcaggcagattgcttgagcgtagaagtccgag

SEQ ID NO: 61502 - DNA, 1031 bp, Homo sapiens
aaaaagaaaaaaaaatctggtaaaatgtgaggatatatataggatatatatatatatatatatatataaatacatatatatatgtgtattattttattttattttatagaatggggttttaccatgttgctcaggctggtcttgaactcctgggctcatgtgatctacctgccttggcctcccaaagtgctaggattacaggtgtaagccaccgtgcccagctggaatgtaagcttctgacggacttgggctaggactgtgaacttagcctctgatgccaaggagcaaacatggaatgaaagcaggccaaaggcccttttgcataatatggcagtaaggcaggaagggaagttcattccactttagagaggcagtgtttgaagcatgaggaagtttgccagccagagaaaatgggaataccttctgtgcagagtgaatacaaagatacaagggtgtgaatgtgcagttagggaatggggaagctttagtaatgagactgttaaggtggattgtgtcccttgtgaagggactcagacgacataaatcagttaaaaaaaacaaaactaacttcagtttttgaataggtataggattcacctggttcaaaatttaaaaggtaaaggtatacagtgaaaagtctccctttcccccttgaactccagccacccagtttccctcctcataggaaaccgatgcacttaagaaacccaatgtcttggatatgcttctagagatagtttgtgcacaatctggcagtaactagtcccctttcatacaaatgaagacctgttatactgtcttgtcctgtttcttgatttttttttcatcctttgcatgttttggggaacatttcttgcttgtatctacagaactttctcttcttttgacagttaaataatagtcccttgatggttgtagataatttattaaactagacccttatggaaggttatttgtgatctgttgctgtttcagacaacatggcaaagaatgacacaaatatgtcagtttacgtatgtgcaagtacattt

SEQ ID NO: 61503 - DNA, 1024 bp, Homo sapiens
aatggtcaacgttagtaaatgcatttaaagactttttgccggctgggcgcagtggctcatgcctgtaatcccagcattttgggaggccaaggtgggaggatcacctgaggtcgggggttcgagaccagcctggccaacgtggtgaaaccctgtctctactaaaaatacaaaaattagccgggcatggtggcaggcgcctgtagtaccaggtactcgggagactgaggcaggagaattgcttgaactcgggaggcagaggttgcagtgagctgagattgcaccattgcactctaggcaacaagagcaacgtgacactccatctcaaaaaaaaaaaaaagacttttgccattgtgttaccatttcaagttttcatcacacctgtaatttaaaaaatggggggtctacagtgttggtcagtactggttcaattttaaaagttacttaaggccaggctgactcagctgatcatgcctaagcaaataacagttaaggagctgaagccctagttaagcctaactgatcttggctgtggaaaccttccagcttctgggaagaaccaggacaatgggacatcagttggttagactgcatcttgatggtttatatgtgcccattgtgtacttgaagtttttcttgtccttcttgccatctgatagtgctgtagagttacagaatcacacaatataacagccaaaaatattagacataattgaatcccactctcattttattttattttattttattacttttttgagacaaagtcttgctctgtcacccaggcatggcacgatctcagctcactgcaacctctgcctcctgggttcaagcgattctcctgtctcagcctcccaactagctgggattacaggtgtgcaccaccatgcctggctaattttttgtattttcagtagagacggggattcaccatgttggcctggctggttcaaactcctgacctcaggtgatccacccacctcagcatcccaaaatgctgggaatacaggcgtagccatggtgcctg

SEQ ID NO: 61504 - DNA, 1024 bp, Homo sapiens
ttaatttcagtttttttgattactagtgaagttgcatattttcatgtttggtttctagtgtcagaatcataatagcttcaaatatttttcccagttccaataacttcgtttttttctgtatagatagttttgtctgtctaacttgattcatgtacttcatgtaacattttagagatgtggcctagttttttggcttaaatacacacacttatattctcaatgatgaatttctcctattatgctcagtaatgctttcaaattagttattctgaagaaggagtaatacaacattatgtttgtattccatattgttattctagtatattgtgaaggcatattatgtgagtaatcctaaaaaattttttaaatccagaaatctcccttaaatctagaaactttaatgatagattatgtttaagtatatgtttcaaatatgcttaagtaatagttttttaaagtctgagaatttatatttgaattatgattttttttcctcttgtaggttggaaaagagactgttcaaaccactgaggatcagattttgaagagagatatgccaccagcatttattaagtgagtaattgaaatattcttctgttgctaagcagaataatactcttgttaggaagaaaaagtagctgatttcagtaacaacttttttttggtataaaacttttgtttacaattgaaatttcaacttttttgtcttctaacttttttaaaaaaactgttcattttagtttttgatattaggcatttttgacataataattttttttttttgagacggagtttcaccctcgtcacccagtttggagtgcaatggtgcgatgtcagctcactgcaacctctgcctcttgggttcaaatgatttgcctgtctcagcctctggaatagcttggattataggcgcgtgccaccatccctggctaatctttgtatttttagtagagatggggtttcaccatgttggccaagctggtcttgaacttccgacctcaggtgatccacccaccttggcctc

SEQ ID NO: 61505 - DNA, 1931 bp, Homo sapiens
aattagccggacgtggtggcaggcaccagtagtcccagctactcaggaggctgaggcaggagaatgcgtgaacccaggaggcggagtttgcagtgagctgagattgcgccactgcactccagcctgggcgacagagcgagactccatctcaaaaaaacaaacaaacaaacaaacaaacaaaaacttaattgagcatatttaagttcacgtgtataataatatccctctcattccttctcattatgtttttttttaaactttcattgaagtataatatgcttgttattatgttttctttaatgggagataaaatagtggaactacagctattgtggctgggaattatgcataatcccaagtagacccatggggatatgccataaacttgagttttatttttctatatatgatggcagagcaaaagtggaaacactactgcagagaaattttgtaaaaaagaaatattttaagacgtttccaattaaagagctataatacagactgactttatgataggaattcagagagagagctctctcattataagtaggaatagtagaaagagcgtttatgtaggaagtggggcttgggaggatggttagatgtagggaggaaggaaaatactctaggtgcaatgaatggcatgaccaagtcatgagggcctgtggggagaggggcacatggtgggggtggtaggaactaagcttaggtaggtaggttgggcaatagtgaaggtccttgaaagccaggcaaaggaatttagaattgggcaggagggaagctttgtagttgctgagcagtaggatgacaatatgaaagcatcttccagaagattcataaccaaatacagaaggaatagtaggtgctaatgttgtaacagagaataagctagatgtcaaactgaccagatttattttctgtcagtgtagatttgcttcagattgattccttattataggtgagaaatgtttatagcaaactattttatttgccttggaaaaattgtcattgctgtatacagtggaatttcattcttatttctgcaatggagcagaaatgaataaggaaggcaattcttggacctgatccaaggatgttcagaactgaatggatcaaaaagcatcacttctgaggtggtcttgtgatatgaacttgaaaagggcatggtgtacattatctgttggcaggcaaatgacagctttcatttcgaactggacagtgttgtcactttctgccttagtgctgctctgacagtctgcttgaagtcaaaacttggattggttcaccagcttggactatttttgaagcatactgtaatgtctaggcttattgaataaaagaatgttcccaaaataccatgtgaaaggatgtactactgctacatgattgccattattcacatttcttgggaattctttgttttaacccttaaactttattagttaagaacagttatggtatttacttatacaaatttaccataatttatattcatgcacaaagaagaaatttgagaaggattaaaatatgctttatacttaatttagatctcttttgacctaaagtaatgatgtcacatttttaggtcatcaggccttgtagctttttctttgcttgtgatcttgaacactcaaaataatttgtgatgaaatttgtatttttaaacacacttgtgggtgaaagtgcccagaatatctttttttaacaattaattacttaatcatatcacttaataccttttgtttgcctggggctaatgtgtgatttgtgtgtgtgtgtgtcctgagttttgtggtcctttccactgctacagtattagaagatttttgtctcttaatgtggatgcccaagttctgtgatgtaatcattgacctctgcccactgccttgctgcatttttgacctagagcaagcactcaaactttaaatagt

SEQ ID NO: 61506 - DNA, 1036 bp, Homo sapiens
cgaagtgggtggatcacttgaggtcaggagttggagaccagcctgggcaatatgatgaaacctcatctctacgcaaaatacaaaaaaaattagctgggcatagtggcgcattcctgtagttccagctacttgggaggctgaggcaggaggattgcttgagcccagggaacggaggttgctgtgagctgagatcgcgccactgcactccagcctgggcaacagaatgagactctgtctcaaaaaaaaaaaaaaaaagaaaaagaaaaagaagaaaaaagacttgtggtagtctttttataatctctaaatggattttcctcttctttggcatacatttaatcttcttggttagtgataattgaaatcacatggaactgaggaatttgtgctctttttttcttacaaaataattactcatactcaaggtcttctcctaaattgtctcaaattagagtaggtggtaattctgggaagaatgtattagagggtcatgagtgagcatatttcgagatcccataaggctgtcattggtccatttgatatatagcataagattttttttctagcaatttaggttgaagattcaaagggagagagaagtactagttgattgatttaaattatctaattaaatattattagtatatagttaagatatacaattatttaggaaactgaccttatgcctactttcattctttaaatactttttaaaaattcagatttctattaaaatgtgcaagatcactttaagaagctagggagcttgaatgtttaaataaaatccaattttccatacacaagacagacttcttcctgtttctgactgctggttagtcttagtgggatttgtttggcttttatgaatgccattaaattttaatgtgcagatcagatgtcttattgtataaaaaaatggttcagtctctgttttggacctatcattttaccacacaagggaaccattagtgataatcaattttattcctgtaaaccttttcaatttcatctttttcagtttcctttctccataatg

SEQ ID NO: 61507 - DNA, 1747 bp, Homo sapiens
tcaagtagtagctaaaaaaggacatatgagtataagagttcaggaggctgggcacagtggctcactcctgtaatcccagcactttgggaggccgaggtgggtggatcacctgaggtcaggagttcgagaccagcctggccaacatggcaaaaccccgtctctactaaaaacaaaacaaaacaaaaattagccaggattggtggcagacggctataatcccagctactcaggaggttgaggcaggagaattgctcaaacccaggaggcggaggttgcagtgagccgagatcacgccgaaagtgttgggattacaggcgtgagccaccatgcccagacattatttttttcttctttatgtttgggggttggcaaatccaagctacatgttgagagaaatctcggatgataaacttgacatcttgggatcttctgctgggatcaggggcagcaggatacgccattcagagtattactgacagttttcatattgtcccattaggtttgtagtagatggagccagggtgagggccaggatgataactgatttagaaggatattagatattttgtgattgcaggtcatcagcatatgcaggttaaattagttacttaatcatgttgtgatggtgtctttgtaccttgagttttctttttctttttttatttttacaataaaggttgttaatgttggaactttattgtcaaacttgtagtgtttgttttgtatactcattttaggatcttaaaagcccaaaacatctaaagtgtagaacatcttttgtgaatattgttatacaacaagattaaattccaagcttactttctgatcttttatttttacagctatgaagatttttgtaacaactaaaaactcaaaaaaccaaggcatagaggaagctttaaaaaatcgcaattttactgtagaaaaaatgagtgctgaaattaatgagataattcgtgtgttacaactcacctcttgggatgaagatgcctgggccagcaaggtacgtgttcttagtggagaaataagcaaaatccccaactctccctggctgggggttttgattggcacctgtctcatactttatcttgtaatttttgtagcataagagtactcagatattgtgaaagtaatttcttcttcatttctgtttcataggttacttgctatctttgctaatttcctttgttctaaggtagaacaagtaaataggcatgtggggtagatactggtttaaggctgagatttatagcttttccatcaggctggagtcttattggttggactggtggaagagtatattcccgtggatgggagctctgccttgtatatgggtggttcttcccagctgactaagtaagatacagatatgcctgtaattctgaactttatggaaaacttttctttaaccaatctttgatccagagaaatctacagaggaaactcttggcatttctagatgtgtcccttgatcattccattttccccaaggaaggtttaattaaaatattagtcttcacattggtcagttagtttgagggatcccttcaccctttttctggaatctcttttaggaccccagaggggctggcagattccttctagagcctgttagcagtggttttgtgttgctgctgctctggtctgctgctccctgtttaatgactgtgaaccaagctttcaggtctgggggaacagagatacttgggttcatactttccttgtaggagcccaagatgtaggcagt

SEQ ID NO: 61508 - DNA, 2101 bp, Homo sapiens
cttcttccaggtgagggatagtaagggaactaagaaggaggaatagcagggaaggtcagaaaacacttctaaattatattactttgaggggtttatttgtagaattaaaattaaactgctagattaacattttcaattgtttcttccaaccagtaattccaagtttttcaggttaattgaatatagtgaaatatcatccagtgtgtgcatttcaaaacaagatgtaaaagaactgtgatttgtggcaccacatactaacgaggcttccctgaggtgggaagggctttggcaaggctgcagtagatgaatgttgactagtggaaaggctgacaatgaggcatgtgacaacagggctttttcctgctgaagacattaaacatattctggcttgagcaattttaccagttttcacagttttagcaatagggaacccaattccactctgtttagcaacagagtagaattaactgaatatttgcatgcaagatgctgcattttgacagaaatgagaattgtggtgtggtgacaatatttttaaggccttcgtaggactgactaccttagctatgtatgttaatgctgtaacttcttctctgtcttacgttctatcatggtatctcaacttttgcaaagaaaataatggtgggatttcttcccaaaaggacactgaagccatgaagagagcattggcctccatagactccaaactgaaccaggccaaaggttggctccgtgaccctagtgcctccccaggtaaccctctagttctgcttttctgatcaatacaacgagaagctaaaaaccaagcaaatgaaagaaagaaattttcccataatctcatcatctgagagaactactgtaacattatggggcataccccattatctgatagttctgagtaactgaagcaagtagtaggccttacaaggatgaagggaatagattcgatcacctctaatcacggaggagtaagtcatactgagctgggcattctttgcaaaatttttggttctccccttccctgaatccaaaaggtaattattttgaatgaaagttcttctcttccagttcccattgagcagacttccatttatgtcaacagagttcttaattaagcagattaaatcatgatgccaatgagaattggaaagttgactgtataaagataagacccaaataggttattgaactaggctttattgattttctaatctaatatttattctgttttagattaatatttgaatgaatgtgaaaaacctaaagtaggttggaggtgctaaatactattaaattgttagagtctgttttcatcatccatattcttaccacaagctacttagtatctccaaatagatacagttccaagtatctttttttgcgtgtctgttgttgaaacctcaccctatggtttaagggcactgcttggctgttagctatcagatatgttgccttctattcactcgtcttgtttaaaatcatccattccttggtgaatgaaatgacttgtaaagtatcctctctaaataatgaatgtgtcaacaatgtagttattgaatatctctttattttaggggatgctggtgagcaggccatcagacagatcttagatgaagctggaaaagttggtgaactctgtgcaggcaaagaacgcagggagattctgggaacttgcaaaatgctagggcagatgactgatcaagtggctgacctccgtgccaggtaaaagttcctctgtccttacagagcagtagtgggtaactcactcctaacagggtgattcagaaaacaagcctctgccagttttgagttatctctttggctagtagataacagagatattatagtctattaaattcttttgagatggaggtgaactttccctttgctgactttatttatttatttattattttttgagacagagtctcactctgttacccagactggagtgcggtggtgcgatcttggctcactgcaacctccacctcccaggttcaagagattctcctgcctcagcctcccgggtagctgggattataggcgcccgccatcacacctggctaattttgtttgtttgtttgtttgtttgtttgagatg

SEQ ID NO: 61509 - DNA, 2244 bp, Homo sapiens
gaaaatagtgaaatcagttctttaggaacttgatgggaaacagtggtttcctatcaccatgtgctcagtattagctagtttcgattatttatatatttataggttgcctaggaggaaggtaggcatttaagattatcattaggttcattataaaaatgatgataattcagtaataatgatagatttttattgccagtgttttcaagtatattattttgatgcttgaagccactccataagataagtggggaaaatgtattacctaccttcattatatgttaccttcactatataagttagaaaatggaaacccagggaggttaaacatcataaacaaggttccacaggtaccaagagtcaagatttgaacacagatctgcttgttcccagtctggtacactttcattaacactatgcgtgcttcctcctgaaacattttcaatgtatacttgcccataagaagacaatttaatggactatttatttcagaagcacacattactatggtaacaaagccctccctagcaataagatcaccagcacattttcccactgaagtttagattggattatgtaatcactaccaagaggagaataattatcaaaatttgctggcctggtcttcaaagtggttatgcagttccgtgaagctaatgtgcatttttaaaagaaaaagtacttgatttgggcgtcttgctttgtttatgtctgttttcttgtgctgtcccagatttactgggaaaaaggaaaaagccaagcatgttcatgaaaaccacatgtactgtgctattgggaatattttgtcattaagtatttgagggtgtacaatgacagcatgtgtctgttttgagcagaggacaaggatcctcaccggtggccatgcagaaagctcagcaggtatctcagggtctggatgtgctcacagcaaaagtggaaaatgcagctcgcaagctggaagccatgaccaactcaaagcagagcattgcaaagaagatcgatgctgctcaggtagtcacagtgattttcaggaggggtgggaaatatttcataaatatcctaagtcataaatatcctatctttcttctctgtctcttatcatttactgtggttggataatggtttctaagtgatgagtgacttccagcacttaccaatgttaacacctcctttaccaccacaggtttagacaaatgtttatctatattttgaaataaagatcttaatttacagcacttcagttaggtaaaagtaagctctcagagtaccaagggaagattgcagtacattggaactattccttgtcccagaattcacaactcttgggtcattgtaatgtttaggggttaaagttttccgatactgctctactgtaaaatgattttcaagcatttcacaaacacacatgtttgaggaactgaggaactaataaggtgtggttaattcagagatgagataaagcttgggaaaatattttatgctaatgggtgtaaaaaaattgattttaaaaagatgagagattgagtttcttatctaagaacctccatacaataataaagatcagaattataaaaatgattactggtatattacttttgaaatccttcttctggccttgttaagtttagtagaaaggagtgtgtgagtagatcacagcgtgctgcttctccgtttctatgtgtagaactggcttgcagatccaaatggtggaccggaaggagaagagcagattcgaggtgctttggctgaagctcggaaaatagcagaattatgtgatgatcctaaagaaagagatgacattctacgttcccttggggaaatatctgctctgacttctaaattagcagatctacgaagacagtatgtatttaacccttacattgccttttcatatcttttcttctctttctctctcccttccctctccctttctttctttcttcccccaagaacatacatatttcaattcccctaggttaaatgcacttatgatgctcttccactatattctcattaattctaggtcagatgttaatttgctgtatcagtgatgtaactgaggtttaatgatttattgctggtcacatagttataaattgataaatttaggatgctaagaactccttttttgagatgctttttaaatttctaagctagggctttctttgatacatcatgtttatgacctatctgtttcccatacataagaggaaaataatttttgtggctagctatgaaaagactcct

SEQ ID NO: 61510 - DNA, 1049 bp, Homo sapiens
ctacaggcgcacaccaccacgcccagctaaatttttgtatttttagtagagatggggtttcaccatgttgtccaggatggtcttgatctcttgacctcgtgatccacccacctcagcctcccaagtcctgggattacaggtgtgagccaccacacctggcctattatttttatttttacagatgagacagataaagttagcctgaaagttacctttctatggctgagaggacctgagatggaaaatgagtcagattctttgtatttttataatggttagaatttgaagtctttggaataaggtgttgggggcagtttttttctttgtgatataattgtggttgtctttttatttctgtgttgatacttggttgaggttctttggttggaaggacctggtcaagtaaaaagtagaggattattgaaaatagaggcacctcatcaaacccaatagcttgaatgtggccagatcttgggcaactggaagcccctccctccacctcttagtcgctgtgtgggatcctctatgtctgtttcaccctgtgtgttgacttagtttatttatctgggggttttgtctctggctgtgagctaccacggcccaggcttaatcactttccagctccagataccatcactggttgactatgcagtgtttttgaaatatggacccaggattatctgcctaagaatcatctgagaaggtcgttaaaaatgcagaccccttgaccccaccgcagacatacttaattggaatcgcttttgatggtgggtttaacaatctgtatttaaaaataagatctccagtgacttttatccacactggactttgagaacccccagaatctaattgagtgccttgcctgactgtgggtatgttgtccttgaggtagataaccacccagtttaatcagttatggcaaggactggggattatgtgataccaaatgtatagtagtttatgaatgaaggctgggcacggtggctcacgcctgtaatcctagcactttgggaggctgacgtgggcacatcacccgaggtcaggagttc

SEQ ID NO: 61511 - DNA, 1039 bp, Homo sapiens
aaacccctctcaaaacaaaaaacaaacaacaacaaaaaattgcttgtaacagtacctggcagaattaggactcaaaagatagtattactactagtttgactataactgtttcagctgctcctacaacaaacatggctgcctgggcccacccagttccagaggaaactggtgttttcagaggtggcaggcagagggtgccgctaacctagtgatgattgattgagctccgctaaccaaatgattgatctgagctttactgatgcaaactcatatttaatgtcttaactaggacaaaataatctgaatgtaaattattaatttcttatgtaagggccaaataaataaaccactcctttcaaaccaaattaatagtaatcaggagcaatttgtcatcctattagcatttgtcattagcagctaagtgatctcaatgtaaatagtgtttatgtgtgacaggatggctgtctttttctctgtagggggaaaggagattctccagaggctcgagccttggccaaacaggtggccacggccctgcagaacctgcagaccaaaaccaaccgggctgtggccaacagcagaccggccaaagcagctgtacaccttgagggcaagattgagcaagcacagcggtggattgataatcccacagtggatgaccgtggagtcggtaagggcagcagtgcactataacctcattaaattggtctcagtgcaaataagcaagttgttgataggggtcctgtaacatctgtaattaggtaagggttctttagctgctgataagtaactgtgattccatttccaaatgcagccagtaaaattcctgtgatgtaatcaagaagcagaccaggcatggtggctcatgtttgtaatccaagtgctttgggaggctaaggtgggaggatcacttgcgcccaggagtttgagaccagccaagcaacatagcaagaccctctctgtacaaaaataaaagagtaaagaattggctgggcatagtgatgctcacctgtagtcacacctttccagctacttggga

SEQ ID NO: 61512 - DNA, 1034 bp, Homo sapiens
tattacatagattttagatcatgattttaaaagatagtgaaataaaaataaagtgttaaataaaaagaactggctgggtgcggtggctcatccctgtaatcccagcactttgggaggccgaggtgggtggatcgcctgaactcaggggtttgagaccagcctgggcaacatagtgagaccctgtctctctaaaaaaaaccaattagccaggtatggtggtgcacacttgtagttccagctacttgagaggctgtggtgggagggattgcttgagccggcaggtcaaggctgcaatgagctgttgttccactgcactccagcttgggtgatagagcaagacgccacatcgcaccacagaatggcattgcaattgtctcctctgggtcttgtaagtttcattgtttttctcttggtccaggtcaggctgccatccgggggcttgtggccgaagggcatcgtctggctaatgttatgatggggccttatcggcaagatcttctcgccaagtgtgaccgagtggaccagctgacagcccagctggctgacctggctgccagaggggaaggggagagtcctcaggcacgagcacttgcatctcagctccaagactccttaaaggtagaagtcaggagcacatatcattttactttttatgcttcctattattgaaagacgagggaaggaagagagagttttgaaaaatacataatttctggggtctagggaaaatgaaaagagtgtgaccaaagatataaggaaatctagagcttattaggaaaaagcttgctggtatatagtagcaactaaatttgtgttttccaaattccactcagtcaagagccctttcgtgatttttgctctatccacatatcatctgtacttttatttagccaatatttttcttaaaatggactttttttttttttttaaatggacttctttttaaaacttaaatttatttaagagaaaactctgtgggccgggcatggtggtacatgcctgtaatctcagctacttgggaggctgaggtggga

SEQ ID NO: 61513 - DNA, 1016 bp, Homo sapiens
tgaccttagcatttggggtcttttagaaattgcttatctttcttggaactgcaaatgtttttagatgctacattgctaatgatcagagctccaaatatgaattgtgtgggctgtgctaaagctagatgaaatgtttgcattttctttttttttccacagaagcaagtagattggtatcttagaagccatgtgcttttgtcctttctcagaatcatttcacctgtcaactcaagacagctccaggctgtctcttactcagcaaatctgaaggtgtaaatattaatgtggttggtaaaaatatggatgctacagcagtcttgccctatgaataacttttgcctattttcccctaaatgatgaaaagtgagcagtagcttttctagataagaggaatattattgctaaccctgcagtgaaaggtagctcttagttctaaactgtttctaatatgaccctagatcttttttttaatgtttttatgaccctagatctttattcccaccacctatttgcctttattctttacacatcctcaaagctttcaagctcttgtgtcgattgtatttcctcagggacctcctgcacctgcagctgatcttggatttttttcaggctgggaaattcacattggtttttaactctgtattttgctgaactgttagctgtgagcccaggttctaagaaggaagggagactttgctggtgttggacctgacctgtagaattatttataatggtatctctccaactgcatgtggcagagccccactgtgcatggggagtgggggagggtgacagtgaagattttaaaggaaatttaaatttcattacaatgaaccaaaatacactatgcagaacaaaaaatatacatgaattatttaaaaaaacaaacaaacttaaaagcagacagcattggcccacattacttgccccactctgccatttgtggccagaagtcctgaggtctatctcctgaagtgtgcaagatcaggagtttgctgactttgagttgtgtg

SEQ ID NO: 61514 - DNA, 1023 bp, Homo sapiens
ttttctctccggattccttttaaaggtaatttgctactatcgtttggttgtttggctcctcagaaatattctcatgtgagaatcactcttgtcaagtttgactttagtatcaagtatattaaagaaatggatgccacttgctttcttggtgtaaagatttctctagaagccctttgccattggagtgagtcccttttcttctctcaccacacagtggcttgggctgagtggcgctggaggctgagaattcccccttctgtgaagcttggtacacaaggctcctagagaacatgtttctttctcatcctaggcaggctttggttactaaaccagctgaagcccagtttcccaagtcgtattgctcttactaacactatccctatttctcatccttcccgccatcgacaaagccgggcatcccagccgctgaggtgggtataggtgttgtagctgaggcagatgcggccgatgctgctggcttccctgtcccccctgacatggaagacgattacgaacctgagctgctgttaatgccatccaatcagccggtcaaccagcccattctggccgcggctcagtccttgcatcgggaagctaccaagtggtctagtaaggtactgataagcacccccagttgggggctgctccatatgcatccggccatgtgcagccttgacacattgcatcactcatgatctgtgctggtcctgtgagtctgagcagggcgggcatctgtctgtctgcaccatgttgttaggactggcttcacaagtttgataggtctgctaacgccagattaattggactgcatttatgtttaggggatgaagagagatggggggggtcacttttggaaaggattccttttcttactgattttgtggccatcgctggaaaccccttgggaagccgtgaatgcatctctcaatgacttccaggtcaggaaccatggtagaccattacgaggtcacctggcctgaccattgagctttgcctgctcccaactgacccctcactgatggc

SEQ ID NO: 61515 - DNA, 1434 bp, Homo sapiens
gaggctgcagtggccgagatcacaccactgcactccagcctggatgaaagagaaagaccccatctcaaaaaaagaatgagcagggaaatcctcaccaaggtgacaagtgagcaaagatctgaaggtgaggggatccctgggatccctggggaaagagcagtccaggtacaggaaacagcaagtcctgagggagaagcatgtttgaagaccaagaaagaggacatgctgtaagctatctgaagccacagtatacaatcagcgatggccagttttgggttctttttggtgatctgggaaaacccctagtgatgcaagcaaatatgggggatgccaggtaccagtggggttagctgcatcccactcctggctgaaacctattttagagacaggcctgcatcagggaccctgggtaacggaaagtacctttttccttgcaggccacagagatgctggttcacaatgcccagaacctcatgcagtctgtgaaggagactgtgcgggaagctgaagctgcttcaatcaaaattcgaacagatgctggatttacactgcgctgggttagaaagactccctggtaccagtaggcacctggctgagcctggctggcacagaaacctctactaaaaagaaggaaaatgatctgagtcccaggagctgcccagagttgctgggagctgaaaaatcacatcctggcctggcacatcagaaaggaatgggggcctcttcaaattagaagacatttatactcttttttcatggacactttgaaatgtgtttctgtataaagcctgtattctcaaacacagttacacttgtgcaccctctatcccaataggcagactgggtttctagcccatggacttcacataagctcagaatccaagtgaacactagccagacactctgctctgcccttgttccctaggggacacttccctctgtttctctttccttggctcccattcactcttccagaatcccaagacccagggcccaggcaaatcagttactaagaagaaaattgctgtgcctcccaaaattgttttgagctttccatgttgctgccaaccataccttccttccctgggctgtgctacctgggtccttttcagaagtgagctttgctgctacaggggaaggtggcctctgtggagccccagcatatgggggcctggattcatttcctgcccttcctcagtttaatccttctagtttcccacaatataaaactgtacttcactgtcaggaagaaatcacagaatcatatgattctgcttttaccatgcccctgagcaatgtctgtgctagggaaacttcccgtcccatatcctgcctcagcccgccaaggtagccatcccatgaacacactgtgtcctggtgctctctgccactggaagggcagagtagccagggtgtggccctgccatcttccca

SEQ ID NO: 61516 - DNA, 1025 bp, Homo sapiens
aggaggataccatctggcggctgcacattgtaacagtaaaggcagaaagctgtagtgataacctctctcctaaaagagttaactggtctcatccagcagaagctatcttaaatctgtgatgtgtcaggtgcagccaaatatcacaccttctgatcttagccatcccaaaccagtatctgtcccgagaggaaattccccccacccccagaagtttacagaaaactgcctcttcaagtgtttgccttattcagcttttcacttgtgccattaagcaagcactgtagcaaaagccacttccacatggccctggcagggagcactgctgctccatgctccattctcactgtacttggtattgtattttttataaataagatttttatgtaaagcttagaatttgatttacagggaccttgctgcagtaaataccatctcaattttgtgccactggttcagctgttagcacagtaaaaaaatcatttgtatcaaaggggcaaatgctttattaaggtagtaaaagggaacattacttctgcttttaggaagttactgcaagcacaagcatttgtgcttttaagcaaattaaagtagtaaaagaaaaacttaagtgaaacctttgccatcttcatgttttataatataaagcttacccaacaccagttaagccatggttaacctaaatgcctcatgccccagttcagcaaaaggaggaaaatgtgcctgcctcacagtcatcagtctttttaaatcttttttgttgttgttcttaagggtttgaatttgtctgcattccttgtctttaggggaaattcccttttcatattgtgtgcttcccaaagctatagtcatagatttcttccagaaactattgtcataattgtcactggagtgcttaaatatacgtactatactgacaaaatacatggaagtgagttataatgaggcagaaacaaaatcctcggtaacattgatgatactctaccgatcaccgtggttttggaaagtcagtcaacagttgtattatt

SEQ ID NO: 61517 - DNA, 1115 bp, Homo sapiens
aatgctttaactagaatatgtattcccactcacttggtacctaatagtgatacatcgtaatgacacttggaaaacaaactggtcctgaggaattttggcctcttctcatgtcctcacttggaactttccagctttcgtgacgtatttgactcctttaaatggcttatatttctccccatacatgtccaaacggtttacttttaagcctgtatcaaaaagaatgaaaaagaataaattatcatcatcccaaccaatataatgttagcaatgagcgctatatggtaaatctgacattaaccagtgtcccttccaccatttggaagaaatgtctcttctatcatttacaaattattgcactttgatggtatggttttggttaagattcccacacaggcagggaatgtctgtgaagtataattctactttctgtgaatatgaataactctctttttggtgcttaaatgagggcggaggtgaggggaagctgtttgaaataaggtgctctgaaaaatcatttggtcggtgcctgtgagactgccccaccaagcacagtataaaaggcaaatgggctactgctctttctagagaaggaaacttttgttactcttctaaatgcctaataaatgagcttgcaaaactcaattacccttaactacaagtcaaccttatccttacctgaaatagcaagctgctggatcttaaactgtatgttgaggctcggattctcttctggtttgggggctccagactgtaaatttaccagtcctttaagacttgggagcttttgtggagtaatttttcccacatcccatgttagtaccttaaaaagacaaaaaatgaaaaacaaatagaaccatttattaaagacaaaccctcaaaaacaaagttcaaagatatcataaacttctgtacaaactgaagtgcagtctcttgaaaacaagagatctggcatctacagtgagtttacctctgattaattctgtgactttgaatggggagtgagagcagagaatctacatttgttgagcattttcttttgtattagcaccgtgcttagcattattcatatgttgtctcattgagggctgtgaagtagcttttgtcttctatttaca

SEQ ID NO: 61518 - DNA, 1040 bp, Homo sapiens
gagtgaggctgcagtgagctatgatcatacaactgcactccaaccttggcaacagagcaagactctgtctctaaaaacaataaataaaaataaaaagatacagtgataggtctagtgaagactcatattccattgatgttatcttccttttttttttctttcttcaggatctacagtctttgcagaaattcagggggtcattgatgcttgcattaaactatctggaatgcctgatctctccctttctttcatggtaagttttattctcctgttttatagccccttgaatgcctaatacatgtgaagtactaaatgaaatgataaatattgagataagtttgcatcttagattgcaaaggattatctcagaaatattcctagcagagtttcctaagacagtcgcttacatgatgagcgtggtctttgtggaaagactaagggaggtctttgcctgagtgtgctagaaggggcttaaaattggctggctggcttctgcaaatatccagtatcatttttactgaataattatttgctttgctgatatgaaaggacactggtcttttgtatcattttagagtcagcatgatatactgctaggaacaattaagagaactgacttctggtgttgtcaccagtttgctctgaccttaagtcctctgaacctcagttttttaatctgttaaagggaaataatactacttgccttttctcctttatagttattgaaattcaaataaaataatgtacataaaatatttacaaactttaaagcattatgaaactataaggttgtgtagatgtggtcataaactcttccatgactgctttatcttcagggaacatatttgtcaaggtatctgagtacagttcccatattcattatagtctatgaacgactgtcttctgtttttctggcagaaccctaggcttctggatgatgtcagctttcacccctgcatccggttcaagcgttgggaatctgaaagagttttgtcatttattcctccagatggaaatttccgactcatatcataccgtgt

SEQ ID NO: 61519 - DNA, 1001 bp, Homo sapiens
attccatttactccactgaggcgtgcttggcagcatctcatgtaaaataaagttgaatactgaagggcctagttataactctgtattctcactggagacattttattggcagaaggttttgaaacaaccaacctcttttttcatcagtggcagagattctgttgttgagccactggaattagattagattactgttaacacacaggaggcaaaagataagtaaataaatttaacctggtttggcaggtagacagagggccacatggcctatatttcttttctagaaatttgatcatgttggtatggatatgtctgacaattctagtgaccatccacaacttcattaagaaaaatccaaacattgaagaagcagctttttttttcctagtaataaattttctcatgactgttttatacatcagctttgccttctccttttttggtttctaggcagtagtaatgttggggacacactccccaccgggcagctgtccaacataccatggcgtcgggcaggggtaaagtacacaaacaatgaagcctattttgatgttgttgaagaaatagacgcaattatagataaatcaggtaattgtgtgcatgtcatcttatttggggaaaaacaattcatctgacacagatgaatagaaaactgaagtcctggccgggcgcggtggctcacgcctgtaatcccagccctttgggaggccaaggcaggcggaacatgaggtcagagttcgagaccagcctggccaacatggtgaaactctgtctctactaaagatacaaaaaattagccgggcatggtggcgcgcacctgtaatcccagctactcgggaggctgaggcaggaaaattgcttgaacccaggaggcagaggttgcaatgagacaagatcatgccattgcactccagcctggctctgtctcaacaaaaaaaaaaaaaagaagaagaaaggaaaagaaaattgaagtcctttggcagtatggtttcggtggaaag

SEQ ID NO: 61520 - DNA, 1068 bp, Homo sapiens
tcccattcgaaagtactacatacttaacaacaacaaaaaggtagagttcagagaagtggtttaaagaaaaacacctgtcttcttactaacaaaatatatctaccattaacatttttgttaatattatggtattaacattttaatataatattaacattttggtatatttctttgaatatttccaccaccagaaggttgcatttttttctattttgataattttggtttttaattgcactttaaaatatagtcgcaatcatactgtatctacaattttgcagtctacttatgattggtgttcctacctgcaacctataatcatgttatcttcctgctcaaaaacgttcaatgtttgctcactggctttatgataaaagctaaatatttatcctagctttgaaggactttctctactttttaatttgatctctaacttctcaagtgaaaaacagttctgcttctgctaaagggattaataaaactttaggtttttctctttcatgtgtgtttttttctcatacagttccaccatggagaatgctcttattccttcctcacttcctgaattctactgattttccaaggtggccacccaccacagttcaggagggattacttcattaatggaaccattctcttgaactttgtaatacactatctaatgaatctgttatgttttgcattatatattttagtaacttttctctgactataaaatacatgtttattttggaaaattagaaagtataaagcaaaaataaatataatctgtatttagctgggtataatcattgtaaatacttttttgtcggagtgaatatttatatataagaataatttttttcagttttgtgctgacttttcaatttaacgttacatcatgtgtatttattttccaatgctattactttatctgtgaagtatggaattgctttttaaagtcttatacagttatttacttaattttttttccaatgtcccattcagagtataagttttaggagtacagacacaccatcttatctttctttgaatttctcctaacattcgtccttacacaaaggatga

SEQ ID NO: 61521 - DNA, 2353 bp, Homo sapiens
ctgaggaagtttctttttgttcttaaatggctttcttttttttttttttttttcgtaaaaggatgttggattttgtcaaatgcaatttctgcaccttttgaaatgattgttttagttcttattgtatatcatgttgattgatttttgtatgttgaaccagccttgcattcttagaataaatcccacttggtcaaggtgtataatctttttgtgtatgttaaatgatatttaatgtataataaatttaaacctttctttgccccaacagaaaatgatccacagtctatttctcataaactgttccggtgacatatttctagagaagcactggaagagcgttgtgagccagtctgtctgtgattatttctttgaagctcaagagaaagctgctgatgttgaaaatgtaccacctgtcatttcaacacctcaccactacctcatcagtatctaccgggataagctcttctttgtatctgtcatacagaccgaagtgccacctctctttgtaattgagttcctacatcgagttgctgacacttttcaggttggttatctatcatacctttctaagttaaatgacccaagttagctgaaggtgagacatgattatattatttaattacccaggttttgatgtttactgtctgtctctctctgtttaagcgtaaattcataagcccttttctgtgtggtatacagttacacacatggctgctctattcactattttttatatgtattacagattacagttggctctccatatacatgggttctgcatccataaagtcacccaaccttacatggcaaatatttgaacaaaaaaatcgaactgaacatgtacaaacttcttctcattattacttgaacaatacagtataacaaatagttacatagcatttacactgtgttagatattacaagtaatctagaggtgatttaaagtatataggaggatgtgtataagttatgtgcaaatactatgccattttatgtcagcgacttgagaattgtgaactttggtatctacaggggatcctggaactaattcccacaaataccaagggatgactgtatatcatcaggaaacaataatgccctccgcatacagttctctcaatggtctcaagattttcattggttatgaactcttctatatttacattttattattttgtcttgcggaatataccaaataatttaagcttatctatatgtattttgggataatcagggtgaatgaagtttatagctcaaattccaatttaatgtttcaatactttctggtataatatgtaataggaattaaattcaacctagaaatatcaagaaaatattgaggaataatattaggactatagaggggttttttttgtttgcttgttttgttttgttttgttttgttttgtttgagacggagtctcactctgttccctaggctggagtgcagtagcatgatcttggctcaccgcaacctccgcctcccgggttcaagcaatcctcccgcctcagcctcccaagtagctgggaccacaggtgtgcaccatcacactcagctaatttttgtatttttagtagagacagggtttcaccatgttggccaggctggtcttgaattcctgacctcaagtgatgcatccgcctcagcctcccaaattgctgggattacaggcatgggccaccatgcccggactatagagggttttttcccccgctctgttttatatatgttcagcagcttaagcaatgaattatgctactctaagtttattcttcagaacaaaaagtatttagcaggcctttctttttgccttccattgtgtgatattttgtgtgtattttgtcaggactactttggtgagtgttcagaggctgcaattaaggataatgtggtcatagtatatgaactcttagaagaaatgttagacaatggatttccactggctaccgaatctaacattttgaaagaattgattaaaccaccaacaattctacgctctgttgtcaactctattacaggtaagatgaaaacatactgtgctagtaactgagcaattaaaactttgtaaacaactcattattgctcatgatctgacatattattaaggtagtacaatttggccataattaaagttactggtaaagttaaaatggatgtactatatatttattttcatggaaagaggctagaccttaagtgataaagaacttttggttattactctttttttttttctaaaacaccacaacaatattattaccattatttaacactaaatactaagactgaataaattgttccagttattcctaaagaagccagtatatgagcccacttagaagagaatttagt

SEQ ID NO: 61522 - DNA, 1144 bp, Homo sapiens
tatagaaggaatacatttttgtttttagacactgtcttccaagaatattttgactattgtaaatgcattgcttgtgaattacccaggatgattataaaatgtttagtaaaaaggatttatgatgtatttaagctgcagtcaaagctctggtgggtctgcctctgaacacagtttcttctagtggcttttaaataagctgggagaattctgttttatgactcaaaagccactaggaacaaaaagatggttgtggtaataatgagtgtgtagttttctcagaaagtttatgaaaataataattaaaaaaataactgcagctaccaaaaggacgataaataaagaaacaggctaatttacactgcaacatggtattatttaattgttatatgcattagaccttggtcataatatggatagaagaagtaagctctcttttcctattatagaaggttaagatgggttttaaagctaagcacagtcgagaacttacaagtgttatgctttcatctcagcactaaggataacaacaataaatctaggaggctggtttaactttctgtattctgagacctgaactactgccaataaaaacaacttcggtggaaactttcctggaaagaatttttcaccagcttaagaggatgagtagagatctggccctaaaataaagtaactacaaaatcacttactttcaaaacaagcaactctttcagagtgtattgtggcaaaggagcactataaatccttgtgaactatattttcgataggatgaatgattttagataacctgtgtcggtgcttttaaatataacttccactctaaataatttattaaacttcctcagcataacaactagaatgtcttttgcctcctaactaaacaagaaatgtcttttacctcctcctcttaaatcataagctaggctgggtgcagtggctcatgcctgtaatctcagcactttgggaggctgaggcgggcggatcacgaggtcaggagttcgagaccagcctggccaacatggtgaaaccccatctctactaaaaatacaaaaaattagctgggcatggtggcgcatgcctgtaatcctagctactcgggaggctgaggcaggagaatcgcttgaacccagcaggcggaggttgt

SEQ ID NO: 61523 - DNA, 1626 bp, Homo sapiens
ccccaagtccggcagcgctcacctcagcgcttgcggcgcctccaccttcagctttttgggcttcggctcctcctcagcagctgccatcttcgcgctcccaccccactttggctctacagcccacctctgccatccactctctggtcccgccccctcttcgcatcaccgctttctcttctccaaatcccgcccctccagactccgcccattctgtgccgctgtcatccacaatcattggctctatccgtcggcaccaacagcgaatgccccgcccattcctgaccccgcctcccctaccatgagggaccccagactgcgttaggcagcagatgaccgcctgaatctagatggagagaaacccaccatttttctaggccctggattatgtagaagatttagatactaagcctcaagagacgtctttcctctcatttacggtcttcctgcatatttaaaatttctaatacggtagacagagtcggtgtctttgaagctgttaatcaggcaatttcctgggcactccagctgcgggtcctcgcggccttctcggcttctccagcttcggtaggagaggatccggcgccgaatcactgactggcacaggtgttggggtgagtgtgaggggcgggaaatctgtggactggggacagctccaaaacccgggagtaggctgaatagctggggcccccgactccgatctgggctctaggagcgtctttggtgctgttggcccgggcctcgcttcccccccactcccggccttccgggctttctcgccagcaaggccagaagggagcggtccacctgcagcccagtgttctcaggcgcctgagccccggaggtcaagcttactgggttccccctctatagtgagctggagtacagacggcaggaatctcagtcccaggtttctgctttggaggacaaaaccccaaacggacctgagcagacgtcctgttagcgggtggtgcctggaagagcctggggtgaggaatgcagtgagaagggtgttgcagttcttcaggagagaggtaacggggttctaagctgagcaggtggcagtgagtgtggaagagtgacgggcgatgtggctgtttgtatttggtagatttgtttgaacctgaaacttacagccttatgtgtgattaagaagatggtgccagtgacaggaggaggtattttatggagtttgagttttatcgaatttgaaacagtggtttacatggagattgtagaaagactttaaaaaaaattatgagaattaagcccgaaagactttcaaggtgagacccaaaacagatgaagtttcatataaaagggtaagaagtatttttgtttaggagaaagttatcaatgacataaaatgctgcaatggtcagaggaggaagctgaaatcagaataggtcgttggattttataattagaaagtcattgagctgtttgagagagatgctttaatagtaactgaggaaagactgcaagtgtagaccaatccttcatcatttggggcatgaagcaagattattgagagtggcaaggtgggggaaagtttggggtttgttttaaagaatacaagatatctatttgggggcaggaagcaagcaactatttgaagattcaagaaaa

SEQ ID NO: 61524 - DNA, 1032 bp, Homo sapiens
tcccaagtagctgggattacaggcgtacaccactatgcctggctaatttttgtatttttagtagagacgggattttgccatgttggctaggctggtcttgaacttctgacctcaagcgatccacctgcctcagcctcccaaagtgttgggattacaggtgtgagccaccgtgccctgccttcccagaccttaatttttactgtctgctgagtatgtgcttctgagtgactttctgacatttcgaagtcatatataccaaactaaattatctgttatcctgaatctgtgcatttttccatatttcctgcatctgttaatggcaccagtaacctcctttactccaaagtttgagacctagatatttgattcattttacatccacattataatgtctttccttttccattcctgctgccacaccttacgtttagactttatcttttgcttagattttgttttgacttcctaagcagtctctttaccttcagcctcaagttctgcctacttttctttaggcacagctctacttattcatcacggcaaatatttgtaaactctgaagttgatgttaggaaacgttgaatcctgaaagcccatatcattactccatctgacattagcaattaaggattattaaggatcatgacttttaatagtactaaaaaggaaacaaactacagttctctaatcagcaaatgctgagcttttctcaaatattgcttcctaactgtttcacttccatggaccccttttattattttcctctatctcctacctcactatggaccctgtgttctaaaattaaacctaggagctgggcatggtggctcacacctacattccagcactttgggaggccaaggtgggaggtttgcttgaacccagaagttcgagaccagtctgggcaacaaaatgagaccctcgaatctttaaaaaaaacgaaacaaaaactagctggacatggtggcataagcctgtggtcccagctacacaggaggctgaggcaggaggattccttggcttcccaaagtg

SEQ ID NO: 61525 - DNA, 1114 bp, Homo sapiens
atgtatctattatagaaagactgaaaatttagacactccaaatttaatagtgggcatctttaggtggaagaattatgaggtttaaaaaaaaacttgtattttccaatgtttctacactgaacatattaggaatcttgcttttaagttggagagacttgaagtacactgaatatataagtggccaagtgctgtgtggctaaatattatctttacagaatggacctctgggataccaaatacctctgaaacttggtaacataattattatgactttattgtaggctataatcttttaagctatatttctgaaatcccaaagctctggaagctggaagttttttaaaaagtttgagatgaattaatttggcagcaaaatttgaactgatgtaaaggtgtcagtagtatttatttgtctgacacaaatgtatatgctttgctatggaaatattaggctgttaatgacatgccacatgaattcctcctgggtgttctacaaaatatatagtgcagtgttaccttcctaaaatccataaaattctgaattccaaaacataccctgccccaaggatttaagaaagggtttgtggacttttattacttatttatagtttacttttaaaagttggctactgtgcaggaacaataatttctcatcagagttagttcctagatttttttctctagtcactgttctgcacttctatgatactaagtagatgctcatttcaaagatactttttggctagctctactgtaataccagtacagttgatgtcactgagttattaggcttttcttcctctccagtagtaactgaaaagacagacttctcttcaacttttggacttgaagatttggaaggctgttttacaaaatggtctcccaaactgaagtttcacatactgcttgaagaagatacattctgatgatttatcaaagcagatttagagtttttgctctcatttatgtgtattatttctgatgttgtttgtacttttggcttcgtaccatttctttaaaaatttggttcatacacttcagatctagaagcaatgtgattagcctttgatataagaacatctgagtttctatttgcatttttactttcattgca

SEQ ID NO: 61526 - DNA, 1051 bp, Homo sapiens
tagttggagttaattttccttttattggttcacaatttcttaactcttcaactgcattaaactgtaagattagagccaggagttagggtgccatccacttttcccctctatggtcttagattcttttttttttatagcccgcatgcttctttggaaagtgaggtaattgtgtcaaataggatagccttgagtggggcccagaggttgtaaaattttatgtctgtacctgattcacctggtaacttgctaaaaataccgatgtccaggcctacctttctagattcggatacataaagtgacactttccatattaaataagctgctctaagtgtttctgaagttcaggaacgtttgggaccatcagatccagcaattgactctcaaaggctgcggactggaattagtacgtcgtgctgccgttgccaggcattttatattttcctaggctgaggcttcccaggctgttgctttttttccccccacctttgcagatggattttgcaggctgttaaatcccactcccgaagacctgccctgacagcgcctctttcctaagtgctgttacagggagctgagcttgccgaggtagacagtggccacgtgactgctaaaccggttgccagaggcgcggccatttttggggcgggcacccaatctctcgccctgtaaactgcggggtgacgggacgctgttactaggactcaagatggccaccgcgcccgctagtcatctcgctagcccgcgcgccagtgagctggcacgagacacgcggtggcccacggcgtctggggacgatctccagcccttcgcacggggcggagcgcccgccttccctccaatcagcacgccgggccggctagccaggggccgcccgcgcgcggggtgtgtgaggacgcgctcccagtcgctgagtgcctgagccgggaagcagttgctgtggtacctgctgctgcccgagcggacgtagagcatcggacgcgggcgccgtggcgctgggcaggagggcgaagccatgacgtcagtcaggtaacgagcgggcggctgccttgac

SEQ ID NO: 61527 - DNA, 1041 bp, Homo sapiens
ggttttgggcatcgcttacagcttgggtttgcgccagggaagactaggaaatggagttggggaatatttgttgtagagctaatgagccctattctttggtctgcccagataggtcaggtttggtctaaaactattctgggactctggacatcactgtgccctacatgatgattctggaacccacttttgtgggttaagcctacattggaaaatttatgtgggcagtgggtggggtcgtggggtattttccttctaacactcgaaactttttgaggtatgtccaatagaatctgccaagccactcagaacattcatatggagactaaaatctggctaagattgaaactgtctttgttgagttggtttctttagagccttaaagttttcaaactcatttttacctgtgtttttaaaatacgaattgtaaattcacattactgcacaattttttttatgctgtgggatgtttttagagaggtaagtgagcttttaaactaaaattgtttcatttatggaatattttgaagaagtaaaacagaaatctttttatttatttatttatttatttatttatttatttttgagacacagttatactcttattgcccaggctggagtgcaatggcacaatatctgctcactgcaacctccgcctcccgggttcaagcaattatcctctctcagcctcctgagtagctggaattacaggcacatgccaccatgcccggctaatttttgtatttttagtagagatggggtttcatcgtattggtcaggctggcctcgaacttctgacctcaggtgattctcctgccttggcctcccaaagtgctcacaggcatgagctaccgtgccggccaggaatcttttatgtgcaacgttgtcagctgttaatgctcctatttatgaataggtcacctttgtttgaaaaaagcgtacaaggttttctaactccaaatctttccagccacaatattgctacgttaagcagaactgtcaaagataaaacttgaaccaaagtgattttctagactgtttgaa

SEQ ID NO: 61528 - DNA, 1050 bp, Homo sapiens
ccactgcactccagccttggtgacagagtgagactctatctcaacaaataaacaaacaaacaaaaaacacacaaaccctccaaagcttttctttccctcctgtgtcatgctacttagtacatagcctggttcacagtatatgattactatatatttaatgaatgatttacatattatttgtgaagtccaaaatacttaacgttgtagttgttccatcagttttgaactgctgaataagtgtgacattacagatgattcactacagaagaatattgaagatcttcaaagcattgttaaggtgatctcctttcagttcctggagtggtgttcctggaaatgactaatagaacagcaaaaaaccgtctacttgggcattcttggtgttttatcaattaagtcagagacctataacagtgttggagtgcttgttttgaagaggtcagctaacttacgttgacactgtgtgtgtatgaagagtgtaattttcgtttctgttatacaggtattctctgaaaccaaatgaccaaatcttggctgaagacaaacacaaggaactgtaagtgcattaaaccattggttgtaaatagtttactctgtctatgaacttgatatatgtatatgtaaattatctgattttcaaaattatataatgacaaagtataattaacactatgaccttaatcctaacaattatgataacctacactatataatttacactacataaagtttacacaggacataatttctcctgtattcacattaaaagatgtagtgttgtattccatcatctagactaaagtcttactgggaaatatgtcatgctattttctctttccagataaaatattaaattgttcctattttctttctgactgctctaccagaaaaaagtaaaaaataaaaataaattgtcactcttaatttttgggtcttactccggtggatcacccaccttcatggtaatgatagacaaatataattttgtttctgtcactggtttatgcaaaagtaaatgtcaattgtttggtacaaggtaaaacactttat

SEQ ID NO: 61529 - DNA, 1053 bp, Homo sapiens
ggtgggtggatcacctgaggtcaggagttcaagaccagcctggccaagatggtgaaaccctgtctctactaaaaatacaaaaattagccaggcatggttgtgggtgcctgtaatcccagctactcaggaggctgaggcaggagaattgcttgaatctgggaggaaaagttgcagtgagccaagatcacgctactgcactccagcctgggtgacagggcgagactctgtctcaaaaaaaagaaaaaaaaattagcctgatgaggtggtgtgtgcctgcagtcccagctgctcaggaagctgaggcaggtagatctcttgggcctaggagatcaaggctgcagtgaaccatgatcattccactgagctctggactggacagcagagtgagaccttgcctttaaaaaaataaaaaaagaataccaataagagagtacaatgatagttctaattatcttgatattaatgaatattaagtatgttttcattaaaacatttttagttcctgaaattttgtgattcagatttcatatacacttagtcactgatgcttcacgagtatacttgtttctctgtctgaggaagattggcatgggaaaacagggaaatattggtcagcagtgacacttgtttttctaagcaaagtggtttttctcaacttcctgtttttcattattctacatactgaagaccttgggggatgattttaagtagagaaagctgagcaattcaagttgtgatgtgatttatctaaaactataggatttatagtttgttctatacatgatccagtaatcaactggtttcattagctttctagtttttttcagttttagttttgtaaatggaataatttaaaataaattaggaaaacatcactattttactaagtattttttcacctactttccattgtgctaggcattaaagaaaagatagtgtgcagctttttatatgtcaattatacttcaataaagcggtttaagaaaaagtaaaagatactgattttatttataaatggaatcttactctccaatagtggcttttcaaaatctt

SEQ ID NO: 61530 - DNA, 1062 bp, Homo sapiens
aagaacaaggaagaagggcattgttttaattattttgtgatctaatttaatccccacagcaactctgtgaagcagatattgtaatcattcccattttacagatgaggaagagacttcgtaacttggtttatataagaaaaggatagaactgtttagatctttttgattgctttccattttgtataagttcagtgacttaggaaccttttttaaaaaacttctttggaggagtgatattgttcattatgaacatacctacttgaaaagtatttaaaggtatttttcatggaaattatattttataagttttagtatggttcactagaaatacgtcacaatttgtaggtaatactgtgttttattttgagttggctaattgttaaggtaaaactttagaggataaagtgagctcatattgatgaatggtaatctgatatttccaacagactaggtctttttttgaagttcatgtattataactttattctttgtgatactagctccctctgtagaacttcaataagattgcaactggactttttcaataatttagaaaagtgatctaaacattatctataacatttccctgtaaaattttactttgtattctaatcagttgcaagtgggtttttaaaagtataaatgtaacatttataaaaatgtttcactttgtacacacaaagttttaataacatatacaaaataaaactttcttcaaacattcctataactttaatgcttttttatttaggaaggctagagagaggtgtgatttctaggtctgtaggtctgtgttgagtaaagcctgatggaagccctaggggaaaaataaattttgacgtttagctggatacttgaaattatcccttttttttttttttttctgaaactttccggtttgacttgggtgggaaaatgttcataagggattttttttttttatcttgtagagaaggggaaagcaaacttctacaacaggtagaaagagcaaagagaaaatcttagcaagatccagaaatttagtggagaattgcaggaaaacattcttgacatttacggttt

SEQ ID NO: 61531 - DNA, 1032 bp, Homo sapiens
tctcaccatgatcactgacatcaattctccttgaaggaggatgagttttgtttgttcattttattgcaaaccatttgaagagatgatagattggtagcagaaatttggcagagaaaaggatgataaacattagaaaggaggataaagcccactggaagacataaatgaattgatgatattttggtgtatattttctcattgctttatgattataaatattttctgctgctttttgccactatctatttttcatgtcttccaataaagtattccatggccaaaatttgtgtgaaattctcttcggttgttgctggttttacaagttatagggttctttggaatataattactgaaatgatgactacactaaaacatatttcttcttaatttaacaaagtatttagtgggaggaaggctctagcttttcttattttctttaatgttttttaggcatgctagaggaaaatagtgttcttactattagttttgaacattttttatgactatagagttgaaagcccaaaacactagaagtaaatggatcattgcaaaatatttgttttgttttcatttgtgagtggggcattcgtgtgtcactgtgtctatgcttctatttttctctgtatatagtttatatccttaagactttcagaaagaaattgagatgttatgttgttttattgtatatgcatgtacatgcatacacacacacacacacacacacacacacacagttttatttgttcatcatatatttaaggcctgacataggtcttacaaagttcaattactatagggcttaagtaggaaatgaatggtaaaatgagccaatttgaagcaataaatactgattgatagattatcaccttcttccaaataagatatgtggcatcgtagaatcttgctcttagatacacagatatgtgtgatgtttaaatagttgagaaattcaaccagaaatgaatgaaagggttttcccgttatcctgtcatacgcaaattaccagatcattcagttcttcaatttatcaat

SEQ ID NO: 61532 - DNA, 1150 bp, Homo sapiens
actatagaaaaaaatgcagtgtaacttgtactgtaaataaacgattagcaatgaacattacagtgagagctgatagtttatgaattattcactgcaaacttattgtctctgtgtcattaacatgtaagataatgagcctaattaccatggctttaaactcaggggagttagcaatttatgtgtaaaagtttctgggctgtagttaccacccacaagggtattgagagaactgcagacactacttctgtgttttgtttcagaaatgttctttttcctcacttgcttccttcttaataaattagtttttatttatttttatagtgagaattatgagcttttcctcttgcttgaatacctttttaaaggagttatgagaaatatttaagtatttttttagtgtagtttagtgttgtaagtagacaaaatattattagatgtattcttttatttgcttacataagttggcatcacttactatagtaaatgaccactaatagtgtaatttcttggaaaatctagcctaaaaggtcaatattaataattggttttctcctctaaaaggatttgtactaagatgatttactttcaaagtactcagtattagcctatagccttttttctaatctttaatattgtatctttgatcttaatttaaagttttgatgaacttgttgcttctattttctctcttatagtataaattatctgtaataagccaccttaattaaagttggtaaatctacaactgcttcaattatacactaatcaattatacactaatttaattctacttagcaggatacggtacatcattaatcagttttagacttaatacaacagatttagaagtaatcaaaattgaagcattttatttagctgggaaaaaaatgaagggtcataatctagtaattcacatatcaattctgataaaaatcaaagattctttgctaaaaatgaaggaatgtagctgttatgtttactgttgagtgccatgggctgaagctgtgattatataatatctttagatgttaatagcataatagttttgtgctctacctttttctttaaattgttattcatgttactaaatgggttgttttctgtaacatgattgtttaacgtatacataatataagaattccttgagtga

SEQ ID NO: 61533 - DNA, 1054 bp, Homo sapiens
ttttttcttattattattatactttaagttttagggtacatgtgcacaatgtgcgggttagttacacatgtatacatgtgccatgctggtgtgctgcacccattaactcatcatttagcattagtatatctcctaatgactatccctcccccctccccccaccccacaacagtccccagagtgtgatgttccccttcctgtgtccatgtgttctcattgttcaattcccatctatgagtgagaacatgcggtgtttggttttttgtccttgtgatagtttactgagaatgatgatttccaatttcatccatgtccctataaaggacatgaactcatcattttttatggctgcatagtatatattcaggtatattttaaggcagtttttaagtatatcttttttctttaatagtacttacaaaaatgtaattatttgatatgacaaagctgcttcatattttcatattagcttgaactttccattgatatgtcaagcaaataaatacttagtttttttctgagtagaaaccaactgtactgcaaaccccattgatagtaaattaattgcagggatttaacatgtagggaaaccttaattattctgaatatacttatgttatgatgtgtagatgatttgtttactgtctttaatgtgactgagtcaaaatatgtgtagttatttgcataaaagggaagtgttgctaatatattttgcattacttaatgttatatataaaattaattttccttgtaagggatgtgagaaatttttttactcctcatttctgtttattctcatctatttctttgaaaatgtagatttaatttatttaaatactgtgtgatgaaaacattacagatatgttcttgctctctttttttttttgagacagggtctcactctgtcatctaggctgagtgcagtggcataatcatggctccctgcatgtcaacctcctgggctcaggcagtcctcccacctcagcttcctgagtgtttgggactacaggcgcgcactaccatgccgggttaacttttgactttttgtagagat

SEQ ID NO: 61534 - DNA, 1046 bp, Homo sapiens
agtgtaaggtcttataattttcatacttcttgaactgattccaagggtaacattaagtgaaattttgtttagtttctatagaaaactctgttagttgtctggaatgaggagaaatacatgctgatttctgtatgtttgtagtaacaagtgattctgagactgggattctgattttgacttaaccagtttgccacgtgacctccatttggcaatctattaattattacttttactttctgtttagtttaatggccaattatggacagtctgttttaaattcttaaattcttatagttgtacacttatggaaaacatttcttaaatgtggaaatttagtatttttgttataagatatttcaattcatttattcaacatacttaaacaataaaaacattttactatttgtgttttaatactcttctgctcagaaaagtttactttgttgcaactcacagaaggtaacttacttttttctactgtgatttccttataggtttgatgaacttgtgaaaaaattcaaagtcgaatatcatgctggtggctctacccagaattcaattaaagtggctcaggttggttaattattttaaaagttaaaaggattcaaaatgattctagacccatgtctattttgcataattgtttccttttatattgtgttgctgtagaatagttttgttcatttgaattgggattttagtagtcattgcacatctaatcaaaagttattttaattggtatttctttggttattggtaagcttgaacttttaatgtttattgttcatttgtgtttcttcttaaattgtttcctttcactatcattttataatttttcatgttacagatttgtagaaacttcatattttatagatagtattcctttttattttataagttgaaagtatttattttttgttatgtgtacattaactcttacagtgtcttttactgtgccttagttcttaatgtaactttcaaagtttttaacgtaattaaactttatggcttcttcatttcctgcatgtcccccttacgaaggacgt

SEQ ID NO: 61535 - DNA, 1020 bp, Homo sapiens
atttttaattaaaatttaagaggactgcctaaatgccagtgtgtttatgttgtatacatctcggggcatgcttttaagtgttttcttgatgtaaaacatcacataataaactagtgttcataattgtattttaaagctttccaaaattctatgtaaaatgagtttctaaaaacactaaacaaaagaagttttaggaattatgtttgaatgaaatagaaacattgaactcaaaattgtaaagctgatatttcaagaactaccaattagtgtaacattactaattgagttacagtatttagaagttaaaactgatgtaaatcaaaggactcatgttgtttatctattttgaatccttttttgaaaaaagttaatctttaaagtttttctgtattaaaaaaatctgattatctcttgtgacctattttacctagaaaagctagttagaggttaaaaggttttttatgagacatacttctgtgcatcggaacagtccagatgtaaatttaaaaagaagaaatgacaatgaagtgatcaaagagaattctgtgttcaaatgctttcacctggagcagttgtagaaatgtcagtagcacaactgtatttataattatagcaggatgtggcagatggtgatgcaacaccgtctcgtcaattctttgtgtcattgaagaaagtagtaagtattaattctgccaattttatgattaatgaataattttaagtaacacaggccctacgaataaggttgactgttcaaattgtgatacctcattatagtttttaaagtttaaatatgaattaatactcctctttgcctttctgttctctttccttttcaaattaggttgttaagttttcatagctaaaataagatgaaggaagcagtggcttgctgtcctcaattatatttttgatgtgtttgtgaaattattataacttagatcagattctttaaagaaaaatcagtatttcattttttcctttcctcccttttctccctctctcctttccttgtctctc

SEQ ID NO: 61536 - DNA, 1811 bp, Homo sapiens
tttgctacgagtaataaattgtctttgtttctgatccacagttcttgtgtccttatgtcattgtgtgtgtgtgcatatgtgtatgcaggagaacgaatgcggcagattgaagagcagttgaatatcagacctttgtagtgtggtggtggtgattatggtgttgagacagaattttgctgtgttacccagtctggtgtgcagtggcgcaaggctcatttcagccttcgaactttcaaactccatgggctcaggtgaccctcccagctggtactgaaggcacaccccaccatacccagtgattttttttttttttttttttttaagagacagggttttgtcatgttgccgaggctggtctcaaactcttgggctcaagcaatccacccacctcagcctcccaaagtgctggggttacgggcataagccaccatgcctagccctttgtgatttttttaacttaactctggctcacacaatttaactgtaggtctgtttgtaaacctgaagcgctttctatgctttcttccttacatagaccgataaaataagtagaaaatatggtgctaatgactagtatttggtataagtagataaatgttttgtatcacatttgcatgcttataatctgtgatcaatgagcagtctgaatatttttccctccatcctcataagttaaactaaaaaaaagttatagattgaggctgggatatctggtggcgaaattatatttatttgaacagagtttgtgtatatacatacatatttcagaatatattgaaaaataaaagtgtaatgaccttgataaaaatgaaatattcacttaaaaactccatttaataatgcccacaggaaagaaatgcttctagaattttttaactaatcatttttctcagtacttttgattgtcatgcaaactaaagaaatggacttaatgaacaatttagttacaataataaagtttcaaaaattctaaatttacctcataattgcaacagatgcaaaattatttcatatctttatactcgttatgaaattacctcatatccaaaaatatttatgtcaagtgacaggctttttgcagcatttttgatattattacccttgtaatatataattaactttgtaagttaaccttgtggaacttttaagggaaatgcattaacttagcattaatatagacttctaaaatttactgtgatgtagaacatttgatttaatgttgtctgtgtctaatacaaaataactgtggtccacttacttatttcaaattttattctcaaaggtacctactagattatgtgtgaagaagtttgtgaccaaagtaatataactgattctgttttgaaaatctagaataaagtttatgcaaaagcatatggattatttctttatgaatgcagttttatactaaaaactcctccatacccacgtaagtagatatattctcatagtgatgtagaaaactgacaaaacttttcatcctcagagctaggaattcttgtgtttggccacaagggaaagacaaaggtattagaattttaaataagctatcatcaacaaatactacatctctccagctccattcataaatatagcaacattttggaagtgcagatgaatcgaacatagttaagtgagaaaaatttttagtaacatacataatttgtaaatattgaatcgttttttaaatgatactctgagtcataattatttcaaattgtacataatgctagaagaaactaggataatagcagaataagttacagtgactaaaatcataggtttttttaagagattggggagtctctgtg

SEQ ID NO: 61537 - DNA, 1046 bp, Homo sapiens
cagaagcaagatttgaacccagagagtcttcaatcaagatggattctgctctttttatgacaatgctagacttcttatattgggacccactattattttcctatatcaggccagcatttgtcttaaggtctgtatgattttagctgctgagtccttaacaactttatgtactttatttctctccccaaagcagtataagatattacatggttgttatattaagtttttttaatcgtaagtgatagcacagaattgaaatcccattcataacagctacagtttctcacaaagcattcttgtcacatcactatctgtggcagaatattaaactatgtgtaccatttttttgccccattaaattatttatgttcctgttttacagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtcagtgtaattccaagggaaccactatactaattggctattttaacactggtaaaatatgaattccaatgtgaatttggaattttgactttataattccttttaatgtttgataaatgcttattccttatatcagttttcctgtattgtttttaaatttacttttgttaaacatgcagttgaattcatgaggcataatggaataaaagtttgaggttatttagtccagtctctactttttataattagaatcagaaaaggctgatagcttgctcaatgccttgtagcttgctcaacaccttgtagctaatttgttgcaaaacttgaattagaaacaatgttcttttcaccatatcctgaggttggaatacgagagagagagacagagagacagagagagagtgtgtgtgtgtattttatgtatataaaatacaacattacattcaggctcgtaagacttagtcatctaaatggtcatctaaaccatttct

SEQ ID NO: 61538 - DNA, 1034 bp, Homo sapiens
gctgaagtgggtggatcacctaagatcaagagtttgagaccagcctggccaaaatttttggtagagaccagaccatctctactaaaaatacaaaaattagccaatcatggtggtgcattccttagtcccagctgctggggaggctgaggtaggagaatcgctcaaacccaggaggcagaggttgcggtgagccaagatcgcgccactacactccagcctggctgacagagtgagactctgtctgaaaacaaacaaacaaacaaacaaaaacttacttaaagtgatagctttaaaccttattcgaccatggaacaagcctttgtaacataatctatactgttacaataagtacactttggcagagtaagtgaactaatgatttttttttataatttaagctagtctgtgaatgacagttgattaaataatgtcacagctctttatatatagcattaaatagagttcaaagtatttttggaatttattaatttataatattcttctgtgattattaaagaggtgggatagctaaactttttctcaccttttatcattgttccaagtgcagttttgaactcgtatgtgttagaactcccattatattggtcaaatcgatgatcaccatatgactttattcctgcatttttgcctcaaatttttaactatcctattctggactgcttcattaacttcattagggattaactatgaatgtttaagcctttattttacaatgtccttgcaggtgtccttaactgtttcatttataaacacagagaataaaatgaaaaaaaaatctgtagagttgtttgttctatttggagcttttcatgttggtgtaaaattcctgacacttaacacatatgaatctttttcattcatgtttaataattttatttgagagtcacttcaagtaaagcccaaactgtgttaacatttgagttaagcaaagacatctttgcttaacaataaagcaaatatcacaataaagcaagtcacatgaatattttggtttctgaattcatataaaagtt

SEQ ID NO: 61539 - DNA, 1132 bp, Homo sapiens
tttgtatattgttacctgcaagttattgataatggaaggaacaccttttcaatccttagtcccctttcccccaacacagcttttagattgtcgataaacttcccagctcagtaattaactgagctcagtcattgcaccctgtatcatgtgatttttttttccagtggaatacattattagagcacttacacagccagtctagctgcagcagcccaggcggcaacagcagtgccatttttcacaaagaaaatgttgaacaggagccaaatgtttggtggcagtctgttgctaggaaatcaaggtcctgaggcgattaatgacaaagcaagcaataacaagaaggcagaattacagatttaaaagagaaaaaagtggttggtgttataattacccaaagaaatccgcactcattaaattggctgtttttatgattgactttaattggaggttagctcagatatttagctcctttcccacccctttaaacacacacaggcacataatctgtagaactgcagacttgtttttctaagcattgagaggagcttgccctgtaatttgatccccactgacagatgcattttctatgctgccattttgaattaacctattgtagaacaattttcttcagccctgttgaataaaacatccagtctgattacctccgatggatttgatagagtaaaagaatgtacttctcattgaagtagattgtttgcatggactctactgattgtgaactctgccagtaagcacaatcatttgtaataaattttcaaagaaatttgtgaggaaaaggtaatgagagtcacccttttatagtttaatgtttggcacctccatcaaaataatataattcttataagacagtgttatttttccagtaagcttttcacgtggttttagaaaaaatttctgaatcttcatttggactattcatatatttaggaatagagtcttgtatttacactctaaaatgaccattcttcctccccaacaacagtattttagtgcaagactcaatatgcaaagcactctattgcaaaaatatttttggtatgtacaatatttaaagtgattttaagattggcctatttcagtctttgaagtatttcccccccccaaaaatccc

SEQ ID NO: 61540 - DNA, 1008 bp, Homo sapiens
aaaaagaactataggaggcaagtgcttccattagaagagtttttaaatctgcttctgtttcatttaaatctacttctatccccaaattacttacttataattgactagagcagctataaaccttaagatgctatctgaatatttttaaaaagttatcaccccagacactgccaccagggggaggaagctaaaatcttaaagttcttaactgatgatgatactgccagtaggtagattatattgcttagccctacatagttaactacttcctccagataataccgccttttgggacatgattctcacaacctgtaatatgtgatacctgtagacttagcacactattaattgtaaataaaatggaaactttcgtactctggtggttggggtcaggaaggggaaagaggaagtacaaataagcaacctggacatttttattgtttttctcttatctgttagtctacttgaagagctatccttgaaagtgagtgctttagatctatgaaactgggcagctatcatagcacatctattaagatctaataatcacataattaatgtagcaaaatgaatagactgtaaggtagttttctattttttgttactacactgtggttttgtttttaataaatagttttggctttattttaaacaattaaaaattcaaaatatttttatgaccaaagcttgtaggttctatccctggaaaatattttataaatgcagaaaatagttgcttaggattggaatccaactctgtttaccatgaacaacttaaaagttgatctcataatcttgcatgttgtggaataataccacgaaaaagttaattaaagaatttagatgtttgttctcctgtctagaactcaataacttttaagtagtaactctccctacagtttaactgttaaacagtaactcttctgacagttttaggttttattctgtgaagactcatgatttttaatttttgcatcttaatttttcagttatttcaggtattgaaat

SEQ ID NO: 61541 - DNA, 1029 bp, Homo sapiens
tgtattggcaatagaaataaatggtgatagtatttttttcatttagataaatttagcactgctcttagtattattgaaacttagtttaggaatgtatcatttatctataatcatttattgctgaagtgaacccttctttaaattttcctcttccaaatattgatgtagttctttctttcttcatcagttccatgcatacaattcaattttcttcatgacacgggatcatcatctataacgtctgttacttataggactattctatgagtctcttcaagtgtatacatgtatttgcttttattttaagttactcaaattgttatatattttgagtacttatatatacattttaataattttactagccctggagctggtggtgtgtcatcttcaacttcctttttaaattccttctaatttcttagggtgggaaaaatctaattcagtagattgaatttttagaaaagagtagataaactgatgtctaaatatttaggtatttgtctattctggaacctttttgcttcatgatttttcttttttactttgcattcctgagatttcctttcatgaactggaaggctttactttactaagtgactcagcagtagctctatgtatcttttagttggaaatgcctttggctctatgcatgcacacactgcccattaattagcaaaccaacatagaatcatctgttgatgacaaaattaccaaaatggatcatccataagtgtttatactgcaaacagtgtatcagaaatgtcataatctcattcattaagaaatttacatacacaccagattttagagtgctcattcatgatgaatgtctacttccacactgtttgtttggaaacattcaatagccagtcttgaatttaaaaaatttaattgaatgcttaaagaattacaagtgttcctttccttggctctaatgctaaccaaagtgcttttctaaactgctaagaatggactgaagattctgctgagggctgtagatacttatctgcctaattgagccatcat

SEQ ID NO: 61542 - DNA, 1143 bp, Homo sapiens
ttccaaatgtatatttttagcacatacctcttttctgatctccaaacttaatgaccaactggttatttagattattatatgcaaatagacttcttaatatacagtgtcaatcctgtttctcttatgtttaatacatctctgtatatggtaccactgcagggtttgactcatgtgccctagccaaaccctaggagtcatccttgattttttcttttccttcaataagtccctatctttatatctggaacccatttactcttcttttatcagcaattaccattctattacagaccattagtatttttctcctgccctactgctatagtctcctgactgatctccttctactttttaaccctttcaaaccattctccacagaatagctggagtggccttttaaaaatgcaaaccagcataaaacattttgatgtttaaatccctctcatggctgccaatgattgctcatagaataaactccaaactttctgccatggtgtataaagccctacatgtcttacatggctttcctcctacctgtctaatatcatcttattctagttctttctcattgattattcctttaacaaccaagcccttttccttcaaaagtccttcactcttactcctccttcctggaatgctcttcactgttttctaagggctgactcatgtataaccttcaacattcaactcaaatgccatcctcttagagagtcattttctggttagctatctaaagtagctttccctgttcctccatgagctgttgtcataatatccctccaacccccaacccccaccttatataaccatgcttgtctcctttgttgcagttatctccatttgtaattaacttgtttaaatcctcctagaatgccagctaataagaaggtaaggtccttgcctctctctctctttttttttttttgagacagtctcccctgtcacccaggctggagtgcaatgacgccatctcggctcactgcaacctccacctcccgagttcaagcaattctcctgcctcagcctcccaagtagctgggattacaggtgcctgtcaccacatccggctaattttttttttttttatctttagtagagatggggttttaccgtgttagccagagtggtctcgaactcctg

SEQ ID NO: 61543 - DNA, 1034 bp, Homo sapiens
agatgttttattgaatttctaaaataaaagtccacctaatgaatggctaatttactcaacacgtaagacaaagatgtatttctgtgttactaagaacatgcatcctatctccttgacaatggctctaattacctcagcttggactgatcaatatttgatctttttcccaccatgcaaacatgttactttgactttgtctcttcctcttcttttcagataatttgcagccatgtgagaatggttcattttgtttgttctccctggcttgaggccaggggtctcttattagtataatgcagttcattgatgtgaatttgttgatctcctgggtaggttttcacaaatttaaggcaattaaaagcttttatatggcatttcacttgaagttattagtggcctttcagtgattttgcttttaaaaattacttcatcattttatgattatttcctttccttctcttttctctactctccccatgctataaaattctatagtaaaggattgaaacaactatttcattgatttcattaaaagtaataatttataaacttataattcaatagcttaatattttaattaccacaatttttaaaggactaatgaaatttttggttttgtgttttcaaaagctgctttgttttaagcatataaatattcatgatagaagccataatttggagaataataagaattgaatctaaaaattattagtaattgctaaaaaattcaaaaagcacatagtgtaaactttgtgtatatgagacagaactttttctaaattgcagtttcattaacatcttaaagttttctcgtagctaacagatgtccatgatatttttgcttccttaacttttacagtcaatggaccattctccagcaggtcataagtaagaatgttaaataacggccactaaatcttaaggaatgtgacaacattgattagattaaaatcctttgacttcattgacatatcttttttctttccccatttaaaaaattgtttcagttgttttcctactgtttgttggtggca

SEQ ID NO: 61544 - DNA, 1581 bp, Homo sapiens
ggaatcatcagcttcaaaatgaaagaacaagatagtctcttggcattcaaaaatttagcatactttaactcatatttgctgtgatgttaggtagtgaattattcttgttaactatctagcgtccaatgtgacatgtgtttgttgttacctacaacttatcaaataaacagttaccctctggaatgataagaacttgggctttttatgaaaaataccctctaaatgaggacagaaatctatattaaggataggctattgattaaatttagagatacacataaagatgactctcatataaaatttagaataaacatgaaagttttagcatgtccagactttagggatttaggctttatgaaggtctcaagcctgtctcctggaattccaacattgtgatgactcaaattttatcagtaaatatggaaaaataagctaaagttcttgagaaattgctatctaataagtgattattttattttttttctagttttaaaataaaaaatctttactatttattagattcaccagtgttttatactgggggtccccaacctttttggcaccaaggactgtttcgtggaagatcattttccacagggcagggtgggggaggggtggtttcaggattattcaagtgcattgcatttgtcgtgcactttatttctgttattattacagtataatatataatgaaataattatacaactcaccataatgtagaatcagtgggagctctgaacttgttttcctgcaactagacagtcccatctgggggtgatgggagtcagtgacagatcatcaggcactagattctcataaggagcacataagctagatccctcacatgcacaattcacaatagggttcgcactctaatgagaatctaatgccgccagttatctgacaggaggtggaggtcagacagtaatttgagcaatgaggagtggctgtaaatacagatgaagcttcacttgcacatctggcactcacctcctgctgtgtggcccagttcctaacaggccatggatttgtatccgtccatgtctgaggggttggggacccttgttttatacaattctaattgtgtcattgaatttcttttttcttttttctcattgttaggaggctaaaaacaaacttgtcttgtgcagattcgtcgtctttaccaccaaatttttgtcatggtatcttgtcttttttttacgtctttctaaactgccttaatccttgtaagggaataggtaaggtgtaaatataattaataaggtgcaaggaaatgttattagaaagaaattagattgttatttgaaaacatacagagcctaaatgtaagagaaatgtcctaagcaaaacttattaacaggaaatttactgaattggaaagtactcttgattttatgactaatatgaattgaggtattcttatagacactcagagattcctgtacacatgttacttgtgtttttccaaaactatatacgtatagtctttttacaaataaacagtggccaccaagaaaaattacagcagtacacataagacataccgtatacatgatactcaactttgtctatatcct

SEQ ID NO: 61545 - DNA, 1056 bp, Homo sapiens
aaggacatatgttatgaagtaatgtagattacagctggtttactataagttggagtactatcgtggagcactttgaatgctggggtgtgaggcatttggattcaatttactaggaaaagaagagtgattagggtgattaatctgtcagcaagatataggatgattaaatcaaggagagaaaggaggcagggatagctttttaaaagggaatgatggattttgctttatgtatatgtatttcaaaggaaacaccaaactgttgatctttaaagagcatacttttgttcagcactgtaactaacagttgtaacataaaactcacttttctgatgggaggcagaagactttctaactttcttgttatttctagaggaataatatcaatacaatgtaaatatgtatggaatgcatactataggccaagaactatattaagcatttatttaattctcacaacccttgagagacattattattcccattttacaggtgagaacagtaaagcctagtaaagttaatgttgtccagagtcacatagttaataagtagacagattagcaaaaatttttaaaataagtttactagttggtttaaactaaggagaattgagttaattctccttgggtcttatcaaattatcttcatctgacttaggcatagtttctctctttttttatttttcatatcactcctgatctcttcccaccatgggtactcttaatgtgtttgatatggctcttacatttggatgtgtcctttaagactgtattgtgttattttagatgcatgcatatgtgtttaaattatacataatatataaaagggtaaattatagcttgtctgatttgatatatatgtttctactctattgcttttatatttttattttataagaaacacacatttttattttataagaaacaaggtcttgctattaatatgttaccaagaccagaatgcagtagttattcacaggtgtgatcattgtgcagatagccttgaactcctggcctcaccctatcctcccacttgagcctcctaaatagctggaactac

SEQ ID NO: 61546 - DNA, 1049 bp, Homo sapiens
aagtgaattattctcttctatttctttacattgccttctgtcattggtaacataacctttatggcattcacaagtatatttgttctagctttcttcttttagtaattctgttgctgtcgtttgtgtgaaatactgcatattataacattgtaattataaatgatttatacattatcttaatcgttgtcagggccaacgtttttcttacaagcagataggaactatgctttgttgtaactcatatttgatcgactctgagaacaaaatgtattttatactttcttggagtagtcccacaaaacatgtaggacccattaagaggaagaaagcatgctatatggttgttatatttgttatttttgacttgtaatttattcattctctcagccctgttctctgactagtgttactatggcacctaagttatggcatggaaaacaagctaattatgttcttcagaacagacgacagtgatacatcttgagacacaagcatctggtagtcttagccctttcctcatcagtgctagtctaggcttggttgggctctctggttgtccaaatatttttctgttacaacacatccttctttattttatttttcttctataaatagtggtttatgctttctaaagcctctagtctcatatttagtttgttcctttttgagccttctgtctactcaaagaagtaatatagacttactcccagctgtgtatgatctactcttactcctgtttattgagttaagctttttactatttgtaaacatctcttggttgtgtagacacaaatacaccaaaactaaaaatggttaaattggggtgaaaacttacggatatttcttacaatttatttttcaaaattcagtgatgtagttagatggctctcctgataaaaattgtttaagagatatgagtaatcaatacttttttatcagaagtgacatctaaccatattaccaaattttgaaaaacaaagaaaatattagaattatccacaatttttgtacctaaacttaaccagttttacttttgtttattcccttat

SEQ ID NO: 61547 - DNA, 1273 bp, Homo sapiens
ttaaaatgcaagacaatcagagactgatctaaaagtaatcaaggatgatcatgtcttgggagtatcctgtttctcagttgctctggacagaaagcacctagaaggttgagataattcaatgcaaaatcagagatttccccccatgtaatcaacctcagaacttgagttggtcctaacagtagactcaaccccttggaaaagactaggcagagcaattttcctattgactacatctgagacgccattcattcttgtgtcacatgagacatagcatatactttttaggtctctaataatagcagttctctaagaagcaaactgggatgaaagacactattcacttattttcttaaatggggaaggcattaaaaggagtgaaggtttattaatgccacttttaaagatataaatagtagatttttattctaataagtcatacatcaataaaatttgttattgcagctccggggcagcaattacttatatattgacaacttatacatgttttacatgcccatttgctctccttttcactactgaaatgtagttaccatagcaatgaacacatcacatggttcctgtgctagttctaaaatagagaacagcaatatgccatatgagctctgcttattttctacgtaaggactgcatatacaacttgaggctattccataaccttctcagtgcagatagcttatcattgatttagaaagctttcaaagtaaaaagcaattggcagtaatatatttcaagtctctagcttctcttgtactgttatttgccactgagctaaaagaacagtttcactagctttgaccaccagggactctgctgttgtatatttagccatagattgtctatggaatagcagtgccacttagaagattggtgggagaggcatatatagcattcatggacacattttctaagtcttactgagcaattcttaaccaatcttagcttttctcctactgtctcccttaatgtttcaagtttttaaaaatataggactctgttttagaatttgaggaaaggaagatgccaggcacaactggaggcatgctattagttccttttatgtccattattgttgtgtaaggttttaaaatgcattggttatatagcagtttatctatagaaaaggacttcagatttcagtgcctggtggtatcaggccgtatttatgccttactatcacatttagagtgtgttgtaggctgtcagacctccagaaataaagtaggaacatacccctcttactgtgactcttacc

SEQ ID NO: 61548 - DNA, 1038 bp, Homo sapiens
aaaagtaggggcaggttacgaaggacctctgaaagtcagactgtggaactggaacttttatcaggaagcagtagttagttttttcaagcaaaagctaattagagttgatatttaggaggatgaatctaacagttgtgtgcaaggatgccttcaaactgagtgagactagtactggagactggttaagagactacaacaataacctgagtaagaattaatacaggcctgacctagttttgagtgagtaggattggaaacaagagttttaggtattataggatttatgcatataaaatggacttgacagaacttgaagaaagagaaagtgtcaaaaggacacagaaagtgaggcaggatatcttacaatgttaaaggaaaggaataatagaagttaccccccaccccagagaaaaaaaagtaaagagaaaagattggaaagttaaaaactgaacttttagagaaagactgcatttagggaatgtagcaaataagataagcaacagaaaagtgagagaatgggaataaagatatgcaacagaaaagaagggaagagagttcctaggaaagggtggggaaattcaaattctaaaatatcgatgaagtctcatttttcatgtattaaattatccagtggagttggaagatccaaaagagagcaattaaatatgctagagtgcatggggaaaattgacaaaagacctaaaagaaaaatatttaaccacaaaatgaaaagtaataggagatgctaagaaattttggatgggagttaaaattaaatctctgaaagaataaaagggaattaatactcaatttatatcttaaataaatatttctaaatgttacactatgcagaaatccttcttccctggaaaaaatgagatcaagtcctattcaaaaaggtcaagaagaaagactgaggttggtgacccgtgagaaaagtttctgagataagtgtaggtggaatttgtagtattatttatcataagtcagatggctgttaacaaaaagttaattttacatctcatctgttagcccagt

SEQ ID NO: 61549 - DNA, 1002 bp, Homo sapiens
ggtattcttaaggaataaaacaaaaataaatcactttatcttaatagttttctgtgtgaaaatgcattaatactcttggctagtgtgacaaactagacaaaaatctgcattttatcccttctaactttaattttgactctaaatttggagcatgaatgagaagaaagaagtgaaaagattaaaagaaaggaaaggtgagtattttttccttccatcagtgccgctgtcctaccctcattttctcctataaatcccaatcagttccaaaagccactgagtattgccactagtgatctggctgctgacagaccaatccaagcgcctctaaaaataaccagtgtttattcgtcaggaaatattctcagtggcattttttttttaattgattattattctggttagcttctctgcaaattttacttttgtaaaaaaaaaaatctttaaactgaattcggcagttttcagtgagaagcagcagcttaggagagcactggagaatgagataaaaactggagctgggcagaacacaaagcataagagaggatttttttatatatataggtgatggaaaattgcatagtgcctgatttaaatgacagacctgctaagaatttaaaatgacaattcttggggtaaaaagttttataaggccttttattattctagaaaatcagttcagactggagtgtgtttttaaatctagcttttcttgagccgaactgattaaatgttcgtatttttagaacataaataaaaataaggtgctcaaaagcatgtttcattataaagccttttttaaactattgaaaattgatttaaataaagtgaagaaaatacctcaaaacctaaatatatatattctctatcttttcattgtctctgcaactgagtaaatgacaaatgatgaagagaattcataccttctctattggatcatttatttccttttactccaagtaataaattttagattttttttaaattttagatctctaagaataa

SEQ ID NO: 61550 - DNA, 1048 bp, Homo sapiens
tcagcatggatagaaagtctacagagaatgtattcaggcagtgttgattaccaaagaattaccttaggtgacttttaggttcctgtgttcttcacaaatataaatagtgcaatgaatgatcactcagagtttcagagtttctgaaaataagaccctaaatcaggccctgctggctaagagagtgcagtgttgtttttgtaggtgcctgaaccccaaaagaggacaattttagaacagttcagttaagggaaagcaataagctagtcttctaattctcttcatttaatcatttatttattcaacaaatatttactgagttcttactatgtacataccactttgatagaccccaagacaaggtggaagtgaccagagagtgtaccatgaaagagcatgtgggaagggttcccattttagctatgatggctatggaatgaccctaaaaatatgaatatctagcaatgacaaaaaaaaagcgacacaaacagcaaaacaaatttcaaacagagagaacaggactataaaagtctctgaacgagagagaacttaatgtactatgtactccaggaactgacagaaggccagtgtgactggaatggagttagtggggacagcatatgagatcaatctggcactgacacatcatataaacagcataactattaaaggagtttctatttggaaaacaaaacaaaatggtatggctagatgactcaatgtgtggaaacactacagttggttttctacagaactaggtagactgtgacaggattgcttaacctttgtataaccagctggttaaaaatagaataaagattttctttatccagtctatcattgatgggcatttgggttggttccaagcctttgctattgtgaatagtgctgcagcaaacatatatgggcatgtgtctttatatcagaatgatttataatcctatgggtatatatccagtaatggtattgctgggtcaaatggtatttcttgttctagatcctttaggaatccagttcatgttctttgcatggacatggatgaagctagaaa

SEQ ID NO: 61551 - DNA, 1383 bp, Homo sapiens
gattaaaagtgacttttgtgaacatttaaataaatatttgtgactgaattttctatggaacatttttccttcagtggcttgcattttaatgaaggaattattttaaaattaccttattccctcccaatgttgtttaaatatctagagggtatctagggcttaaggaagattggatgtggaacaatgagtggaggcctagagaacaagggtagtttcctgcaacagttatatggatccctagcaaggttcatatttctgtctatactgctggttaatctgaatattcccataaattgtggaacataatccatggccttggttttctgtttcttgtagtaagatttatcattttatttctaccataaattagagatcattacatgattactatgaaggatctacattgctatttgttatgatcaaataaacagtatttttgcagttgactattcagggatctgttaaagcatttagaccttaggccctcatagcatatatatataagctttttggagacttggctctcactactttgagaatttggcacacagggtaatcaaaaaaaaaagctttcttggctcttgcctgtaatcccagcattttgggaggctaaggcagaaggatcccttgagctcaggagttcaagaccagcctgagaaacatagcgagacctcatctctactaaaaaataaatagtaaaaaattatcccagcacagtgatgcgcacctgtagtcccagctaatcaggaggctgaggtgggaggatcacttgatccagggagtttgaggctgcagtgagctatgattgtgcacactccagcctgggtgacagagtgagaccctgtctaaagaaaaaaagctttctttcgaaatggcctcaggtttatcgatttttaatttaacattgctctacagatttattttgttgagtttttttttttttaagtactaagagtgttttgggcaggggaaagaaattcacagtgtttttttgttgttgtattttgttttgttttctgagacggagtctcgctctgtcacccaggctggagtgtgcagtggcacgatctcggctcactgcaacctccgccccctgggttaaagcaatcctcccacctcaacctccccagaagctaggattacaggtatacatcacctcacctggctaattttttttggtattgttagcagagatggggtttcaccgtgttggccaggctgatcccaaactcctgacctcaagtgatccacctgccttggcctaccaaagtgctcggattataggtgtgagccaccacacctggcctaccacaatgttttttaactgaacagttggctgcagtaagcttttagaagcctacacgttggtatttgagcatacga

SEQ ID NO: 61552 - DNA, 1036 bp, Homo sapiens
tatttttttaattacaatctaacaaaaatagaataatctaatataaatagaaactacaaaatgttccagaaaatgtaagtattcctgtgtgactagtgtagaattaatataagaaacattaataggtgataaagtaaaaaagataacttagggttagattacactgagatttgagtgcttggctacagagctgggtcttatttgaagggaagtgggaaactattgaagggttttgagcagaggaatgatatgttcaaaacagtggtttaggaatataatcccatgctagtgtacaaattagactagaggagggagagactattatcaaacggatcaatttggaaacaatttagataagcaccaataggaattgaattaaaataatagcaagctaatgaaaaaaagggaataaaatgtattaattctacatctacacagattgagagcctactatgttctatgtacttggtaaaggactgtatatatttttgtctttatagtcaaggaattcacaacatatgaaatgtagaagtatgaaaaaataacaatttgttgtaataagaactataatagatgaatatttaaggtgttaaggacacaagaagaggaagcagccaataatacagaggagtctaagacatgctttagataagatttaaccttacatgagtagttacagtttaccaaacaaagaaggcaaagaacaacattctagccagaagaaacagcacataaaaagtcacaggcaaagaagagtagagcatggtgaattgggggacatagttcactatatctacatgtgcaagctaagcataggtacagaagctagaaagataaggatcacatcactaagggcaaaagacatgaaaaatttggtgactatatgagatgaaacaagatttagtgactttataagaagacaaggatgaccttaatattttgaatttaagtgactagaaggataatgataaacccaatagtaagaattgtataacttatagacacttttcatctgagtggacattaaatacctagg

SEQ ID NO: 61553 - DNA, 1035 bp, Homo sapiens
tcccaactcaagtcagaaaccctctctaaaacattcacaacctgagaggtccatttaatttggttttataaaccctaaattgttagaaactttttccttctcttggacataaatttgccttcttgatcacttttacccataggttctagttctactttgggaaactatatagaatgcatcttatctgtcttcactgggcttcattgtgggtattttcttctgttctatcttccagttcactaattcttttttaagttgtgtctaagcttctattaaaactatccactaaatttttactttcaatttccatttaaacctgttgtattctagtcctctgttaaaattctcgattttatctttaactcttgctatttcaaagtttctgtttgttaagttcaatatctggaactgctttattaagctgtaatttctgctggttttaatttcctgcttgcctctttgtattactgtttattttttattgtgggtgatatgttgtatttgcaaaattgcttatagaaataatttgaagtataggatgattcatgtttgcttttggcaggcatggggacattggcacactatatttatcttcatctaagtttaaagatttagatgattagaggctaagctacaatcccttgtctaggtctttctactgcctgttcacacacccttaatccttttgattcccaccctgagataaggagattttaactaggcccattactcttgacagactgggttccagactttgtcctcctagcatcaaacaccagactcacttctctgggtttctatcatcctctgtattatagcctggtaattcttcattcttttgttaggacttcaatgccttcaaacagattttttaaaaatatgtccagatgttctaattcttgataagacagttggtctgaattacctaggctgccattagtacctgcaacctactttaatccgtattaatatttttctgtccttctggattgcttgggaaactgttaaagagcaggaataaccctgaccaggcat

SEQ ID NO: 61554 - DNA, 1042 bp, Homo sapiens
agcactaagttttctgtatcagcttgtctagaatttttgtttcaaaattgtattcttctaatttatttgcagtttttctcttctaattgtttaattgtccatcccctaccccctgccccaaggcaaatgtactgtcttttatccatatgtgcccataaattctaaactcaaagatttctggttctcccttatatttatggtatttttctacttctctgttcagtatatttttgcaagtgtttcagttttcttcagtgtttgaggttctctagtgtgtcatttcattttcatgcatcagagtaattcctaccattcttatatggagtctcttacctgatgattttttaattagtaaagtgcaatattgaacaacattgaagattttatttcttaatctaaaacataatatttatttaataatgaaatggaaatataggttttgtgaaagggagaaaggtgtttctctaaatattatacctgtgtcaaaaagctgcaagtgctactaccactgttttgtgacccctgaatgatttctgctttctttatattaatacttactctaatagtaattgaactcccaaaaagatcacaaagtccccaattgctagctttataaatacattgatgtgtaccttgtttgatgagataaaagcttcagtaagtgatatccccacctgtgtggttaatttcaaaatattgtttgtctaatacattgttgtcagtgacaactgaacaagaacttttagaagcagttggctgtccattaatggcagatttcaaggctatgcaaattgtgccagttcagccctgcattttttcgatattatcatatcaattgagtcagttcagagtagacaaagcaaggttatgggaaccacctagagcatcatgcaccatttaacatcaatgcagcatacatgaacatctgcaacttcgatcttattaacagaggatagaatggaaggcagtaaacagctttcttcatcacttaattgcaaaatagtatttcctaatgtttgcattgtttatcaacacgaacttc

SEQ ID NO: 61555 - DNA, 1042 bp, Homo sapiens
aagttagctgggcatagtggtgcacgcctgtaatcccagctaagagtagctgaggcacaagaatagcctgaacccaggaggtggaggttgaagtgagccaagaccacaccactgtaccccagcctatgcaacagagcaagatgctatctcaaaaaaaaaaaataatatatatatatatatatatgtatctcaaattagcttgtttatatatttgttacttgtgtattgtctatccccactagaatgttggcctcataaaagcagagtttttatcctattcacatctgtattcccagtccctaataaagtacctgacacatggtagagtcttaataaatatttattaaataaaatagctaagcccgaactagactaaaactatggcttttttgctcctaatcaagtgtacttcccatgaacatttaatttttcctactttttgtggaagcacttatacctttggaactacagtaagaattgatgttcagaataatgacattaagatgtgctgtaggattctctattatcaaagaaaaattttattcagttcaataaactaaactaattaaagcagggatgtcatggcatattattatattaacacatttagaaagatttccaaataaaaagactttctgctttttctttagttaactagaaaattaaattaactcagagctctttatgcctcaaaagtccttgttaattaggattgttctataaatctctattattagcagagttcatcatcttttttattgccctgtttattagggcagtctaagcagggtgtctttgctcatatcctgatatgtgtgtcctagtgaaaagaaaagcatttccggattctcattttttccctattccttgatataggcatatttcatgctgttagtataacaatttagtttccttctatcagttctctccataaagctggaatgatattattgacctatgaagcaaaataattaaatttaaggtctgtttaaaagcattaatgctttgtgacgttgtttatgataatagaagattgaaaata

SEQ ID NO: 61556 - DNA, 1334 bp, Homo sapiens
ttatatccagggtgaacattgcattgaaatgtcctcccaaatgtagatgacaaaaattttgtttcattaatagaaagaaggtaagactgaaacaccacaggtattccagataacttggatagggccattttgtaaagtcagtgtagaccaaaatatgtctctaaatatgagggaaataaagaatctgaaatgacatgaaaaataccaagtatttatatcaacctcctgttctagacgcacatgggaattaggaagtgaaaatttcattcagaagagctgtgcacaaaaagtggaaatgcattattcaattgaaacaagtaacatttttaagggggataaaatactttctacatgatctcactggttttgtcgtcctccgtaagggaaaatattgacatttaccagactgtttgctccagctttctgatctcctgcagtttatttttataacaaccttatcgatgggcctcttacccagctctctaggtttaactgagttgagtcgatttgttaccacagcttcaagtagctgttacagaacaagcaagacatcctaataaagctgtaaacgtgtttactcaaacagagtattgattttacttggaggggaagaagccggttcttagcacagtgtcagggtggatgaatttcactgcagtttttcattgtcatctgtcagggttgtgaaacactaagtaaagccatcagaggataattagaagtaccagaagtttagcccctaaaatcagttaaccacttgggagttttgtagcttaattagcttttattaaaactttccctagtattaatagccaagcacttttaatggtatttccaagtagatcaagatatcaagattgtgacttgttaaatatatgaatttaatggctaagggtttttcagaccttttctcactctaaattaggctaccactagaacataattagaaccaaaaccaatgtaaagatacagtgatctgtacttatactagcagaataaatgcatgatttttttttctgaaaaatcaacttaaaagaagtagtaaaacaattataaaataatttaagccaggcgcagtggctcatacctgtaatctcagcactttgggaggccaaggcaggaagattacttgagcctaggagttcaaaatgagcctgggcaacatagtgagactcccatgtctacaaaaaattaataaattagccgggcatggtggtgcacacctatagttccagctactcaggaggccaaagtgggaggatcgcttgagctcaggaggtcaaggctgcagtgagccgtgatcacaccactgcattccagtctgtgtgacaaaa

SEQ ID NO: 61557 - DNA, 1049 bp, Homo sapiens
aaacataaaaataaaaaataaaataaataatagccagtttgaaaaatgcttacccagtaagggaattattatcttatctcacacaattttgggggttatcgtctcatattatttttgaggttgcctcattgacttgcactgcttgaggttgcaaaactactgaagaagtgggctactggtaggattcttgctggtgacgctgacaggctgctgggaatcagtgtgtacgggagctggctgtgcaatctcttcccagctctacattctgggcctaccttctgggtagtttgaaattggccatggtgggtgtatttacaccacagaaatctgcaaatgcctcaagtcagggctttttcttggaagaactggtggttaaaccgtaaccagcacgccattgccgtgagctctatttatagatgctgaatcaatgacttcataacccaagaaaggaacgctcatacagccagagacccttctaacctctccttgcacgagtcttcatgccttatatcacttgtttggatactgcatttcttcggctcttaagatatgtaaccccagctctaaaagcttaaatttgatggcttcctgcatgcttcctaggaccacacaactattacagctatagaaataaaatctgactgagtctgggccctctaagctttgttcagtgacctgaaggtcactccatgttccacagcccctacccccaacctccaagctagcacgcatccccctgcagcacccagagccgggtcctcatgtaaactttcatcacctctttttttctgtttagggtccagacaagggtttcttttgcagacaagtcccctggcctcccagcctggggtgcaggcacccgtctgccccgcctgcaggtctccttgagccgggtaagtcactgcagcccgttccttcaacacctggcagcagcatgcggacaaagaactcatgctgttgtgctgagcctggtgattcaggctgtaaaactgcaggccaagttgttaaacccagattcaggtagacagccaagcagggccaaggctgcc

SEQ ID NO: 61558 - DNA, 1082 bp, Homo sapiens
tgggaagatgagacaggtggatcacttgaggctaggagtttgagaccaccctggccaacatggcaaaaccccatctctactaaaaatacaaaaattagccaggcattgtggtgtatgcctgtaatcccagctacttgggaggctgaggcacgagaatcacttgaatccaggagtcagagagtgcagtgagcagagaccacgccactacactccagcctgggtgctgggtgatagaggaagactctgtctcaaaaaaaaaaaaaaaaaaaaaagcgtaacctaaatcaaatcataaggaaacatcagacaaacccaaactaaagggaattctacaaaatgacttgcctgaaacctttaaaaacatcaagttcatgaagactaggaaaggctgaggaactcttccagattaagaaggaaattaagcaaacaggacaaataaatgcaacatgtgatcctggactggctcctggtctggaaaagagaaagctataaaggcctttaattggacaattagtgaaatttgaatatgaatttcagcttagataacagcaatttaacaatgttaaattttctgcatttgataattgtacagtgattatttaagaggatgtccttcatgttagcagtgaagatggaaatatttaagggtaaaaatctatgatttgctctcaaatgttcatttaaactataattttaggctgggcacagtggttcacgcctgtaatcccaacactttgggaggctgaggtgggcggaacacctgagatcaggagtttgagaccagcctagccaacatggtgaaaccccatctctactaaaaatacaaaaattagccaggcgtggtggcacgcgcctgtaatcccagctactcaggaggctgaagtaggagaatagcttgaacctgggaggtagaggttgcagtgagccgagatcctgccactgccctccagcctgggacagtgcaagactgtctcaaaaaaaaaaaaaaaaaaaaaccccaaaactacccgaacatggtggcgggtacctgtaaacccagctactcaggaggctgaggcaggagaatcgcttgaacccaggag

SEQ ID NO: 61559 - DNA, 2580 bp, Homo sapiens
tcgattctttttcttttcttttctttttttttgagacagtctcgctctgtcgcccaggctggagtgcagtggtgcgatcttgctcactgcagcctccgcctcccaggttcaagcagttatcgtgtctcagcctcctgagtagctgggactgcaggtgtgcaccaccacacccagctaatttttgtatttttagtagagacggggtttcaccatgttggccaggctggtctcgaactcctgagctccagcaatcctcctgcctcggcctcccaaagtgctgggattacaggcatgggccaccgcgccaggtaaactgttgattcttaataaatcccagtagagacgtgcgcttgcgtgggcaaaagctcctgccgaggccatcagacgcgttgttgaggctccgggtccttggctttaccctggagacccaagtccaggggccttgggtgcactcagatggagaaaggtggcagcaaggagttggatgtgccactgagacaaaaaccaacgctaatactcaccatccgtgcattgccttctgtaagcgtaacaaatgcctggggccacggtcaccggaaagcccctctccttgtccgcgcctggggtggcttcggggctcgccgctgagacgcggggccaggagcgagtctggcaacttccagagccctccgcccgcctcccctgcctcctgcttaggtcgctgctccggcggggtgaggccgggcgggagcgggcaggctgggcatggcccgcgaggcagggtagccggcttggagcgcggggtccgggaggcaggcgcggggaaggaggccgagcgcgcctgccgggagggcgagcaggaggcggcgggcaaagcctacttcgcttagttttgtgcgcctgacagcagcccttcagcaaggtgaattctttgaggaagggtctcattcacaagctgccaagacatccgcgacctattcttgaattcacacaaaaattaaaggaaaaacaacagcccaactaatttagcaacttgcaagaggcagctggtgctcctttccgcgcccctggggcccagtcttcccctccccaccgcctcccaccccgcccccacccccgcctcgcctctgagaggtctccccagagttattttgtatcctgcagctccaggcctcattgtgacagctgagtgacttagctggcaccgtgggatgcggaatgacaaaggcgcagagcatcggaggcccggtggcagcaggggatggcaagggatggcggaggcttgcagctctgaggaccccccatccagcagccgcctgaggtgcccagtcgcccattccacctccctctaaaataatgcttctatgaattaagtgagaggcttttgcagtccaaaaattggtacttccagtgtcctcgcaggctggagatggtggggtctcaggcttctgcatgtcctggccctgacagttctttttctgtcgctgccagtagcaccttctctctatctcatccattaagtgccaggtctcctgccttctgtccccgaggccacttcgctctccctggcttccccatctttgtgcctccttggtggtgccagcttcctctccagcctgggagaggtcatgggttccaaaggcctgtcctggcagtgccggcctggactcctgaaccgcccccaagggccatccttacagaacagtgacttcaggcctggactctgaattcagacctcactgaggggcaagtggagtgcaatgatcagctgctcagttgggaattctgacctccctgaaactgcttaacacctcagagcacagttttcttgtctgtaaaatggggcataatagcaatatttaaagagaatggttatgaggattacatgagccaattcagggaactcacttaggttgtaagtgctccaaaagtgttagctattattaataatattgttctaccaaacactaaagacatgttcagcaaatatgctccctcagtccacttcagcatcttgagttcccacactatcttcctcagaggttttgagtggagccacagaattacacaacactatccccaatatcagtccccaactcctttaattggcaggaataaagtgttctttccctagccaccctgtaaatcagctcataggtcattaactgttactaagagctccagactaggctgaggaagctgcaaagaggccactgaacagatactgggcagaatttctttctcttcagatacagctgtactcccaagcaacatccttgtttccaaaaaattctacttacacttatgagaaagctaattatttggaagccaataagccaatttctgtcttagtccattttgtgttgctataagaaaatatccaggactgggtaatttatacagaacagaaatttatttctcacagttctggaggctgggaagtccaagatcaaggtgctggcatctggtgaggactgctctctgcttccaagatgaagccttggtcgggtgaggtggctcatgcctgtaatcccagcactttggcaggccgagggcagcggatcacctgaggtgaggagttcgagatcagcctgaccaaca

SEQ ID NO: 61560 - DNA, 1269 bp, Homo sapiens
accatagtatatataggattcagtactatctgtggtttcaggcatccactgggaatcttggaacatatcccctgaacactactgtttgttaatttaggttaagcaataccacctgctatagcagaaaaacttcagcatctcttcggcttaacacaataaggtgtatttctcctgttacatatcagaacaagtgggaggagtctgctccatgcagttacttaggggtccacgctaatggcagctctgctaacttgtagctcatcatctggaacacatggcttctgagatactaccgaaggggaagagaggaatggagaatgactcactctggttcttaactctttgaaccagaagtaacacatatcatttcagcttctcatccattggctgaaactagccacatggttctaacctaatggaggggaaggctatgaaatgcaggggtgcacagggactatttggtgaacactaatttttctgctacagagaaagatattacaaattacaaataagctgaacttagagttatttcatgtcatcagttgcaattcaggaaacgaaatctaggaattattacagactgtttaccacaggttatgactccatgtgtggcattggaattggtagaaaacagatctcagtctcggtaacagatatgccaagtcacattggccatggaagtgaggcacatggagcagatgaataggctgcaaacaccagaaggggcagctcagataagaggtcctcaaaatatgatacttgattttggaaagagaaaaggtacaatgggaacagttccaagactatgtatgtacatatataccacagaaaaaaatagcaaatgtagtacatgtaataaaaatagaacactccattggtcaaatgctaagatgctacgtgtttaaagtcactcttcaacaaacacacacagagtagaaaaagtggttttagactgggtaacaggaagtactactttacggtagttaggaaatatattcatgcaggcttcatgtatttaatgaatgtctatgatgtgtttgacatttacaagaaatctgtaagcatatgaagtttacagtctaatttctgaatttagacagatagatcttagataaacagataacagatccttaaccttttattttacttaacattatttattactactatgtgcaagacactttggagaatataaagatgaaccaaccccaatcccaaccctgaagcaatttataggcaaggttgtaggctgagtgcggtggctcactc

SEQ ID NO: 61561 - DNA, 1806 bp, Homo sapiens
accctgtctctattaaaaatacaaaaaattagccgggtgtgatggcatactcctgtagtcccagctaaccggaggctgaggtgggaggatcgcctgagcctgggaagttgaggctgcagtgaggcatgattgtgccactgcactccagcatgggcaacaggaacaagaccctgtcttaagataaataaataaataagaaataaatcaatggttgttcaccctgactgcacagggtgatttggaaaaatgctgatgaagggcccctctccccaaatattctaatttaattggccttacgtgggacttaggctctaggctggttcaagagctcctcaggtgattgctacgtgtggccagggaggcaaaccacaggtatgaatggtgtgtcttcattaagtagcttttatggcactagggcagttacacagatgaacaaactggtccatgcagtagaaaagctaattaggaaaacaggcaaaatatgacaagagagtagggtaaatgcttttatttattccataattcaacaaatattagctaagcacttaacaagcgccagtgctggagtgaagccaggctctcagtcctgtgggctacctgcaaaaaccaggaaaacttcacagaggaggcagcagccaagcaggaattgggaggagtgcttagccaaggtctttatcagataaggcagggagtgagggcatcgcagtgaggacagggtgtgctgggcacagacaagtggcaggctcgggaagctggagatgagatactagtgaggtgcagatatgcatacctttagaggactaaggggtttaggcttggtccagaacgcatttaaaagacgttaaaggttttaaagcaggaatgcataaattagatgtgggtacagaatactggtatttgagataaccccagctgttcataaaggcagctgtagctagaatttcctaaccagtttaatgctttgactgatcatcccccatcccctctgcccttgactgaagtaaccagacattgtgaccttgtggggtcagtttctagtcaatgaagggagaggattccatgtggcagttggaagggaggtgtagatcaatgttttttaagtgactaattgaatgtaaatagaattcaccatgggctgggccctggacaaatacgtttagcgtccttgcctgtgcctccttacccaatttcctttagaaggacttggtagtgcctctgtggatgtggtacctcttatcaggctgtttgtctgacttgcttcagagcaagtaaacaaacccaaaagatcaaaccatctgggttcccagaggttcctgcagctcctctgcactttattattcttgttcagaactcaaggacaaataggtcagatcatgaaatcagcccagtactagggactataaccttttggctaagacactcacagaagaagtaacttcctcggttggggaagaagaagatttagcctaggccagtggttctcaaatttagtgactgtaagcttcaagactagtcatgagctaaaaatatatttttgggagactcgcttcagacttactgaatcagaatctctggggttgggccaaggaaactgtctttcaaacactcattcccagatcattctgattccagtgatctgtagattgcatggagcagtataactagtcagtggttctggtctgtggtggtggctggcagctgttttggggttgtgggggacaggtcagataagcttctccattcataatcctccagcccagtaggcttgcaaaatttgcaccatgcttggttttcaattcaggctat

SEQ ID NO: 61562 - DNA, 1227 bp, Homo sapiens
cctgatctcctggggttacaagagcacaggtttaggcaaacatagccgatttctctctaaggtgtctcttcacttcttgatgcactggagatccttgtggaataatacattagtgataatgagtgttgggtgctcacaaatcacccacaattcattggctgaaggcatcttaaacgtggactttttggcttttattgtctttagctgcttcttttaacatactttagtttgagtgtacagatttggggttttcaaacttgtttttaattaaggcatggtttatttttattgcttgagataaaatgcagtctgagggtcacaaatgtaatttacaaaataaagtgcatctgggcagaccataagaaaaaaaaagaacagaaagcctaaataaagagtgggccaggattcttaagtttatttagtaacttcttggagaataaaaatcccagcacctgcattataaaaaagcacaccttataagtgtccttctcttcgaaacacctaagtgaactacactgaattatgaactaactaatggtttgtaaaaattcgccttgagcaagctattgaagatactaaataaacgaggctgagacagagtctgaggaaacccaacctgctgtttgttttatcagtaatgtaactcaaaagtagccaagcggatggctggagttttctctgtgttttgtttccctgggctgagcctgtgaatgccaagatttaatctaaagaggtttgtgttttaaaaaactaacaaccaagtaataaaacacctataaaaactgtttataatggaaccggtgacagtttgtagtgtagtattacaattcttctgctccccctcgacctttctctatcctttcatccaactctgtgccctttgtctaagttcctttctcaccttgctgccaagaagctcaggaggagagggagctcacaccccaaagcagcagaccatctttaaaaaatgaagtgtgtgttgtggtctgcatttgaagacagggctgcgtgtgctgcttgttttgtctgagataaggacgaagataagttgtcctaacaaagtacctacctagttgtacagtggtttctaatgggaaggtgaagatgccgctgcagtgtcagtggcatgaggctgcaggagtcaaccagggcaggaagcctggggcctcccctccctggcacccggcatagccatgcccaggcccaagatggccctgactccaggga

SEQ ID NO: 61563 - DNA, 1038 bp, Homo sapiens
aacttggttcttttgcaaagccatagttctcctccccctctcaaagaaatggcgcctgggagggaaacttcgtgctcaaactctctaggagccatttctcagcccacctttcctattttctgaagtctcccttgccagcatcccattcacctccggaaagaaccaggggcgctctcttcagagtccagagagctctgggaggcatgtgggcagcgtcagagtggcctcgcctgggcggccagaggagcccccagtctccctcaagtgggcctcaggaactcggggggcccaggggaagcctggaaaaccgaacttcgccatcagccttccttacagcgctggctaaaagagagggggggaagggccccccagcggtcttccccgcccccctcccgcctcagcccctctgccatccgcctgcaccgcccaagaaagcacccagaacgcggctgagctcgccagctcctcgcaggcagggagagagcatcctggggggcagcttccccctccagcccgcgtctgacatccccactcccacacaaggatgccgccgccgtgccctgtccgcagtcgctgaatgtcactgctccctcttcctcccgatcagggtagacacagctcccgaggcgtcccccaccccaaaactgccgcgatcgcccgaaggcgcaaagcctgggcgaaggacgaagtttggggcccacagcgacgggagtggggacgcgttggcgaggaccgcacctcagtcccagccctggcgggcacactccccgccccaaacggcccaggcgtccccatcctcccgcggacaccagcgtctccgccctcccccgagggcggcgagaggagccccccggggcggaggcaggtacccccggggcggagactggggcgggcggggtccgggctgcgcccccggccaggccgggcgggctggcgggcggcgcggggggagcggggctgggcggcgctgcctcgggctctgtgcgctgcagcccggagccgaggaggaggaggcggaggaggagaaggaggcggcgg

SEQ ID NO: 61564 - DNA, 3960 bp, Homo sapiens
cccggtgggtaggggcttgctcccccgaggcatgggatggcgaggaggctgcagcgacatcgttctgcctgcacccggcctggggctggcagggtaggggtgtgttggggggggaaggatgcgagccagggggcgggcgagtagtcgcccgggacgggacgggacgggagagagggtggaggagggggcgggatggaacgctccgggcggcgcgcccgtccgcacactccaccgaaggagctggcgactgagaacctcgaattttaacttcgcgtgcccgcccgcgcgcgcccgcccgcgcccacccctaaatcctgcggccgccgccagcgatcagctctcacacaaactttagctgcgggctagggggtttggggttgagtgggggaggggagagggaaaaggcctcctgattggcgtcgtctgcagccaataaggctacgctcctctgctgcgagtagacccaatcctttcctagaggtggagggggcgggtaggtggaagtagaggtggcgcggtatctaggagagagaaaaagggctggaccaataggtgcccggaagaggcggacccagcggtctgttgattggtattggcagtggaccctcccccggggtggtgccggagggggggatgatgggtcgaggggtgtgtttatgtggaagcgagatgaccggcaggaacctgccccaatgggctgcagagtggttagtgagtgggtgacagacagacccgtaggccaacgggtggccttaagtgtctttggtctcctccaatggagcagcggcggggcgggaccgcgactcgggtttaatgagactccattgggctgtaatcagtgtcatgtcggattcatgtcaacgacaacaacagggggacacaaaatggcggcggcttagctcctacccctggcggcggcggcagcggtggcggaggcgacggcacctcctccaggcggcagccgcagtttctcaggcagcggcagcgcccccggcaggcgcggtggcggtggcgcgcagccaggtctgtcacccaccccgcgcgttcccagggggaggagactgggcgggaggggggaacagacggggggggattcaggggcttgcgacgcccctcccacaggcctctgcgcgagggtcaccgcggggccgctcggggtcaggctgcccctgagcgtgacggtagggggcgggggaaaggggaggagggacaggccccgcccctcggcagggctctagggcaagggggcggggctcgagggcggaggggggcggggcgggatcgggtgggggcggggttcggggagtcggaaggcgggggctgagagggaatttctgagtgggagtgaactggtaggagcggtggggggccggcgagggtgtgaggaagactagtgagggttgggtgggaggagaagctgaaggtgtagaagcaggtgcagagggagagttagggagggatgcaatttgagagaagtggaaggcggaccgaggggtgtgtgagggcaggtgagatgataccgaaggcgagattgcagttgtctgggcgcagagtaggtgggtttgggtgtggtggatgtggagtagagttgaagcggtgcagagtgttgggtttggggaggcgttgaggggtttggggaggcattgaggcgcatgtgaggagcaggtacgattgcagtgatgggaaagaggtatctgggtggatcgcatgttggaataagaaggaggtttgctagctttggggtatgaagtattttttaaaaacgtggaaggatgggatggttgtgcttgggagagtttctgaaagatgatgctaagacagcagagcaaacttaaatatgaaggaaggggagagaggctgcttagaacttgcaaaatctgtggcagaaaatctcctggggacaagggattggtaggggtgggacaaggcggcaggtgtgaagaaagtgggtggagctgtacagtaattttcggtgaatgtgatttggtggactgtgccaggggtgaggatggggcagagaaaggtgttagtttgggagacaagttgtttgataggctgtatttattattttttataaaaatgagaaaagggtctcactatgttgcccaggctggtctcgaactcctggcctcaagtgatctgcccacctctgcctgactgatgggattacagacgtgagctatggcgacccgtgatacgctggattcattatgttaaacttgatctggagtcttcaagggagtgtccggcagcagggtatcccaggaagagacatgcaccataccttgggataggacattttgcatagctttgaatttgctagtactttgctgtgggcagagtgcagggagtggtaggagatgaccaggcaaaggcagaggaggggttagattacaaatggtgtcctatgccccatgaaggagtttaagccctgtaattggtagaaggtgttgggacgtgttaaagagagtgttagacagaagttgtgaaggggtagtgataaagaattacagatgtgggaaataggaaatgaagaccaacgaaccaagtatgtttggggttggaggtaccaaggaaattcagggtagagcatatgagggcccctcctatatggacagaaggtggaaatagcaaatggaaattagttgtgttcgaacagtcttagttctatggggccccaagaaggttttttgtgtttttttttttttaaagtgcattcttcctgtcttacttgtataccctagattttttggcatagccttgaaataaaacactccatttttttcttactcataagttctttttttttttttttttttttttgagacggagtctcagtctgtcgcccaggctggagtgcagtggcgccatctcggctcactgcaagctccgcctcccgggttcacgccattgtcctgcctcagcctccggagtagctgggactacaggcgcctgccaccacgccccgctaattttttgtatatttagtagagacggggtttcaccgtgttagccaggatggtctcgaactcttgaccttgtgatctgcccgcctcggcctcccaaagtgctgggattacaggcgtgagccaccgcgcccggccattcataagttctttacacatttatcagaatgaatttggacagtattttatgtttttaagaaggaaaggataatgcacatgttttttcttttccgagaacttctactgagagttaaaggttggagtggtgaagtgatggtttaaaaaaaaaaaaaaagaaaagaaaagagagagacagaggaagattttaacattaaaagaggaatttagggaatggctgatggtcatgacacggtcggcagaggaagttttgcttactagccacacttaggcttctgagtagagtggatattatgtcattgctattatagcatgtgtttatttcacacactgcttttgaagattgggtggaaactgtcagatgtgaggcatagcatgaatgaaaggtaaatagcatgagtattagaaagtagatgaggaagtttaataattttaatgtgcttcataagctctcatggactttcacgtatcaattagtaaaagacgtaactaagtgatctggctttcagtctcctagttctctacagtgtaccctcagttttccacgtgcttacacatgcctacatttgtactgagagaaaaggaaatagttttttttttttttttgagacagtcttgctctgttgcccaggctggagtgcagtggcacgatctcggctcactgcaacctccacctcctggattcaggtgattctcctgcctcagcttcccgggtagctaggattacagacatgtgcccagctaatttttgtatttttagtagaggtggggtttcgccatgttggccaggctggtctcaaactcctgacctcaggtgatccactcacctcggcctcccagagtgctgggattaaat

SEQ ID NO: 61565 - DNA, 1244 bp, Homo sapiens
taatggagtcaaatttattggtctttactttatggttagtgccttttgtgtcttgttttaagacttttcctaccctgaggtcaataagatattctcctatgcagtactatctttttaaagctttgttgaccttaaacaatgtataactatgagtaaaatacactcttcttgaccccagcctcaccattacaatctatttttgctttccttcacttttttctgttctctgtcttgaatttttacttctctgcagctataactaagagccaggtgctgacttctcctgtctcttaggagaaaatggtcatatagacagaagttcagccagattagattttacaggtctccagctgactgtattgccctttttccttttatgagctagcattttattgtgttcctgctatgtgtctgccatcatccttgctgctttcatatttgttatctcagtgattcctcttaacggttctgtaaaacagagaagtattctcatttttacagaagagaaaacagagacttagattgatttagtagcatgtccaatatcccctagcctaggtagctagcagaatggggactggatccctgactctgatacttcccatcacagcacacctacttgttgattaaaatgtcagaaacctgttttttgataacatccaaaaccaaaaagaataactttcttactcttgatgtaacatgccttaagtaaagcacacaaagctaactattgtgaaactggataaaatacctctctgtatatagccagtggaccttaagtggtccatggctggatgacagaaggtctgttaacccttaaaaatgtataccagtgtatatgggtacatgtgcttattttttagagtagagctataatatttatgaaactctcaaaagggaacctgaatttttcagggtatctggatatctggtctgaagacatctgtaatacagttaacaaagaatcctgtaataatctctctttcaaaagaatcataaaaaagttaagatgtcagatttttctcagccaggtgcagtggctcatgcctgtaatcccactactttgggaggctacagtgaaaggatcccttgagccctggagttcaagacatgcctgggcaacatagggagacccccgcctctatttttatttatttatttagattttttggtatcttcattttatcttatttattttgttgagatagagttttgctcttgttgcccaggctggagtgcaatgg

SEQ ID NO: 61566 - DNA, 1559 bp, Homo sapiens
acaaacaatggcatggtggcatgtgcctgtaatcccagctactcagaaggctggggcaggagagtcgtttgaacccgggaggcggaggttgcagtgagccgagatcacgccattgcactccagcctgggcaacagggcaagactctgtctcaaaaaaaaaaaaaaaaaaaaaaaaatcacattttttcccttaatacattattctcggtctttgtcatcaaaaaccaactaaagctaatttgtaattagggagaaatctaggattgaataggaatttttaaatgccaaaaaaagacactctaaatttagttgattatttcttaagtgaaagtgcttagttataatacatcattactaatcagtgtaccctggctccaaagacctgatgacttcaaatgacttttcatcttgtctctaaattcctctgttttacaagggatcaaatttcctgtgaggttcctaacagtgtgattaaattttagagactgaaactattgagcacttaaatgcagggataactatgcaaacctaattcatgggtttcaccaggagatttgggacctgtctctactaatttatgatgatgatgttgaaactaatctttgctagggattatggaaaccataatagtttattgatggttcagttattgtttgttgaagcacatttacacaattatagtttaatgacataacaaggatattgtcaactaggagagcatgacatgaaaaattaaacttgcaattaatataatatgtattagttgaaatgataatttttatggtgatttagcctcttagaaatccttggaaaacattattagcttatgaattgaaaactctctttgttaatgagtagtgggaaagaacttagtgttactctaaaaagatggggaattaaatattcagttcaaccagcgttttattgagtgcctgctctgggcttgctgctgagttaggctcataaatataagttgaacaagattgatgtttgcagagatgaaatactggttgcttttgttttttctttcaatcacccttccctccagagtagatggctactattgccagagtgattcaaacattcaacaggtttgtgtgtgtatgtgcatgcccttccctgtgcattatggtgtcacctgctcctgcagtggcttcctattcatctgtcacgttcacacaccacagcttggcttttttcacagccaactttatttctgttttttttttttttgagatggattctggctctgttgccaggctggagtgcagtggcgcgatctcggctcactgcatccaccacctccggggttcaagcaattcccctgcctcagccttccgagtagctgggaccacaggcatgcaccaccacgcctggctaattttttgtattttagtagagatggagtttcaccatgttggccaggatggtctcaatctcctgacctcgtgatctgcccgccttggcctcccaaagtgctaggattacaggtgtgagccactgtgcctggcctatttctgtttttcatttttaaattatatttgtcttttttagagaca

SEQ ID NO: 61567 - DNA, 1439 bp, Homo sapiens
tttaaagcgaatcttatggggaagacaaatatatgtaaaacagttaaagtggagctgcactgttgggttcaaggtgctgcaatggcccaaagtttaacccacaaggggtacctgaaggtaatacccgaagtaactccttgtcacagagatctaaagagcctagtttgaaaacctctggagagacagaaagagtttgggctttggcatctgaattaaaatccttcatgacttaatggctctgagatcttggctaagtcaagcctgttttccttttgtaaaaacaacaatgctaccttacagagttgttttaaagtttactgataatctatgtaaagtacctggaccacagtaggtgtcaggaaatggttggtattattattattattatagtttagtgctttgttatttctttttttttaaacaatttattgaggtgaaactcacataacataaaatgaaaaaaccattaaaaagtgaacaaatcagtggcatttagtacattcagtgttgtgtcaccactgccactatcaagttccaaaacatttttattgatcccaaataaaaccccttacccattaagcagtttctctagatatgtccctgagactccaccaatctgtgttttgtctatggatttatctattctggatgtctcatatgaatgaaattatatgatgtgtggccttttgtgtctggcttctttcacagcataacgtgtttgaggtccatctacattgtagtagcatgtatcgaaacttcattgctttttatagttgtatagtattctagtgtatggatataccacagtttatctgttcatctgttgatggacatttgggctgtttacaccttttggctactgtgaatagttttgttatgaacatgggtgtacgtgtacttatttgagtatctgttctcaattcttttgagtctatacctagaaatggaattacagaaccatatggtaattctgtgtttaactttttgaggaaccgccaaacagtgctttgctatttcttaattgcttcttatatgttctgtctctagctttgctttgtattccccatagtacctaccacagggctgcatgcagggagcatcagctcgctaaatatttgttggtttttctttgattagtatttataacctcacctcccagttcacatgttttgggcctgaagcattgatttcagaggaaatagatgcatccaggatttgaaagataagaaatatcaccatatggatggcgtttcatgttgtcagacaacagatatttgttaaccaaggacactattttgagcaactctgccaataacctgagctgggtgctgatagaagaaaaataagtcaaggtcccttcccctaaacagttctgttctgtttcggaagatactgcttagatttgtggatgctcactcagttacacaatgggctttgaa

SEQ ID NO: 61568 - DNA, 1684 bp, Homo sapiens
taatacttatgatccaggatattttgactcttcttatgctgacatgaatatttctgaatagtgttgatgtttatgtaataccagtgaagctaaaagctcagtgctggactaagcatttctctagatatgtttagaatatttgtaatgaatgatgtaaatagtgttatattataagaccgtatgatacaaccatataatttactgatattttgtagttaaaaataaaatgattcacaaccttagaaaatagaataatttaatttgatgtagcacaaatccccagaattaatttaggatgatttgctacctttttgatagccttttagtccaaccttcaagtttttatagaaaaaaaatgaaaagagaataatgattttagggttttcgcttgtgatagaatgtcctatctacatgtgaagcaaatccccatgctctgaaaaagagaaatagtgtggataattccaaatcaggaaaaaaaaaatcatttctatttggcttttgaatgaattatgcatttttttttcctgtggatttgtctttccagttagatactgcttaggctaaaatgaaattggttttcaatctattctcttgcttatatgaatttacagtggggccagtgggatgttggaaacaaatcagcctaagattaaaaaatttgcggtggataatatacaaagtggataatatacatgtgtttagttgagaattggctacagataagagacttctgattttgttcctctcctagctgtgtattttttttttttttttgaacactgtgattctgcttgtagcaaagagctgctgagttacatctgcttctgcctaattaactctgttggttggtgtcagatgagagctaattttgagattaaatcgaggagtggggtgtgtgtcgtggctgggggaggggagaaggaggatccaaggttgcttgattgttttacgtaagatcaaaatgcagttattcacaattgttcttttaaatttattttttgcttttcaagtaaaaataatcactgctgtcctaaaatgtgacttgtgtcaatacatatttactattatgtaaactggtacgtttttcttgtaggtgagcttattggtcatatctgggtagtccattcagtacctaggtgcctggtggcctttgggacaaacagcgaatgctgcccaggaatgtgaatgctgaccttaaaacaacttttgactgtctttttttctgataaatgttatatctgtttggctatttgagtagtagtgggtttttgtttttgttttgtttttccatgatgagattttttcttaggaatctatcacaaacctgatttttaaaatttgaacaggtctgggcttagggatgaaatttacttctataggcacttggctgggtccttggggcttcattttctgtctcaagtttcatatttataagaatccttcagtggtctaaaagaattattatatcaccaaatgtagtataataactcattggagctgtttgtcttgaatggttgtggagatacacggatggttgctgaatttaaggatgtccttatgtccaaatgaacatttccttttttcttttggcagatttgcctgaagacctggataatctccatttttgtcatggactgttaaaacgtttgaagttccaattctggtactttcccttattttatta

SEQ ID NO: 61569 - DNA, 1817 bp, Homo sapiens
gcaagactctgtgccccccaaaaaaaaaaaaatgattgtggtaaaagcttgtcatgaaggtatattttaggtatctattagttatgaaacacattttttttttttttttgagatggagtttcgctcttgttgccgaggctggagtacaatggcgcaatctcgactcactgcaacctctgcctcctgggttcaagcgattctcctgccttagcctcctgagtagctgggattacaggcgcatgccaccatgcttggctaattttttgtatttttagtagagacggggtttcaccatgttggccaggctggtcttgaactcctgaccttgggtgatccacccgccttggcctcccaaagtgctgggattacgggtgtgagccaccacgcccggctatgcattttgttttaatgtacgttcgtttgcttgtgtaacaaaacacctaaaagcaacttggcaatattgggcacttttcctgtgacctcttctactttctgcagttgtattttgtgcaatcaaattaaattagttgtgattcatcctgaataaatgatgaaagattaaataattacttggatacagtgaaatatcttctaatgaaattttgcccgaaaccattttacttgggaaagatcaatttcctgttctaaactaactgacagagaatgattctgtgttctatcctgaaagtggttgcactgtgaaagccagtgatttcattcctaaacacactgtgttccaagtctaacatttttgtcaagggtttatataatgaaacaaaagtgagtacttattagatttgtagatgacatagatgacagaatcaagattcaaaacaatctttagcaggttggaagataggcttaaatcaacgagatgaaattgaacggtaataaacgttaaattgcagcatttcaatttgcagaaggaaaggggtggaaagactcaacttgacagcactttttgaaaaaagatctgggatttttagttggactgcatgctcaccatgaccacttgtgtggcaggggtattgaggaagttcctgtaatttgggttgcatttataattggataatgcctgaactgtcatattttaagatggccaatagccaaactagtgagcaaccaagagaaagtggtgctttgaaacaatgtgatatgtggaagggttaagaaactgggatatgagtggtctaagttatggctggaggtagcatggggttttgtcgttagtggttttcaaaaggtacttgtttttggacatttgaaggcctctcatactgaagaaatactaagaattgtcttgggatccttccagggaataggactagttaggaataggaatagggtcgaagttatggggtggcagatttttgcttctctgagcaagaaatttagctagagctgtgcaacagtggggtgagctgcctcaaaaagtgacaaattatcaatcactggaagtattttaaaaatgtaaagactcattgcccatctatttgggatattgggcagggatcttttattggataactagaggttggactggatgaccttcagccccaagtttctgaatctgaggggagaatgagtagagtgaatttacagcttactgatcacagggacaatcttgtttaaattgcctcctttaaggtggcattttgggttggcatttaaaactgtactgtttgaacaagtatagttcaatgacccagctgtttttcagcaacattccaggatctctgagagcaaatactatattcttcagtatgtctggctaaagtttttaaggaaagatattattttcttctcttaggtatagt

SEQ ID NO: 61570 - DNA, 3978 bp, Homo sapiens
gagaacagtgatggacttagttggattttagaattggctgggcacagtggcttacacctataatcctagcacttttgagaggccgaggtgggctgaggtcaggagtttgagaccagcctggccaaaatggcaaaactccatctctactaaaaatacaaacattagctgggtgtggtggcacattcctgtaatcccagccacttgggaggctgtgcaggagaatcgcttgaacccagaaggcagagattacagtgagctgagattgcgctattgcactccagcctgggtgacagagcgagactctatctcaaaaaaaaaaaattaataaaaaaaattaatgatgttcgaccctttaatctgttattgactcttcccttgggtgaattccatcttctcccgagcctcagtttacccacaaagttctgcagtttaagtgacaagttatatgtgagcacactctgtacagtttaaactataaaaagaattaagaagtggatgttatcattggacaccaagattagagctcaggtttggcccaattcccaggccaaggctctttctccttgtagcctctttgtagatgtactcaataccagattggagatctagggtggtttttgtatataccaagcatctctcagaacaaatgccactgtccacctggaatcagatttgtatatatcttctttgtactgagctgtttaatgagctaactgggtattaagataactagaatgctctactacttaaaggtgaagggttatgttactgtattattttcagttttccaatttgtgggttagagggtatcatagacctctgttaaagggatggggatgtgattccatagaagtagctagatgggaagtttttttacgtatgagacttgggaaatacaatacctagctgaaagctggattatttactcttttttttaagtttaagattttttgaaataagtttaatgtactttcatcagattttttatatcatagacttattctttgatgtgtattttatgtttatggcagacatatacctcaaaccactttcatataattttgttaatttcaataaatataattaaatgtataatttagatgtgattatgcctcataaatgacttcatatagagaagtgaaacattctaaaaacaatttcttctcagactgtgacccaatttcttgttgaaaaatatagtcactgtggctgtgttatgtaatacctgcctgtcattacttcttgtggtcattctgtgtctgaaaaagtcatgctaaagaatcttttagtttatttgtgtaagcttcattattaagagactttcccctctttttatcctttaaggtcttgatttcccagttaaagatgttcttcacccgaatgcagtctttcctgttggtaaaataagacaaccatcaacattgcctgtttgtctgcttttgaatctcttaaggatggatgtttgtaagatgttgcttaatacagtctggaatactctgtccatttgttgaattgtaaatgactttcaaatgtgcaagttctgttaaatacaaagagaacctctatgggtaacttttgtgttgaagaagtcatttgtcaaccatggtaaaacttgcaaacccactttatacagagtggattcttgaagctatacagaaaataaaaaagcaaaagcaaaggccctctgaagagagaatctgccatgcggtcagtacttcccatgggttggataagaagacagtctctgaacagctggaactcagtgttcaggatggctcagttctcaaagtcaccaacaaaggccttgcctcctataaggacccagacaaccctgggcgcttttcatcagttaaaccaggcacttttcctaagtcagccaaggggtctagaggatcatgtaatgatctccgcaatgtggattggaataaacttttaaggagagcaattgaaggacttgaggagccgaatggctcctccctgaagaacatagagaagtatctcagaagtcaaagtgatctcacaagcaccaccaacaacccagcctttcagcagcggctgcgactgggggccaaacgcgctgtgaataatgggaggttactgaaagacggaccgcagtacagggtcaattatgggagcttagatggcaaaggggcacctcagtatcccagtgcattcccatcctcgctcccacctgtcagccttctaccccatgagaaagaccaggtaagcgaaggagtaatgttcgtgcattctcactactgtccttttgtcttttacggtttcacttaagttttatgtggacaaaagttctgaataaagtttgataaaattgaatgttttgccttagagcaggcttttgtattttaaaatgtatatattgtactgcattgtgtggaggacttcctcactggttggccaagaatttaatggaagagtcatgtggtttgtttttaagctctaattgctaactggttggtgtctgaagggaccaggaaggataatattgatctttcttcatccaggcagggtcatatatatttcagaaatctacgaaaaggccatcgtatatttttctctttattactattttcaaagaagaatctacagacttcttattttactattattatttttttgagacagaatctagctctgtcgcctaggctggagtgcagtggcgcagtcttgactcactgcaacctctgcctcccaggtttaagcgattctcctgcctcagcctcccaagtagctgggattacaggcacctgctaccacacctggctaatttttgtatttttaatagagacaggacttcaccatcttggccaggctggtctcaagctcctgacctcaagtgatgcgcccgcctcggcctcccaaagcgctgggattagaggcgtgagccaccatgcccagctagacttcttattttaatggtgataatctatgcttttttttttgagatggagttttgctcttgttgcccaggctggagtgcagtggcacaatctcggctcactgcaacctctgcctcccgggttcaagtgattcttctgcctcagcctacctagtagctgggattacaggcacatgccaccatgcccagctaatttttgtatttttagtagagaccaggtttcaccatgttggccgggctagtctcgaactcctgacttcaggtgatccacccgctttggtctcccaaagtgttgggattacaggcgtgagacaccatgcctggctgataatctatgcatgtaagaagttattttaatacgtcacctaaatccctcatttcaataaaaagtcattttttattgtccacttctctgtgttgtaggtgaatgtttattttgtctcatacagtatctttttaaaatactctgatttcttgggccttatgttatttctatagtatttataaatatatggcagaattctccttacattactgctaccactttaagtttttggttgagtaagatttgtctttgtttcaaagctacagtatttacttcccaaactaaacacaaagtagagcagcagaaagttatttatagttcatgtctagttttggggtttattctctgtcttttgggtgagcagatatattgatatcagttaattttattaatacatgttataaaacattaatcattgttgatagaaaggtggttttggctgggcagggtggctcctgcctgtagtcccagcaccttgggaggccagggtgggaggatcacttgagcccaggagttcaagactagcctgggcaacatagtaagacccctgtctctacaaaaaaatcaaagaattagccaggcttggtgaagcacatgtgtagtcccagctacttgggaggctgaggtgggaggatcacttgagcatgggaggtagaggctgcagtgagccttgattgtactccagcctgggtgatagagtgagatcctgtcccaaagataaagaaaggaagaaaga

SEQ ID NO: 61571 - DNA, 1286 bp, Homo sapiens
tttaattaaatacatatgtatatatatatttttgttttgtttttttgttttttttgagatggagtcttgctctgtcaccaggctggagtacagtggcatgatcttggctcactgcagcctctgcctcccaggttcaagtgatttccttgccttaacttcccgagtagctgggactacaggagcgtgccaccatgcctggccaattttttgtattttagtagagacggggtttcaccatgttggccaggatggcctcaatctcctgacctcatggtccacctgccttagcctcccaaaatgctgggattacaggcgtgagccactgtgcccagccttaattaaatattttttataaaagcttatactgtgaagaaattccttaagggactatagagccatttcttgatggatttggatatctttgtttttaaaaatatgtacactaccctaaggtatgttaaggttttataatgaacaggtacgtggactaattcaggtagctttaggcaatttaatagtatgtttcaataattttgtgatccaggggatactttttacttgtgatggaagagtcagtacaaattttccacagtatcttctgatccttcgctttaaccttgcccgtcatttcttgccaaccttatcatatttttttcaggcagcatctgtacagaagtatttttagtctaaaggaaaattcatgtctgaaagtgtctaggattgagagcagagtaatttattgcttagcaggcaattgttactgctctttttatgatgctgatctttaaattgtttagttagcatcatgctataatgaggaaagctgagaaatgttttctagaatttttacttgatgaaatttggagactaattctattaagtaatcatttgattcttaaaaaacaaaaataaataaaaatcagtttaaacaaagttggcaacatgtttgtattctttaatgaaatagcatttttttccagctgggtgcagtggctcatgcctgtaatcccagcactttgggaggccgaggtgggtggatcacctgaggtcagcagttcaagaccagcctgaccaacatggagaaacctcgtctctattaaaaaaatacaaaagtagccgggcatggtggtgcatgcctgtaatcccagctgctggggaggctgaggcaggagaattgcttgaacttgggaggcagagattgcagtgagccgagattgcgccattgcattccagcctgggcaacaaaagcgaaactccatctcaaaaaaaaaaataaataaataaaa

SEQ ID NO: 61572 - DNA, 2747 bp, Homo sapiens
tgaacctgggaggcggaggttgcagttagctgagattgaggcactgcactccagcctgggcgacagagcaacacttcgtttcaacaacaacaacaagaacaacaacaacaacaacaacatttttttgtggtttttaatttttttttttttaagctcactagctattgttagtgtattttatatgtggccctagacaattcttcttccagtgtggcccagggaagccaaaagattggacactcctggtctacatcttttgtcaaaggcacccaaaatgcctagtagccattttaaaatagtttgagtttcttatactaaatcatagtatgctaattgtcgacctatgatgattcttcctttggctgctgaacttggattcatatgtagattgattgtactataatttcctatatataagactttttctaatatatttgaaaagattatcattgttcttgatgtgcttgaagtcataggatttgccttgcattgtgggaggaaatttatgatataagtgaaaacagttcagaaatggagtgatctcaattacaatctagtcaactaatgccttttttttgagacagagtgtcactgtgtcacccagtctggagtgcagtggcatgatcttggctccctgcaacctcagcatcccaggttcaaacaattcttgtgcctcagcctcccgagtagctgggattacaggtgtgtgccaccacactgggctaatttttgtattttagtagagatggggtttcattaatgttggccaggctggccttgaactcctggcctcaagtgatccgcctgccttggcctcccaaaatgctgggattatagacgtgagctactatgccccatgcctggcctaactaatgacttttttttttttgagatggaatctcactctgtcatccagactggagtacgctggtgccatctcagctcactgcaacctccgcctcccagttcaagtgattctcctgcatcagcctcccaagtagctgggattacaggcacgcaccaccaagcccggctaattttagtatttttagtagagacagggtttcaccatgttgaccaggctggtctcgaactcgtgatctcaagtgatccgcctgccttggcatctcaaagtgctaggtaggattacaggcttgtgagccaccgtgcctggccatgactttcaagaagctgtttattctggttacttttttgagcagttacattaaatgtaaaacaaaataaaaatagtaagaataataactaacgttttgtaagtgttaaatgctggcactattccaagtgctttacatttattatctccttgacttgtcacaataactgcaagggaggtagattattacccttattttacagatgaaaaaatgaggctgaaagcttaagtgatttgcccaaggtcactgatagagctagtgagtggtgaagccaagattctgacgagacagtctgacctcagagctctttaccactgggcagtacactggtcaacagtggtggctttttttttttttttgagacagagtctcgctctgtcgcccaggctggagtgcagtggcatgatctcgcctcactgcaagctccgccttccgggttcacgccattctcctgcctcagcctcctgagtagctgggactacaggcgcccaccaccacgcccggctaattttttgtatttttagtagagacggggtttcaccgtgttagccaggatggtctcaatctcctgacctcgtgatccacctgcctcggcctgtggtggctttttattaacagtaaaagtatctcttccagttcttcaaatgattagaagcagttttgccccaacaaatagatttccagcattttaaatttggtagatgcaatgagcttattatagtttttaaagtagatactatttataatattagcaatatggaaaggcagtagagaaagtagtaagtctgtgtctaattagattgaacatcatcatcattccgatgcatgactgctaggaggaatacaatgcaagttaaaatagaagggctccttcctttctgaaatgtaattgcacatcttctgatagtctggaattcaaattgggtattaccacactggcttcttagcataaattctttgtatttatttaagaaagctctcttcggtgaggtgatatggaaatgaattaaaccactgaagataaaactttatctttgacttggtgagggaactcctaaaggatagtattaatgtttctcattaaaagtagtaaagctcaattaggtcagattatgaggactttggaaagtcacatattctaagagagacttccattatcactgcgcactttgtagcattaagattccatttgaacatttgagctttagcatttttataaaatcagtttagttccatttaaaataaattccatagtatttcactttagtgagaatgtcttcataaaatttattaagtgtcaagtcttggtctgtttccagtgtagtacataatgtgggaattctcattctaggttggcatcgtaattggaaggtgggacactttcagtatcaagtagggcttctgatgttttttctgttgaagaaatatttgtattagaatcttacaaaaagccttcaaacataaacaaaattacaaaaacagtgatactgtcaataagaaaaaaatcaaaatgatttttttttttttggatacagagtcttgctctgttgcccaggccggagtgcagtggcg

SEQ ID NO: 61573 - DNA, 1770 bp, Homo sapiens
tggtcttggcttattcagttgtttattctatttctcctgccccttttagagagatacgttgttagggtttttggcactgttattaatatgaaatatttctacaaatagaagataaatgtacatcctacagcagttgcttgagttgtttacacacatgaattagataagtttatttttagattttcttttcttctgttttctccattctgttttctcctcttcagtccccttaaccctgccctagagcagaccctcctcatctgttctgggacttttccaatagcctgtactttatgaaggactattcattagtccatattgttctttgatgtggcaggcttccagaagtctctcagccctaggggaattgttcatagtctcaggcaactctggatcttttttggcagaaatgtgtatattttttatctgctaattatagagcctgaatgtcctcctctctgttgaccttcttagttttcctttgaattggtatcctttgtgttgcagatgtcatctttcttgaagagtgcttgattatgtgtatttaactgaaaatcgaataaatctctaaatattgtaaaatatgctcttcaaaataacctgcattttggaattggtatggataaagtcagttttagaatcactaaagtcagacagaaacctattgtaatgtgaaagacgaggtggatcaaatacttgctgttccagggtcatggaaggaaaaaaattgcagttcatgttcttcttataattaagcttcagaagttcttcacaatagcagtgtctgaggactgcttttgtgagcaggtagtaccagttgttgagacattgttgagagagcacatgaattgtctcaaactagttagttgggtcaagggaaagataaaatgaagggtgaatgagtctttctattgtactctgaggcatgacagcgtgttccacttttgagcttttatcaagatgggacttgtctagacttctaatgaaatgggcttcaggtaaagtagaaacattatgtcaagaggatttttggttgttcaaatgaatgttaaacattcttttaactctttggatcttagatagatttgatagttgtgatacctttactgtatgtaacacatgatcctgtcctgaatgatcagcagctttcaggagttactcttgtattcccagctacatttgtgatactttcagtgctaagaaaatctatattctgtagctttgaagttatttaacagttaagtactatttgctggtttattctgattttgtcttaaatgacaaatattttattcatcctttctcttcaaacattatttaacaaatgtacgttttaatgtttctcaaaaatgaaggtctatattctttttatatgttttatctttgtatgttatttctttcatctttttttttttttttttttttctgagacagggtctcactctgttacccaggctggagtgcagtggtttgatcatggctcactgcagcctcgacctcccgggctcaagtgatccttgatcctcccacctcagcctcctgagtaactgggactacaggtgtgcaccaccttgtctggctaatttttttttttcttttttttgagacagtcttactctgttgcccaggctggagtgcagccgtgtaatcatggttcactgcagccttgaccttcccaggctcaaatgatccatcctcccacctcagccccccaagtagcttggactacaggcacacaccactacacccagctaatttttgtattttttg

SEQ ID NO: 61574 - DNA, 2337 bp, Homo sapiens
ttgttttgtttataaacttccttttcttggccctgtgccttaaactacagtagattaggtgaaactgttctctgatcacactagcatttaaaatatgaacctgaatcttctcaggtactttgatctctccaatctattaatgtttctgagtacataaacatcaattagctcaccaaattaaagttagcaaatgcgtcagccatgtaatttgcatgtgacattttgagttagcagggccaagagggaagtatgtttttgtgagtgggtgtgcttatctctctgtcttcaggtggtgatggaaagttgtacatgtaagagaaggagttgtggcagtggatatgtgaaatgctaactgtacatatgcctctgcttggggcagaagcactttaccagagaagtctccaacagttgcaaactacatattctttttccttatataagtgaatcttttaattagtgtaatattatgtagagtgtatgttttttctgtttttttttaatgaaaggtgatattttgataaatctgcaaaatgagcaatatagacaacattttagagtgaatgatactagatttaaactatgaggctggtctctgcaaagatacaaagtaaatactaatcactggtctaagcaaaatccaggaaggatttttgttaatttgacaagtgggtttagaattctttagccactattttttagaaaccagctttgttcatacatcctttctctaatttgcctcacttttgatctgtgataaaccagctgcaatttggtttcattaacaaacttaactggtcaacagatgttttggctctattttgtcctttctattagaaacagcataggcgtacacagaaaccatgctgggccttttcctgtctgtagctcgacaggcgttacagaagagcaacctaactttacttacaagttcaatttttcttcctcagtatttttattataggtatacaaacattgtagttttgtctcccccatcaagtcggtcttttgttgttaatcttccatctgttagtccagtatacacttctcaccctgctttttagcattgcaaaatcttagcatgcagggaaaaaggtactattgcaggagaggtaattgagatatcagcgactcttccacaattcaagggaaggagtggaactagcctggtgaatttagataatttcttccgtcttctttgatgtcagtgagctgccatatggagagcagtgaggcctgcaggaaggaggtgagccttggtctgggctgcctagggtgttcagagtgacatgggctgagagccagaggcagagcttgactgtttctgttagtagtttctgatgtgaccagccctgctttttgtccaaggtttccctgtcatgcttgccaccctatgggtatgatgaagtttaagaaacagatcataaacattatcttgggaaagagaaacataagaacatattaaaatctagtaataaggccattaaaagatgactcccatttgatatttgaccaacttgttttcaaaattagtattgtaaacacttctgtcttataacaaaacccagctttagctgttgagccttgagttgtgagtaaagcagcagaaaacaggatctgctagtggaagagtattggctgtttgaagaacatcagctgttccaggtagactcctggcagtgtgtgagcagacctgggaaaggcaggcatggagggagctaggaaaatacttctctcctaacctttataatttataaaattagagtatttcataaatattaaaagagtagtacagtaaacactctatttctttcacatagattcaccaattttaacattttgccacattctttctcttcctatatgtgtgtatatgtatatgtttttatacatgggtgtgcgtatatatacagcacatttatatattcacaattttgactaaactgttggaaactaaattacaaatattatatttcacccctaaatacttaataatatatcaaaaatgttctcttatatactatactattacgcaaaaaattcggcagtggaatgagtgttaactgacagtccatatttccccaaatggccccaaaatctcatttataacttttgactttttttgagatggagtctcgctctgttgcccaggctggggtgcagtggtatgatcttagctcactgcaacctccacctcccaggttcaagcaattctcttgcctcagcctcccgagcagctgggactacaggtgcgtgccaccatgcccggctaactttttttatttttagtagtgatggggtttcgccaggttggccaggctggtcttgaactcctgacat

SEQ ID NO: 61575 - DNA, 1149 bp, Homo sapiens
tggcatgtgcctgtagtcccagctacttgggagactgaggtagaaggattgcttgaatccaggagatggaggttgcagtaagccaaggtcacaccactgcgctccagcctgggtgacagagtgagactctgtctcaaaaagaaaaaagaaaagaaaaaatactgtatgggggatgttgtatatttcttcttgtgagataccaggagataaataatttcagcttgtctcattactggtggtgcttagtttatcagttggttaaggtggcatctgctagatcttcgtttataaaggcgccttttcccttttgtaattaacaagtaatctgtgcaatgatactttgaaagcatgtgagtaacctttcacccagtgtgtattagttttctattgctgctgtaacaaattacagcaacttaatggtttaacacaacacaaatgtattgtcttacagttcggtaggtcagaagtccaacatgggtttcttaggttaaaatgaaggtgagggcaaggtaatgttcttttctggaggctctaggagagaatcttttcccttgcttttttgagcttctagaggctgcgcatattccttgactcatgatcccttcctccatcttcaaagccagcaatgttgcatctctctgactgttctttcacagtcacatctgcctcttaccacagcctggacagtttttcagcttttaaaggatgcatattattagattgagcccatttggataatccagataatgcccttatctcacagtccttaactttatcatatctgcaaggttattttgccaggtaaggttctgggcattaggaagtagacatttttgggggagcccattattttgcctgccacacagggtttagtattgtcacctaaatcaaattttgcattgggggttgcaaatcattgaaggttttgggctatggtgaaccatgatcaagtctgtttagaaaggaaagagggccaggtgcaggtagctcacatctataatcccaatgctttgggaggccaaggcaggtggatcacttgaggccaggagtttgagatcagcctggacaacatagtgagatcccatctctagaaaaaatttttaaaaattatccaagtgtgatggcacagaactgtagtcctaactactt

SEQ ID NO: 61576 - DNA, 2007 bp, Homo sapiens
cacctcccaggttcaagcaattctcatgcctcagcctcctgagtagctggaattacaggtgcctgctaccatgcccagctaattttgtattttttttttagtagagatggggtttcactgtgttgatcaggctggttttgaacccctggcctcaagagatccagccacctcagcctcccaaagtgctgggattataggcgtgagccactgtgcccagcatatatctataatttaaattagaaccctcaatcagagaagtctaaataggctgaaaaagaaactcatttatttaaaaaagaaaaatgacatgcagatggatgtatattatattcttttagtttttagtaaaaattcagaaaaataaacatgaacttgaggtaacgagcctctagaattcttcattttatttcatttcacaatgtttcagcagtcttctgcagttagttggaaggttttggaaattctgactaatccagttgttgaagaataactagttagcttaataaatatgttttctagagctgataaaaaagatgattttttcatctgatgagctctgaccctctataaaccttctaacttaactcattttccaccagctacagaaatgtaacaagatgccaacaattacatcctcatggagcatgtatactagcttataaaatcacccctttgttggaaaattgtgtaatatcttgatttcaatttagcatggcatgttggttagcagtaaatcttgctagtgtatgaacacaagcctgcaggcagtttggagaacattgatcaggtgtaaattgtatgtatttttctcgcttctaaaaattttatagcagaatgaaataaagagctagcattgagaacactttttcagttgttttttattttttatttttatttatttttattatactttaagttctagggaacatgtgcacaagtgcaagtttgttacatatatatacatgtgccatgctggtttgtaggttgttttttattttgacatgtatcttgtggaaagtgccttctctctcctgaaatccatgatttgtgtctctgaccacttaggttccccatttagtatgtgacacatagcaaaagcaaacaagcatagttaaaacgtgtatttgtgccttgtgaaatgtgcattataagcagttaatactagatttgaaggctgtacaaaaaacatgcaaaaagatattaatattaaatacttagtgcttattgtgtatattaagcatttaatatatacaatataattttgcatgaactctgaaagataagtactgttattaactgaattttacagatgaagaaacaggccaaataaggtgacttgcccaagagtacacaggaagtattggagctggtgtttcaatcctggtgcacaggcagagtgtagtgtagtcactttatcaccttctgcctctcatttcttcgggcgaaatcaacacatacctagtgaattcttgcaatatataaaacactgtattaggcacataatatggaagttaccacatatctaaatggtaataaaagtgatcagttgaggctaggcatggtggctcacgcctgtaaccccagcactttgggaggccaaggcaggaggatcacttgaggccaggagttcgagaccagcctgggaaacatgacaaaaccccatctgtaccaaaaatacaaaaattagctgggccaggcgcagtggctcacacctgtaatcctagcactttgggaggctgaggcgagtggatcacctgaggtcaggagttcgagaccagcctgaccaacatggagaaaccccgtctctactaaaaatgcaaaattagccgggcgtggtggcacatgcctgtaatcccagctactcgggaggctgaggcgggagaatcacttgaacccgggaggtggaggttgcgggagctgagatcgtgccattgcactccatcctgggcaacaagagtgaacctccgtctcaaaaaaaaaaaaaacattagccgggtgtggtgacac

SEQ ID NO: 61577 - DNA, 4039 bp, Homo sapiens
tggggaaatactgtatcaggtgatttcagtgtaatgtgttagaatgaaagtaaatttttatattaaatactgtttatagtgcccattatgtcttttttaaaccttgtatgttggtttatcatcatcattattattatttggtagtctcgataactagagctagctgcatggttagctgcgtgatgtcctggcttagggcagatgtcagatattgcagtctaaattattattggggtatacttattctattttatgatatgcagtgttgcctgactctcgaagcataataaagccaattgagatctttaaaaaattaattattattgatttcttactctgaagttgctcttgtagtgggtttttgctatatatattttttctttccttctttttttcttgctacattgttcctgctgttatttggaaggcactaggacattttgcctcttgaacaatgaaaggatccagatcgtgtctgtctcacattttgttatcccagtacaagactcaattgaataaaacatattacccatctggcctggaaatctcagtggcactcaaaataacttactaacaagttgttggatcatgatatcttgagattttctgaaagttcagcttctttttagctgttgctaagagagaaatttcattgacatgagggacacgaggacatgtctgcacactgccagttgttttagaggcatttggctctgccgccttgcagatggttagactctgggtggtgggtgaatgtatgctgattatcttattgaattaaggtaaccttttgtcattcattgaattctgcagaccagttggtcagtgagcagctgctccatgtggcttggtttgggttttgaagtacacaaaaactatcttaaagggtggtcagtctaatccaggtattcaacaaagcaatattgaaagccttcttccccttttgacactgttttctgttctgatggaagtgaatgagcaaaaatatttttactttttgctcaattaactaaatgattgaagcaaaggtttatggaatggccgaataagaattttttaacctagtgctttaagttgaagaaaatacactttcataatatttggtgtcagaaacattctacttttatggcatggtcttatgtttgaagatacgtggtagagtttttaaagtttatttttacaaatatctagaaactaaaaagcattcttttttatcatgcatgcttaataacatcatcttgacaaatactagctgcataacttttggtttgtagggttgttttaagatcagttttttgtttgtttattatattttaagagacggtgtccctgtcttgcccaggctcgtcttgaactcctgagctcaagcaatcctcctgcttcagcttcccaaataactggaataaatctgccatattttttctatatggcttccatttcagtttctagaaactctttcaggaggcttcattttaaataaagaggttcttaattgtttttagtaaattgctgaaattgtatggctcatttctcttctcagagatttttatcttgagctgatccttttggttttactgaaggtgcaatataggtaacctcagagaaagtgactttagccactagttgatttgcttattgtcagagagaaatcatttaacagtgattgatgaggaactgtttaatttctccagtttagtcacctgttgggccctagagcctttcgattcagagctcactgtttcatttgcatttatatcctagtaactatcataatgtctaccagtatttattaagcacatattctgtgctgggtgtcgccgtttatatatgctctttcattttgtcctcaccacaactttatgaggcaggtcttgttagctccatgttagagatgatacagcagcctcccagggatgttcattcacttgtctggtatcatgcagatagttaatggctgggccatattggagtccagggccttcagactctcaggctcatgctcccttctgccctgctgctgttttaatgaaaatcagccttgttctgaaccacagttttacaatgaagcttaagattaaactgaaaatgctcaagttctctgttagggcttcagattctatgtctatacttgtcttattaatggtaaaaataatgtaacaacattaaagaaaaattttgaagggtgaaacactgtttagactcttgccaccttaatacaaccgttttgtttttgcttatttccttccagatttgtttatgcgcgtgtcctttcacacaactataatcaaagcatatatacagctatgcagttttttttttaaacatagtgttattttatacatattttctttttaaatgttcttttttgtttttgagatggagtctcactctgttgcccacccagactggagtgcagcggtgcgatctcccctcagtgcaacctctgtctcctgagttcaggtgattctcctgcttcagcctcccttgtagctgggattggccatgcctggctaatttttgtatttttagtagatacagggtttcgccatgttggccaggctggtctcgaactcctggcctcaagcaatctgcctgcctgggcctcccaaagtgctgagattacaggcgtgagccaccacgcctggctttaaatgttgttctttaaaaagacttttcccacctctttgaatttcccaatctcaacgaggtcccttttataattcgaacaaaggaccatatgctttttcttattagcctttattatagtctaattatgtatttatttgtctggctattttgtaacttaagttgtcccctctaaatggaaaagcttcatgaagacagggaccttatttctgctgtatggatgcaagcagttatttattaactaagattaagcttctgtttatctgttacctcatctgtcagaaacagttggacagattttcaccaaacttagaaggtttttgaagggcatctgtggtgatcaggagacacatgacatatattttctgatcctgtgtctgagataacatacagagatttcaaacatgagacctggctgggtgcagtggctcatgcctataatcacagcaatttgggaggctgaggcaggaggatcagttgagtccgggagtttgagaacagcttgggcaacttagcgagaccccacctctacaaaaatacaaaaattagacaggtgtgatggcatgcccctgtagtcccagcgacttgggggtgctgaggcaggaggatcaatcacttgagcctgggaggttgagtctgttgagtctgcagtgagccatgatcacaccactgcattccagcctgggagacagaacaagactctgtctcaaaagacaaaaaaccccacgaaaaaccaaatatgagaccatgagacctatattgaagggcccaagggcagattgtcaagatggcagaccttggtttgcactttagagttgggtagcttcttaacttgggctgttccacatcttaatctaggatgagcagcaacaaggatgtctttatttaataatgaccaacaagtctcccagtcacatactgactaatttcaaataaatgcatttgatcttttcattttcattttgcttgtttaaatataaattgtctattgaaagagtttttttttctttttgagacagagttttgctcttgctgtccaggctggagtgcaatggtggatcttggctcattgcagcctccgcctcctgggttcaggcgattctcctgcctcagcctcctgagtagctgggattacaggcatgcgccaccacgcccagctaattttgtatttttagtagagacggggttttccatgttggtcaggctggcctcaaactcctcacctcaggtgatctgcctgcctcggcctcccaaattgctgggatgacagatgtgagccaccatgcctggcgtttttttgtttttttttttgatatggagtcttactctgtcacccaggctggagtgctatggcacgatctcggctcactgcaacctctgcctcccgggttca

SEQ ID NO: 61578 - DNA, 2525 bp, Homo sapiens
aggtcctgtagtccccatgggaataagaaagcaaaagacaaattcacttgggtggttactgtaggttgtcatatgttgtttatttcttcagtgactgataggctgtaagtctgtcagtttcttagttgttttcttagttgatttttcttttcttttcttttctttttccgagacagagtcttgctctgtcgctcaggctggagtgcagtggcgcaatctcggcacactgcaacctctgcctcctagttcaagggattctcctgcctcagtctcccgagtagccaggattacagccatgcgccaccacacccagctaattttttgtagttttagtagagacagggtttctaccatgttggccaggctggtctcaaactcctgacctcaagtgatccacctgcctcggcctcccaaagtgctgggattataagcgtgagccaccatgcccagcctttcttagttgatttcatagtcatcctgtacttccagtcttgccattagcaaatattgagtacttgctgtgtgcagggttagaagttacttctttgtgtgagatctatgttttgtgtgtgggtggtgtgtgtggggtgtgtgtgtgtgtgtatgtgtgtgtgtgtttgtgtgtttaaaagtagacttttttttgaagagcaattttagatttacagcaaaattgagtggaaggggcagagatttctcatgtactccctacccctacacatgcacaattttccccattatcaacctcccccaccagaatggttgttacatctgatgacacattgtaattgcacagccttatcacccaaagcccatagtttacattagggtttactcctggtgttgtatattctatgggtgtgagatacatgtttaaaaatattttgtattagataaattggggataatagtcatttcaagaacaaaatgttggataaattaaattagctaataaacacagagtgctttaaacattcctagtgcaaaataagatcttgttgtttgtggtggtggtggctattcaggcttaaggtctagattccacttagtatgtaagtaaataatagcaatcctggctgtcatctgtatgtgtaatgtagtaatcagttttgtttagctagttcttatgtgtagcacattaaagcaatcttgaatagtgaggggacctcattactagattaccattaaatggtaatgttaagtgaccctgaaaccaaagtaatggaaaattgtcttcctttttttctttttttttttttttcccttgagatggagtcttgcactgtcacccaggctggagtgcagtggctcatggcaacctccacttcttgggttcacgagattctcctgcctcagccacccaagtagctgggattacagatgtacgccaccacacccggctaatttttgtatttttagtagagatgaggtttcaccatgccggccaggctgatctcgaactcctgagctcaagtgacctgcccacctcagcctcccagagtgctgggattacaggcatgagccactgtgcccagcctgtcttcctttttctcaaacatttaatttgctgtttcttgatcacatatcatccttctttcctttcaaggtcaggggagataattttttactgtatgtactgctgcatcttcacacaaattatcatctgaaaagccttctcagatttgacaaatgaagtctcttttcattcccaggaggaacttgttaaaccaatgaagttcaaaattctaattcctgttcctttctagtgtgcaccactttattcatcttgaataaacatacaacctcaagcatcctacaaggcaaatagattcctttttaattagtggctctatacacagagttttatcatcatgaaatttataaaccaggaagggaacaaatatttacacttgcaacttcatgtcaacattgcctactatttgaagagctctgaaattgtaaatgtatcaccccctccttcttcccccactccccacccctgccggcttttaaactatggcagtagaaaaataggtttcaactttctaggagcacatctctcctatgtggggaatgtggcagattctttatataagtgctctttctttgtgactggcattacttttttttctcacaaagatttgtttcagaagctaatcttcatttttttggttgttgctttttgtagtactatttctaaggcatctccaagtagaaaggcaaaattttattttgagaagttactgctttcatagttacacagaattatttctcaatttaagtaggccttttattccaggacaaaattaagccagtcagaaggtttctgggagaaaaataatgaagagctgaggttttgtatgttaatgtgggcagtctaatgcttgataaaagaaaacttttggctgggtgtggtggctcatgcctgtaatcccagcactttgggaggccgaggtggtcggatcacctgaggtcaggagtttgacaccagcctggccaacatggtgaaactccatctctactaa

SEQ ID NO: 61579 - DNA, 2722 bp, Homo sapiens
tcctgcctcagccttcccagtagctgggattacaggcatgcgccaccacgcctggctaatttttgtatttttagtggagacagggtttcaccatgttggccaggctggtgtcaaactcctgacctcagataatctgcccacctccgtctcccaaagtgctgggattacaggcatgagccaccacacccagccaagaaaacttttaaagatgtgtaaatatgcagtgatttaaaaatctcagttgaagcttgttaaaatgtatcaaaataatttaggaaaaggggggctgattttgccaaaatttgggagatgcatactttttttcaaggctttactgcagttttaaaaaatattttattgttttgtaggcagcttctgaaccagagtaggctcagagactccctttattgcagttttgatgctgcagaaagtgactgcttaatttcagctgttgaggatgttggttatactatgcctggatcaaaaaaatgattttacattgcttagtttgttaaaatatgtttaataggttaatctttttttcaaagcatcaaaaataattaagatgaaatatcagataaaccctatgtctagaatgaataatttagttctaaacatcctggatgctaaggagaaaagaacaagatgttggtttataaaattcttattgtcaaataaagaagcatagaagtttgaagaaagataatttttttgtttttattttttctctctgaatttaggagtaatttatgtttgggttctaatcctatgttatcatcaaagagtaataacattggcaatcttccctcccattctgcttcatcctccccactaaagggaaataccagattgtaaaagaaaaaaaaaaagcatgctggttgtataaaaagaaacattttaaacaaataagaaatatatatattgaaatgcagtctccctgaatgatgctaaacccctgtccaagtaggcatttctcagcccacagaaagggatggcattaaatcacagctcaatggagacatttttatgaggagctgtgatggtttgtgtttagcaaacatgtattgggcatctcagatttgcctgttagggatgcaacagtgagtgagatactatttgttcccttaagaaactcaaagaggaaaggggttgacttgttcagtcagtgacttatgaaatatttcatactcattcatttacagagtactttttgtaggtatagtacagcgtggtcagccagggagactatagtgggtgcattagtaactaaccatacaactaatgctaatgttgcgggctgactgggtttggggtgaacaaatgacccctaaagctcaggagttctagaccagcctgggcaacacagtgaaaccctgtctctactaaaatacaaaaaattagccgggtatggtagcatgtgcctgtaatcccagctactcgggaggctgaggcaggagaatcacttgaacccgggaggtggaggttgcagtgagccaagatggtgccgctgcactccagtctgggtgacagagcaagactccatctcaaaaaaaaaaaaaaaaaaaagacatttgttttggctggggaaggctttgcagagggaggtaacttctagattgagatttgaagtcagagtccatccagaaagtagggaagacattttatgtagagaagtaacaagctacagggatcagaggtatgaaccagggtgcatgtttgggttatggtgagtggtgtctggccaaactgtgtggctcagggtctttctgcttcaccatctttagcatagaagccttccttgtgctcacttgctcatctcattctcacaaaatagctgcttcatatctaggcaccatctctctattcccacaggggaaagagggaaagtgccaagggtaacagcggaaacgtcttcctttttattcaggaaatgagggactccccaaggcttctgcttatatttcattggcttgagctgagccgtacaaccatcactagtggcaggtagtctgggatgtcaagaaagtagcttcccagtctctttggttagaaggcaaaggagaagatggtgggaatcggtttgcatcagtcactctacacattatctgctttgttagggcagcattatcttagtattgttaccaagttcagggtcttttctggggtgatcaagcatcctgggtcgcctgggaccaagtggttttctgggttgtaggactttgagtgctatagcctggaaagccctaggaaaaccaggatggttggccatcctagtctttccccatatcctctgttgtccaaaaatatggaagcaggtcatttcttgacataggagctgccttgactgggcttaaaaaggcctgaaaggcagcttaataatttacaatgagaaataaatgatattggatcaggggaggatactggaagaagagctccatgggatttgcttggtgctcgtgagattttgactgacaagagatcttagggctactatattacccaaattcaggggactctgttcactttgccagcagcctgggattaattctgtagtgctaatgccattctgagaagcctttcaatgaatctgagctcagggttcttagtccccctgttactgaagcttctccccagacagtgtcgtttttgttttttccttcctttctaagcttctggtgctgactagtctccccttctaatggacagtgtttagatacgttat

SEQ ID NO: 61580 - DNA, 4591 bp, Homo sapiens
tgttggccaggctggtctcgaactcctgggctcaagcaatcctcctgccttggcctcccaaagtgttgggattacaggcgtgagccactgttcctggccttatcttactctctctttttttttttgagacggactctcactctgtcttccatgctggagtgcagtggtgcagtcttggctcactgcaacctccacctcccaggttcaagccattatcctacctcagcctctggagtagctgggactacaggtgcagctaatttttgtcattttagtagagatggggtttcaccatattggtcaggctggtctccatctcctgacctcaggggatccgcctgcctcggcctcccaaagtgctgggattataggtgtgagccactgtgcccaaccatctttaagcctccttaaggaggctgtgtctctaacatgccctgttggttttatagttggactctcactggacagcctcgtttttctaagatttgggggttataaggatcagagttgtccccagttggctcctttcacctcgtccataaggttgttgtgaggcttcactgaggtaatctgtataaagtaaggtgctggcctgtaccctgtacatcactcagtagtggtgatttcactgccctttgcctcctgcctttggcttctggctatctccaaacaccccatgccttctgtgctccaccctctgttgaaacacaggaatctaaaaccattcattgatactttttgagtgattatactgaaaacaattgcatgttgtctcatgcagaattttcgtgttaaaccctgtgttgcaaggatgccattaaccagcacacagatggcggtggagattgattgattgagatggggtttcgctgtgttgcccaggctggagtgcagtggtgtaatcgtagttcactgtaactttgaactcctggactccagtgatcctcctgtgtcagttttccaagtaactgggactacagtctcatgtcactgtgcctggctaatttttaaaattattttatagagctggggtctcgctatgttgcctaggctcttctcaaactcctggcctcaaagcgatcctcctgcctcagcctcccaaagtgttgggattaccagcgtgaaccaccacacttggctggggatggagttttagacaccagaggcttccttccgaggttgacctagaaagcacccttggtgggtgccatgggatgggggaatacagtcaaaaggaacctgctcttcccgctgcgcctccacctgaggtggatgtgtctgctggggctgctggagtctccatcttccactttaacttcacttaagagctgaaagctctgccccttcttcaagattttccctgctgtctccccttccctgctcaaccagagattcctcttattcttcctcttgctattagtattaatctggctcactgactcttttccttaacctcatcctaaaactgtctgatgcatattttatattttcttgcatgtttgacttttagttagtattttacagtaatttcgttctgcagccatcctcttatctgataccctggaactcattcctgtgcctatcagttctcacctctggtaattaaactttgtaaaaaagaaatgtgacatttggacatattctcttattagtaaaggtattattgtgtatgagactaatgctgtgcatctataataagttgtttcaccttgtgaatactaatgtaatttggaaataaacctttctttgttaaagactttttctacatgggccacgtttttccagacctatttcctaataatttgtggtttttaaaggtatgtcaatagagatgctgtagccagcatggctggattctgttagataaacattttgtgagattgcttaccttaaacaattgtctttaaaagttaatttcttccctaatgtgtcagtaaggaaattctatagtatttaagaagcctgataaagtccagttaaaacattttgcattgctctttaaacatcttttctgagggttgatgtgttcgtgtttgtttggttcacatagtttcttctgaattttaagaaagctttgtcagaatcagtaacttgcctatagtgtatttttcatgaccatatggctttcttcatcaaaaacagctaagtaaaaatttcagtgaataatagtatatatatatgggaatgtattcctcatcatttgtatgctcttgagagagtgactcatgtactgttttctattgagttcccgaaagtttataaagagatgacaaacaattggctatgggattgaaataatgcacatgtaaaatggaagggaaaacatggaaacagtttcttcctttgttcttcccttaccttgatgaaatttttaccacttaacgtttttcagtaaagtcaaggtcagtatcagagcctagtacggttctgcttgccgctgtctgaggattacctgtcttattacagaatgtacatgctcccagaggagaagatacagtttgatttcaggatgacaaacagctcttctgggacaatagtgtcaagtataaaaggattataaaggttttaggaccatgggatggtttgaaggggaaagggtgaaatgacagttaaggttggcatcaccgaggtcccagttgttggctgccccctacttctcctgttcccctctggcagtattttacagatgtatttcctttgacctttcctttagtaggaagttgtaggctttaagatccagcagaaaaaaattatgagccatttgtgaccctcttgagcagtccttcaggtagaacacatttcataagagctagtgaatggtcttgggtaattaaagctcactttatgattatacagtgtggtggccagcccagagggaacatcacaaatacacattatgaatgtatagaattgagactttatacctggagactgttggatgacctggtcctctgcccccaggcctacccttctgcccatcctcatccaattctgttttgatttttaaaaagtatgtgcttcttagccctctcattgcttcactgtgaggggaaaaacttttctattgaggtgctgaagctgtgctttccaggactcatacttatgtgctgttgaatgagtctcagtgctcctaggagtctataaaaggaatagaagacttcttttctctaactcccttatggtttgtattttatctgctaagagacactggcatttcatggagatgggagagaaaaagacacagcctacttagacagttcctttattccaacatatatactcacttcacatattcatagacaccttccacctagcatcaaattctgaactcatagaagacttaggtgtttttggttttgtatgcatagcttttgaaatccctgggttgaaaattttctaggtgttgtttgtatgctctagtcaagcccaggacataaagggttatgttaaaattactttccttagtgactattaaccagaaattttatctgtcaggagaaaggattcatgcaactctaagaatgcattgccctctgcataggctattagctttggcaaccgaagatagatgagacttaggctgtgtttaaatttttcattgtgatgagacaaatctattattataaaagccctactttatcagtgagagtgtttccttatgttgttttaattaaaggagcagtgtgtttttaaatttaattatggtaccttgaagatctgatactagctgtaagctaaggattctttgggttttcaagattttttttttggagacggagtttcactctgttgcccaggctggagtgcagtggcgtgatctgggctcactgcaacacctgcttcctggtttcaagtgattcttctgcctcagcctcccaggtagctgggattacaggtgcgggccaccatgcccggctgattttttgtatttttagtagagacaggtttcaccatgttggtcaggctggtctcgaattcctgacctcaaatgatctgccatcttcagcctcccaaaatgctgggattacaggcgtgagctacagtgcccagccagttttcaagatttttaatgcatttggagcagcgctatcctaaagaaccttctttgatgatggaaattttctctatctgcaccatccaatatggtctggtaaccaccagccacatgtggctattgagcacttaaaatgtggctgagactgagaaactaaaattttaattttcttgaaaatgtaaattaattaattaattaatttatttatttatttagagacaaggtcttgctctgttacccaggccggagtgcagtggtgcaatcatagttcactgcagcctcgacctcctgggctcaagtgattctcctgccttagccttctgagtagctgggattacaggcatgtaccaccatacctggctaattaaaaaaaaaaaattttgtagatatggggtctctctatgttgcccaagctggtctggactccaggcctcagcctcccaaaggagaaaatgtaaatttatatagtcgcatgtgattagtggttattgtgttggacagcacagatttagaatctgaggaaactctccatttagt

SEQ ID NO: 61581 - DNA, 5977 bp, Homo sapiens
agaagcttctgcatattaataagaaaacactagaataaatgggcaaaagatataaaaaggcattgacagaaagggaacaaatggccaataaatacaaagagatgcttaacttcattaataattagtgaattacacattaaagcaactagatatgattttatcccatcagattggcagaaattaaagagaataatattctttggcggcaatgagaaaaaatgggtgtactttcatattctgagcatataaattgttcagacctttttggagaaggtagtttggctgtatctttgaaaataaaatcacatacttttaatttggtaattttgtgtctagtgaaatacacctgaacacatgctcattccagcactggaatggtgaaatattggaatgattaaatgtacagtggtacagccagcatatagaatgcgatacctaaaaagtgtgtaagagtgtggtatagatctttatgcagctgatgtgggaggctctctcagatacgtttttagtgagaaaaaatataaaattattacatttatatttgtaaacctcaaaatttatatgtatttgtaaattctaaaacatgcttttcagattttttaacatttctgaaatcagcgtatctaacaattggtgacatagtttactaatttaaactcttggtgaagcatagtgcacattacaagtgataagatcttagatttgatgaaggatgatatgtaaatacgtggataaaggactctaagacagacatgggacgagattgaggaagtgtcagtggagactttgtctgtgtcatctatgttgtcaaattttttttacagtgaaattatattccattattgtgtaacgaaaaattttaaaaatacatatttatattttttagacaagatataattttagacaagataaggttgcctggatgtctctgatgtctgatccatttctctacttgggtgattatgcttgatattcagctttgagaactttaaggcctggatggttgatagagcgttcagcttcattaagaagttaagtagctgtgaagattcagtgggagagaattgagaactgaggtccaagagaagggaggagccgaactccagaattcagggccagttgcctcatggggacctttgcatctgtgtaaagaggttgaaattctctccccacaaggtggtgccaggctttttatactggactgggcataccctggagcaaggctcagtggatgggaggcagaaaatagatcaaatcaaggagccttatccaatgtcattgaaaggaaaattcattgttttgggagagagctaagccctagtgggaaagagccaaaggaataaatgggcttttaaatctgaggaatttacacaaggcaggcaggagatgacctgccataggttggaggcaggctctgcttggatcctgtgtaaacagggcatagtgtgagtgtctccccataagtaaaagctgtgttgtgaagatgaactcacagtttagtagtgactttttgaccaaagatgactcttcaagaagggataaggtgtatggagtatagctcattgccaggactgtgggaggcagaggaaggagaggacacttggccaagatgccatttgagctggtcactgtaggaaagggagaatttggacatgtaattttttttttttttttaagacagagtctcactctgtcacccaggctggagtgcagtggtgtagtcttggctcaccacaacctctgcctcctgagttcaagtgattctcctgcctcagcctccccagtagctgggactacaggcacatgccagctgcctggctcattttgtatttttagtagagatggggtttcgccatgttgcccaggctagtcttgaactcctgacctcaagtgatctggcctggacatgtaatttttaaggagatattcagaagaaaagggaggtgagcccaccatttacaaatgcacacaggaggccgggtgtggtggctcacacttgtaatcccattactttgggaggctgaggcaggcagattgcttgaggctaggagtttgagaccagcctggccaacaatgcaaaatcccgtccgtactaataatataaaaaattagccgggccactgcactccagcctgagtgacagagcaagactccgtctcaaaacaaacaaacaaacaaacaaaaatacacacaggagaatgtgaggagctgagtagtacagttttctcggagtacacgtctattaaagggaagcagtaggaagtaaaatagaaaaaggtaggctagggccggaccatgaagagctgagaatgccaagtttagaaatttgaccttgagtcagtgaactcatgttttacatttaatcttttggttaccaatttttttttgtaccatcattggtttgatttttaaaatacagtcactttgttttctaaggattttatgatatatgttcaaatcttgagttaaaggtaaatagaacacagtttgggtttttttttggcatataaatggttgaatttcaaaattatatttgtgttacaaactttgtttttactctctgccttccagcatttgcaaataaccatttctctttcaaaggaaattctagtatgtattcccattcaataaaagcaaagagctgagctctatatgaataagaggtaaaattgaacatgaaaattactgagcaagattagtgggggatgaaatggatgaacattggggaaagctgtgatccttgttacctttgctatagtgcaatttggaatggcttctttattcctggcaattcctgacagcatttcttttaaacctggccacctttccattgccagctcgaccttgatgttagctggtgctgctactgcaagggctgcctttggcaggaagccttcagtcaactttctgggctctggttttggctctgcacatgccttgctgagaagaccttaagaatctgaaatgtggagggtcattttggggtagggaaatgtggtggcaactcttgagttttctgccacgatgtaacttaacagatcctcttgtttttccttaaatggtacaagggtttgcaccgaaatggtaattcatctgtgtctgtgatgctttaaaaaataacagtttcactaatgtgtcacaacatgtattatttatcattttagtaaatggatattttaacaagcaacaatttgcaaatttaagcatggcagttaacatgatctgacattaaaaaattaaataatctcctgccatctttgttatcagccttgcattaaggattttagcccttctgggagcttttatttttttgttgactctgactgatgatggcagattgtggtagtgatcagagctatgcttttataaattattttttagttggaacaatattggcatgtaacgtggactggcagaattaacattgtttatcattaccagtgttgttttgacagatattctcagttctttaaggaagcagatagggaatgtctgtaatggacatctgctgtccactataggttgcccaataatgagtcctggtaggttctaccttctgctgtggaagccagcagagttcaaatgggcattttctgttcttgcctcctaggaactgcaggggtggacatgcttcttaggcttagcctgttgactgcttccacctggagtttgaatctgaacagtgttagaaaatgcagggacaggctgagtgtggtggctcacgcctgtaatcccagcactttgggaggacaaggaaggaggatcacttgagcccaggagttcgagaccagcctgggcaaaaaagcaagacccagtctctacacaaagtaaacaaattagccaggcatggtggtgtgcacctgtagtcccagctacttgggaggctgtggtgggaagatcctttgagcctagaagtttggggttgcaatgagctatatttgccccactgcactgcagcctgggggacaaagagagaccctgtctcctataaaggcagcgacagttagtagtggcactagagttactaaaattatcaagattttcttcctggatagtcctggttgcacacatcagtgttactataggtggacttagcctttacttttgtacatttcgcactgatacctctaaccaccttttgtgcacatagcagctattataccccccatagcataaccaacctgtgtaagagaagagtataagtcagttgcttgcaaggaactcttaggggtagggagctcttgcctgggggaggtgggggtttctcctctttctgtcctcccctagtcattagagaaaggcctcaagagaataactcagagattacggttgaattcaagagggtagattgacatctcattgagctgcacagaggtaccagccaggtgctgctgtgggattagaatggactcctgagaaagcgttcttgagtgagtgtggtgtggctttcctggagtttggggatgtctgtgaatacagaggcaagtatcttcctctcatctgaaagccccccatgtggctggagctgcccctggggacagtgtatggagagaggacagcaaaaacgcttgacatttcctgtgggcctggtggtctacatggaggacagctggcctgagtctttttgaaagacttgtcctgcctgcgaaggctgcctgccagggctaggcccgcagcagaaagaggttgtgggtgaaccacagaggcaggagctgagaggagactgagagctgagtcaaagggcacccgttgcctgcatcaggcagcatggaggtcccagcaaaggggtctcactagagagagctggcatgtggactcctgcaaatggtggaagatattttacaggctgcaggactggaccacagaaaagtgggcagacctttccctttcctcacacttgccgcctttcattccttggacccctctctttttcctcactgctgttcttaggggaaaagcttgacattggataaaatgaatttggatttagactaaatagactttttaataactgaaagtttggctttatttaagataatattttctttttaaaacactgtctagaaatcagtgggtttttttttttgttttttgtttttttttaaagacagagtttcgttcttgttgcctaggctggagtgtgatgacgcaatctcagctcactgcaacctccatctctggggttcaagcgattctcctggctcagcctcccgagtagctgggattacaggcatgcaccaccacgcccagctaatttttgtatttttaatagagatggggtttcaccatattggccaggctagtcttgaactcccgatctcaggtgatctgcccacctcagcctcccaaagtgctgggattataggcatgagccaccacgcccagccaaaattagtggttttaatgttactaaatcctgaaatagctttccatgatgacaaaatcaatcaacaatctcaaccccagtagactggagtggattttagaatttagcacactttcccttatttatactctgcaggtttcaagcatacaacttgccagcaattactgtgttggctgagaaatttgaaattttactagcttgaacactaaatttgttgatgtaacatacagctaataataaaggtcacgtccccatattggcatgagggaccccttatgaattagcctgaaactttgcagcctttaatcatatttttctctcttttttcccttgagacggagtctccctctgtcgcccaggctggagtgcaatggcacgatctcggctcgctgcaacttcgcttgccgggttcaagccattctcctgcctcagcctcccaagtagctggaactataggcatgagccaccacgcccagctaattttcgtacttttagtagagacggggtttcaccatgttcaccaggctggtctcgaactcctgacctcaagtgatccacccacctcggcctccccaagtgctaggattatag

SEQ ID NO: 61582 - DNA, 4289 bp, Homo sapiens
tgagatccttttggctatatacccagaaggggattgctggatcatcattctgtttttaattctttgaggagccgccaaactgttctttatagcagctacgccattttacattcccaccagcagtgcacagagattaccattgcttcatatccttatcaacacttggtttttttttttttgccattttaatgggtctgaggtgatatttcattatggttttgatttgcatttctctaatgattagtgatgttgaacatctttttatatgcttcttgcccatttgtatatcttctttggagaaatgtcttttgaagtgctttgcccattttttaattgcattagtttgttgtttttttgatttgtaggagttatttatatattccgggtattaatgccttatcagatatttggttgaaaatattttctcccattcataagttgccttttcactttgccctttaatcatattattattattattattattatggttaaaacattaattgtgtaatactgaaaagtttaggaaataatatgacagattttgatcaggtcttaaatatcttcccaataggccctatgagtaaggcataaaaagcttgaattaattccatagtttcaccaaaacgctcttcttcttaatcttattccttatttttttgaggcagagtctttctggcccaggcagcctggagtgcagtggtgcaatctcagctcactacaaccttcacttcccgggttcaagcgattctcgtgccccagccacctgcgtagctgggactacaggtgtgagctaccatgcctagctaatttttgtatttttaataaagatgaagtttcaccgtgttggccaggctggtctcgaactcttgggattcgagtgctgggattataggcatgagccaccatgcctggcccttaatcttgttcctatcaatctttccagctttaccttccccagcatgacttcctcttatccccttcctatgtccaaagattccctaaaaatattctagctctgtaccattccacacactgcttttttgttgttgttgttgttgttgtttttttttgcctgaaatatgggatatgtacctttccctcttgtttaaccttgtttttcagactccttctttttcttttcctttaaagactcagcccagatgtgaaaatgttccagtcagccagtcagctgcttttctctcctatagcctcttaggtacagcccaggttagcacacttgtctgaaagtattgtgaggacttttataaaccccctctctccaggaccatatgctgctagatcacctagcttagctttgcctttttattcctctttgtcatgggcctaccataatatctagtccataatatttgtgtactttagttttttatttatttatttatttttgagatggtggtcttactccatcacccaggctggagtacagtggcacgggatctcggctcactgcaacccccgcctcctgggttcaagctattctcctgccttagcctctgagtagccgggactacaggacacgccaccacgcccagctaatttttgtatttttagtagagatggggtttcactattttggccaggctggtctcaaactcctgacctcaagtgatccacctgccttggcctcccaaagtgctgggattacaggcatgagccacaacacccggcctatttgtgtactttaaacgattatgggtagaaagaaagagcaaatgcctttttagaaataagataacagaactttttaccaattgtgcttccaaatatgctttctcttctaattttatctgctaagattttggcagctaattgtagattttatgaacttacattgggttgcctttgtcttctgttataaaagcaataattagaggaaatgatccttttgagaggttgtttaatgaattctgcttgttttaaatgtgctgctttaaatcttatttcacgtaaactgtactaatgcccaaattatctcaccctagatcagcattgaaccaaagtattatgatgattaatttccttctgttaaatcccttatagtcttttctttggtgtgtgtgtggggtcaacaatcaaagaaagaatttattgactttacatttaatatggtttactctacttgattatattgttcaagtgtgaatttgtgtatggtataagattatgccatactgggattctattttctgttaaacaaatagctttgtgttttattaactgccagtgtttaaatttaatggtttaagatttcagagagccctttttgtaagtatttgaaagtttttattataatcctgagcctaaccttcttctggtttcactgcatccttctccagccttgaaacaagccctggcacagacgcaaatcctggcgtgcaccacctcttcctctcccccgctccccactctaacatgacaagaagtgtctgtcccagaagtaatctgattgtgcacctagagtacctgttttctgcctggggaagaatgcacactgctggacctagagcggtggcaaaagtgccctctccactgtgggggccacagtggtaggcacaacccttatccctcagccccattagttaattaagtcattttacctgcattaaactttacgggcagagaaaattcagtaagtcaccactaccaggtgactttcttttttatgttaccccctagcaaggcatgtagtttgcatcctacagaatataaaagatggggccagcatctattctgtgtcttagcagtgaacttcatccaatagatacttgatttttaaatactttcaccttgtgtcatgattaaatcactaaacaggaagtttcagcttttctttaaagaagtacatcctattaaaaatttaaatgtcttcataactgcttacgctcagtaaatgaacactaggaatctataaacaggaatctatggctctaaaaattgaaattttgggggctgtttcattctttagaacttgaaaacgccataggcaattagctataattcatttgcagattatttttgccatgttaaattaggaattttagccatagcaagcataacagacaagcacacttttaaattattttgttcagcaaaacaccataggcccttatatgtgtttgctggaatttttctttgtcaacaataaatctatatgtttctttagttaaaaaaaaaacagcaacaaagtgtttattgtagaatgtttactttttaaacaaacgtgaaaggcattggtacaaaaagggaaaagcacctaggatttggatcctcagtgggtccaggagtacagcttccttgttctgcagttactggaggcagtgtggtgaggggaaggatgtgggctttggactgagctgctgcttctacctgtgctatgactttgcacaagttaggagtagcctttttgagctttgttttctccttagaagatgactaagatcatgtttgcacatagcacatgacacaaactcatgatactggttttgttttttctaacattgtctcagtgggtcttcactgccttctttctacaattttttttttttaagggaatagggtcttactctgttgctcaaggctggagcgcagtggctgatcattgctcaccatagcctcaaattcctattcactgccctcttatatagtggataatgtgggcgttagtctcatgcagttaagagaacaggttcaaaagaagttttgaactgtctgttttattttcacaaggccagtcagtgacagagaaagaacttccacttgggtgtcctggctctgtgtcccatggttttcctactgaaatactattactgtgctatagcagaagaaagaaggctaagacagttctgtgcttacagtcaccttcagtttcaaatgtaatcatatcctgggggaggggaaatgaaactttgagtttcatctcccaaatcattcctttatttagaatcaaccggctgggcacggtggctcattcctgtaatcctagcactctgggaggctgaggtgggtggatcacttgaggtcaggagttcaaaaccagcctggccaacatggtgaaacccccgtctgtactaaaaatacaaaaaaaaaaaaaaatagccgagcatggtggcaggcacctgtaatctcagctacttgggaggctgaggcaagaaagttgcttgaacccaagaggcggaggttgcagtgagctgagattgcgccactgcactccagcctgggtgacagagcagtactccatctcaaaaaaaaaaaatagtatcaatgaa

SEQ ID NO: 61583 - DNA, 3084 bp, Homo sapiens
ctaattttgtatatttttagtagagatggggtttcaccacgttggccaggctggtctcgaactcctgacctctggtgatccacccaccttagcctgtcaaagtgctgggattacaggcatgagccaccgcgcccgacctctaaatgaatttttaaaactccagcatctcacaaatggttcttgaataatttttccttagcctgcagtgtttaagttgggttttgaaggttttgttactcaatagtcacccttttttgggtgtaagtttgtcctctactcctgagtaagtaagtgaccttagggcagtattaccatgaaacagatctcacaaataacattgataccaacatcattatttttggtcaaatgttaaatagttaaaatttgtcatcctagtctatattgaactaatttgaaataccttatatttaagcaaactttattgtttttaacatagcaaaacaattaataaaactttaaatcaattacacatgaaacagtaagaaagcagtgcaagattaaaatctctaggtaagtgttctatagtgtataagtaagttctgtagaacttcagaaaaaagagaggtcagtaggattcttagagcaaagtgtgattttatctgtactttgggtcagaataacttttctgattttttttattactaacatacctaaacacagataatgttaacattaattaagtgaccttagggcagtatcacaatgaaacatctcacaagtaacattgatactaacacaattatttttagtcaaatgttaaatatttaaaatttgtcatccttgtctatattgaactaatttaaaatatcttattgaaatatattattaattaattcatatcagacttagctagagacacctaatgttcaaaacagaaagtagaggtggattgggcccagttggctccagttgctcagaggatgtggtcagtgctgtttttgtacatcttgagctctgctcactctgtctgcgagtaggttttgcgttttgcttgttggctgtcttgttgggggtgggaaaatggctgcccataccttctgccaggtgggcaaccccaaagacttttcttttccagcgcacgtgtaggagcagcctgttggaggcatgtgcccatgctttagactgtcacccaggtcatgaggactgtggtttgaagagtgtgctcactcaactggctagggggtgagggcactgtgtttgacaactgtcaaggactagcgaggttcccagatgaaagggggtgatataccagaagaagaggcatgggtgggaaatgtgcatagcagtcccagccaatagctatcactgcctaccacatagtgctacaaaacagcgtaagaattattcattgagtgcaaatgttgggggagtgggggttaaacagagacctattctaagtgattcttgactgtttgtccaggtgtcattccttgttataggagttttaaaagcagaaaattctcaactgctcattcacctaatactccatgaaagtatatattcttgagtgtcctaagtgtgtgtcctttgaaatgtttatatatataaaagatattttaagtataaaatcttaaatatcttttacacttaaaatatcttttatattttatatttgtgcttttataagttaaaaaatgtgatcaccatgaccctctacttggatgtgacaaccctccattttataaaataattaccgttgaatcaaaatttttgctcaacgtatgctatccagttacctgtcaaagccaactgaatgaatgatgaaaaggttcagatcaaaagcaactggcttaacttcacggaggttttcatgctttaatttaaaatgtgtctatgtctaactgattatctctcacattttataaagaaatattgacgttctgtaaagtatgtagtgacctcacttctggctgtgtgggcaggtttcactgcaggcctctgaagcattgatattcctgtaacctttgaggcaagatgtgtgtgtagtgtattaatgagctgattgaagtgatgtacagtaatttcatccttgggtaaaaacagatgtgaaagattctgttttaatatttaatcagcctccaagcctctgttggcttgtttaagttgacctgacagcattatacctggaaacactttgaattaaactctgagtgcttgaccttgttcaaacagttgtaatttaataaggctgctgtcttggtggagatagtgtcgctaataggcaaatcctcttctgactgggattgttctgtttgtgagtgctggggttggagagattcagagattctcatcagtttgtggggaggaactgggatttgaagaagtaaaaacaaatctaaattaagaaagtgtcttttagaagatctttaaaaacttttattttaatttttagacatatagaagtaatgtttttaatgtcattttgattaggctcattttggttgaaaggaatggaaaatcatttgttaaaaagagagctggaaacttgtcagaaatcaaagaagtgctaggaggactgcatactcactctggctctccttgtcctcctgtccacccatccctccacccacccatccgtccctgcttttctctgtctctgtcttgggcgtcctctgcacgatagcctgtctgctctctcctttcttctgttggctccctcaatctctgtttcgtgtacttctctctagcccatagctcctctttactaatcatttctgttctctcatgccatcagtttgcaggggctcttggtagtttcagctctcttgtatcctttcagctctaagtcttgctgtcaacaagtttgtttccttgttcacgttccagttagctgggtctgaatggctctcctgatcttttttgtgccatatccaaattgcccatgctttccaaagcagggggagctgtggacaagacagtttttggcttgaaggaaagattagttggggcaaataccatgatttgcccaatataaatgcgtgtagatatatattttctggttctaagagtaccatatgcttactggggaaaaatgagaaaatttaaaaaactaataaaaataca

SEQ ID NO: 61584 - DNA, 2678 bp, Homo sapiens
taggaagctgactggctcttctcttttaggagccctcccagggtggcattcattaccttgtcggattgccatggtccagtgtgggtagcagaatcctgagagacccccagtgaccctgccctttgtattatatcttcccctttgagtataggtggaacctatgcatgtttgagatatcacccatgattctactaccttgcttggcagagggagactatccaggtgggctgatctaatcacacaagccccttagaaaccatattctccagcaggtgggaagaaagagtgatctgaagcatgaataggatttgatgttgactgcgaagatgaaagggaccatgtgccaagcaatgtgggtagcttctagaaactgagcatggtccccagctggcagccagcaaagaaacagggacctcagtcctacaaccgctaggaaccgaattattctaacaacctaaacgagcttggaggtgaatttttcctaagagctcatggataagagcagagtctggctgacaccttgattttggctctgtgagaccctaagcagagaacccagctgagcctgactggatttctgacccactcagctgtgagctcatgaatgggtgttgttttaagccactgtttgtggcagtaagactaatatagtccagggtctggctaattcttagctttgtcagattttaacttgattttctgtggatatcaagggtggagctgtctctcaggggtagacttacaggagcctagctgaagaaactggtgtatggaatcaggaggccagcatatttatttgtttatttacctgaaaagtaaatgttccagggactgagatactccatgtggatggtcagtacattatctcccttaaggcagacctgtgtaggaggccaggtgtgtattagtgagcatggcatccaaaccatgagttagatgagcacagtttccatggcatcaaacacctgtctcacaacaaggatggccttctctatgtctggacaatgtttagatgggtactgccagcttctctggagactcactgtattagttttcaattacagtgtaacacataaccacaagttagcagcttaaaacaatgaaagtatattatctcacagtttctatgagtccaggcacaggtaactgggtcccctgctcaaggactcaccaggctgaaatcaaaatgtcagcagggatgtggtctcataagctcactggttgttggtggaattcagtgccttatggttgtaagactgaggtcctcttctcccagaggctgccctgccacatggccctctctacaatgtagcattttgcttcttcaaggtcagctggaaaatctcccacacacttttggtctttacaatctctgaccccctttaaaagcctagccctgtgtatgctcatagggagagattgtacaggggcccaaatcttgagggcattgtaaaattctgctcccacacttgctttcccctcagcatcccttgatgactggccagctttctgtttgacacctcctttctttagctgtgttaatatatccagtctttgggagtccaggcttggttggatatttcacatctctgaagtgactacatagttcttctcacattcagtatgtattgatttttaaaatttaaatttgtgaacttaatcacacctttatttctgtgatcctcccccctttagtaactggggaatgggatgaggaggaatttcttcatcttagtttcagaagtcttcacagcagtggcctctatttgtagtttgatggtctaaggagtttagattgttagagaacttctaccttcactagaattttgaagacgtaacttaaaattacacttactagatgtagaaactggggagacaaaatgagttatttgcacagttaaattattagctagtgaagaagggtttttatttcttatttatatcctgccttctctcaatatgatgatgtccagtaaaaggcatagatagtctaaaagtgaagcaattaaaaatttttctattatgggaatttgacagtacaaaaaaacacagatgtccttgcccattaaagtgaacaccaaggagtccaaaatattttcatgaggtagttttttgccattgcctgtcagttgtgagagatcattgcctcaggccacagcgactaggtgtgtggcagagttaacctgcctgctctctagggaaaccgtcaagaaatgggcaataaattaataagtagaaagtgttctctgagctccaggcagttgttgattgactgatggaaaaggtaggcggtaggctaatagacgatgacatccaaattcagctgttgcctctcagctgaacccaaccctgggcttctgctgccttttgctccttttccctgagtggtggtggcctgcaggttaaacaggtgggcttgggaattgggctgcctagggtaaatcctcattcccccatttaactcagtctgccagactctgttttcttgtctgtaaaatgagggttaaaagagagtctctgtaaagcatttaatacgttgttgggcactagcggtggattaaggagaagagggctgtgatgggagctgtcagccccagcaggcaggagttagaattgtctggaattgccggtgtagggtgataataaaaagcaaactgactcttggtcggtttattact

SEQ ID NO: 61585 - DNA, 1706 bp, Homo sapiens
aggcaggtggatcacctgaggtcaggagttcgagaccagcctgaccaacatggtaaaaccccgtctccactaaaaatacaaaaactagctggacgtggtggtgcactcctgtaatcccagctactcaggaggctgaggcaggataattgcttgaactcaggaggcaaaggttgtggtgagccaagatcgtgccactgcactccagcctgggtgatagggactccacctcaaaaaaaaaatcttttttttccctttttatatttttgtctggatcctaaatattgggacatttgaaagatgtgcatatttagtttaagcaaattctggtggatttggttggttctctctgtagtaagagtagagaagaatggtagatgtgaaaagaatatattctgaaaagaatatgggataagagaaaatcaagaaggcaagaaaataatcatttccacccttttatctactttgaaatcaccacttttcttactttggtcttctgtttcctctataaactatgcttaagagaccagagtgagcagacttcttcgtgaaaacctgagcttgggagttgggatggtttacagtcttggcttcagtccacttttctgacttaacacccagacccctttccggctaaatttattgtctcctgttcctgctgggcctttctggagcgtccgcctctggagtgccctctgctcttgaggtcccaaactgcccatcccacacctacctggtcacagctttgcagtttaagtccccacatgccagtgactgcttcctttctggacccctttactgcatttcagcagtgctgtcaatccttcctttaaatttatgtcactggtttgtagggctcattcttccagcctgcagacgtcagttgagattccactgtgatcaaagcaggatatttaagttctgcagcgggtgggctgcaagtggtagaaatagttattttcttgccttcctgaatttctcttgttccattctcttttcaggatacattcctttcactacagagagttgtctgctctcactacaaacagaaccagccaaacccaccacgatttgcttagacataatgggcaagaactttcagaacatttggaacttttcagaacattgggtggtcttagagactagccagtacagaaatctcttgagagggtgttactgtgttccttctggacacctccagtttctgatttggctgtcctgtttgtcagcagtacatccttcatattgagcccaaaacctccattcattctggtgttcttcagtgcagtcacactgcttcgtgatggcttttcttcagtgcagtcatttgcttcatgtgacttttcttttttctttttctttttctttttctttttttctgaggcagagtttcactgttgttgcccaggctggagtgcaatggcatggtctcggctcactgcaacctcctctgcctcctgggttcaagcaattctcctacctcagcttcccaagtagctgggattacaagtgcccaccactatgcccgcctaatttttgtatttttagtagagacagggtttcacaatgttggccaggctggtctcaaactcttgacctcaggtgatgcatctgtcttggcctcccaaagtgctgggattacaggcgtgagccactgcacccagccatgatggcttttccaatgcaaaacattgcaatagttattcctt

SEQ ID NO: 61586 - DNA, 1360 bp, Homo sapiens
atccacaagtctatatgtgaagaggttgagggaaaagtaaccactggggacatgagaaatctgaaaagtaatagttagaaatggccatcttagccttattaaaatgtaagtaaggccgtgtatggtggctcacacctgtaatcccagcacgagaggccaaggtgggcagatcaccttaggtcaggagttcgagactagccttgccacaatggcgaaaccccatctctactaaaaatacaaaaattagctgggcgtggtggcatttgcctgtaatcccagctacttgggaggctgaggcaggagactcgcttgaacctgggaggtgaaggttgcagtgagctgagatcgcatcattgtactccagcctgggagacagagcaagacaacatctctaaataaataaataaatataatgtaaggcaaggccttttcccttatatctattttagggtttacccttgtgtatacagaaaaattgttccctgtccagcttattatgggctggatagcaggcagaactcctcagtttgggttagcattgcattaacagaactgccacatctttctggataatcttcctttgtgcataagctccaggctcaccttctctgcctcacagctgtgcgctggtttcccttagctttcttgggttctggatggatactggccttctgggtgagaagggggttctttggcaaaaggtgtttttgacataatttaggaccttcttaagttctacagcagacctaaatttcttcccccaagttctttgtctatatagagtactcagcactcattacccattctcagttctgaaggaaatcttatggagcagttgtagtatttatagggtaagcagagtgcccagtttccatgccccaccccaaaccatttagatttcagtcatgtatgtcaagggaggagtgagtacatttttgtggtcagctgcctcttcttttccctaacattctcactttttcatctttcctgctttcttgaggtcatttatctattgaataggatgtctattgaaaggaaaaacctcccctaatcgcctttaaactaatatttcttactgggcatggtggatcacctgaggttgacagtttgagaccagcctggccaacatggagaagccccatctctactaaaaaaaaaaaaaaaaaaatattagccaggcgtggtggcgcatgcctgtaatcccagctatttgggaggctaaggcaggagagtcgcttgaacccaggaggcggaggttgcggtgagccaagatcgtgccattgccctccagcctgggcaacaagagcgaaactccatctcaaaaaataactaaactaatatttctcttttctcaataata

SEQ ID NO: 61587 - DNA, 1278 bp, Homo sapiens
ttaatattacaaaggacttttagactggcttcctcctaaacatttcttcaactcctatcaagttcagtctgcaaatatcctaatttctaggttgtttgggaatgttaattgattgtctcatgtatgtatgtatgtatgtatgtatggatagacagatagatgaaggttgaaggatggatggatagattaaatggatggatggatagatagatagatagatagatagatagatagatagaaagatagatgaaggttgaagggtagggctggaggaggaattccagctttccagtagattttctatcaagcagtcattcatatatataacttcctatattgttagccaaagttcatccatgtctcttgtatttagctctctgtctgtattgtagaaagcttatttattatgtgagcattttgctttctcctatccctccctctttctttaacatcagttataacagctgtgaatacagtttataatatgagcagccatattcagtttttaggctttcaaaatcacaaatacaaaggaggatataatacatagtcctatattttatacaaattgggacacttttcttcatttcttatttcgtggcattgcctaactatagtcaagctaatgacccatgtagatgtagtgttgtacctggtgtccgtgtccctgtgaatgtgtcatgttgtgctggcctgattccccaacatcagccccagggagccagcagctggagcagctgtcatcttgtgaaagcagagtgtccttgttgctattgattgggttgttcagtcaattgcaaaaaagtggatctaactgtcaatggtagttatatgataatcctggagataaataagtgtcaagtgaagtattacttgaatttaggacttgaagagagagaaaggggtatgagtagttggaggggaagatttgctatgacaagctattattcagtgtggttattttgtatgacaggtaagtctacaggtatcttttgttagataaatcagaaattaagcattccctttgtaaactccaaacaagattttgaaacaccatggtccccccttatccacctccaagatctccagtggatgtctgaaaccactgatagtactgaagtctctatatattatgtttttcccctgtatgtaatacatacctgtgataaagtttaatttataaattaggcacaggaagaaattaacaaaaataagtaagaatagaacagttataactatatgttctattaaaagttatgtgaatttgttttctctctc

SEQ ID NO: 61588 - DNA, 2285 bp, Homo sapiens
ggcgtggtggcgggcacctgtagtcccagctacttgggaggctgaggtaggagaattgcttgaacccaggaggcagacattgcagtgggctgagatcacgccagtgcactccagcctgggtgacagagcgagactctgtctcccacaaaaaaaagaaaaaaaaaaaaagtattacttatttagtaagtccatagcattttgttcacacagtgtatcattgtgcttttctgtttcaaagtgtaattatttaatctagaaattttaagtcctgtgacagaaaacaaatgctgttctcacaaaatatgagaaatcaaattccatcttattatttaaattaattcttttttaactgaagaattgttatgtgggtagctttcaacataattttttcaatattagatgcttataactaatgtggatttagttaattcgatgtttatcacatttaattcttatttactacaaaggttaaagcaattttatttcttctggaaacttttaggatcttgtgagtgagggacgtcagccaaaattggcaactttttcaagcaactggctcaagaaattaggaatttctctaataatgagccatcgttttttgaattcaacaatttaaaagggctgcatagttaggatatgattccagtttcccctcagtgcaaattgatatttttttctgttgacacattctactttgttttcgaagactagtttatagtgttcttttaaaagcaaagaaaatatctttaaaaatcccagctttttggctgggtgcggtggcttcatgcctgtgatcctagcactttgggaggctggggtgggaggatcactggaggccaggagtttgagaccagtctgggcaacacaggcactccatctctttaaaataaaaaataaaaaaataaaaatagccaggcttggtggcccacacttgtagtcccagctactcgggatgctgaggcaggaggattgctggagctcagggattcaaggttgtagtgagctatgattgagccactgcactttagcttgggcaatggagcaaaaccttgtttcctttaaaaaaaaaatttattaaaacatgctcttactttggcaaaaatatatgtttcttcatagtgatgataatcataatgatacattattactatatgcagcttataagaatcagttgtctaatgtatccgtgtaagtttctctgtggttttaagaatcattccataggctgataaatgcatactctcttcaccccattgcacatccagcattctgaatttttctcacttccttgaatatgccatgttccatgcacttgtagatcttccatcacagaaggtgcctcatctgtccagaacccctgccatacctctgctccctttgtctagctaacgctcactcatcctttagatcccagtgaaatgtcacttgcatctgggaggactttctgactaggttctgagcttcctttgcattctgtttttcattgacataatgacatcacatttattagtattgtctcattgtaaaccccagtaaggcaggaactgtatctctctgtatccccaacactaccacagtgcctggtgcatgttaaattgcagttaatatttctagaatgaaagagtgcttccatccttcatcatccgtctttcagataaagaagtatctagttacctttgtcttaaattaaaacaatttcaaaaggttgcatgtgctggtggaccagttgaaatccacagctcccatattgctgctcattgccactgttattgatgccctggagatgatttaaaattcagttatgttgcttgtgatggtggtatttaaaaatctataattttggctgggcgtggtggctcatacctataatcccagctctttgggaggccaaggcaggtggatcacaaggtcaggagtttgagaatagcctggccaacagagaaaccccgcctctactaataatacaaaaattagccggtcgtggtggtgtgcacctgcaatcccagctactcaggaggctgaggcaggagaattgcttgaacccggaggcggaggttgcagtgagctgagattgtgacactgcactccagcctgggcgatagagcaagactctatcttgaagaaaataaaaaataaataaataaaatctataatttttatactcatgtgctattatagtgaccctgtgagacatcataatgccttaatgatagcttgtcttgtttttactttcacttacatctatagttccaaatgttttattgaattgtgctttatttgataat

SEQ ID NO: 61589 - DNA, 1426 bp, Homo sapiens
cttatatatctgggaactttgtataaaaactaaacactggcctggcacggtggctcatgcctgtcatcccagctctttgggaggcccaggcgggtggatgtcttgagctcaggagtttgagaacagcctgggcaaaatgtggcaaaaccctgtctctacaaaaaaatacaaaagtgacccaagtgtggtggtgcacacctgcagtcccaggtactcgggaggctgaggtgggaggattgcttgagcctgggaagtggaggctgcagtgaactgagatcacaccactgccctttggcctgggtgacaggccgagaccctgtctcaaaaaacctgaacacttctttgttatgtttctacaatttgacacaataattcaagtcagccaagcactttaaaaattattttgaaataattttagatttataggaaagttgtcaaaatagggtagagttaattatatataaccttatgcagtttccctgataaccacttatataaccatagcacagttataaaaaaattatcaggaaattcactggtataataccattaactaaactgtggccctttttgactttcaccggtttttcacctcctgtatttttctctgttccaggatcccatccaggatcccacattaccttcagttgttgtttctcctttatttcctgcaatctattaaagattctaatcctttctttgtctttcatgacttcagcaaacagttttagttggatgcttagtatataccagtcactgagattggtgcttgagggaagggagataaatgaatggatgagacatggcccttacctaatgaggtgagccaacacatagacaagtaatgctaaaacaatgtagtgcctttaaaaggcctttgtactatctccctagagaagagagagttgctgactcactgaataacagtgttgaggcagcattttcagaagaaatgacattgatctgggtcttaaagaatggggaaacttttccttgtggagaaatggagtggaagaggagttcatcatggacaggcaggggcatttggcatgaaagtgtgaaagactggcttgtttgcagactggcaaatcacttgataggaatggagcatagggtatgtgaagaacacagtgaggcatgaaactagaagagtagttacaaagctaccttttttcattactttttattaataaatatatcctcatatttgtagggtaagttttggcttaaattttttttaaatctcattattcatacttaatgagcatttaattgtaatcagtgtttctagttttaaactgcacaacattaagattgttactgtacttttggaaagaaaaagagaacaaataattatgcttagctgttgcaatagcatctaatagcatttaaattctgttaataaagaatatgaatttattctgta

SEQ ID NO: 61590 - DNA, 1725 bp, Homo sapiens
cttttcttcatattaatttgtgtgtactctaaaaggaaagattatttggcttgctcataaatccaaaattttggtgatgaaaatatgtttataattatttcttttgagcttgatttgttgtggattttttcctttattttggtttaagatcaaatggtttcctaatgtgtatgggtcactgtagtctaaatttttttttttttttttttttttgagatggagttttgcccttgttgcccaggctggagttaaatggcgagatcttgcctcactgcaacctccacctcctggcttcaagtgattctcctgcctcatcctcctgagtagctgggattacagatgcctgccaccacgcccagctaattttgtatttttagtagagacaagattttatcatgttggccaggccggtctggaactcctgacctcaggtgatccgcctgccttgaactcccaaagtgctgggattataggcatgagccaccgtgcctggcctctaaatatttttaaagtatagatgtttttaaacttgtagctcctgagtgtgaactgtcccttgctgttttttgggcatctatcaaggcatttgttctaaccactgagtaagaaggacatcactaagggggttgtagctatacctttcttctttttatctttaattaacatgcattgactgcctggtatgttagaaacagacctgcctattacagtctcattcccttccatactcatccttgcttgtgtggctacctcccaagctaggactgcaagacccttatcactcctgcttactattggtttttgtgtccttttggcaattttctagtggctgcttgaactattggttgtcagattgacctgatttgtttcacttgtaaacaaaatgcttaagccactgttgatttttgtgacagctcagttgcttagagcaaggtgttaatgagacatcggtcataggtccaggctctgggttgactggtaagctttgctctggcccatggccacagaccctgactcccccttgccagctgtcttgcacatgtagctatggctcattatggggacacagcagggggtggagataagacaaggcaaatctgtcatctctgccagaaaagacaactcctactgataggtcagtaaccttttcattggaagaacagcacgttagtattagcttctgtagatgtgtctaactgagtctttttcttaaaataactcatgtgattgtatgggttgtctgcagcaagtttagaatactgctcacattttaaagcatgtttgaatataaggatggctttttagtttgtgaagattattgtccttaatcagggattcttaatatcattctctaaagtagaaaagtgagctttagaagtcaaatttgataaagctctagaaaacaactgcaaaattgctgttataaagaaacctgtcaaatttaggaagtgccctccaggagcccttcatcccaaccaatcctctcctaaaagaaaggaaaaaaagaagaaagatggctaggtagatggaatagtgatcagaaaaaaagaacttttctagaaaagcataccagtgtgctctttaccagagcattttagcaggtaatattttacaaaggacccagcagataattgggcaggttttttctttaggaacttagtgttgatggcctgaattaatctgactaggaatttagacatttcttcatgatatattttgagtcca

SEQ ID NO: 61591 - DNA, 3697 bp, Homo sapiens
acttctgagggaagtgagggagcattccaggcatggagaaggagtgttctagatggagggaacagcaagtgcaaagagcccttgacatgtctgagaaacagataagaggccagtgtggctggcgtggagagagaggggagagtcgtcaagtagtaagaggtgagagcagatgggaggaaggtctcagcacaggtcaggcctctggctttgctgagagtgatggatgcctttgcagggttttgaacagaggaggcacatgatttgacttaacgttttaacaagctgtttcctgctgctgtgttgagaataagctgtaggcggcaccaaggtggcagctgggagggtattgccacaaaacaagcaagagatatgatggtttaggccagtggtaatggtggagagtgtgagaagaggacagattctggatgtattttgaagtagagcccgcagaatttgttgatgaacttgatgcagagtgttagaaaaagagaagacttcaaggttattggcctgaataactggaaggatggagttatctatcactgagataaacagaggtaacagaagtaaaggggagagatggccatggtagaaggtggattacacctttaaatttttaaaacatatttttatttaaaatagccctcactccctggcccagtgcacacaaaggacctgatttgcttttaccctgagtttgtcactgtagatatcctggaatacttcgttaaaaactataaataaagtggccataatacggctcattttgttcagattctaaaaaaaaattccttcataagcagttggcttccaaatagcaatgcatgctgtcagtttggtgactaattgggttagaggttaatagcaaggcagtcctataaacatcaacgggagtggtgtatccaaatgaaagcttgcattaggcaacaattcaaagaatgagaatgactaaataccatgttacaagccaagtgaattatattaagagttttaactttgagagaaagggacgttacccctgaaataactatcttagttggatcttccctacttaatactcatagttgggttgtaaaaatgtaaaggttaccatcaaaacagcacttcttaaccatgaaattgactaactttgtaaaattagaaattctgttacttacttcctactatgctgattggacattccttcttttgccaaaagaacagaaagttggattttgtgccttctagccaagagaaccacacacctctctctctgtagaccagctaaatgcttcctactgctcggtgatgaaatcagatcatggaatcagtcagtttgctatactgaattttttttttttcagctgtgttctaattgaacctttggggaataaactaattcttaacatctgaaagtttaaaggtctgatactagaatttatggggtggtagaggagaccttttagtctctgtatccaaaccaaaatgtaaatttacttttatttattttttattttttgagaaggagtctcgcttaggctggagtgcagtgacatgatctcggctcactgcaacctctgcctcccgggttcaagcaattctccctacctcagcctcccaattagctgggattacaggtgctcttcaccacgtctggctaatttttgtattatttagtagagacagggttttgccatgttggccaggctggtcttgaactcctgacctcacgtgatccgcccacctcagcctccaaaagtgctgggattacaggcgtgagccactgagcctggccaatttctttttttattgtgggataatcattccatacttctccctcctctctagtccccacccccacccccctttttccccccacaagtgaagatgatttcctgtgctggtctaggattagttttgttacagtctgtctttataagaacatttcttttccataatccagaagcattttgtaaaacctatgcctggaaattgagtcactttttattgcttagattttcttcacagaaaaacataggttctgttggatgagtatttgttgtgaaagcaaattattaaggggtgaaaattgtctatacaagttgatgtataggaggatatctgaactggattagttgctcttttatctgtgttttcaaagctctttaatagtaactcttataacacttataacagtgttatcactattgtttgggcatcattccattctgctagactgggaattcttttataatacagtgcctgataggcatccattcattccttgaaataatgtattgagtgctcattatgtgcttgaaatagagtgtgtgcaggagccagagcagtcggcagaacagatgcagcttgtgtcgcatgtgcgtacagcccatggcagggtggggggcaggggacccagcaaacaagatacagataactgcgcagtacagtgccaatatgcacaggaacagtgactgtcccctacctacataaatgcatagacctcatatgtgtattgtgaatcctctataattgttgaatttgactttgaaattaaacacttgatattttagactagtcaaaaatgggatatgttattattttaataaaaacaccattgtatccagccgggcacagtggctcacgcctataatcctagcactttgggaagccgaggcgggcagatcacctgaggtcaggagttcaagaccagcttggccaacatggcaaaaccccgtctctactaaaaatacaaaaattagctgggtgtggtggcacacgcctgtaatcccagctacttgggaggctgaggcaggataatcacttgaaccctggaggcctaggttgcagtgagtcgagattgcaccactgcactccagcctgggcaacagactgagactctgtctcaaaaaacaacaacgacaacaaaaataacaccactgtatccatattgcctacaggagaaaatgcagatcacttattttatgtatgtgttgaatcattttaaataacctgacggaggtcctttcttgggcccatgcctctgcacatgttgggcatgttgtagttgtcgttactagcaagacacacctaccctttaagaccagtctaaatgccaccttgttccctccatgtaatctcagaacttctttaagggcaaggaccaaattacgtctgtgaaaccctagagtttgatctaccacttcacgtggaggcatgggacagaggttttgttaatgagtgaatgtatccatttaataagttccttcttcagtacactcttgagacctattctggctttcccaggaaacagctgaaggagtgacctccaatcaagtcagctctgtgtcaatccttcattttcggatgttttttcttccttttctcacagggtcataaggatcaaatgtaataatgatgtaagagttaagcgtattcaataaagggaggcagtggaatcatcacaatgttgatcatcacaatcaacattattattactgcaccactatagttccttgtaatacacagtccagaaatattatcacaaaatctcactgaggatgtcattgttctgggtttgacctagatgttgatgtaatgaacagttctctatcagttagtgtgttggcctagcacaggtgcttgacaaaggccctattcagacttctgtgcattacttcaaacccctccctttgctcccatagtatagtaatgaatt

SEQ ID NO: 61592 - DNA, 1451 bp, Homo sapiens
agattcagtcccctctctcaagaaactagcagtatgattggatggataagatttatgcatgtgaaacagagaatgctagatattttgggtggtaatcaagtgtaatagtatgtgattttagttataagcgtgatgagtgcaggaagggagatgaaaaataaataatatttagtgaactccactactacagaataaatatttataatattttctatttcatcaggaagaacaatttgaatcactggcttaatcactggtggggggcctggtttttagtctgtgtcttaaaattcttagctcacttatgtcatttgtcatatgaactttttggagaaagaaatatttagtttttatacgtagtttttaagactttaaaggttttataacccttttcttgaaaaattaagacatcaaatcagcaagtatttattgagcactgaccttggtctgaggcatgtacattttttagtttttagacaacagtaaagtaaccctgaaataatgcctacaatgactttgataagtacaagatggtgagttgaggttttagccaagaacctttgttttctcttgctgaatatttttctctttggttatgtggtagaatttagagctcaaaatgttcagactgtttctgtccaagtagcattctcaccatggtcaagatttgtttagtgatttataattaattagataaaagtacgcaaagctttttgggctttgtactgggaagtgctacataagactgcgtggtagtggtttgggcctcattgcttatatctgacatagcttccaggatttatgcctgtctccaccaagattcttttcctctttaatgaatttgaaagtaactatttatcttgaatgaaattagttttttctacctagagctgggagtttcattttctaatcagaatgtctgatttatttatgtgcctgccaaaaaaatcccaaaatactggccgcctgagttctggctaatgtttccaggtgctctgttttgaaaacattccgtttctaccctgtattacagatgctcttgcgtacagtgaaatcttgtgataaatatttttcagtgaacataaagtatttaaaaaataaacgaatggcagtattagtcatacattgaccgaatgccaccagtgtattatttatcatcatatacaggacatagtccaagacacaatccttatttagtggttctgtagtctaattatctgtaaaatggtcatgtcaaaaaaaaccaaggaaccatcagttgggcaaattgtttgcaattatgattaataacttgctgtggttaattaatgggaaaatatatatggcttctaacgggctgctagtttcacatatataagcagtgtgtattcaaaagaatttataccaagtaattatttattactacattctaggtttaattcttacttgtgttttcaagccattcaaggaaa

SEQ ID NO: 61593 - DNA, 1270 bp, Homo sapiens
caagtatttctttagccatgtgaacttacattagaaaataatgaaattcttgagatggttaatttttaaagctgtttaccatacctttcttttaaaagggatggaagatctggccttttagaatatgatttgccagccttccatagagtatactattgaagaaagcaagaaatgtgtgtttgcgggattctgttgctcaggctggagtgcagtggctcaagcttggctcactgcaacctccgcctcctgggttcaagcgattcttctacctcagcctccccgagtagctgggattacaggcgcatgccaccacgcctggctaatttttgtatttttagtagagacagagttttgccatgttggccaggctggtctcaaactcccgatctcaagtaatcctcctgtgttggcctcccaaagtgctgggattacaggcgtgagccaccacgcccggctgaaagcatgttcttgaatgtatatgtgtgttctctccccatgtgatttgtaaaccctccaaggcttgggtctcacattctcattctttgaatcttttatggcataatggatagagagtctgtgctcttgtccagttgaagtaagtagtgggcgctcaaaaaatgttgattggccaaaatatctacatcaagtacagtaacgactcatagctgctaacatcttttgagcaattaacatgcaccgtacactgtcttaagcactttatatatgtcacctcatgtaattcccacaacaactatagttatccccatttcacagatgtagaaactaaaacttagaggagtcagatacttggccaagatcacacgaccagaaaatgatagagctaggaaagtagagacaggaatcaaactcagtgagtctgattccagattctgcagccttgactcctttaccccatgcctggtggatcagtaacctttcagaaaatttttgtaacaagttctgaaaacatagatgaaataggaattttcccttaaactaaatggaaaactaaaaaagtaatcattagatggagcagatttctgctaaatgggaagtcttgggagggcctcattagaaaatgagggaatggggggccaagcatggtatcatctgctacccagtgagaaaaatatcgacttacgctgtgaacccttttattttatacatgtaccacctgaatgaggatggtatatttatgagctctcacatctcattgctgggtgacatcagggagctcttttttgggatagctgtccatctgttctcctcc

SEQ ID NO: 61594 - DNA, 1945 bp, Homo sapiens
actgccacttggctgctggcttcaaaagagcctgaatcagtgagttgcttacaccagggagaacaaacaggctcttctccttaaagtgtctgtaattatatgaccataattagaaataaaaccttctttatacaatttgagctcacaaggaaagactttctgcatacacaccattttttcctgtgttgtttcacatgctgatcaggaaacaggtcacttggcctaatcatccaccattgaatagagtggagagagccagattccccacaaccccctaggttgctgcatgtccttgaggtagtctcctgccctctctaaacttttgtagcattatgtatgatgaggttagtatagccatgtaggaaatgttatgagaaccttagtgcctgctattagttccttggaaaaaagagatagcctagacataagtaactcatgagtagagactaccagttttggtgcagttagggttttgagtttgttatcattttaaacagtaacattgtttgggtggttctgtggtgttcgaagagatgtaggtcaccgttgatttttgcctgatgggttttgagtttgagtagatgttgattaattcatgagccccaactgcaagatagatgttcagtattgattagacacatgcccctggttgtatgctgttaaaaaggagtcagctgtgaaatactcctaaagctaaatcaataaactactaaagttgttttcccccaataagtgtttgtattttatccctttaagtgagaaaggctgttaggaatttctgtgatctggccgttaagaaaactagctgtatctttggaacaatatgctcatatgttagccattccaggtgagtataaattattcatatatacatcttcgctgaggataacaatggcttaatggaggagaaaacacaacaattttctttgaaaaattgtctttattctggtgacataggtagacaactttgctgagagcacacctaagtactaataaaaatttcaagggattgagacatacatcctcacagagtaagagtttaaaaatgcctacaattggccgggtgcggtggcttatgcctgtaatcctagcactttgggaggccgaggcgggcagatcgcctgagttgaagagtttgagaccagcctggccagcatgatgaaaccctgtctctacaaaaaatagaaaaattagctgggcgtggtggcaggtacctataatcccagctacttggcaggctgaggcaggagaatcgcttgaacctgggaggcggaggttgcagtgagccgagatcgcaccattgcactccagcctgggcaacagggcaagactccgtctccaaaaaaaaaaaaaaaaaaagcctacaatccctgttataatcatggccagtaattgctaagcaattagctgtactattagaatgagtcactaccaagttttctgccttggcaatttttttctgaaaactttattgaatttagaacaatttctggatgactttttttctctcaacatacagacattgaccagtcttcataaaatccactaaactcagcaccttctaggcttgtctttctcctttccttgccttctcttccaaattcctagaatgggccgtgtgaacttcctgactgaccatgccggctgcatcctttaaatctttacagtggcttctcatttccttttgcatctactctggctgttcacgccacacatcagaatcgatcaccagcaggctctggagtctcatttccctcatctgctgcgtgggtctccagtcttctccctccattcattcattttcagttcctctaggcagcaccttcttccttgagccttttctcaagagctatcgttttcttagactctgttctctttttttccttctgttccaagtaactcttgaaatcccgtcttccctaaaagtctttttgaattaactaga

SEQ ID NO: 61595 - DNA, 1832 bp, Homo sapiens
cctgactaatttgtaaaactttttgttgagacgagatcttgctatgttgttgctcaggctggtcttgaactcctggcttcaagcagtcctcctgcctcagcctcccaaactgctgggattacaggcatgagccacagagcctggccaaaaatacatctttttaaatgcaaaacataccaagtaaaattgaacaaaatcctggctggtgaggcaagagtttaaacaagggaggagaagcactgtaccagttgtttctacacacctatgaaagatctggcatgaatggcttggtctttgtttaaaagcatagagcgccatgtgtatgtatggacacttgcatgcttttgagtgatgatgattagggtgagagattttccttaggaaagtttcaaaagtagtcacttatctactcagttttaagtaaatagaaaataattttttttaaaaggatagtgtgaggaagtaattttgtttttaaaaggatagtgtgaagaacaccctaaaaatgtttgtagaagaggattattcagataaatctgtagtgagtttatgcatacctcctttaaaatctatctttagtacagccattatttagcatgaagatgatttgttgcttttgttttccaagttttgttgcttgtaaataatctgttaagaaattttgggccgggtgcggtggctcttccctgtaatcccagcactttgggaggccaaggcaggcgaatcatgaggtcaggagtttgagaccagcctggccaacatggtgaaaccctgtctctaccaaaaatacaaaaaaattagccgggcatggtggcaggcgcctgtaatcccagctactcgggaggctgaggcaggagaatcacttgaacccaggaggcagaggttgcagtgagccaagactgcgccactgcactccagcctggcagacagagtaagactccatctcaaaaaaaaaaaaaaagaaattttgtaaaacatgctgaagggaatcctgggccaacaggtatttttaaaaaataatatactattcccaggtttatgttgattatttatatttgaaaatgttgattgtagatactggtagattactttcaaattaatcatttattcctaattgaccagggatgagtgagatgtttatttagaaaacaaataattttagataggaaaattgaatctttaaaaaataatggtgatttaatatatcaatgtgtggtttttgtgtgtatgtgtgtaatattggagcatccaggagtgtgcggtgtgtatatgaccttatttttctactgtatcttagaggttgccacttccatgggtataaaacttaattggatttctcgatttttattttgtttatgcacttttacaacttatgtcattttaggttgtttattaatgccagttttgtataataaaattattagagaagttatgaaggaggatggcatgagaagggtggccagagtttcactgtttcatgtttgtaactttcattccttttgaagtgtacatttattcctagtgatagaaattgatgttttctttggcaagcattagaagcaagtctatgtgaaattatgtaatgtctgaaaagttatattcatgattaattggcctatccaagaatggtatttgtgtgtgtggaataaggcgatcatgctttttatttggcagtgagttaaagtgcccctgctcagatcgggttactccacagggctttttgactgagaattgtatgtttagcttaatctctaaaaagcgtaaaatgtagcttcggagccaaatatgctggaattcatattgtaaccaaagttaatcttaggataacttta

SEQ ID NO: 61596 - DNA, 2513 bp, Homo sapiens
tcaaacatctactgtgtgtataattctttattatgtatagtaattaagataaaccaaacaaggatcttccaagagctcaccatgtactaagctatttaagatatgcaaaattttaccaatgtcaccaaaataatgggctttttcttccttcttcctacagtttacccttagtaggctttctactgtttacccttagtaggctttctactgtttaccctagtaaagatctaggaaattaagtttaaaatcttcaccctcaggggaaggccttgtcatgcctggtatttcttctcctggctttgctgcagcttgtattagtatgcagggaggggctttggttttgtgcagttccaacacaccttacagtgaagctgtggtgccagggagcagagtctgtccaagataatgctcatgtaagtgcccagggtggtgcctggcctaaagcataaggagatttagaaactctgccacaaagggggtctaagaatgagtcttctgctacacagaattaactccaaaaaacaaggtcagagctcttgaccttcaggtagtaattatccacataatcctcttttcctactgcttatgaatactgcaattgaaagggtcagaggtagtctgaaagcagggaaaacaaaagaagtcaggagcatggaaattctgcacaccagatggtttgtgtgcccagagggcaattgagaattaagtgtagtaatggaattacactacttttattggttctatgaggacaagcacttggagtaccaattatattctgcgtggcatactttgggtgctgagtaaatattagtaacttattgaatagcacataacatctcaactgccatgtaaatctctgtgagtgcagggcattgtcagaggtggtggtgataatattattgagaaagtgactagtgtctgacttttctagcttgttaataaccacttacctatgtcccatctcctcattctactttcctgtttggatctaattacattcagttgagttgcctgtgtctcctgagcagttagagcaggtttctcttggcaggattaatagtaagaatgtctacattcagttcacagtgtgcctaggcagtgttttgtagcaccatatctaaattaaaatgaatgccttggggcaactgcagaagctcctagctgcctctagctgatacacagctctactaagtatcagctcttgcttgtgtttcttgtaaattgttgttatgcctatcctttaatctatgcattactattttgcttctagcctcacttggaaaacattcccaagtcatagagatgaattacaatacagaatttctaccaatggcagtacttgcattgttttcagaatctagtgcccaggttttcctactgtttttcttgccgtctttaagacagaatttctatttacatccttgtcgatttttgtatccctaaataaattatagtcttgaagtctggacctgctccagtgaaggttcctacagcactgaagttgggaatcactagagaggcactttgttaattttctttttaaaaaggaatgactaaaggtttgtgacacttgaatgtaagttgattttaaaattccatttttctaaatccagagtagggtttatattgctaatatcatgatatgcttgccaaagagaatagtttgtaaatcctaaacagacttcctgtaaccatgtgttgaatttccagctgtgttgaatcagactttggtccctcttcagaagataaatccaatacctgcagtttctaatggcagaagtggaggagagaagtccctgtccagataagaaactgaaggccctggggcaagcaattgtttcatgaatgtcctttccccagccccgcgccccacccctaagaaatttgtaggcttcatctaccaggaaaacaaaacaaaacaaaacaaaaaaaacaagaaaacacacaccacacaaatgagatgctattgttaaatgcagtatgtaggattagatttgtttccttccaatagaatcactttccttaatcagcacttttataaatggcacacctgcctgattagaacaagttctagactacaggatacagtgtgagcatttcaattaagtccacacaattaaaaactgttgtggttgatgttcttagaaagactttccttctctcgtcttactccgttatggctaagctttattattttatacttctgagtcagcctttgatcatgggactttcccactgtgtggtcatttatatctttttttgtttctaaatgatttctttaaatgaaaaaagaagcgatgtattttagggatatatgtagggatgcttttgaatatttttattttattagattttcctgcttccttactgtcacttaaaatatggagaaccctcatcctgtgacaaggaggtaaaaatacagcagtcacattcaagatctccatacattaacaataataaatccttttgccctgagtaatacagatacttaatccacagagctcggggggatg

SEQ ID NO: 61597 - DNA, 1068 bp, Homo sapiens
attacccacagagaagtataatgagcaggggaggtgatacaataaaaatctatatagggagagtagaattatgatgacagtgttgcctgtgtaaagtcttatagtaagtatatctccaattatcttttagaaaaaaattgtttggtgtctacttatgtccaattcatgatgaaattgcaagaatagccatggaataaaacaaaagggtacaggagtatagagaaaatggcgatagacttgtcgtaaacagagttctgttctaccccgaaggatgtgaagtagacccagggctgctctgagggagtgctgggcatgaacctccctgcagaggaatggctgtcctgaccacagttactgttactgcagatgcagacgggaacaaaataacgctctggaaaaaaaataagatgatttagatcatcacaggaaatccctacttttagagttagtgtgtttccgaagaccatatctgaagcagattgctgtgagggaaaatcctgagtgtgcatgatctctatcctaattaggagcaaacttgatctgttccgacagacatcagttgcataagtgggttaagtggcaagaaataaagtctagttctttattaggtaagtgtcaaatagagttctgaagtagcaaacaaaaaaaccttagtaacaacaggaagcagttttcagcctttgttgcagtgccatcagttgtgaagtttgtggacaataattcattaccagtaataaggcaccaaaatttgtaaaatatttttcttttaaaaatagaccataacaggccagacatggtagctcattcctgtaattccagcaccagccgaggcaggtggatcacttgagcccaggcgttcgagatcagcctgggcaacatggtgaaacctcatctctaccaaaaataaaaaaaaaattagccagtctcaaaagcttgtctcaaaataaattgaatagattgaaatgaaaattaaatttaaaaagactaaaccgatacatagtcttgttataattttgttaccattgcagtgtattcattttacttggcttccttctttttctttttttt

SEQ ID NO: 61598 - DNA, 1017 bp, Homo sapiens
ccacaattaaaaaaataaaaactaagcaaatgaagcggaaaaaaaaaagaatccattccattgctggacagctgttggaaaggctctctatgatgactcctattggtgtaagttttgtactctgtaaccacaagaacgaatctaaccctttcacctggatgaagacacccagcgagtccaccccagtcttttaaagctaagtagcctttgttccttcactaggtcataatattttgttttgttttgcttatactttgtttgaatcatgatcaagatatggttcacacattgtgattggctgatacgccctttaaatgtctattaatctagcgattcttctgtatctattttttgctcgcctattcacttggtctcctgtttaatttgttgaagaaactgggccattttttccgtagtgttttggtactagcatctccccgctctatagattaacatattcctctgtcctctgtatttcctctgagtcggtaatgggcttgagagaccttgatttataaatgtttgtagtccaactactgtcatcctttggcatctgtgggggattgggtacaggacccctccctcacccctctaccaccactgataccaaattccatggatgctcaagtcccttatgtaaaatggtgcagtatttgtgtataacctatgtacattctcccatatactttaaatcatttctagattacttacaataactaatacaatataaatgctatgtgaatcattctattgtctaggggataatgagaagaaaaaaacatatatgttcagtacagacaaaaccatcctttttcttttcaaatattttgcattcatggttggttgaatccacggatattaatcccgcagatatagagggcctactgaaaataatgattcagtttagatcttttttgagagtaaagggacacaattttatccccccccccccaactttttgtttggaaaagttgtaaagatgaggaaaaattatagaatgaacacccatatgccttt

SEQ ID NO: 61599 - DNA, 4613 bp, Homo sapiens
aaacagggtcttgctctgccacccaggctggagtgcagtggtgcaatcacgactcattgcagcctcaacttcctcagctcaagccgtcctcccacctcaactccccaagtagctgggaccacaggcatgcgccaccatgcctgcctaatttttttattttgtagagctggggtctccccgtgttgcccaggttggtcctgcccttttttgggtattatatgacattttttcaagagtacagaaaagttgttacagagaatatcccccaatttggatttgcctgattgtttctttatgattggactcaggataaatgtttctggcaagaatactatataggtggtgctcagtcctttaggataggcacttggaaggcacatgatgtcactttgtcccatacttgtttataaagtgtccaccagatttctccattgtaaaggtaccttttccccatggtaattaatacataatccatggtgtttagtggttacctttttaatagttttaaaaaccatatgccattggtcatgggagaaattgtatggaatagattatgaacacattagtaaagagttattgccactgatggaaagataattttagacatttgttattctgaggaatggaggggaggtagcaaagtaagaaatgggctctcatgaagacagacttgtgtttgagtacagctctacacctgaacctatgcaaccttaaaaatgttacttaacttcttagatgctcaatttcttttctaaaatagagataatactcataccgggcaagattgttaagatgattaaatgagatagtgcaggagcagcctgtagcctagcagctgccccagggccattgcatgggagacaaggagatccttccagagcacagtttgctggatgtattcatctttagacttattcatgagccttccttcttgggattagtttaaaatattcaggcatgttgttgggaaaatgtgatcaacaggttaggtgcctttgtgaaatttcaaagaaaggaattaagaatttggagatttttggtatcattttcagacatcttaaatataacttacctgtagtagatttgtatagaatcaaattgccatttactcagacctttttctgactggaatccattttactttattataagggatttttttaaacacagtttatatgtagtctgattgagaacagtgaatcataataatcctgtgacccatttacatgcgttactgtaaaagtttcatttcgtacaagtgacaatttttaaaagttaattagacttggctacacggaggttagcaaaaagtgctttgaattatcaataattcagcagggcagacatttctgtataatgcagtggttttatagagtattgtgagatagttatccttaaaataaatggttgtgagcatacatcagcatggcggggttcgcttgaatgtagcgtgaagtgataacatctatgctttctattattggacagagcgcgggacatcagtctttctggccatgaactactagcaacctttgtcctttgtgttacctttagttaaaaacgaaaaatgagcatgaatgctggctgatggccatgtctctctcacagctaaaaattcatctgggaaagaaaaatgggtttggagatttggatttgtttcattgcatgaatgatatgtgacattctgtaaattatttatcagtgcaaggatgacagcagtagcttgaacattgttatatcaaatgaaagcaggaatcccgttagtaagaggaccgggttttagctcaaatctatcaggggaatgttgtcactttaaagccagattgttcttttaattgctatttaaaggaacaaaagtgttcccaaggtactgcagttgagcagttgcaagtaataactatggatccataattatgcagtgctgattatctggcatttaaaaaactgtggctacagtcagtgaccaatttgttatagcttgtctcttttcgtttttctagtacagaatgttttataatctactttttaactggggctacagaaatacatttgcatagctacctcagaacgtaaagcctgtgcatattataagaacaaattaagctgaaagtaaagggaagataatgaatgcccttgtaagatgagatttgcagtcatattaaacaatttgtgaatgtttggtcatgagatggttttttgtttttgatgacatgttgtcccaaggaactaaggcatttgttggaatcattataaccattgattttttttgttcttaactagcatatatttccttcatgtattcagttagcagatatattttgagtgcctactatgcaccaggaaatgcattaggcatttgggctagagtggctgaacaaatgaagtttattctatgctgatgtatatttagagagttagacctagcaaaatcttgtttttaatttacatttaaaaacatttgtgattatgttgggtgttcttgctctgaatttttgattcatgagattcaaatatagagacatcatagtaacattcagatggctagcagacaacatgtgtgaaggcttggaatatgcggtaaaattacagttttcgtagttttggctgttgaaaataatgtgaccagatctgtaggcactgtcagctattcctatggatgggaatactagcattgctgatagtagtaaataacaatggaaatactaaaatgtatgtagatttatacattgttaaaagcaattttcatacgagagttaaagggtgctaggggactagacaaatgttttgttgtttcttatataaagtgggaatgtcaggccgggctcggtggctcacgcctgtaatcccagcactttgggaggctgaggcgggcggatcatgaggtcagaagatcgagaccatcctgaccaacatggtgaaaccccatctctactaaaaatataaaaattagccgggtttggtggcacgcgcctgtagtcccagctactcaggaggccgaggcaagagaatcacttgaacctgggaggcagaggttgcagtgagccaagatcacaccattgcactccaggctggcgacagagtgagactctgtctataaataaataaataaataaataaataaataaataaggtgagaatgtcagagattcaaggtttatcttttttgtttggtatggtgtggtttacttttgaagaccttcgtggcacaaaagccttgttaataatgaccttttcaagtgtcccacagaatcctgctcattctattattctgtcacctaaaaacatatagatattttatgtcaaatatttagtaggtgaataatagcaatctgcgctgcaatatttaataaagtcttaacagtctatacatgatattcatagactataatgctgaacgaataatttattttaagcatatagataatagaaacaattgagatgtccaatgaatccttaattatgttcatttcaggcaagctatataatatataaaggtattagatttcactggtttaataaaaatgacttctgagtcatacattatactgaaatgtattcaggtagtactttagtgtcaaataatttaagagatttatcccagcactttgggaggctgaggcaggtggattatgaggtcaggagatcgagaccatcctggccaacatggtgaaaccccatctctactaaaatacaaaaaattagccaggcatagtggcgcgcatctgtaatcccagatactcgggaggctgaggcaggggaatcgcttgaacccgggaggtggaggttgcaatgagccgagattgtgccactgcactacaacctggcgacagagcgagacttcgtctcaaaaataatataagagtttttttactagcagaaagtgtttatttaaatacgttatttagcagtttttctttgttaaagaaagaagaagctttaagtgaaaaatgtaaaaagcttttgattttaatgtttttacttttgaaatggaaaagtgacagtattttttattttaattttgtcatagccccgtgctgatcccattccaatatgtagcttctgtttggggactaaagaatcaaatcgtgaaaagaaaccagaagaactcctctcttgtgcagattgtggcagtagtggtaagttgtgtttttcctatgtgttgtacaatgacttcccattatcatagcttcatgctatttgtctctctattaaaactgtattgttatttaaggcagttatatggtaatagcataggctttaaattttaaaagaaaaagtaaggaatagagaaaaaagcgtgagtatgttagtactgacatatggatattatatatgcttatataatactatacatatttatgattaagcttttattttataccagcattggtaattcagtgtggagatgtctgcattataggtaaattccatgtagagaattctaagctttcaagctgagtacaaccccatctttaaaaattaatagcaaaaaataagtaaaaattaagctttttctgttaatcttcaaattttttccccagactacccaaacttttttctccaaagtcttgttttaaaattcatgactatttctctagttatagtaatctcta

SEQ ID NO: 61600 - DNA, 3123 bp, Homo sapiens
ttgattgctgcacgtaatttaaaatcttatcatcacttatgacagctgcttgatggttgggtagaagaaatgtttcatgctgaggaatgacagtgttgtgtaatgattcttattccttatatgaaggtttaacgtgataggccctttgtggttcagcagctttcaggtgctgactagaagggagagccttggaaataagacatttcaaaccctgcttgaaaaatgcattctgacagtctttttgatgggctttacagattcattaaaattcttttacctggccatggcatcatggatagtgacaaaagggcatggaaacattatctgtacgttcagtttaatacatttcagccccacgatatccctgttttatgctggtgaggtagtgcctcactcatcagttctgactctgtcgttatcttttgggttttctcacgaggctcattctgaatgaattattcttttgtgtaactgcctgatcaatttagtggtgttcacttgtctagggtttaccctttgtggcttttaaggtggtactttaaaaacacccttccctgtttttatttctttaggatctatttgtctgggtgcctagacagattaaagatgtacttaaatgtgggaagaaaagttcccttcatatatttccttacctctggtgatacacttacttgagttgataagaagttcgagatcattatcttctagatcataacttcaaggcctccttcacagggtataaaggtgtaattctaaacaggtagatcttagattttctgatgtaatcaatctccctttgtctttcccggattgaagacctgccagaggggaggttgatctcctttatgtttgaggtcactgaaaatttctttcccctggtgtttcttacttttcgctcagactttttcagggtaaagccaggggtgtttaggtacagtgttatgttttctctgttcaaaaatatcctcttgttttctcttttaacaaatggagaataatgacttgaggatactgtccagagggtttatgtggctggtgtggttttgtgagccagtcttcaagtggagagagccagaggctttggggccaaggtatgggtcatggcagaaattcaagccctggggtcaccatgtctctttgttggggataaaggatgcctcagagtgcttctctggactctgcgatgggatccggctctagtgttgaagttcacttaatcttcccttgagtgtgctgtgccagcctggatttggctgctttagtcaaaaaaactattgttcctaacgcagggaaatgctttgtacatatttattcatctgataaatcagaagaatagactttgttgttttttcctctttaaattgaagggtcaaaataaaatatagttcattttagggagtttgggggttcttgtggttctaaggctctgttttgacaccttggtaattctaaggaaaaaagaaaacaataggccagcatacctcaacagtgtcctcaaataatggcgggagccctgttgtcacagttcagcatttcaagtgggaattacagattagttgggactcctagttgaccttatggaaatggctgccttctcactctcagaagagtctattggttctgggattgaattgagaccgttcataatgttcaaagggatcccaaaatgtaagttgtttatgtgaaaaaatacccatagcagcataaaaccagaaaaaggaaatatagatggcagcctgtggggaggatcattcttaaatgtgtttcccatatgtgcctgatgcttttcagtcgtccctatctgaagtaccattcatatgatgtcacatttagactccgcttagatttcatagatgagagtaataaatgtatccttctgcttacatcataaagtaaagccaattagaaatttatctgtttttaaaggggctcgatgctttaaatgggcagtattttctttaacagtttttttttctactaaaaattctttaaaaaaaaaaatcattcaagtttatatgtagtaaaaacgtgaggtgaggtatgtagtgcccggagctctgaatgtggtgtccctagcctgggttccagttctcttccgccacttgctgggtgtgtaactttggttttcctcatctgtggggtgtaaaggagaatgtctgcaccctccatccacagagctattgtgggatccagtgagaaaatgataggaagatgatcagtaactgtaaaacatgagacaaatgtgaaggattattccagccactaatatgaatgtgggaatcatcagatagtctaggtctgtggaagtgttagaaatgattttacttgactttcatggatcagcctactttgaaattaacactgttatattctctttgcctcattaagaccaaattatctttaattagcttcacataagtattagatattataccaaatgaaattttgtgtctgctgctcagattgctgggtggttaaatcttacttacagatgagttgtgtgcatgtgtgttttcaaattagcaaatctaagataagtgtacagttcaaaattacagcatcattctaagtggaagctcattgaaacgggagacagaagaaaggctgctgtgatgcagctgggtgagtgagagaaatcccttttgtacaataaagggagcaagagccgtggagtagaatatcagtgcaccctcgggagacctgaagtcttccctgggtttgtctttatttgtgtgttaaccctgaacaaaatttgcatgctcatggagggaactggtaggggcagtgtgtggatatatggacatataaaaatattttaaaagaccactagtttcttaaggtcaccccaggagttggttgcttagtcatccagtttcacattgactagatgcagattgaatcattaggttggaaagaagactcttgactagaaagaaacctaaagatatgatccaaagaagaaaagaggccaggcgctgtggctcacgcctgtagtcccagcactttgggaggccaaggcaggtggatcacctgaggtcaggagttcaagactagcctggccaacatggtgaaaccccatccctactaaaaaaaggaaaaaaaaaaaattagccgggcatggta

SEQ ID NO: 61601 - DNA, 1139 bp, Homo sapiens
acataatttcataagtggctatcagttgctcttaggagaaatccatattctttaatatagcccccaaaaacttctggattgggctctggtttaaccccatcttacatcactattctgttcacattctgcacattggttacattgaacaacttctctctccttggatatacctcgttcatctctccctctgttcatgccatcttccctgctcttcccctcttctggtcccatccaatcacattcatcttttgggtctcttttttagggaggcctttctctaacttcctgctagattctcccatatccctaagccaccccattgtaaggcattaatgctcattcttgtttaatgtttgtctttcctgctgggctatgtgatctggaagggtgggaaccatgcctctccttttcctcactgtatccagtgctcattaaatattagttgaagggaggagagatggacagatggatggtcaggtagccagtctgaggggcttagtgtctgagtcgttattagttttccattgctactggaataaattactacagacttagtggcttaaaaacaacacatttttaatcttatagttgtaggttggaagtccatcatgggtctcaccagattaaaatcggggtatcagcagggctggctcctctctggagactttaagtgaggatccatgttcttttttttttttttgagatggagtctcactctgatgcccaggctggagtgcagtggcgtgatctcggttcactgcaagctccgcctcccgggttcacgccattcttccacctcagcctcccgagtagctgggactacaggcgcccgccaccacgcccggccaattttctgtatttttttttttttttagtagagacggggtttcaccatgttagccaggatggtcctgatctcctgacctcgtgatccacccgccttggcctcccaaagttctgggaaggagaggatccatgttcttatccatctgggttattggcagaattcaattccttgtgttgacaggaccgagatcctggttttcttgctgtcaggtgaaggtcatggccaggttctacaggccacccacattccccggcttgcagccccctccccatcttgaaagcctgtgatagca

SEQ ID NO: 61602 - DNA, 1026 bp, Homo sapiens
aaaattaaagtgttagaggaaattgttgagtttatgaaatcgctaaaccagaggtaaggaattacttgatcagtagcattgctttcctttatctaattactatagattgtgcagtagtatatcaagacacgttacggtcttttgtgttattttaaagttggccatgagaaaataaaatggaaatatttcttcatccctcagcatcctttacagaatcatagaaatttagaactgtaagggatctatggccaattctcttgagctaaataaaggtaagattgctgcctaaaggaaagataggctgaagattttagaatttgatagggtagcttaaatagtagtagttgagatacagtattgcttaaagtgagagaaaccattaagagaaagaatattccttgcccctgattgaaaatggctgaaatccactaattttcaaactgcataattattaaaaagtctgtctttcataagatacctgtgagaataaatagtaagctgtaatatgatgtgaattaccttagttactgaatattaagtcacaaagtacaaaagcagatttgaatgtagagaaaaattcagtgcgtgaaattgaggtcatatgtgcccatgatatatgccttacaggaagtaataaaaaagaggggggaagtaagtggtatacttttaagctgatgggatccattttaagggtggaatttaaattgctgttctttaaaagttaagtttttaccctcctcactatataaggggacagaggggagggctctgatcaaagtagacctctcccctccccgcttcagtgtgcttcttagaagtcgacaagcaagctgtctttgtttgccgttcctgagcagaaagaggagattgataccatttttatctattcagactttttccttgcattcatttgaatgagagaagcctcataaaagaacagtgtcacaggttaaatgcatctgcctgggtgtctctcctgcctgaggtcataatcctgtgacaatattttattttctcaacatctta

SEQ ID NO: 61603 - DNA, 1319 bp, Homo sapiens
aatttccttctctgccttcacataccctttgaagggaaatggaacattctgtacatgtttttgtaatgtactttttcctccctcttaatagattataagcatcccctacatcattaaatattctcctaaacatagtttttaataagtatgtagaactccatagtatagagcagggattacaaacctggcaactatgggtcacagatatgctttgttggtacaatatttttacaagtttgaatctgagtcctctgggtggtgcgtgtgtgctccagtttgccacaatctcactactccctgctgtcttacgttccaatttgcttcagtcacatacattatacaatctaggtccttcctggaggtatttgattttccaaccctctatataaatgaactctaatttatttaaccagtcccttagggtggatattacaaatgtttccaattttttccatccacaattatttccttgaaataaattcctagaggaggaactgttggatcaaaggctagatacatgaaaggctgtatcagttttcaggctgtccagcagtatagaaggatacctattttcctgtattgtgaccagtactcaccgttactatatctccttgagtctaagacacatttttttaatgttttaatatttttgaagtcagatgcatcatacagtatcttagatttgattagagtattattatttttaaaattttaccagtttgataatagaaatatgtctgattatttctttttaagtagtcagattgaacatttcttgtgttttattcttggctgtttgtatatcatcttttctaaagtacctctttttatccattaatcatttttctcttgggatttttacctttttcttcctgatttgcagaagctctttttttgtgtgtagtcatattcatgaatctttttatttatggcttcagttttaaatgtcagtcatgcttagattatataaatatccacatatctttcctggtacttataacattttattttttcatattacaatattcatctgtctagaatttattcttgtaaaggataggaaataattcctcttccagatagatagctatttgttctatcatgcttattgaatcatttcatcctttctccactgatttaaaatatgaccttttgatatgctaaacttttctgtaggctttggttgttctggtctttccattcttatccattgacctatttctctatgctagatgtatagtttgaatcattgtagttctgcagtactcaaaacttttatttaaattttaaaattatattttatactgataatttttttt

SEQ ID NO: 61604 - DNA, 1926 bp, Homo sapiens
tgttggtgagaggcttaatgacatgttgggaacagcttcatggaaggattctgagagaggggccacctctgccctcaccaccttcactccagggaaattgaccttagtgatggcttcctaaggaaaatgacaaagggaatgacgcattttttggagtaaagttcagcatacaggcatccttgagcagcttattacagctacaacttatatttaatatcttctcttaaaatgaaacattaaaatatttttctcatatatatattaattcagggatgtggatttgccaagtctgcagaccaaagaaaaagggaagaaaactacttcatgagaaagctgcacaaataaaacgacgatatgcaaaacccattggacgaccgaaaaataaattaaagcaacgattgttgtaggttgagatcttatcaaaagaaatcatttatgttttgctttaaaatataggtgattgttattctctcagattcctttaggggttttttggcatcattttttcaaactcaagggttgaaaaatacttttccttttgcataagctgtggaaattttttgaaaataacatttttaattaccattggcattttggggtcttctgttggcagtagctgtgatactaagtgacatttttcaagcagcaggatggaagcagaatgtaagaattggaaacagtcattcagcctactttattactggctgagcattagagcttaattatgtaaatattttcataggaattttaaaacgagagggatttgtccatgtctatagcaaatctcttttgtcactccagataacattttagaaaaatacctctctcttctgatagtaatgtagcattaccactttttaagatctcttttatgaaataggagcttctgaaaaacctgcagatgaccacttacctctgaagagttagacagaactatttgacaactgcactagtgcagacatatatataaaataatatattcgcagtggcctggaaatctactatgataaccccattttcactatcttgttgctgtataattgccattaaagcccagtagagcatttagcaggagttagttggaaaagcagagaaaagataagaggtgaaatgaatttattttaacctgtgtagagtatagatttgactatcagcattaaggtgtttacgaatgggatcagtagacttgcacatctatagcagttctaccaacagactaccaccatcttttcaggcttagtgaaagggtcattgtgatggagaaagaatacatgctctgcacacaccttgaacagactccaagaatctcactcccttgcttactccttttcccctaattttatctgaagctgctctcactatcttatttgctctcagaaaaatagtattctcccgcacctttatctcctaagaagaagtaagaaatgcaggctcctttctagagttttctatgaaactttgcaaaaaccctttaaccagtagacattttcaatagattttgaaaaaatttctagaggcaaacatgaaacatttatgaataaaatctttcatggtagtatcatttgaagtagaaattatatgtttttgcattcatcctgtgtaagcattgttcccaacatgggtccatatcctcagggcccaattaaaaaaaccaaattaggatataaactttctaaacagaggacacagctgaaaattgcatctggcaccaatcctaactttttgtttgtccaaaattgtcctttgagcttaggaatttttaagacagtctagggagttttcctttttacatgctttataagcatattatcctttctgggcaatcgattccagatacaatccaaatgcagctttctgatgtgaaacatttttgcctggatgagttccttgttggtaactctcactgtgtctctagtgacactagag

SEQ ID NO: 61605 - DNA, 3949 bp, Homo sapiens
gccaggcagagtccctggcagtagagccacctcagatgagcctggtagctgcacctacctccccttcaactaacagctgaaatctggtcattaaatctttgtatacaagatgatcactaaaatatactcttgtatttgtaattacttaagatatttttataattcagtattgtatctttttaaggctttcattttgtcattattcacctttagctaaattgatcattttgaaagtacattcttgggccccagcattgtcataattcatctgcaaatgtttctctattgtataaaactctgctacaaaatgggtagcttcgcaaaccctagcctgaggtgaagacagtcggccgctgttcatgtaagcagctgtgttagcgagtgacctctagtttctagaactactcaacagtatgggcagaaccagggtacaaagattctgacgccaagtgtctgataatgaccatggtaaatgtgccgcttcttcaccagactctccatgtcatgtctgacccgctgtagcttttctttaatcatttcttcagttttttgctattgttgtccttttttcagcaatattttatgctgtagttaattgtcttctctcctaagagagtattattggttatcttaccatcctaagcacaaactgctgagaggaagaggatgtctttttatgttttcttaaaaaaaagtacaaatttatagccatatccaaactctatttatataagtttgcaaattgaattaaaaattacttttaactagagattagataagcttcttcttttgcttctggataacacatatgacttatttcctcctaatactttaaaaaagacatttcaggaaatcataactacttgtgacaacaccaaaggatagcttgtttttatttaattataattaaagcattgggtgttcttttagtctcttcagcatttttcttgcttatattgcccttgggtccacatggattcttccagtacctggtggatgggccctggaagaaccatgacatgtaaatgcagttgctgctgcctttccaacagagaaacatctaggtggtggcacacacaaaaaatacagttcttaagtttaagcccattgaatgcatctagttgcaataaatttgtttttagatacctttataattctatttattaaatgctgatactattctctaaatttctgcctaggtctgtaaccagtgatgaaggatccatgaatgcattcacaggaagggggtcacctggtaggggtcaaaagactaaagtctgtaccacaccttcatctggtcatgctgcatctgggaaggactcaagcagcagattggctgttacagaccccactcggcctggtgccaccaccaaaatcaccaccacctccacctacatttctgcctctacacttaaagttaacaagaaaaccaaagggctcattgatggccttactaagttttttacaccatcacctgatggtcgcagatcacgaggtgaaattatagacttttcaaagcactatcgtccaaggaaaaaggtctctcagaaacagtcatgcacttctcatgtgttggctacaggtaccacacaaaagctaaaacctccaccttcttcacttccacccccaacccccatctccggtcagagccccagttcacaaaagtccagcacggccacttcttctccctctccccagagttcttccagccagtgcagtgtgccctccctgagcagccttaccactaacagccagctgaaggcactctttgatgggctttctcatatctataccactcagggacagtctcgcaaaaagggacacccgagttatgcaccacccaaacgtatgcgtcgtaaaactgaattatcttccacggcaaaatctaaagcccacttctttggcaaaagagatattagaagtcggtttatttctcactcctcctcctctagctgggggatggctagaggaagtatttttaaagcaattgctcacttcaagcgaacaactttccttaaaaagcacaggatgctaggcagattaaaatataaagtgacccctcagatggggaccccctcaccagggaaggggagcttgacagacggaaggattaaacctgatcaggatgatggtaagcaaaaggtcaaagctccaaccaaacctgcgtcccgtccctttctccccaaccctgaaaaaaatcaaccaatcaattcctatttgtcacataggtcttagctatttctcttgttctcacttcactttcatacagaagcagtgaaactttgacctttttctaatgctgactaaacctccaaaatgttgtttttccaactaatactctcccaccttttattatttatttccattcgtagtgacactaggacccccagatgccttcatagcattgcttatggctttgtagtcccgcatgagtagccactgccatgcttctgccatgctctcccccatgtcacctctgcagccacagcgctgttcagttgtgtgctgtcagtgcttccaacagggggtgtttcagctcttccctctgctccattgctttctcatgacaaagttcatcctgcttccgtctcagcaaagcctgatctgtgactctgtgatgtgtgcttttggatgtgagtgtgtctgtgtgtgtatccaccttagggagaaaacggatttcataatttcattgaacaaattggcccattacatttgctaccctttatcaaacaaaaaccgaaactgtgtcatttggacaaagtggtagaatttattatctcaaaagtgataatgggaatgctataactagacatcgataaaacttctaatcttggttgaaaaatatgatttcactttgtattgctcttactttccctcatatatttattaaagctgtaaaaagatgacagtgataaattcaaataaaaatttgagtatagcagggaaaggatactgctggatctatgagcagtgcttagatgtaaaagcttatttataaagctttaaaaaaaatccctatttgcccagtatgctaatttggtgccattttggtaatatatggtggttactcatgattcaagtcagtgaatacactttctgctggttttaaatgacagatactgaaataaaaataaacatcaaacaagaaagtgcagatgtaaatgtgattggaaacaaggatgtcgttactgaagaggatttggatgtttttaagcaggcccaggaactttcttgggaggtaaggcgaggatcccacattgtagtagcaagtataagatgtggcttctaactattaatatggaattactgtgttgattttatagagaatccctttcaacatcctttgtgattctttagccgttatcatgcccatttctactgactgtacattcaaaagcaatgacttagtagaattgtcgccactcttaaaagtaggtatggactcagctggtctcacaaaataaaacagagtagcattagttgaggcagattttggaaaacatttctaggtgtgaaggaatagatttctgatgagttttgcctaaatttagaaaataacaatttaaaatcattaacaaaaagaagaacatcactgttaaattcaccgatgtttcttccaacacagatggccagccatatgaaaaatgtctcatatttttagctcttctgcattgatgaaaacaatattttgtttcacaatcagttgtagtcagttttatttttattgtccagtaatttctttaagtgattccactttaattctgcttaagttattaccacccagatattgacaggtgaggctgtcagacttctcaaagacgaatctaatatgaattgtgaatttgttgtgtcagtgactacattcggtttctatgaccagtgtggtcaggtagactccctacccaaccccacttcctgttttgtggggaaggggttttctgtaggctct

SEQ ID NO: 61606 - DNA, 1095 bp, Homo sapiens
atttcacaattgattatttaattacagttgtgataaatactacttcgtggaggaataggaaactgtaagcttctgtaataaataagcctgtgtaatagccacatcatttataatcacctaatttctaatctgttacaacagattgttaaatccagttctatcgacatttgtatgtatttataccatacttatttcctttgctatattgtttcttagggtattcgtttgctgtgaatcttacacaaaggtaatgttaggttggtgcaaaagtaattgtggtttttgccattgaaaaaattataaaaacagtaattacttttgcaccaacctatttcataagggtctatagtgttttaaggccatgcaaattcacaattaagattagtgttctgatcttgataagttttgatagtcactggtgaaagaaccaaaatgtaagtgaagtatatatattattattttccttttctttctatttgacagaaaatagagtgtgagagtggggtggaagactgtggccggtacccttctgtgattgaatttggtaaatatgaaatccaaacctggtactcctcgccttacccacaggaatatgcaaggtaatggaataagtctggcaggtgtataacttgaatgtcacatatgtgagaaaggaaaattcttgattctaaagcaggaattagggatgattttaggaaataaattttggtagtcaatgccaagtgcttcccaaactattgcttttgccagcacctttttatggtattccttgttctcggtaaattccttatgctccttagttacatgggcattataaattttgccatttagcttctagattgtgctttctttccttggttaattggggaaatgttggttttgtatgaaaccaaattaaaaaaaaaaaaagaaatttgccatggtgaattattgggtagactttcttctccagttgtcttttatattttttaattaggcctgttacttttatctctgatttctggcattttattttcaagtttttaatagaaatttagcaaaagaaggaaaaatgggagaaagtaagtgggaatgggtagtcttaagagacccttc

SEQ ID NO: 61607 - DNA, 2703 bp, Homo sapiens
attttttagtctgcaaagttttcagtatttataaacttgattttcttatagaatagatcttattttttttcgttagcatgtgagtgtctggccaatcacgtaactggagaaaatgctaagtgttttctaaaagttaagtgacaaaataagagtcaagaattttggtttctccttccttataccatttggttgtgtgttcttgaacaattttaaaagactatgagctttaatttgcataggtaatgataagccatgtgctctgaaagatttgaataaaatttgtacataagtgcaagatttgaaagtagtctcacctgtgtctgcctctctcttgaaaacctttttccccattcttatactccaaagaccttgcaagtgcttctaaacattttcttataaataccagccatgttcattaagatatggaaataaaaaatgttctgatttttaaggtggagaaaaagtcagcagggaagagaggtgtttgtcttttactcaaagtaacagtggaattggtagaaaacaaattaggtcttttgattttcagccgtgctatttactgcatttagaccatatataaatctctgataataactttaaagttacctcttccagaggtggaaatggtaacaactaagtttgaggacttttcagcctcatatgtatgcagattgtttaaaataataaattcacttctgagtaagatattatatctataccactaaccatatataattggaaataagatagtaaatgtgaattttgaaaaatatgcttggtcccttgacaggatgatatccttattaagttgattttttagggtggtggttccacatctgtaaagctttctttatataggatatttttaaggaaacaaattatttgttcacaaagtaaagggagcacatattatggattatattaaaaaataatgtatggttgtttttacattctgtctttactattggctggctttctttctttctttcttccttccttccttccttccttccttccttcctttcttcctttctttcctttctttcctttctttcctttctttctttatttttttgacggtgtctcactctgttgcccaggctggagcgcagtggtgcaatctcgattcactgcaacctccgcctcatgggcttaagcgatcttcctgcctcagcctcccaaatagctgggaccacaggcatgtgccaccacgcccagctaatttttgcatttttagtagtgatgaggtttcaccatgttggccaggctggtctcaaactcctgatctcaggtgatctgcctgccttagcctcccaaagtgctggaattacaggtgtgagccactgcacccagcctccaatgttattatacagcctttttatgatgtagagaaaattgaacaatatttaatcttccccccaacagtataatctatctgatagattctatgatttttaaactttaacagattaccaaagctttacctgtgtgaattctgtcttaaatatatgaaaagtaaaaatattttgctaagacactccaagaagtgtggatggtttcatcctccagcaaatgaaatttaccgaaggaaagacctttcagtatttgaggtaagcgcgtgtaaataaaaaaattcagctttttgaaatctagtactcctaattgttgactatgtgctgatttgtgtttagaaggtacaaagtatacttaattttggcactgaaattcagactgccctttaaaacatctccatgttttggaatgtttatctaaccatattaagcaaccatttagactgatgaagaatccctacttcatcacattaacatttttgtcttccccaaaatccctgtctacactagatatattcaccatgaatttatgatctcctcagctctttgtaaattctactttctttggcaggagaaatgagctttgttcagcagctccagccaatgtctggcaggtgctcactcttccagggaattgagcagctgtacatatctcctcaatacacaaccacctgtgtttccatccacttcttggcagtgtggataatccttttggtgagaccctagcagatgttgggactccctcccatctgggtagatggccacccctgaagaactctgctgttcacaggaaccccttgtggccatatgtctgtcattgtgggtttcttgaagacattttgtatttccagaattgatttcgtagcaggcctttgcctctatatagttgcattgtttaattatgtatctgttgtcagtttcagggattccgttaagctgagtcagtttcaccttgaggagaccatgcctttctcacaggttactgtctgtctgcagggcttttcacgtttctcctttatgctcttccctccacttgcacacttctgttgtctgctgcattttctcctctgtgacccattgtggtgtgcattggtgctcattcctaggtgcttgaaacaagcctaccttgtacagcaaacgtgatgtcctctttctctggaatatagtttcacttctggattttctttttctgaattgttcaggctgaaacttattattctgccttacagttctctttatttctggcctgcagtgtcttgccatcctattaaataaagggaaggttgtaggtttctcacatggaccaggctccttctcagacaggtctgggcccactagtttttccccaaga

SEQ ID NO: 61608 - DNA, 2911 bp, Homo sapiens
ctatcagctctttcggtaagcttggaggaagaagggtattgttgctgggaagattaggtgatatattagttcttactaaaagctaggcacttttgacatttcaagctggttagttctttgttgtaggggctatgctatacagcgtaggatgtttagcagcatctctggcctctgctaattggatgccagtagcaccaccaccccttccagttgtgccaaccaaaaatgtctccagacgtagccaaacatcccctgggggcgcagaatcacccccagtaagaaccagtgggctagaaggaaggctgaatgcacgttgcctgaccttcctgttggtatgctatcctgccagccccagccagctgaggtgacagagctgctcacagttgaagcttagctaatgtcacaagttcagctttcctattggctccttccttgatgccttagatcttttcttccaaccaaaacattgtttctcaaagctcaaaacacattgttggccttaagtaattatttcataaatcagcatgagtcagcactgggattgaagctctcataaatccatggaacgtcttctcatgggcaagggaatcagtcttgttaggatggtaagaatgggctgttctttcagggcaggtgcttttggaccatccagagatgagaggggagacatcagaagcatgtatgtaaaattcacttatacgaataaggagttggatttgataagtaccgaggtccctattctagaatctgagttaatagagtataacatttgggcaacttttctcctagcagtttcttacaaaacttataaaataaaggaggaataatcacacattacgattttctggccttccctttctttattcctcttacacttttcacaaccaatcagaattttcttcagcactgtcatctctgtatttttctggttcacagttatgtatatctccatctttcctttttgtaatatactaccatttccaaaagggccatactctcaaatacatgtaaacttcctttaattaaagggagaattgtatcctctgtgcccattgcccatatttgattgtgttgctatgtatgggacctaggttccatccgagggaaatagttatatgaaatctaaaaataatttgtgcaagatgagaacccgtatggtccacaggagacctgagaatggtcaagttcattgtttcagagctctggttagcaaatatccatttcccttaagaaaagtgctagggaaattcttcttgaatctgctgtgttttctattttcaaagagtaactacatttgatcaaagaaattggcatctgtgcctagcctcctgtctatagccatcagtatcacagcttgattcttttattttgaagagaagtagactgtaatcatagtgcttattgtaggttgaaattcatatcactttctctgtaagtattcccaacatagatattttatcttttccaattatatttaagatgatgcttgggataaaaccaaaatggaaacctctttgctaatccacacttctgaggaatcagaataatacagttcatttattttagttttatgtgaaacccttttgaaacaacataaagtttaacttacttgagaagtattttgatctgtttatatttccttaatacagatttattcggttcagatagagaggacatgcctgatcatttttagctcagaataaattacaagtaaaaattactcctttactagtggtttggcccttctttggtagcttaaagagaaattttaactaccttaaatgtaccctaatttaagagaaaatgtggaattctgatttgccagtgacagctgttttctggttaaagctgtacttgcttaatagagtgttttaatctctcagtttaggatttggaaataaaatgatgtactttctgaaataccatatagaagaaacaattttatatggtgcagtatttttatgttaaataatgttgtctgtttctttttgctaggttgatgggaatatgagcaaaatttattgccaaaacctttgcttgttagccaagctcttcctggaccacaaaacgttgtattatgatgtcgagccattccttttttatgtccttacaaaaaatgatgaaaagggctgtcatctggttggatacttctctaaggtaaaacaagagccagcatgaccttcattttctttttcaaaatgtttttggtagagcccaattctttgaacagggctttttcattactataatttgaataagtgacatgtgtttttgaaaagctcaggttcttgttcagagctcattttaaaagatgaaaacaaaaaacatggtgcctagtaagtgtgtaaaggacctcagcactgtgtgccgccttgatgacactctaattgctgccttgtggaccacttagcgtctttgattttctcagtgtttagcttatttccgttttccctttaagtggtgtcaacatgaaggtttcagtttagtgtagcatttaagagagaattctcctttctccttgttgccttccctctgtggtcaacagtatctcagtgagttaggacgctggcatttggacagtcaagctgataaaatgactggttttacacttttgtctcttattctctgtgctatggttttaagttctaaagcaatctcacctttagaaagcctaagtatcagccgggctcagtggcttacgcgtgtaatcccaggactttgggaggccggggtgggcggatcatgaggtcgagagatagagaccatcctggccaacatggtgaaaccccatctctactaaaaatgcaagaaattagctgggcctggtggtgcacgcctgtagtcccagctacttgggaggctgaggcaggagaattgcttgaacctgggaggtggaggttgcagtgagccg

SEQ ID NO: 61609 - DNA, 4480 bp, Homo sapiens
cgagagaccatcctggccaacatggtgaaaccccgtctgtactaagaatacaaaaattagctgggcattgtggcaccctgtaatcccagctactctggaggccgagacaggagaatcccttgaacccaggaggcggaggttgcagtgagctgagattgcaccactgcactccagcctggcaacagcaagactccatctcaaaaaaaaaaagactagatgaaactaaaccatattctcatgtgtcagctggaatctagaggactctggccctttggggctattcttgaaccacattctagaggttattagaactacagttcaaggatagccagagaagggctggaatgacctggaaaggttcagtgcaaattgttacatgcatatgactttccaagcacataatagatggctgtaaacagaaaggaaagaaggattagttattttattcatagcttagaatttagctgtagtaacatgttaagctgcacggaggggaagaaggatcactactatgttggatctcaaaaaactccgaaaggtggaaatggttctggacaaagcaaggaatggtatcaaggatgaattctcttaacccagagtacatttctttttagagagagtgacccatttgtctaactttgcaaaacagacgaattacttgaacctttgccattgatgtgcacatccagtgagggacaattcatcttcttagaaaaactgacacacattgcttcatcctcattttttagaggctccatagacaactacaaatgtgcaaaagttgggagtacatctttttcacaaagaaatcttcaattctgccctgtagggttttttccacaaccatctcctgtgatctttcaaattggttcattaaagatctgggtgttctgaagtaattctttggtgtggtctgtaccatttgtggtcagtcttatttgtggtttatatttggccagagcatccacgacctcaaaagccttttccagatctctgtgtaggttttggcaacttctttgtactctgaataaaaaaatactgccctgatgccacatcccatgaaagttgcaaattcttctttaactgtaagagctgtttcttaccatgttctacccagtcttcctcctggtttcaaactgttcgtaatattttggtctaacctttgtttggaggctttagggtttcttgttgttgtctttttgtttcattttattttgttttcctggtttgaaatgcagattatttctctagctttttacattgactttttattcataggagaaatatatgtgtgcacatctacccacacagatactgttttagtttcactgggacatttgcccaaaggcagaagacagattgctgttgcagagttgtagattattattatatttagcaagatagccagctaaatcctaacttactccactgggtgactccctgggatgttattttctctatctctgaagttatttgagcaaggaaagcatttcttttatgctgtctatattctgttttatttggttcatatatttccttggattctttatgcatattttatggcactgactttcaagaataaagatgtagttgagaggcatgtcagagtcgatggtttgttgttaattgatagtttgattgattaatatagtaggatttttctgcttgatcctgacctaacccattggctttctttagtggacagttttacaaggacagtggcaggtgcagggaattgcccacttcagcagggctctgacatacttgatctgtttctccttccctcaggaaaagctttgccagcagaagtataatgtctcctgcataatgatcatgccccagcaccaaaggcaaggatttggacggtttctcattgatttcagtaagtgaagtactttatttactttcatgatccaggaagctgatggccgttacaggaaacagtaaaatataaaactttatttaacctgcattgttgtttttatcaatagataatgggctttctatttatatttacataggttagaacatcttcctcaagtgaaaaatgtactgctgctcagtgattgtactctaggaaattgagactagatctctcggcagcaggcctcatgcacaaagccattaccctgaatgaaccgacagaattacattccattttgtggtgctcatgctcattagcaccaaaagaggcaattatttgtgattaaagctaaaggaagtattatttgaaaggattttcagctctctgaaattttgcctataatcttgtacagtacaaagcagaaaaggtatatttccatttagaaaaataattttctaggcagcttatcctgggccttgctagtagaaataactcttaccttattttgttaatttcccttttctattatggaaattaatacagtgtttgtatctagaggtttcccaagaaatatttatcttatatgcactcatatcttctgaaccttctcagttaaaaccggcataatatataaaagtatgcacatggataatgtttttaaaaatggtagttttttttttcctccttgtttatattatactggatgtgtaaatgttgtgttaggggtacatttggagaatcaattcaaaatatctagataacatgatgaccagataacccatgataatagtcatttctcgtcatgtaaaaatctgtcactggccgggcgtggtggcttatgcctgtaatcccagcactttgggaggccaaggcaggtgggtcacaagatcaagagatcgagaccatcctggccaacatggtgaaccccatctctactaaaaaatacaaaaattagctggatgtggtggcacacacctgtactcccagctactagggaggctgaggcaggagaatcacttgaacccgggaggtggaggttgcagtgagccgagatggtgccactgcactccagcctgggtgacagagtgagagactctgtctcaaaaaaaaaaaaaaaaaaaaaaaaaaaaaaaaagtctgtcgctaggaaccaggtgcttcttgattaccagattgcagtttatctgattattaactgaaaggaggaaaatttaggactttgcacaatcttcatcagctacatcagatgcaaaaaccacaatgtaaatgcgcttacagaaaaccatgaagaaatatagtgaatctaaatctatattgttaggtattaaaagattaaggtctgattaaagtgtaaaataactgaatagcagttttggactgatttatatgatttattgacattgaagaatatgattcttttaaaagaagaattttgattatttttctctttttagataatatttttagttatttattaattaccctagtcttatctatactttcctgacctaattatccatgaaaccagtaatcccaaggagggccaccttaccaaatgcagtgtaccatttttatttttatagagtcctagctgtaatcatttctgagggcaaaaccatttatcttgttctctagttttgtgtggctaccattcataagtagttcataaatatagtttctggtatgcatagcagccattcaagccttaaatgtttggtcatatctatatgcctacagaataaggcaaactccttagctcaatatttaacgtcttccaacatctagttccagcctgtcctttaggctttttcatctactaatctcctttttctcaaatagtctgagcatggtcctatacctctatttttttgtctattcagtcccttccttgaaatgatcacctcgtcctttcctagactccgtctgttcaaaatcctgcccattgttaagagccagctcaagaatctctgctttttgatcccacctcctggaattttatctcatacctttattttatcttataccatattctatatggtatcacacttacactctgttcacccttttatgataattattgatggaggtttcatacttccaacttctctgtatccactaggacagtttcctttataataatatgtattagatgatataaattaaattttattgatataaactaaatttccaaattgatatatggttgctgtccacaatcattgtctacctaaaattaaaaaggaactggtacttactaggtaaaagttcaagctctaaattcagtagtatcttatttgtacagcatgatctggcactaaggccttctacataagagaacaatctgggtaacaaatacattatcttcaaatgctatgtcttttttttaaccattttagtgaaaactgttactagaaactaccttgtattattaaactacagaacacattgaaaccttttctcagtggctccaggccaccatgatgaatgctgtccaccaggatgtgagcaggcaaagtagtgctgagggtgtggtttttttcttttctctttcctgtacacctagcattgcccctactggagtgagttaagaagtgcagtgaaagatttgaataaagt

SEQ ID NO: 61610 - DNA, 1836 bp, Homo sapiens
tatggtttttactgatcataccatagtaaagttgaaccaagttgtaagttgtaagttgaaccagttgtaagccaaggactgtctgtataaagaactgcaaatgcagggctttgaacactgttcttcagggcagcagagtgaggtggaatggtcatccatgggaccatgtgctgcttgcagagtaagtcatttgtatatcacttcctagaccagcttctctgggatttgtcagagcaaggctccccaggaggccatttgcagagtttggccagagtgagtaaagggcaccaactcccaatctggttataaactccctagtgggttttatgactctttgcccacaattggaatgggtggaggagagagtgactatcgtggattggttgagaacgcattccttcctcttggattctaggattccctttctcagtcagaaaatttgaaagtcttccccatctctgtctgtaaagtctttctatctctctctccctccgtccccaccagacatctcagaacttcagagaactcccttgcccacaaaacatttgcagttcctacttcagagcctcacaccgtcaaggcaaggagctcttcttctcccagccactgctgagcactgggggcccagagtgctccctcccaagccctggactgcttctgctgctggggctgcccagcaatgccttatccatctcactatttttttctttaattttgaaataatttcagacttagagaaaagctctaagaataataccaaaatttcccgtacattgttgcacatgttcacattttatcacatctgttttctgctctattattctcaatctctccctttgtttctcttctctctcatattttcttttcagaatcatttgagagtaagttgaagatgtgttgcacctttacccctaaatattgcagtttttctacaaagatgctctcatatatagccacaatacaaattattaaaatcaagatattaaagtaatttatgcacatttgttcaaattttaaattttgcgagattatactgatgttctttctggaggaaaagaaaaatctcctactccaggatcacatggagtatgtaattatgtccctggggcctcctttaatctggaatagtacctgcttttttgttttgttttgctttgcttcgtgttttccatgattttgatattttttaagcatacaggccatttattttgtatggtgtgcctcaatttgggcttatctgatgtttcctcatgattagatttaggctgtacattttttggcaggaataccatagaagtgaccgtatgtccttcccagtgcatttcatcaggatcatatgataatacatttgtctcatcactgggttaaggtggtaactgccaggcttcttcactgtgaaattaccatttttcgctttgtaatcagtaagcatctggtgagaagatactttgggattatataaatatcaattctcatccaattttcacctcctagttttaccattcacttatggctcttatctaaaataattattactatgataattaccaaatggtaattttctaattccattctttctacaacttactaattggcattctagaaggaagaattatttcttcttccccatttatttaatttttttgtataattgtgggttttaattttattctataggttataacctgtcattaccatgattgattttgatgttccccaaacatcaaattgtcccagatttatttatcagcaaatgtttcaagtgggttcttgtgccttttccacatgcttccatcctgtggattcttccttcctttctgccacagcatgatgttc

SEQ ID NO: 61611 - DNA, 1916 bp, Homo sapiens
aacaaatacatttctagatgacctctggaattagaattacagatactttttattttcttatttatactttttgctgtaactaaaaagaaaagaggccagagtcaatggaggcctgacagtgaggatgcatggaaaagaggcaggtcctgttcgttccgtagcaggagcatgcctggtgcagagtggtgctcagaaaatactggtatttattgaatgcataactgagcttggagagatagtgagcgcagctttatgtagctttcactgtgcgtttggatgtctacgtgcactttgcacagactccagagctcagcagggggtctgcattagagggagcagctgggagtcgtggacatgcggtggtagctgaaaccatggatgtgggtgagggcaaccagggggaagtgtatagggaaacagggctgagggtggagtgcttggagtgttaacatctaagggactaataaagaatgaggagctcgccaaggaaatttgcaaagggcccagaagtcagaagaaaattgggagataatggtgttaggaaaaccagaagaggtcagtatttcaacagtaacagtcacaataatcatcatagctgccacttctagagcccttgctatgtgtcaggcactgttaccggaattacacacatttactcacttagtcctcacggagaccctatggggtaggttactgtgaccatctctcttctgggacgagacactaagagacttgtctaagatcatcccccagagattcagtgccccagagagaaagtcataagaagtattctttggacaactgtatattaagtgcgattaaaagtagattcaaaaagcttttgactgttttattctgtttggttgggcgtagcgtctcacgcctgtaatcccagcactttgggagtctgaggtaggtggaccacttgaggtcaggagttcaagaccagcctggccaacatggtgaaaccccatttctactaaaaatacaaaaatatggatgtggtggcatgtgcctgtagtcccagctactcaagaggctgagataggagaatcacttgaacctgggaagcagaggttgcagtgagctgagatcaccccactgcactccagcctgggcgacagagcaagactctgtctttttttttttttctttttttaaaacaaagcaaaacaaaacaaaacaaaagcttgactgtcaagggctggggacacaggaacctagttgtctttatttttaagctggagagcctggagcatgtgtatgtacatcagtagggaaaagaaagagcagcgctgatggaaaaaatcgaggggaaaacaaaaagcaacatccaggcaggtggtttattacaaagtctgatctggcatttgatgaaattcaacattctctcctaactaaaatacttaaacctactaactagaactataagggttctaaatctcagattaactttttcttttttatcgggggcagacggacgtgtaactaacgctataaagggtaaaggacagctggatccaagtctacagacttacgtctatagtttttagagaccagataaacttgccattaatattaattaatggcaagttcgtcagttaagttaaatatcagttaattgtacattcaggcatttctaaaattagtatgtttgtggaataatcataaaaatgtgtcagcagtttcaatttttggctttctttattcagtattaaaatattgggcagtccttcatggaacaaggctgtaactataggaagcagaagtgattgaatgaattaggcattcacttcggggaattccctttgctggctcttcatatgttgagggtttcaccttagcttttgtgaggtccgtgtgctatttaaaaactgagtctataattaatcagcgctgctagaagatggtgcaaa

SEQ ID NO: 61612 - DNA, 2394 bp, Homo sapiens
attgctcctaggtgaccaacctggacagcagttactgtactggataccgtaggtgttagtggttgtaacataatggtatttttgtatctaaacatatctaaatatagaaaaggtacagtaaaaatatgctgttataatcttatgggactaccattgaatatgtggtccatcgttgacctaaacatcattatgtggtgcatgactgtatttattgttgattgcccatgtctttcaccaaaagtaagcttcatgagagtgtggactttgctctttgctgcattctgatcttctagaagagcctggcgcttagtaggttcttattaattgttgaacaaatgttaaattaattatgacgggaagaacttttaaaatgtgctttcccttctagtgtgtgattcttagggacaattttattttattagaacataaaccatcagcactggtttacttacttccaaatgatgctaggtatgccctgtcttctttcgaggtctggtacttttgctgaaatgcagcctctatcttaagatcatttcagttgcatcagaaagaagatgtcactgcctgctctaaaccttgggcggagaaagcagagctgtgacataatccacatttgtacatagcaggttgaagagacacttaaatcttttgcttactttttctcttatcagataattcatttcttgattgcatttatttttgaaaggaaaataccagctttagccataagaagctgtcaagaaagcttctctttgcttagccttcccagcagctacgctcctgggtgagtgcagtcaaggcaatcattaaagaataataagttatgcttttgaaatggtgctcaagtacttcatagccttttctaagataaggagcctcccacctttgcccccatgacacttgttggaaaatactggaccagcagctatatccttgggcttttgctgggttttggaagacacattttgacctatgtaatcaagtataatgatgacatttattttaataggattctagtctgtaatataataaggaaaatggctatttttccttattttctcattataatatgttacactaaaagcttctgccattactgttttattatattggtctgaggtacaatatattttaatatgctaaagataacatcaaggttgaaaattgagctctcagtgatttattcagaggttgactgttgctgaatgcattgaaatgagttgcatgagacagtgcggctaacgatttatttgtgtatctttttttaagctaagcttgtcataaataagagcaaataaatagctcttatagaatagtttgtattcattgcctcaatgaaaacattgtaaatatgaaacatacggtctgcagtctctctcattttttctgaaagctagtgttttgccttacatagctcagaattttttcaagttttggcatgcaggtggttggttttttttttttaccaaacaaattttttgtctgtttggatttctaacgttgactggcatttgcattgagttattttgaaatccactactggacaaattccattcaaataattggtatgagaataacctaatcttcagcagaactggaacaaaatgaaaccttagtgggaccatcaagagggcaggaacttggtcattgctaaactccaagccatgagcacagtgcctagcacatagaggatacagaataaaggattgttgggggaaatcaatgaatgcctgagtctagttaatccacttctttgtatgactgtcaacacctgccagatgcatccagctagcttttgaccagtagtgcttaaactcagatctcctctcagtctttgttttttacactttatttatcccttcatcccatccttcagcaaacatgctttaaatacactgtgccagggatggtctaggtgatgaggacataaggatgaatgatttagtccttgcccatagggaagtagagggtcagacacaaaattcttcccagtcctgcaatttcaaatttcagagaggctgtggcagtgcagaggaggaaatgcttccaactctattttccatttacccagttaagatatatagaagagacgcatttttccttgcttttctttttaaagactgggtctcactctgtcacccaggctggagtacagtggcgtgatcatagctcactgcagcattgaattcctgagctaaagtgatcctcccatgtcagcctcccaagtagctgggattacaggcacatgccaccattcctggccatttttcagggggaggggtggggggtcagctagagacaggctcttgctttgttgcccaggctggtttccaactcctggcttcaagttatgctcctgcctcggcctcccaaggcactgggattacaggtgtg

SEQ ID NO: 61613 - DNA, 2834 bp, Homo sapiens
ttgtactctaatattcatgctacattttcatgtttaccaatataaaaaccttttttgtaattatttatatggagtcctgctttgagttaacatcatagaggaacgctttttttcagcaaaattgttttaaattaatgtttctaaagtgtataaaaatggttgggtggattaaaagcaattcagtttcacatgaaccatttgtccacatggaaataaatatgcagcacaattacacggcagaaggtacgaaaaggtgttgctgaaatcatgagaaaatgtaatacaggcggacgtcagtctccacaataaatttgcatatgtccttttttgggggcaaatacagtcatcattttaaatgaagtcgaagagttatttctgtaaacaaaacaaaagtcctccttgtcatactagacagcaaggaagcaaaaattgttagggtcatgtcaaaaagactcaggagtcaatttgaagaggttctgaccagacaataaatataataataaagataaaaaattgcaatttattgcaacttgtcaaatgtttaaattcacaagttcataatgatactaaaaaacaaactgatttagaggataataggaaccagtttattttcttgaaagctgcaaaaattgcaattaaaacatttatcctgcctttcttacataaactgtacagtgaagtaatcaagtagtaaaggaggggaaacatcattttattttttaaatttttaaaaattttttgagacagggtcttgctctatcacccaggctgtagtgcagtggtgcgatctcagcttactgcagcctcacctcctagactcaagagatcctcccacctcagcctcctgagtaactgggacttcaggtaaacaccaccatgcccagctgattttttcattttctgtagtctctttatgttgtccaggctggtcttgaactcctgcgctcaagcgatccatctgccttggcttcccaacgtgataggattacaggcatgagccactgcacctggccagaaacatctttttataaacatattccagctaaccaatgaaaataaaatgtacggtggctcacacctgtaatcccagcactttgggaggccgaggcaggcggattgcctgagctcagggagttcacgaccagcctggacaacatggtgaaactccatctctactaaaatacaaaaaattatccgggtgttgcggcatgcacctgtagtcccagctacttgggaggctgaggcaggagcatcccttgaacccgggaggcggaggttgcagtgagctgagatcgtgccactgtactccagcctgggcaacagagtgagactccatctcaaaaaaaaaaaaaaaagaaaagaaaatgacagaattaaaatataaccattttgtaatccccaccaccaccatgaattaatggatctagacaatgaacaacatcaacagttgcaaaaaggacaaccagaaattatctatcttctgatcaaggatatttgtagtcttgccagtggatggaacccaagtctaatcaatcaagcactggatctagttaccattttgcaagagatacagagtaaagaggagcatactgagctgcagtgcaagtaggagatcagcaaaatccagagtgaggacagtataggtcaagtggccccagttcaaccacagatagattacaaggaaaagaaaggggtgaaggtggaacccctagattaaaatgacattaagatttttttttttaataggcaagactgttctagtgcctggactgttttggtgatgaaagtataaaaaaatgcaagagattattgtgaaagtcaggatagtggttacttatgagagagaaaggagaggtgattggctggagcggatagaaagttttctggagtagccggcaaacttctatttcttgatcctgggtgatagttacaaggacagttgccttataataatccattaagctgtgtatttgttttttgtcattttatgtatctctgttttatttttgttttttagaaagcaatcatcttaaaatgggaggtgacatcctatggtatcttagtgcttgggtttttgtaactcttgaaactgaaaacttactcgatttattggtggcatcctactagtcatgttttaaagagagacacagttttcaccttgactgcttgaaaatgaaaacttgagtgcacaagtatttagtgtacgggcatcaactccatgtcagcctttgcagagccatttttatgtgaaggaaatgtactgaaatttacttgaatcaaatcctctgaagtgttgagtctagttcattagagaacagcattcctgtaaatttcactttcactcttaaacttagaaaaacataattgaagggttgtgcgttaacagaatgaggatgaaatggaggattcggacaaggaatggtgatgcagagtgaggatggagtacagagaaaatatttaactgtgagcccgaggagagaaagaagagacactgcagcatgagaactgttttcccatttttctttttttgtgggaagaacagcaccagcagacactgtaagatgtgtacaggaaaattgctctttcctcctcctaggttgctgagcagttctaaaatttgtggtagatctttaggcactagaaacagaacttagagaaaagatgttaaaagttagatttttaagaaagggaagaaaaaggctacgatgacttaaaatgtcctgaaatgaggctctgctatttatcagaaaaacaggcttccttcttcttaagaaggtgattgtctgttcatagactaggagtcctgccctggggttcacccagcgttggagctt

SEQ ID NO: 61614 - DNA, 2263 bp, Homo sapiens
ccctgtagcttttgagttgcatccagttaaaaacttgtagaacataatgaatgtttttagagaggaaataaaatgaatgatgcccgtgaatttgttttaaacattgtttattttacctaataatttatataaatcttccttgaagaggaagagaaattaccagatttaattaataattggaagctttttagaggatttactttgaaatacctccctgccaatttttcataaattaagcataaactttctttgacctcatcacacataattaaatagctgtggaagggttaaaaccaactaaaaagcaattctgtatctcaatctccattctcctgcaaaacttatacaggaagtttgtttcagttctcaagcagggtaattacaagagacagttacataatttacacttccaatctacttgtctataatcacacacttctacctagttgtatatacccccatgagtatgtgtgttgtactttgatttgtaaatgatgattgcagtgtgattgattccttgcaatgtagcatattgaattcattttttaaaaatgaactttagctgttaacatgtctatttgagttcctgttatttacgtagtttgtggttcttgtgttcagcagttgcataccagctaacaaattaaactcccagagctttttttctcattaaatttggaaaatagagtgtctgtatacaacctaaatagaaaagtacctagtacctagtaggcactcaactgttggacatagcacaaaaccatttcaagcctttgcaggtggaatggagattctttgattaacataatataaagtctcatggggataatattagtatattgtggtgaagctctgctaatattaatgtattgttactgaagtctaaaatttagccaaacagtggacagaatagcggttcattccaggggcttagagaaatgtgtcatctacaacctaagaggtagtcattgctgtctttaatgctgctggtgacgatactgcatatgtgtttgtttttctaacagctaacatctactgtagccagtttggactttaagattccctaagattaaaggctaagtccctggccgggcgcagtggctcatgcctgtaatctcagcactttgggaggctggggcaggcagatcacctgaggtcaggagttcgagaccagcctaacatgaagcaacccgatctctactaaaaatacaaaattacccaggcgtggtggtgcatgcctgtaatcccagctactcgggaggctgaggcaggagaatcacttgaacccgggagatggtggttgcaatgagccgagatcatgccattgcactccagcctgggcaacaagagtgaaactccatctcaaattaaaaaagctaagtccctacatgacaccaagtccatgggcaaaccagccagtcacttgtctggcccccctcccaccctagctccgctacccagggtgcctttgtgctgcacagcttcagagggggctcagcaataaccctggggggacacaaccattgatctccagaggcttcttacctcaaatcacgtttcaaagcatttgggagataaataaaaaataagcgaaaagaaaagtagaccagtggagtgggattgtttgtctagataacctgaggacaactagcgacagtttctcttacatttccaacagtggttgatcagtcagattaggtgatgggctgtactttgattttagaaagttatctccaaaactgacagattcctttttgaaatgtactttgtttgaaaacaaagaaaatttctaaggagatttgtattctcattttttctttcttcaatcttgctgtgtatttttgtttgctgtgtgaaagctcatcatccagaattggaattacaacatactttgtcctatttttaaaaattacagctggtacatacacacaacactcccttccacatatacacacagcattttagggggcttgtaggagagcaaatggaaaggcaagttgctattccaaccatcctgtctcccaaacctggttctgaaatcagtggtactgccatgattatgtaaatagcacccctctcccaccctccaccatcggtctgtggggttggaccagaccagatgactagatattagaatgaagtgtctcagctgcctcagtagaacctcagacctataaaagtaggcaaaagaagtctcagtttttgcatttagtgatttagttaaggaaaatgttcaatcgcagtgttttcgcagcaggagaac

SEQ ID NO: 61615 - DNA, 1728 bp, Homo sapiens
aaagcattttaagtgcatgcagtcatttgtttggcgcagatgctttatttaaagtgtatatgtgttcgattaagtttgccatcttaaagcctttcagtggtaagttcttgttaccagaattttgtaacttagacatgaaaattttatccaagtttcaacttggggagcaagcctagggggagccaggtatttaaaatgctttcttttagtgaaaactgaagaattaagttgtcttctatttcaattgtgttattttctatttcaaaaactatttctttttttaatgaatctctaatgtagacttttgcctatttataagagaggaaataattttaaaatgccaaattacttcatctttaaatttttaaaaataaatgtgtttttcctaaaatatcctagaatttaaaagtggtttgaactgtggaaaacttaaaaggtcaaagaggaagaccttcctctgcatgcctttctaatttctgtcatgctgaaggccatagcactggggctttctcattacctaactgaaagtgcctctgggtcacaaatcagagcattaacttagtttggtgataggcaatgggcttcgtgaacaatttggttacttcaacaatttggtaagctattcttacatcaacatatttttaaaaattcttgccttccccaattttagtttgggcataaatgatactgacagagtataacatctctcattccatgatcattttatctgtgtggcaggtgcctcattttcctaacaaggaaattgaaggatgaatctatatcatagtcagtcaccttattaaaaaatttttattcttctaatccactagaccaggaactcggttgtggtgacacaccatacactcacaaatactcctcagttgaatgtttaatgaaatgaaactctgtgaagtgtatcacacagttgtttacggagtggccatcctcccctgcgtcagttcagagatttgcctgctgctgggatttctcattaggcaccactgctaccactatagccctgtgaggtggcaaaaatgaagaagtggtgctgtaccccatttaatattctggcccaagtatagtcccccaaggccctttccttactgggacccataatatatctgaaaccaggcaagtcatgaggttgggtggaacacagacatctgtggctttttaaagccccaagtgagtctgatgtgcaggcagggtcgagaaccactgggctatacttgaagacagaagaaggaacaataggccaggtgcaatggctcacacctgtaatcccagcactttgggaggccgaggcaggagggttgcttgagccgaggagtttgagaccagcctgggcaacatggtgaaaccccatctctacaaaaatacaaacattagccaagcatggtggtatgcacttgttgtcccagctactcgggaggctgaggtgggaggatttcttgagcccagaaagttgaggctgcagtgaaccaagatcacaccactgcactccagcctgggtgatagagtgagaccgtgtccaaaaaataaaagaaaaaggagcaattaattctctcactgggtaagagaatcaggtataaatgccatctcacacagatgtctctggccctcaggctgcttccatgtggcacgtgctatcctggcacctccggctcaggagcacatccacagaggtctacgcttctcaacacaggggcggtgcagagggagggaagt

SEQ ID NO: 61616 - DNA, 1664 bp, Homo sapiens
actgacatgcagaatgaccaaccccgcaagggagtccacacctacccacagaaccatggaaccatctggtaaatcccagcatggtcagtcagctcagagacacaggcacaccacacggcatcggggagtcacactcctgccatacatcttccactgtgggagttgaaggaagaccattccactctggaatggacttgaaaggatggggacattcagtaagaaaaatcagtggccctttggggaagagctcagcagtggaggtctgctgaggaacttgtgggatcccagagaagagagatctaagagtggggcttagagtaacaggctggtatgtgacccagggcagccagcctccttccccaaagacatgctgtgtccatgctcagggtttcactgggtcaggccattttcccagagacacacttgagtcttgttgaatatttgagtctttcatctgtcttgggactgtccctgggctctgctgaagccctaagcagtcattgtttctgtggttggatgggctagccatttcctaagggtagtccttgaagttaaggactaaggggccaaagggaatttgggggcacagaactgtgtttgctgggaactttgttgccatttcttaagaccactcctgaggcagaattttttttcatagcctctttctttaattcaattgatatctgggtggttagctggggggaggggagaggaaggaagggtgggatgagaggagagcttctgtctgagttcatggaatggtttttaggttcctcaggcaaaagtaggaaaacaaagttagcttttctcaatctgattctatagagcagtctgtctctgttgtttcccttctgtccaaattttatttctttcccctaccttaaggatgtttagttacccaaatgatcaccttgagacttgattcattcagtatgttgaataataatcatagctaacacttattaggattactgtgatgcgtcaagcactgttctgcatgtttcatattaactcaatccttaccagaactgtaacagttaggtacagttattattcacatcttatggatgagggatctgaagcacagagaggttaaataaaatccctgaggtcacacagctggtacatggtggaccccagattccattctgggtagtctggctccagagcccatgctttccacccacccatagagcctctcacgatctgtcgtattgtatgcaatatatgacatattgttttaaaatacgggtgccctgttacccagctttaaaaaactcatctttgtttagtgcacatggtctcaaagtatggttcagggagtctacaaggtcataattattttccaagtagtactaagatactctttttcctttttactttcattttctcatgagtatacagaggagttttccagaatgtcatgacctgtgatatcacagcagactcaataccaaagcaatctatgaaaatctagcaagctgggtgcagtggctcacgcctgtaatcccagcactttgggaggctgaggtgggaggatcgcttgagcctgagagtttgagaccagcctgggcaacatagggagaccctgtcttcttgaaaaagaaaaagaaagaacaaaataaagagagaaagagagaatctaactggcttctcttaagcca

SEQ ID NO: 61617 - DNA, 2439 bp, Homo sapiens
aatctcaagccccacccctgacctactgaaccggagtccatgctgttaaccagaactagtttgtctgcacaatggaagttgagaagcagaggtgtagaacatctgcacgaagcgatttggcaactcagtgacctctagccaaatttcagtctggtggggctttggcgagtccattctccaattatcttgcatccaaggagctgagtgaggtcttacctatttgagattcttcagtcctactgtctcttaagtggccacaccctcatcaaagccagcagcttcagagcagggttctagtggtggttttcaaactcgggtacatcagaatcacctgggggacttctgaaagcacagatgctgggctctgcctctccccaccaaagatcctgattcagcaggtctgagataggttctgagaatttaaagttctagcaagttctcaggtgatgttgatgccacaggtctccacactgagatcttgataaacagcatttattcaagttcttatataattatgtcatgcccataggacttatgggagagaggtcttaaacttgtttcaacaccaatctcttaaaagtaaaatatatgaaaaattcaaaatttccgtctttgccaaggaggcacctgtatcttttaataagtggaaagcagtaagatatcaggcaggtcacaggtcatttagagcacggctgttctcttaaaatgatgtgagaactaaggttcagcatccttctgcactaattgcaaaatcaccacaaaatttaaacgaggagatataaatagcctgtcaagttcatttgtcattatttaaactgataacatgccattcatccagttggtcagtgctgctctgcaccagaaaccaggaacagatgagcgtacaaaccagtgaattgccatctccaagcatgagataacttggttagagtcatcagatttcctgtgctcaaaagctgccataaatccctggcctcgtgtctgttcccaggcttgcaaacccagtgccgtcgactgatacagacctttcagcaggatttgctgagctaaacaggtgtctgatgaaaagtgtgtaatcctcaaagattatcatcccctaaaagcagctggtgaccccaaactcacataatccagagagatggaagttgggagtgagtagcttgccaaagtttacactttggtgtttgaggaggttcatatggtttggtttggttccaggtagtggaagatggaggtgtgcaggggtgagggtgtctgcccctgtcgggggagatccctgtccctatccatgcccttgcctgagaacattattctactatggtccatttacactcttgaatactcctagtttaaagggaaggaattttcattttcaatgagcgttaacattacagttattatgctgggaattaaatttaatttgggaatttgggtctgcaaaaacatatcttgaccttgtctagatagttccttccttatcctaatagatctgtctacatgagataactctctaccacttttattttctcccactgggagagagttaaccatttcaaactcagggctagttaacatgagatttgattcttttactgcaagtagttaagccttaacagaggtgaggcacactcgggttccatgcagtacagcttagaaatgcttactttttatagacagaaatcacattgttcttcctttccctttaagcagacatcttgacaatcctttgaattgattatgtggcctgtatactgaaagtcagatgtcaccttccccaggataagtacttccagtaaagcaaaagaggaagccagcttttgctacgatcaagatagttgatgtggatgaggggtttatgggctaccccgttttcaattacaaggctcccactcacagagtaagtgctgttggccagcacctctggctcacagacaagttccagggaataatttcaccagcgattaattatactgcagctactgggatttgtcctccaaacatcactttgttttccatctgaaacagccaggtttctccagggagagctgaggttttctgattgaaagtatcccgagttaaggagaagtgttagagcaccatgggaatctattcaccaggggtgtactgtacttgtttcagatgcttcaggataatacaccagcttctaagataagtgctttttttttttttttttttttgagatggagtttcactcttgttgcccaggctggagtgcaatggcatgatctcggctcactgcaacctctgcctcccggattcaagtgattctcctgcctcagcctcccgagtagctgggattacaggcgcacgccaccatgcccggctagttttgtgtttttagtagagatggggtttctccatgttggtcaggctggtctcgaactcctgacctcaggtgatctgcccacctcagcctcc

SEQ ID NO: 61618 - DNA, 1302 bp, Homo sapiens
aattatgttgtgaagagcctagaaaaaaatagaggccgggcacagtggctcacgcctgtaatcccaacacttgagggactgaggtcaggagttcgagaccagcctgggcaaaatggtgaaaccctgtctctactaaaaatgcaaatcttagccaggcatggccactggcgcctgtaatcccagctactcaggaagctgaggaaggagaatcgcttgagcctgggaagcggaggttgcatcgagcccatatcgcaccattgcactccagcctaggcaacagagcaagtctctgtctcaaaaaaaaaaagtacaaagaaacaaaaggtggcaagaaattcgttttttaaaacatcgcatgttatgagggtcagagtagtgaagtgccaccagctgcagccttctgagaggaagtgctgctgctggttcaaatggaattctgtcctacatccaccaagcacgccagtggagtggacatgacacacacttttcttctaagctgtacagtttaacatattacaagtgagttcatttaactagtaaggaatcagaaatgtatctttgttcattttgatcgttttgatggattctgttttctcttacgtgagtagactttgtggacttccaaatggctcctggcataagtgccagttcctgctattagttccttgagggtctcatgagtcagagaggagagggaaaaacccactgcaagccatgcaggggtcccttcggatagtggccttgtgcagtctgcagtgtcggtgcacgtcatccctgcacacccgcctgctgtgctctggctggagcttgggtttgcagttgtcttctttacagcacccagggaagcatggcctcctggcaggtgttggccactccctgctttctcctggcctttgcaagcacagtgcaagggtgtttgctgaaaaagaccactgggctttcagtgtacccacacccatcagggctgatcaccctgctgccacctccccaggactcttccgtgactatcagtcatagcctgaagtctgtgtccaagggagtgtctcaggagacagccacttaacatggtaggagtagcaggtgctaaaaggtttatgcctaaatgctccccatggaccccaagttgcctgctggtttgagtggcctaacccatttaggctcaggccctgacagggtgtgtgtgcaccacttcggggtgtgaaagcatgaacagctgcggaaagcgtgggttttctgatgctggctgctgctgccttccggattagggactgtagcggggagacagaacaaaggaacacatgt

SEQ ID NO: 61619 - DNA, 3118 bp, Homo sapiens
tgggggattttctgagcatacatgcaataggttgttttaaggagtttgttttgttttgtcttaatttgtaggagcaatattctgggattggattgtaaattaatttctatgaaagaggtgaaaatggagctagtggagctgatgggagttgcagcagttgacttgaaagacattcttttattagtcctaaaacaaagcttcagatcaacctgctagttaaatgtaacaagcaatatagactctgagtcaacagaggtccttctctttttattaagacccagctgtcaaagggtcattaggtccttcctgtggaaaacaacttgcccattaatgttgggggtggtccctcgacaggatttctgagtaagtgcctgacatttcgtttttgaaagaatctaaagctgtgggagacttagatgttgagacttagcaggagtaatgtcttcaaccatagcttttagtctttgttaaatatgtcacaatatgtgtttggaatgctgctgctagctgcgtgaattgacttagagtgccactgtcaaagattcaggagcgtaaacttcacggagatcaaatcactataactgggaagaggctacattcctaaagcgaatgcacttctctgttgtgatgtttttaccttgtcactactcatattatttctagtggctcctgttctaagctctgggaatgccacagtgaggaatgcccatttattttttctgccctaggctatttgctttctagaagagaaggccaagcagggtctcctgaaaagcctctctccgatctgggccgtctctcctacctggcatattggaagagcgtcatcttggagtatctctaccaccaccatgagaggcacatcagcatcaaggcaattagcagagcgacgggcatgtgcccacatgacattgccaccactctgcagcacctccacatgatcgacaagagagatggcaggtgagtcctgggaccctgggcagctccgtggctcaggcatcccacaccagaaagggtccctggagataggtgcattcattccagttaaagactgaggttccctaacagtattatcaaaccttttctcctaaaaataacacatgaaatgacacttttttactggttggattccagtgttctgtaccctctcattgaggtgctttctgatttttcctaacgcagataacattagtgctagcatatgtccgtatgtgaagctgaagtgaaatttcagcttgtgattacatcttgttctgccttatcacattacagatttgtcatcattagacgggaaaagttgatattgagccacatggaaaagctgaaaacctgttccagagccaatgaacttgatccagacagtctgaggtggaccccaattttaatttctaatgctgcagtgtctgaagaagagcgagaagctgagaaagaggtaatgattgtctttatcatcctaagttgtgtaacttcaatcttgtagcattcttaagctaagaaagtcattaagatcgttgtcaaaagcttggttatgtagagatagcatgtgaaatgatatggcactaatttatcctaactgaggttgcatggtaagacatgataattttattgaattgagtatgaaaaatgaaacatttatcattgattacaaagcagcatttttcactactgagagcatgtaatcagatcaaattcggtgctgagctccaaggctgcagtgtcaattgattctttgtgtttatgaacttgcttaaagtgctccttgccagtgagcatgtaatgtagtgataaaggactcaaatcaattcgctgcatcattaatactgttaaatatcccatgaaacccaatcttctttgatttgttatcctaactgatgcaaaaggttcctgagatgatgcagctggaatgtgcttggctggctggctgtcctgatcagaaccgacttagagacactttgccattgatcctcagaggctctggctgtgtaactgccctctcactggccaccatttttaccctccccacttaggctgagcggctaatggaacaagctagctgctgggagaaggaggaacaagaaatcctgtcaactagagctaacagtaggcaatcacctgcaaaagtacaatcgaaaaataaatatttgcattccccggagagccggccagtcacaggggagcgagggcagctgctggagctgtctaaagagagcagtgaagaagaagaggaggaggaggacgaggaggaggaagaagaggaggaagaagaggaagaggatgaagaggaggaagaagaggaagaagaagaagaagaagaagaaaatattcaaagctctcccccaagattgacgaaaccacagtcagttgccataaagagaaaggtaggtgtctgtttagattttctgtgagtcgcgttcaatcaaatcttatttgtcattgcagacattctgtctattagtatttgtttcactctctgttctttagtcgtagtttatgtgtacccagtcccgctgatcatatatcataatcgtttatctcacagtcatgattatgtttacttttcaggtttgttagtgcggtgacaggaaaccagggacaggccagcctcctagtctagtagtcactgccacctgctggtctgcaggagtagagtaactgaggtttatgggaacaaaaaggggccccagaaagcacttaaaccaccctccaagacctagaggccaggagacttctctaaggtcatatgactcattagagatggaagcagaaccaaatgcgtgctcaagactctaagcctgggttgggcgcagtggctcacgcctgtaatcccagcactttgggaggccaaggtgggcagatcacctgaggtcaggagttcaagaccagcctggctaacgtggtgaaatcccgtctctgctaaaaatacaaaaaattagccagacacggtagtacgcgcctgtaatcccagctactcgggaggctgagacaggagaacccagggaggcagaggttgcagtaagccgagatcgcaccattgcactccagcctgggcaacaagagcgaaactctgtctcaaaacagaacaaaaagactccaagcccagtgctcttcatgctgtttc

SEQ ID NO: 61620 - DNA, 1051 bp, Homo sapiens
agaataatgtttccatttcttaggaggagtgtgtattcatgtgttgtatatataataaaagaaatttgttctaaaactatcaaaaaccagaatcatccaaggcatgatctgaactggactcaacctgaagaaaaccagttctctaccttggcttccctcatattagggaaaattctcatggattaaagagggcaggcagactggggggaataataaccgtaaatgtttaattacagaatatgattaactggctacgtgtgtgcttcagtgagcattcagagcgttaacaaaagtaagacacaagaattcttggaggccggacacagtggctcacgcctataatccccacactttgggaagctgaggcaggaggatcatttgagctcaggagttcaagaccagcctgggcaacaaagcaagactctgtctctataaaaaataaataagtatttttaaaataataataataataattgaatacagtttacctgaaggttagcttttaaccaagcatattgaacccttctttgcagtgtattttcaataatttggggggcaacaattacatcttagcagcaaatctacctgctattcctctatttgaattttgtgtcattaaaaacttttttgctgggcgaaaaacattttataattacaattatggacagtcatttgtgccaacctttagtgcaaacagaaaaaatatttttaggccaggtgcggtggctcacacctataatcccagcactctgggaggccaaggcgggtggaccacttgagctcaggggttcgagaccagcctaggcaacatggcaaagccctgtctctacaaaaaagaaaaataaaagaaaaaaatatttttatatcatacaaataagacatctggcatgtctttaacatttttagattccttctattaaaatattttgccaggttatcagttgctcacatctcagcagccaccaatacttgactttgttaacattttaaacagtaatcctttcttcaggtacctttcctttccttttcatagccctgaagtcctatggaa

SEQ ID NO: 61621 - DNA, 2328 bp, Homo sapiens
atgcatatatttattaatatatatttattaatatgtatatagctattcatctgcttgtataaatatgtacatatttacatttatattaacatgtgcatataggttcagtaaaaagctcacctgaactgaaatgaacttcacaattatggtttgtttctaagtgtctttaatatgcaaaccttacatcagcaacatattgatccagaattcagtgtggacagaattagtgttaaaaagaatacctgtattttaaatgttcaggaatttgctagtaattacattgtagtttgtatcatgcaaaaatgatgatcctaaaaatgatgattacaaatgcatttgttttgggtatttagttatttactgatttgtttcagaggtacacagcttatttttatgccagagagaacattcaaatcaaagtaaataaatcatgtcttccaagatcatttacatcctataaatgtccacaaacagaggtttactttctctaggtagatatgagagttaaggcttctagtcatttttccaggacagtaatgatttgtatataagctagcattaattcctttcccctatatttcctaatttgtaaatgttcaaattgatttttttttttacactgtggaactctgggcttttgcatcagagaatgtcttgttcattaaattcaaataagcacattagcattgcctatatccatgtgttcccaatatgttactctcccaggcctaggttatttacttggtttataacacaatattattacacattagccttgattatgtctttaccatcaacttttaacatgccaaattgaaagcagtgtttgctaattaatttagaggaatgaattcaagttgcccatggttatgctttctaagactgttttttttccttcccgtttttgtctcttcactaagacaatatgaatgatgattcaagtaacttgaaagaaggcagtaaagacaatcccgaacctctaaagtgcaaacaagtgtggccaaaaggaacaaagcgcggtctatctaagtggaggcaaaacaaagagaggaagaccggatttaaactgaatttgtacaccccgccagaaacacccatggagcctgacgagcaggtaacagtggaagaacagaaggagacttcagaaggaaaaaccagccccagtcccatcaggattgaggaggaggtcaaggaaactggggaagccctgttgcctcaagaggaaaacagaagggaagaaacatgtgcccctgtaagtccaaacacatcaccaggtgaaaaaccagaagatgatctcatcaaacctgaggaagaggaagaggaggaggaggaggaagaggaagaagaggaagaagaggaaggggaagaagaagaaggaggaggaaatgtagaaaaagatccagatggtgctaaaagccaagaaaaagaggaaccagaaatctccacggaaaaagaagactctgcacgtttggatgatcacgaagaggaggaggaagaggatgaagagccatcccacaacgaggaccatgatgccgatgacgaggatgacagccacatggagtctgccgaagtggagaaggaagagctgcccagagaaagcttcaaagaagtactggaaaaccaggagacttttttagaccttaatgtgcagcctggtcactcgaacccagaggtcttaatggactgtggcgtcgacctgacagcttcttgtaacagtgagcccaaggagcttgctggggaccctgaagctgtacccgaatctgacgaggagccacccccaggagaacaggcacagaagcaggaccaaaagaacagcaaggaagtcgatacagagttcaaagagggaaacccagcaaccatggaaatcgactctgagactgtccaggccgttcagtctttgacccaggagagcagcgaacaggacgacacctttcaggattgtgccgagactcaagaggcctgtagaagcctacagaactacacccgtgcagaccaaagtccacagattgccaccacgctcgacgattgccaacagtcggaccacagtagcccagtttcatccgtccactcccatcctggccagtccgtacgttctgtcaacagcccaagtgtccctgctctggaaaacagctacgcccaaatcagcccagatcaaagtgccatctcagtgccatctctgcagaacatggaaaccagtcccatgatggatgtcccatcagtttcagatcattcacagcaagtcgtagacagtggatttagtgacctgggcagtatcgagagcacaactgagaactacgaaaacccaagcagctacgattctactatggg

SEQ ID NO: 61622 - DNA, 2757 bp, Homo sapiens
cagagcagctgtgctgtcacccagcagatgtccaacatcagcgggagctgcagcatgctgcagcaaaccagcatcagctcccctccgacctgcagcgtcaagtctcctcaaggctgtgtggtggagaggcctccgagcagcagccagcagctggctcagtgcagcatggctgctaacttcaccccacccatgcagctggctgaaatccccgagacgagcaacgccaacattggcttatacgagcgaatgggtcagagtgattttggggctgggcattacccgcagccgtcagccaccttcagccttgccaaactgcagcagttaactaatacacttattgatcattcattgccttacagccattccgctgctgtgacttcctatgcaaacagtgcctctttgtccacaccattaagtaacacagggcttgttcaactttctcagtctccacactccgtccctgggggaccccaagcacaagctaccatgaccccaccccccaacctgactcctcctccaatgaatctgccgccgcctcttttgcaacggaacatggctgcatcaaatattggcatctctcacagccaaagactgcaaacccagattgccagcaagggccacatctccatgagaaccaagtcagcgtctctgtcaccagccgctgccacccatcagtcacaaatctatgggcgctcccagactgtagccatgcagggtcctgcacggactttaacgatgcaaagaggcatgaacatgagtgtgaacctgatgccagcgccagcctacaatgtcaactctgtgaacatgaacatgaacactctcaacgccatgaatgggtacagcatgtcccagccaatgatgaacagtggctaccacagcaatcatggctatatgaatcaaacgccccaataccctatgcagatgcagatgggcatgatgggcacccagccatatgcccagcagccaatgcagaccccaccccacggtaacatgatgtacacggcccccggacatcacggctacatgaacacaggcatgtccaaacagtctctcaatggctcctacatgagaaggtagacaacgtgggcagtccacaaaacctacggggcatcactattggattgatctgcacaaatacctttgaagagtacgatttcaaaaccagcaattggtgtgaatgcaaaaacatttgttggcaccatttatttaaaaaaaaaaaaagctgtatgcagcagaaagccttatacaagttgtttttctttttttcctttttcttttttttggtaccttcatttctgttacttttatataaaattctctgcaaaggaaggcctctctttggactacaatttggaggcagccacttgttgtgcctgcttctgttaaacaatgtggatatcaagcccccccaaattatctgttttaatattgaacctagagctttttttttcccttccctgtccactccatgtaaatgcctttagcatttcagttattgtatattttgtttaaggtgacacttcagcatgccgctaatgtctttgttagtgacagtgcattttgtagtactgtacaagtgttgtgctaacagtaagccatttcttaagttttttgccttgattagggtgccctaatttgagggttttaaaaaaaactatatttttgttaattataaaactgtaaagagctataaaagctattcccatttggttagtcaaaagggttttattgctaaatgtttggtgtaaagttgagacccttttccattttggtgacagatttctttggggaaaaaaggcagctttctgttttataaatgcagacttctgtttattgaatgaagcatatctcagtgtttatctgtcaggttttgaaacatttcatatatgtccaaatacttggcaggatttaaaaaaaaatagtgaatttggtgtaaagttgctattttatggaaatgcctctaactttacattttcattccatctgtagatttttctatctttataaaatattggagttattttttaaggaaaaatagaaaagtagcttgtgaatagctcaaactaagcttacaaatcgcatgtaaaaaagcaaaaaagttatttgtgtctgtttatattgcttccttttttgtagcctttgtacctgtacagggtgacagtaagggccaagcaggagaggcgtaatccttgtataaaataggatccagcgacactcttgtatttatctgttctctttttagtcagtcacttcaaaaaaacaaaaaacaaacaaaaaaaagctgtacattttaacataaaataaattatgatgagccatttttagcctcttgtgtcctgtcatattatgattgatagagaatgaccaatggaactgtatcatgtgtcacgcctcagaacacatacacattttgggaaaataaattatttagtgtaaattggagttatgggattttctgatttgttttgactttgggggaggggttggcaataaataagagtaatatctaataaaaccatcacatataccaaatacctatttaataaattaatttataatggattttaatgcttttcatgaaagtttattttatgcgagtgcataccttctgtatgccaatcattgtctttaaaataaagtgaaattgtttttttcttttggactttgatcttcatttgcaaagagatcccgcacaaatatccagctgcctcactcgcacagtctgtagaaacatccctccaagcctcgcaccagggt

SEQ ID NO: 61623 - DNA, 1407 bp, Homo sapiens
ctcacccttatcgttattttctttcacagttacaaagtgtattgggtttagtgtcacaattttatcttttagtcccttccttcctcaactgcaaagtcaatgggggtaatatatgtaacagctgagggagggctttcaagaagacacgtctgaagggccgtcagcacaaagggaaaagatccatttaagctgctgtgctaataggaaaagaaacctatcagccatcctcagagtaggaagtggtggtctatgcctgcacaaatcgaacactgcgtccattcaggagtggccaaggactgggcagcccagtgggccacacatcgggcaagaggctgcccgagccctggaggtggggttggggcctggaagcaatctgatcgggaagcagagccccgaacgggctccgacctgtcacatattttgtctctttcctcttgggttaagattctctgggggctgagattcccctctgtgttccctttggccatgacctgctaatcacaccttgtggtttgtgcgatgtctgagttcccataccctgccagcctaacagccctctaaaggagcttgtggaagagtcccaatcattgccccagacctgccaaaccctaatcttagaacagtcccagggacacctcggttgcccaggctccttaaggactgcagcatagctaggactaggagcttccgtgctggccccagtcccaacattccttgatggaacagaaaggcttagcataggaaggaaactgctgatctgagatggcctcagaacaccctgccctccacctcacccactctcactagagaaatcagttcacatctgaatgtgacgccaaggatttggcgaaacaggaacttggattcatcaaagctgaattcattcgattgagattcattaacaggccacatcatttaaaccctaactgtgttctattatttgtaagagtcgtaccaagtggtggtcagttgccagcctcacgttttaatagttgcaagtggtgcctacgccaggtgggagggcatccaccttcctcaccaacattctattttagaagtaatgactcacaatatcgtcacaaagctttcacaaactcctcccacacacccaccctgtgcaggaaatggggccattctttccaatgtacagatcaggatgttgaggctcagattaagctacattaattacccaaactcacccagctaaaatgtgtgagctgaaacaaacccaggtctttccaaatcccagctctttttttctaggacactgtattctgaaaggccctaatttgtcacctctctgatttaaaggcttggctaatgaatacatgttgctgtaaaaactgttaagtgctatataaatacagatccctttgtggctgcgagcaagccttggtctacaatcaa

SEQ ID NO: 61624 - DNA, 1027 bp, Homo sapiens
ggcttaagtgatcctcccaactcagcctcccaaagtgctggggattgtaggcatgagccactgcgcctggcctgtttctggtgtatttatgtgtgtttgtctttgaagaaattgttaggacatactgaagcttttgttttgttttcctgttttctctctacaggcagcggaggaggaaatggcaggtcctaatcaactctgcattcgccgctggactaccaagcatgtagctgtgtggctgaaggatgaaggcttttttgaatatgtggacattttatgcaataagcaccgacttgatggaatcacattgctaacattgactgaatatgatctccggtctcctcctctggaaatcaaagtcttaggggacattaaaaggttaatgctctcagtccgaaaattgcagaaaatacatattgatgttttagaagagatgggctacaacagtgacagtcccatgggttccatgacccctttcatcagtgctcttcagagtacagactggctctgtaatggggagctttcccatgactgtgacggacccataactgacttgaattctgatcagtaccagtacatgaatggtaaaaacaaacattctgttcgaagattggacccagaatactggaagactatactgagttgtatatatgtttttatagtatttggatttacatctttcattatggttatagtccatgagcgagtgcctgacatgcagacctatccaccactcccagatatattcttagacaggtaagttttgtttctagttgctaagtttgtaggatgttgctataattaacagcaatgatactatatttatgataattatattgtttcttattgtggtagatgtatactttccatttgctttatctggcggtataaaatgctttgaaattacctttttcacttagagtaaattaggccttaagcctaggtgtgtgagaaaaaccactgctcttttaatttttcaatttaatttaattttaattttaatttaattttttattttgagacagtc

SEQ ID NO: 61625 - DNA, 2799 bp, Homo sapiens
ggctggagtacagtggcgcgatctcggctccctgcaacctccgcctcccaggttcaagtgattctcctgccttagcctccctagtagctgggattataggtgtgcaccaccatgcctggctaatttttgtatttttagtagagttggggtttcgccatgttggccaggctgatgttgaactcctgacatcaggtgatccacccacctcagcctcccaaagtgctgggattacaggcatgagccactgtgcccagtctgatttcatttaattaccaaaatatttctgagtacagccaagctttgcccacccattcttgaagtctggctggaattcattagactgaaggcctagatgctttggcttagatcttatttctaagttattcagcatttgaatttcaataggaatggatgttgggaagttcccacctccctaagcatttgaagcactaattcataacttttcttcatagatatatggcagtgtatgggagaaattacatcgagcctttgccatttggagtggctttggtatgaccctgactggcgttcacacatgtggagattacatgtttagtggccacacagtcgtcctaactatgctgaatttctttgtcaccgaatgtaagtatctttttagtgcttctatgcgtattaggtaactagctgcagtgaaggctgtgggaagggtgtcagatcctgtgaagaatggcaaaacagcctgacctgagaaacgtgactgagaagcattggaaggaatgtagctttaaaatgatctttctgtccttttcctagatacaccaagaagctggaatttcttgcacactttatcctgggttctcaacctctttggaatcttcttcatcttggctgcccatgaacattattctattgatgtgtttattgctttttatataacaacaagactctttttgtactaccatactctggccaataccagagcatatcagcagagtaggagagcaaggatttggtttcccatgttctctttttttgaatgcaatgttaatggcacagtacctaatgaatattgttggccattttcaaaaccagcaataatgaaaagactaattggatgaatactatctttctaatgaatttgtgattaaatatataatagttgttgaaaatgagtaactttgcgttctccccctaggttgttcttagatgcctggcttatgtgttgacaaagtaaagttttctgttctgagcaaagttatgattataaaaagcaagaaagaacaatcaagagtccttatgtagctatttgaacagaaagcttaagtagatgttttctgccccttctctttaggaagacttaatgttgtgattgaagtcaggctgtacccttacctgttgagtatttgcttattgaactttaaacaagtcaacttgagcagtttgctggttgaggaattttcattgatttccagtagggctctagtcaagaaataatatgttttgaagctccttattacctttagaagaagaaaccctaacaagtgacagtacttgttctttggactaatctttgtttcattttaaaaaatgcaaccctgggacatgatctgttttactgacaaagagtttttgccttctgaaccatctttaaatatactgagcataccaggatgcctgaaataagaagagaatgaaagaggccatagatgacgtgacagagtactggctaggatgccattggtctcctcattaatgcaaatgtagggctggcatatttcaccaaagatgcaacaaaagatgcagtgccagtgtgaccctcagtgagtattcatgagggaaaaatggctgcatccataaaaataaatgggcttaatgttagtggtataggtacccagaataacttctttgtgctatagttgttagatgacagttcaattttatgcttttttaatggtgttattaaatgagccaaataggagtgttttaccagatgttagataaagttcttaatgccgttaagtagggaggtatgcatgcaaagaattgttttctcctgaaaagaaacttacagcacgcaaaatataactttttggtttttgaaatttatcattcttggctgttggaagtaaacagtctcagacatacttggatatgaaaaagtttcgttgttttttacttttaaatataatggtgtatatacattctttctatttagtcttaatttggcagtcaggaagtgatataacttagctgctatttacaacactagaaatttagtactttaagtaatttcacatctatgataacatttgttactttatttttaatgatttttttacagtagttatgacagtaggatggttatggaattggaatttaaactcccaactaatgagcttaagctgcttggaatattaattatgtagtttttacattccattttaaaacaaaaacttagaaaaggtgctggcattctgaggcctgcaattaggccacatagcagaagcttgctccttccttatctgggtgaaatattttatttttgcactttgagtcatattcccacccctgtataagctacataggagcctgaatgaattgggtaggaaaggaaattatgcaaacaagtctcagctagtgctgaatgaccccaatttgggtctgctgtgaacatcatttttgtatttctcacttgagaaatgctgcaaggcaattcaacttttatgcttttaaatctcacaactcagaatctgatatcttaaatcactgattctgttacatgctaggaacaaaatgccaacatctcatgtaaagaag

SEQ ID NO: 61626 - DNA, 2171 bp, Homo sapiens
acttctagctctatttatttgtatcctttgaaatcagaacttatccttagaaccagtcagttaaataatgcggactatgcctataatcccagcactttaggaggctgaggcaggcagatcacgaggtcaggagttcgaggccagcctggccaatgtggtgaaactccgtctctactaaaaatacaaaaattagccgggcgtggtggtgcacgcccatgcctgtagtcccagctactcgggaggctgaggcagaagaatcgcttgaacccaggaggcggaggttgcagtgagccgagatactgccactacacttcagtctgggtgacagagcgagactccatctcaaaaaaacaaaacaaaataaaataataatgtgggctattcagaagaaaaagtcagtgacagagagaccagaacccattggatcaagagacctgcagggattataactctttactctgtgagcagcggtgtttcgtgccctgtctctgcctgtgtgtttttactaagaattccagaaatcctgtaatttgtaaatgggaaacagaggaaccagattgttttatagctgataagaaacagtctgttttagaaacatctgtttggaaagtattactcatgtattcacaaagtcatatttataacactagtcttctttgactgtattcaacaaaaggcagtttcaccattaatttcatagtaagcttttttaaaggattctagatctaaattgcctaagaatgttaaccacattcttgttttaaactctctaatttaataaatgtaattattttatagtcttttatagacttacattttcttcatactaaaggtaatgataatatagtcatttgccagtactttaaggtattcaggcatttgagacaagaaagctgtcttgtagaatagtccaattgctttcttaaacagtactggtttcatttagacagtttctaagccagcaaaggtgtcaattttaatgccaacttgacagtttaacagttagtgtttgtaagcagtttagcctgaattatcccatactgctgtagaggagaattgttagtaacatcaaaggtcagaatgcttcaggtgactaataagaatggaaagagactgagtaggttttttgtttcttttccctgtctttgagtaactttgaatgactaaaattagtatgaaactaggttttggacccccttctcacctcacccggatgtaatgccaccaatttcaaataactaaaatgtgaccaattactttgcttcaagttctatacaaatatctctgaaatctgtaagccatatttcagctattctggtttttataatacattctaccctaaattaaccaaaggactttttattcagtgtattccatgtttcagcataaggaaagtttgtgcctgatatggcaggagaaagaacactatggtaatttcattgttacttcaggtctctttcaatctgaagaactgggttgtctggagaattgaacatagccaagcaatattatcaattagtaatgtcatcttaaaaatgttcacttttactaagttttattcagaggatctatgtattattagaaaaatgaagtatttctgacatggaacaaagaaagtggaaactggtacttaatgggggaagcaaaattagctgggactaaaacggacatgttttgttttgtgaattctacctaaatgtctctctatccacagagaaactagtattacttgaagatgtgaaagttcctgtggtagccataccttgaagcacagtgtttgtacataagtaaatatcttgattctaaattaaatccagatttaactaatatatattattttatatctttgttgtattaaaatgtttaaaaacactaaaaataaaacatttgaaagttggattacagtttcttattgaaatgtctttgcattattaatggagctggtcagttttttatataatgaattttagtttttgcaaatgattggccaggtgtggtggctcacgcctgtaatcctagctctttgggaggccaaggcaggctgatcgcttgagcctaggaatttgagaccagcctgggcaacatggtgaaaccccgtctctacaaaaaatacaaaaattagccaagtgtggtggtgcgtgtctgtagtcccagctacttgggagactgag

SEQ ID NO: 61627 - DNA, 1025 bp, Homo sapiens
tgagtgaaacacacatggcagtattttttccaagtttcaatatttaaattcccagtattaaattctcttcccactccagggtgttggttttcccctcagcgaagatattaaaggacgtatcagggtaaagggcctagtcttaggtttcggttttatctaatttagttaaatcagctcatctcagtgaattttggcagatacataaatatccatacacacaaatacttgtttgattctttgtacttgtccagtcctaggaagtgaggctgtaggtaatagactgtttttccgttttgaaacgaattccccaagtttgtataatcatggttatctgttttagaaataattcgttggtggtatctcctttatgggtcgttatagttctattgtagctcctgaccgcataaaaaacattccaacaaatgggattgcttgaattttaatatcagcagtgggtcatgctcttgttcttggatagaaggtgggagaatagagacattaacactggaatgttttttttctaccagcaatgtgtattcctccatcatatgctgaccttggcaaagctgccagagatattttcaacaaaggatttggtaagaaccttatttttaaaacgttttagataaagagtgaaaatgtatgtttgggttgcttagcgaaatcagatcaatcattgcaaattgtaaatatcttgctgctttaaatttagagttacttatttttttgagacagggtctccctctgttgcccaggctggatgcagtggcatgattatacctcactgcagcctggacctcctgggctcaagcgatcatctttcctcagcctcccacgtcccaagtagctgggactacaggcacgctctgccacacctggctaattttttttatttttcgtagaggtggggtctcactgtgttacccagtaaacacagtggcctctcaaagcctggttggattacgttacagacatgagccactgtgcccagccttgtattaattcttctattagaaacttaagat

SEQ ID NO: 61628 - DNA, 1097 bp, Homo sapiens
cgaggtcaggagatcgagaccatcctagctaacacggtgaaaccccatctctactaaaaatacaaaaaattagccaggcgtggtggcacgcacctgtagtcccaactactcgggagactgaggcaggagaatcgcttgaacccaggaggtggaggttgcagtgagctgagatcgtgccactgcactccagcctgggcaacagagtgagactccgtctcaaaataaataaataaataaataaataatttgaaagcattcttttgtgtaccaactaccaaaaactagacaaagcagcatagggataattctgccctttataagccagtttacaaaagacgaatttgtaacaatttcatttaaatattgtatattaacacatttttatccacctctgaatatgtggaatctttttgttttttatgtatagtcaacaattgctatgcatctttcatacaaaggaatcattttgtttcttttgctgtctatttgttgaaggttttgggttggtgaaactggatgtgaaaacaaagtcttgcagtggcgtggtgagtgttactgttgaataagttctattgaacctttataatttttcaacttgtaaaatggtcataactgaaagatgtctacctgttttgtcttaaagaagaggcagaagttaactttgttttaagagatttgcgtgtaacctgatttattttggccttgaatgtgatttctgattttcatgtggtctttcgtcatattatgtatgcacaaggaacttaggaaagaccagtcaggtggtactctttactcgtaagattacacatttgaaggcagggaacccattattagacttttttgtaaccctttgtcaacaatgctcgtcagagttatgggcataaaaatatcaggaactcattaatttgagtgtactaatcatttatataatgtccattttctagcagttctccctggagaagatttccacatgtattttatgagtttagggagtcctgatctgaattttttttttttgagacggagtctcactgtgtcacttagactggagtgcaatggtgtgattgtggctcactgcaacctccgcctcctgagtt

SEQ ID NO: 61629 - DNA, 1390 bp, Homo sapiens
ggtgtgagtcaccatgcccagccaagaatatttttaaagaggttaatattttggtatttgggtgtcttgatagttcaatgaactgtttacaaaggggataaactaatatttaacttttttcgagacagggtctcactcggttgcccaggctggagtgcagtgagtgcagtggcacaatctcagctcactgcagcctcgacctcttgggctcaagcaatcttcccacctcagcctcccaagcatctgggagtacaggccgtatccatcatgcctgagtattttttgtagtttttctagagatgacgttttgccatgttgcccaggctagtcttgaactcctgagctcaagtgatccacttgccttggcctcccaaagtgctgggattacagatgtgagccaccatgcccagctagtaaaatttaactttgtgaaattttttttacttaaaaaatttttgttttgagattattttaggggtgggtgtgtgtgcacattagaatactataggttattttgatatatgtatgtatgtatatatatagagagagagagactttttttttttttgagacggagtcttgcactgtcacccaggctggagtgcagtggcatgatctcagctcactgcaagctccacctcccaggttcatgcctttctcctgcctcagcctcatgagtagctgaaactacagacacgggccaccacgcccagctaatttttttgtatttttagtagagatggggtttcaccatgttagccaggatggtctcaatctcctgacctcatgatctgcccacctcgggctcccaaagtgctgggattacaggcgtgagccaccgcgcccggcctatatagacatttttgatgtagtgcatgtaactgatatttatttaatcgtattgtagtttttttgttttgtttttttttttttcctctgagacgcagtcttgctctgtcgcccaggctggagtgcagtggcatgatctcagctcactgcatcctccacctcccaggttcaagtgattctccggcctcagcctcccaagtagctgggattacaggtgcttgccaccatgccccgctaatttttgtatttttagtagaaacagggttttgccatgttggccagtctggtcttaaactcctgacctcaagtgatcccaaagtgttgggattacaggcgtgagccacagcgctagccctgtagtttaaaagcctaggcctgttggatttctggggatttacattgatcatatctgtcgcttggtttttttggtctgaaaggaagcttaggtgtttagttatgattggatgacttatttggccaagttaacaggttacagagcagtgatttttagtgttttttaatgttcccattgttagtctat

SEQ ID NO: 61630 - DNA, 1032 bp, Homo sapiens
gcccctagtgtatttgttgaaacacaaaaggccttctaaaaaagattcagtccttgtgtttaaaaagcttactttctagttggagagacaaaataaactgagagtactgaggtaattaatatcaaatattagatcgttggataatcaaatctttgttggaaaggaatagattgttgtgtatagggttagggaaagttttatggaagtaggtttaagagcatgaaggatatgtaggagctggattagatatagcatgtttttattcacatttaatacatgtaactcaacaaccatggtattgatcctatagtatgtctctggccccagataagtcccattaatacctggctctgttttcttacctgaacagcaaagctactgaagccaccccagaatgtagaagccaaaatttctggtggtaaagggtatgagctgtaatctggcccaactctggtcccacagggtggtgttggctttgtttcttgaggcttccttggcatgtgtatataggctggctcttgatctgtgggctgatgaatggccgtaggtggggccccaagagtcattaatgtcattcaggattaaaaatagctactcacacattccccattcaaactgctagaaaaacctgttccatatatattgttttagtaatgctttccttttctgtggagcatatgaaaacgtacaaactttcacagtgtcagttcaatttaatcattcggaggtaggctttgtaattatagttgcagaaacagacccaaaaaagttaagtgaggctggtcacagtggctcattcctgtaatcccagcgctttgggaggccaaggcaggaggatcccttgagcccaggagttctgagactcacctgggcaacatagtgagaccccgtctctacaaaaaaatttaaaaattagctgtgcttgttggtgggtacctgaagtcccagctacttgggaggctgagataggaggatcgcttgagcccaggagtttgaggctgcagtgagctatgactgtggcactgtactcca

SEQ ID NO: 61631 - DNA, 1032 bp, Homo sapiens
tgaggcaggagaatcacttgaacctggaaggcggaggttgcagtatgccgagatcacgccactgcactccagcctggcgatagagcgggactctgtctcaaaaaaaaaaaaaggtgtacagtttgttcacttgagaattcactacaggttaacttgtgattgattggaagtgtcagctgtgtatgtaaagtggcagtcagttgctcaaaggcttatttgtcactcttatatatgcttagagagtagcacagtgcagaaggatacgagtgtttaggaagctagaaaaaggattcatgaatttaccaaatgtttcagggggtttgtgtgtgtgtgcgtgtgtaaggcagtgatgaattctaggcttatgagaatgttcatgaagttattgattgtcttgttaggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccaggtaacattttgaaaattttagtattaattttattaatttatttttgtatttcaaaaaaagaaaacaaattacttttctttcaaaatagatttgtcaaggtttgaaactgacatttgatactaccttctcaccaaacacagggtaagcacagacatttttatctgtattacatttaaaagtatttctcttttgtatatttagaaaaggtgtacatttactgtttgatagcttattaagctaccttgtggtggtgaaatctctgtatctgcttttatttatttatttgagatggagtctttgctgtgtcacccaggctggagtgcagtggcatcatcttggctcactgcagtctcagcttcctgggttcaagcgattcttctgcctctgcctccctgagtagctgggactacaggtgcgtgccaccacgcccagctaatttttgtatttttagtagaggcggggtttcgccatgttggcc

SEQ ID NO: 61632 - DNA, 1570 bp, Homo sapiens
gtttaagtgattctcctgcctcagcctcctgagtagctgggatcacaggcatgtgccaccacgcccacctaatttttgtatttttggtagagacagggtttcaccgtgttgatcaggctggtcttgaactcctgacctcgtgatctgcccacctcagcctcccaaagtgctgggattacaggtgtgagccaccgctcgcagcctgtttgtttattctctgtcacccaggctggagtgcaatggtgcgatcttggctcactgcaacctctgcctcctgggttgaagcgattctcctgcctcagcctcctgagtagctgggattacaggcatatgccaccgtgcctggctaaatttttttgtatttttagtagagacgggatttcaccatgctggccaggctgatcttaaactcctgacctcaggtgatccgcccgcctcagcctcccaaagtgctgagattacaggcgggagccaccatgcctggcccatatctgcttttagaatactatggttgctatcattggcttgccttcaaatatttgcctctttgttgttgcactaacttgggcaactaatgtgtttctaacaggcttttgtgactgattgtttgttctgcaaagcagttttcctagatggctgtccagttgcttcatgtgtccttgtcttgtagttcattgagctgacttttttactccctgttattgtattgctgatttttactccctggtcatactgcagtttatttaagtctgttttgtgctctcttgtgcagaagtgtgtgtaaatttttcccaatgacatcagtttgttctttttccagaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtgtaagtatttctttcataggatactgtgatgtgggccctcagaggatgattttgatgtctgtcatcttattgatctgggtgcaccctaaaggatttctcataacatttaaaaacaaaatcattcttggtcatttctagggtgccccttgaaagtttatagtagaagactgttagtctgacctttggtgctgagagagtaaatgttcattttatatggggtttaatgtgctttgtatttttacaagaggcattatatattggcagactgctaccagtacattcattttacttaattattttgatgtgtgagatgctgacttgataggattgcctaaaatgtatggtgttttgtggttgggtttttttttctttttcttttttctttctttttttgttttggttcagacagagtcttgctcttttgcgatctcggctcactccaacatccgcctcccgggttcaaacaattctcctgcctcaacctcccaagtagctgggactacaggcgtgtgccaccatgcc

SEQ ID NO: 61633 - DNA, 1035 bp, Homo sapiens
gaagcacaaagaagaaaacctacgtttcttacaatcatgccagctaggtatataatctttgttaatgttgtggttcacctttttatatgtgtgtgtatatatacttatatataaaatacgtaaccaaaaggctgtttgagaacctcttgcatgtttaatacagtgtgataattccactgaatggatattctgtggttcattttaccaatccctgtatgggtatgggttggggaaaaaaacctgttaaaacttgcaagttttcagtggaacactaaagacccacttgagctgtggttttttatttaaatgtaatgctacaaatcagcctgtgccttagacattattacattgtctattctagatctactaatttaaaatatcttatagcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgtgagtacttttgtggacttagaatgggggttttggttgtgggaatgagtctttgggtatactgaattatgttgaaaatttgaactgatttcacacagtccccagtttacagatagattagttttagattttgaaatgcgcttttttgatggatacagtgttagacgttttatttccaggccaggctggtggagtttgtttaacctcaaaagctgccgagttaatgttgatgataaccttgagccataggcctgtctaagtccaggtatagctggtgtttggtccctgagtggttcttactgtgtcagaaataatagtgcttttttaaggctctctgttgtcgaggctggactgcagtggcacaatcacgactcccggcaccttgacatcctgggttcaacctcagcctcctactattcccaactaattttttgatgtttttttgtagagatgggatctccatatgttgcccatcctaggctcaagctatcatcctg

SEQ ID NO: 61634 - DNA, 1255 bp, Homo sapiens
tactctttactatgtcttactcttcagggttcattccagcccttgaagtcggtaactaagtcctaaaatgttgggattgtgcaaggaaggcaggggcctggattggtacatgatacctcactgggacctcctcccaaacgcagtggttacatacagccagaactcagcagcaccggcatttatgagaggtgtaagaatgtgaggataaaggattgtttgatctgattcttcagaggaattacttgtcgtttggagattttttttttttttttaaacattcatggttttgattctttaggaagagtcctggaagtagtaatgtgtgtaactaagtcatgaatttaaactttataccctgtgctttaaggctgctgtgtgtcacctctagtgagcctgacttgtaccacattttggtctggtttgttgtgctagactagaattaacaaagatgatttttatgagagtgcttaggcttttgtgctgtatggacagtttggggtctttggatacattccagtggctatcaagagtattgtgtcctactgagaatttgatttttgagttgaatggatacgaattaaatagtacctggtttgtttggcttaatacataatattgaattttattgtctcacgtgaataaaactgaacacttcatgattacatgatggggaaacatgtaggggctttgtctctattgaaatatttttcttacagttgtttttgtattttattttaggcaaaagtcaacaactctagcttaattggagtaggctatactcagactctgaggcctggtaagtattcttgataaagtaggattgttttgatagtattaaaaaatttagttttcattcttcagcttacttttcagacctttcaagcacacagaagagttgaaagaagagtacaataaatacgtgtttaccttttaccacaattttttatttctttttctttgctttttttttttttgctgggccatttggtcatgacacttctcttcagaataaggcccgtctcttcttttctgcataactataatactatcacacctaagaaagttagtgattccttattatttaatacccacttcctgtcagtttcctcgcttgtatctgaaatgttttgtagtaatttttattttgttgatcaaagttcactcattgctttggttctgcctatagtcttgttgactttatataatattttgaagcgtgctgtgtctagaacagcgcttctccaacttcagagtg

SEQ ID NO: 61635 - DNA, 1041 bp, Homo sapiens
aagactataggcagaaccaaagcaatgagtgaactttgatcaacaaaataaaaattactacaaaacatttcagatacaagcgaggaaactgacaggaagtgggtattaaataataaggaatcactaactttcttaggtgtgatagtattatagttatgcagaaaagaagagacgggccttattctgaagagaagtgtcatgaccaaatggcccagcaaaaaaaaaaaaagcaaagaaaaagaaataaaaaattgtggtaaaaggtaaacacgtatttattgtactcttctttcaactcttctgtgtgcttgaaaggtctgaaaagtaagctgaagaatgaaaactaaattttttaatactatcaaaacaatcctactttatcaagaatacttaccaggcctcagagtctgagtatagcctactccaattaagctagagttgttgacttttgcctaaaataaaatacaaaaacaactgtaagaaaaatatttcaatagagacaaagcccctacatgtttccccatcatgtaatcatgaagtgttcagttttattcacgtgagacaataaaattcaatattatgtattaagccaaacaaaccaggtactatttaattcgtatccattcaactcaaaaatcaaattctcagtaggacacaatactcttgatagccactggaatgtatccaaagaccccaaactgtccatacagcacaaaagcctaagcactctcataaaaatcatctttgttaattctagtctagcacaacaaaccagaccaaaatgtggtacaagtcaggctcactagaggtgacacacagcagccttaaagcacagggtataaagtttaaattcatgacttagttacacacattactacttccaggactcttcctaaagaatcaaaaccatgaatgtttaaaaaaaaaaaaaaaatctccaaacgacaagtaattcctctgaagaatcagatcaaacaatcctttatcctcacattcttacacctctcataaatgccggtgctgctgagttctggctgtatg

SEQ ID NO: 61636 - DNA, 1176 bp, Homo sapiens
ggagaactgctccgcctactacgagcgctgcctgcagctgctgcgacccggaggcatcctcgccgtcctcagagtaagggatccactgcgggggaggagaaagcaccctgtcgggccgggtccccatcttttcccttgactcctcttataccccaaagccccacccagtccagtcacgtaggctacaccccctccggggctccggccccggtacccaggctttcctccgctttggttctgtctccagctctggtcacctcctgcccgggcacctccctccgaggccccgcctcccgcccagacacctccctccgagaccccgccttccgtctgggcacctccctccaagaccccgcctcccgcccgggcacctccctcccagtcccccgccttccgcccgagcacctccctccgaagccccgcctcccacggcccggttggccccgccctcccgcaggtcctgtggcgcgggaaggtgctgcaacctccgaaaggggacgtggcggccgagtgtgtgcgaaacctaaacgaacgcatccggcgggacgtcagggtctacatcagcctcctgcccctgggcgatggactcaccttggccttcaagatctagggctggcccctagtgagtgggctcgagggagggttgcctgggaaccccaggaattgaccctgagttttaaattcgaaaataaagtggggctgggacacacgacctcctgagcctccgtgtgtggcgctggatggggaagggagggaaggcccagcacagacagctcctgccttcagtgaaaggggccttgagattcgtcccctccctggcgccaggtctgtggcccaactgcaggaacctccagctggcaggaggcaggttataaagttttaactggcctggccacgtgtaatggccagagaccccagcacctcgggcttgtctgcctcctacatctctccctcagggcaggcgaagctctggttctgagcagctgggactggtagagagccacgtctggtgtctgacaacatgaaagaggattgcaggggaccacgggtgtcacttgtgtgcttttgtaggtgatgccagttctgctggcggcttgctcatgtcttcacagcacagtcagctccccagcctcacctctccagtggaggccctggtgggggaacatcacctctaag

SEQ ID NO: 61637 - DNA, 1068 bp, Homo sapiens
agtgccccgacaaggtggagcccggcgggcccgcgagtccgagacctgtcccaggagctccagctcacgtgacctgtcactgcctcccgccgcctcctgcccgcgccatgacccagccggtgccccggctctccgtgcccgccgcgctggccctgggctcagccgcactgggcgccgccttcgccactggcctcttcctgggtgagcaggacctggtcccggcgggcgggtgggcgggcgcagagtagggcgcggcgtggctcaggttaatccaacaccctctccccgtcagggaggcggtgccccccatggcgaggccggcgagagcagtgcctgcttccccccgaggacagccgcctgtggcagtatcttctgagccgctccatgcgggagcacccggcgctgcgaagcctgaggctggtcagcagggcgcgggacggaaacgggcgtccctctcgacccctgcgggtcccacgtggctgtgtgaccttgggctgggccctggccctccctgggcttccggcttccctgggccgggtgcggtgggcgttccgaagggccagtcccccaggccacgcccagaaccgcgcccctggggcttgggacccccagggcgaaggtgggtgacctgcatggctggtgccaccctctcctttcacgcagctgaccctggagcagccgcagggggattctatgatgacctgcgagcaggcccagctcttggccaacctggcgcggctcatccaggccaagaaggcgctggacctgggtaggggcacgcggccgggatcccggagggccgaggtttccgggccgacccccactctgggctgagcccgtctgtgtcctggtcccaggcaccttcacgggctactccgccctggccctggccctggcgctgcccgcggacgggcgcgtggtgacctgcgaggtggacgcgcagcccccggagctgggacggcccctgtggaggcaggtgagcgcccgcgcctagctctgcagccccaggcgggggcgcaacggctgacccgctccctccgcaggccgaggcggagcacaagatcgacc

SEQ ID NO: 61638 - DNA, 1885 bp, Homo sapiens
tttaatttttccaccccctcccctttttgctactcatttcttgtctcttgcatggcggcaccagtatctcagctcaccaggaagggagcaaagtgtcgcctccgaatctgttctagggctttttcctagaagcctgggggctgaagacagagtgggttttgattcttctccaggcagtgggcctggtagagggtggggggagctgagcctccccaaagggccttgtggatgtgggcagcagcccccaggggagggaatgggcaggggaggtcatttccacctgtctcaggtgcgttttggccaaatgccattgccccattaagcaccaaggaacctgaagcctcatcagggcagagaaaatgggcatcagcacctgcacttaggcccccaccaggcagagagggggcaggctgagtagactgatacagacagacgcagatagcctgacagtcttagctgaactgggtcactgggaacagctctccacacaaacaggtctggaacagacccctgagtttccatcctactggtcccactcctatttctcatagccctgctagcatcacacaggctgggcgctgtcgcccgagatcccccgggactgagcagggcaggaggcagaaggtaaggtcgtagaatcaatcctaagggattggagttcagatgttttttggggccaggcaggtgaagtaagcagggcaaggtgatagggggtggtgggtactggagcactccagagctcaccctccaccaggggacatggtggccacttggctttagccttggatgccaagtgggaagatgggcccagtatggccagagcttccgattccccaacagaggttggcaatatggctttcagtgtgaaacttcacaattttaaacatcggggtgtgtgtgtgtatgtgtttaaacactgttggccaaactgaacacatatttgagcttcatgtctgctctggctcatgaggcaccagtttcctctgactctgagcatgaatgagagaagttagggcttgaagtggagtcccctagagtgagaagggcctcagtggccagcagaccaccgccgatgtctgggtgaggtctactgggctccccaaggaggacagtaccttttacctaagacgtcgggaggcagggctgtaactccaggggctttaggacggttcaggccaagtgcactgacacaggtagacacagacagatggcgacttgggggctcctggggctcctcacatgagctgggagcatgacggggccacaacctggtcccacctcctctgtgctgagatcctggggagctgaccctggcagcgcccctagtgactcactttcctcatctggagaggctgaatgggaaagctacagcatgggctttagaacagatggacttgggttcaaacatctgccccaccactcactttgcagctgagtaagctcagagtttctgagaaactctagaaaactaggaaatgggcatgaaccttctgtcttcgttttccattgctgtacagcaaactgccacaaagttagtagtttaaaacaacacccacttgttatctcgcagagcgtaggtcagaagtctgacaaggccgggttggattctctgctcagggtctcaccaggttcaagacaaagttctcccctggggctgtggggcctctgccaagctcaccagttgttggcaaaattcagttccttctcttgaaacctttccatcttcaaggccagcagaggcacctggcatctttctggtgctcccaattgctgtcttcctcttttgctttttttttttttttgagatggagttgcgctctgttgcccaggctggagtgcagtggtgtgatcttggctcactgcaagctctgcctcccgggttcac

SEQ ID NO: 61639 - DNA, 1125 bp, Homo sapiens
ggtaagtgcatctgctgtgtcttttatgaggtaatgtgcataccagggtactggagggcagtggaggagagggagaagaaggggcagaggagcaactgttgcaaaagcccctgagtgagagggcgattgttgcggttatatcaatgtgccctgatattcaggtttcttttggacacctgaatctggccaattttagtccaatttccattgtcctgggattagtcttcatcatgttaactgcaccaggaaaggggagctgttggtggagtccttggagcccccaaagctgatttgatcagggaaacagtcacaagtgtggcctttttgtgtgtgagaaacatgtgtttcaagttgcagaagcaatcattggatcagtaatttcagggttgggagcagctgggtgatttccatttgccacattgtttctgttccatttaatttccaggtgtcctacataggccaggactgcagagaaattccagagcaccttggcagggactgtggacatttcgcaaagaggcttgatctgagctttaaccttctgaggtatgtaaccttcacaagatgtaggccaggcctgggaggcccagtcctcctgggtactttagggccaagcagataaaagtcaaatgttccaactccacatgggttgtccttttattcagcagaaggctctgagatgcgtggaatcacaccccaaaggtttcactgtgtccggtgattccttggctgcctttttttgtgctgctgaagaggcaggcagcatattgagcctcatccatttcacacgagttcctatgagagagccgtcatattttcactgtgttcttttcatttctcacggatacctgtgcagacaggtcagaatactcttggggaaggaatgagatgaagcctgcaagagtgttttggggtgtctaggtgtgctttcttaggataaacacatgtcccaaaacattcgtcgagtcacaggtagggtgtgtgtatgtgtgtgttctctttcttttgtctttttatgaatgggagctttaaatatttgtgatgataatttctcccggatggtgtttcaaagcaatttaaatactgctggtgtggagtgggtgggaggaaaactctctgacaact

SEQ ID NO: 61640 - DNA, 1061 bp, Homo sapiens
tttatctttacttggctttctattacaactggcagggctgtttttcttggggtaggggaagtggaggggagaaaaattccccacaaggattgtttacaaataactgattttgttttgaagttgcttttgacttactacacttcatcccctaccctgcttctaaggggaaaaaaagaaaagagagactttaaatgccaagggaacattttgttaatttagctacatcaagctgaatgctgcagctaaggcgaggcaggatttagctttcgctacgtcttgaggagttataattttttcttctcagctattgctctggtaaaaaaaaaaaaaaagcatttttttggtgtgtgtgtatgtgtgtgttctaagtctccatcggtgaggtggtgctgtgctggatagtacatttgggggttatatgtgcatgctaatttgctcaattctgtgccgttggcttggtgtaagaagtgggcatgttttccttggttcagtcccacttggtcttgttatgcctttttctttcagtacccaaggaagggacggaggaaagaagtggccagcgttgttggagaggtcaagggaggggctccagtgcagaccctctgctcacttcctccttcactacacttcaggatttgcctggggtcctgggctgtcacactcctgaggctgcgtggaaagtttttgttggcgtctcgatgcccatttattttgagctggtttattctgtgctgcctggagccctggttagtggtgtttatcgcgcgtctctgttctttgttcacccttttcaacgtgattgctgttcacgccgctaagggagaaactgcatgttttgagacttggggtcacatcatagccttgttttttcttgcaaattttagaacaggatttttttttcccctttgcttcttgccacaagataagggctagtggccagagccttttttggatcgggttttaaagccttacccttgtcttacccaaggttaaaactcagtgatttcaggatatgacttttttttttttttttttaatgtatccagtatccattgtcaacc

SEQ ID NO: 61641 - DNA, 1089 bp, Homo sapiens
ctgttcctttatggaccaccagtttttggttctatctcagatatgttttagtcctcttgctgctgccgtttatctggacggcattttccatcagttacaggcaaagaatattgtcctcttttctcactcctcagagtgtttctgggttccaggggaaagaggtgatttgaatgcaaatgcactttaaatcactaacactacataactctaatgcattactgccattttttctttttacttttaattgagaaactgaactcttgctagtttgaagctcagagtcattgttggagaccaagaagctggggtatttctggctggaggatgatctagtagaaaatcaaggagatcattaagacacaggatgcctgagtattgagtattgagtatttgtctttgttccatcacaaatcgtctgtgaaatattgagtaggtcatttaatctctgttgtcattctccaaatgggagatagaaggagttgtgaagaccaaatgaaatactaaatgtaaaagagttttgttcctgtagaagatatactgaaagagtagatatcccaaaagtagtttatttcatttttgattcttttgactttgagcaggtttatctttaagattattttgcttggggtcctatggcattggttgtttataggtttggttttgcaaagttagggctctgtggggggtctacttcctgccagactgtagattgcaaagttatggacttgggtctgaatggccaggtttcccttgggcaaggacaactgagagtataacattttccaattcaattatgttttaaaagggaagagggaggaagcagaatcttcattagaacaaaataaacatgatgattattagcagtgatagaatactaaataaggtatgtcattatagtaagattttaagaaagccaaacgtcagagtaaaattccatatcttacttaacaattttgaggcatgatttttatctagttgtacctctgagctcagagaagaattttatcacctaaccctctacagcagtttcaacatagatgcaccccacccttccccaatttgctcttccacagactgtacctgatggga

SEQ ID NO: 61642 - DNA, 1051 bp, Homo sapiens
gtgtggcagttagttgcccatcacatttggtggacagtggtcctcctgggacttgctgtcatgtggtgtactttaaaacagaagttaagaaaaaacagtgaaaaatgctaccattgaattgggtggcatttaagactgtttctagccgtcctgactcttagaactttgctttctcggcaatattgtgggtgcatatatttggcagggggggattctaggtttatgagtcaacctgaggagtaagaatggaagatgacaatagtttctgatctttagcttttaagtcaaggactgctttccaaaatgttcttggcaggcaagctgcctttgaacattgttagacatagacatagcctcagaatagcatctgaattacgatgtttttgtcttcttttccccaacttgtgatggctgatagacagaaaatgctcataaaaccttgactcaaaccaccaaatggctgaataattcaagcttgagttttttgaagaattttgaatcccaaaataagactcctaaggaaatagatatgatgtttctttcttcctccccttttaagcctaattagggtttgtacttaggtaatggagggtcagattcaggggaaagtcttgctagtatgagcttaaactatacaccagaatttctctatacccataagcttcattaaaaaaacgaaaacaaaactcagaaccccaaataaataaaaacacatttatttgatgatgtctctgtccaccatgaagaggcttagtgttatgcttgttgtagaaaaatattttgtgaatgtgtcttacaatctttcactatttttggtaaaagacagttctttttatcttctaaattagaaattcattgtcatggattttttgtttttgttgctttctttagcctgtttttcagggatttttttttccatatcaggattgcactgtgattggaacattctcacaaagatttcaaccaagtttttcttctcaggattgacacaccatcaacaacctgaaatagtaagccttttctgctttctaatttcctccctagaattcca

SEQ ID NO: 61643 - DNA, 1032 bp, Homo sapiens
tggtgtggttcagatcgtctttgcttgcctcgcgtacgactcctgcgaggcttcatatgtaactcctttcgttctcctccttccgcggtctttcttacgcatacctagtatatagagaaatttgaaccttttgctaagaagttatggagggggcaaaaaagcatatttctgaaaaataaaatcaaatagacatgaagggccttactttttcaatgtatgtggcatttagcaaagcacctgggcttctgtctagatgtttaagcctttgcacctttggacagagtgtccaggctttaatcagttgtatgatttccgctgattttgtgcattccttgtccatcaggtggcaaagaggagaggaggtgggggcaggggcaagggaagaggccaagaaggggagaggtggctggggatggaaatgggaaggtgacacttgaggagcagtcagcaccaagaggtaaaaaaattaatctaagatttccatctagccattaccggctggcgttcacggcctctgagcctctgagctaaaaagtctgcagagagtctcctggcgctacagagtttgtcttgtaaaagtgcagctgtccaaaacatgacagctacagcattagcagggccattaagaggtgtagaacatttccagggaaatgatttgaaaaatgacaatgctggctcctgtgtgatattaattataccctgtactcatggcaaataagctaaaatcgctggcaagaaagactaagtgaggtgtcctggttctgaccgtcattcggatcaaacagccgccaagctggtgagggctttatggtccacaggtaattgtagggtgagaggtacatgctggaaaccatcagtcagggctgtgtctggaggatggtcttatggtgagtatggattgcaggcagctggggcaaagcaggatgtccatggagacggcgggtagtagaaggtaaaaggttggcagggctgtcctccatccatagcatgtagatccaagctgcgctgcccagcagacctttctgtgatgat

SEQ ID NO: 61644 - DNA, 1048 bp, Homo sapiens
aaagagatgtacctgttatggaataaaagttgtacaattcaggcatgtatgcaaaaactgaacacactttcatttaaaatttgtgatgtagacagaacatttcattaaaaaatatcagccttgataacctaggtgtatgtagataggtctcaggtttaggagctggctgattgttattggttctgctgtgggttttggctgggggttgggcttctacagcagtcattttaggttagtattatttcatgtgccctaatgcatgatcctggttgtgcagaagtggttcttggaggttgatgccttgtgatctcactcctctggtctttggtatatacagtcttgctcactttgaatggacttccctttccttttaagcaatgtgacttgtcacactccatcactccaattttgacttgcttttcaagacctggttcaaatccatcttctttgtaaattcttccctaagtgccccatcttagtgactgtgagttactcctgtaataatggcagggtgggtattacatttggcaattaattcttatgactttgtggtctctattctattgccattttgtttttgcttttttaatttttaacttttttatttcaataggtttttggccaacaggtggtgttttgttacatgaataagttctttggtggtgatttctgagattttggtgcacacatcacctgaacagtgtacactgtgcccagtgtgtagtcttttatccctcaccgccttcaccatttcccccgtgtccccaaagtctaatgtatcattcttatgcctttgtgtcctcgtagcttagctcccacatatgagtgagaacatacgatgtttggttttccattcctgagttacttcacttagaataatagtctccaattccatccaggttgctgcaaataccattatttcgttcctttttatggctgagtagtattccattacacacacacacacacacacacacacccacacacccacacacacaccacattttctttatccactcattgattgatgggcatttgggctggttct

SEQ ID NO: 61645 - DNA, 1028 bp, Homo sapiens
gtgttacccctaaacaccagcagcactgacaaacagccagagaccctcaaataactccctttaggtctcatccttcatgaggacagcatcatggggtggtcgtttccaaatctttttttttcctctttattttaacctttgaaactatttttccaagtaagatttcttccacagagtcccaatacaggatacagaccaaagagaagatgctctggctaaagaatggggtggaaagcttgaatcccaactgcttcagagagtgtctccatggaatcctcaggttcctaggaacacggtttgagaatctacagttgatggcagaaggcaggttttcagtggtgtgggatttatcatcttggtttttcctgttttaactgagtgactgctggagtttgcttcccaggtttccttctcaagcggctttcagagcaataggcaaaaggttgagaatagcatcaaaaattaaaccaagccctactgcaagccaatttgtaaaaactgtgttccaaacggctttggggaagaggatgtgacactgtgtaatgacttcttggaaaatttgttactttttcccctttctctgtctcctttctttcttctctcgctctgcttcccccacccattcctgatttgatgaaaccgtttgtgatgtccagcatatattttgctgcacactgtgtgttgttgtactttagcaatttataactatgatcaatgttgtgaccttagggaaattgcttatataattatagaaagtttacagtcgtaagacaaggaatggggaaaatatatcactgtaaaatataaatatgtttaaattacatttaggatttggaatagttccttgcttgtgttttacagagtaatctgtgatttaaatcaggtttagttgtgttttttcccccctaaattgggtattataaatcaagagtagatgctggatatagcacacaagaggatttcttatacattttaatgttgcataagtaagaaataccagtagttcagcagtaaaattgcaaatgtaa

SEQ ID NO: 61646 - DNA, 1033 bp, Homo sapiens
ctggagctcgcagttgtggtttgcctgaagatggggtattgaaaggaatggtttccacccttgcctccaaatgataccaaatgctacttctcagaaagggagcacaacttccctttgggtggctcagctagtatggcttagggatataacagggaacctgctgatgttcatactgtgatactttgtttttctcataactgttatatcaggatgtacattaagttaagtaatcttcacaaccaccctgttaggcaggggctgttctctttatttaacagatgaggataacaaggctgaatgtttgagaacttgccctagatcatggtgagtggccaagctggagttttaaccaaggttctgtgtctctgaaacctgatgcttctcaccctgccacactgcctcttgctagcatggtgtgcctttccctacaacttgggctgctcagtggagcagaattatctgcttgagaatcaaagaaaacccgggaaaagtgtttttttcctgtgtcctatttcgactttctaagtagagactgtgcagggggctcttataggaaatttattacttgcattcagattttgtgctgctccacatatgcaaatatggaccacgtgggcctgggtcctggtctgcttggggatgtgagcagaaatacagtctcattatctggccatcaagccctacaaagactctggagcctctctgtgcaaaacatctagagcaatcctgaaatcaaaggaagctgccaattacctcacagcaaacctgacaattaagaaaaaaggaagtttcacttttctaagttggaaacagagagtatttgctctggggaaggagcaggtaactaaggtttattgaatgcctaacatgtgttagggatgataccaggactccctggtgctctgtctcatttgggtggtgggcatattcccatatcaaaaatgaagaaacagatgttctgagtagttgaaaactcgaacttccagtgcactgggctatggaatgattgtttctcctgttacatgggctgtgg

SEQ ID NO: 61647 - DNA, 1048 bp, Homo sapiens
ttaaagtacccctctgtgccttagtttctttatctgtgcaatctgtacaataatagaagtacccacttcctatgattccattctatgaattacctattgttggttgctgttgttactgtttttttattgttctcttacttgaggacttcagtgacaaagagtagcagtccccgtgctttgggttactgaattttaaactcttttgtaaggctgattgagtgagggagtctttgcttggaggcaggaagatgactccccaagcccctgtttgtcccccattattcctgtcctccaggactggcatgccctgccgttcatttccttgttggaggagacaatgatgatgccttttctacacagacactctcctcagctgcttgcttttgtgagcaggtatctcctctgttaagagattagaatcttaatcctaaatgatatttcatggcctaagacttaaatttatatatcaccatccggaataatgtattggattgcattaaacagattgtagattaacatgcaactataaaacaaatcatcaatgtgttgttgacaactctaagtgcaagttcatatatttaactacatttggggagtattaaagtgtttaaagcggcttaacgggttgatgtaaaattaagcatcatgttctgtttcaatttgtgagccagcccgagagacaataaaatggaggcataggcttgagaggaaggagcatggaagaaaatttggaatcagacttggcaccagggaaatcctggcatggtcaaaacatattgggtagcagtagaaggctgtccatttacatactcagtctatgagcaggtatttgaagcctcaaggagtttatagtccagttgagataaaccaaccagcatacagaaaacaatggtgaaaaataagagacttagtgtcctttagcactgagctgggtgaaatggaccacctgctgtgagagttcacaggaaatgacagtggcatttggagtggtcagaaagatcttaaagatggtggcatttgagctgatcctcataaggcaatcagagag

SEQ ID NO: 61648 - DNA, 1057 bp, Homo sapiens
acccttatccaggcaaaagaaacacacatgatgtacagattggcctttcctatggagggaagagtgaaattgagactttaaagacccctttcattgaactttgtaaaaagttgcttaaaacagctgaaaaaattctactccaaaaaaatggagtgctcaaaactaaaataataataatgataataataaaatggattgaggcttgggtttcataaggctgtttctcagttccagtataccagacaaattacagcctgtgaaagtaattttgtttccccctaccctgtactttcagcctcctaagtaggataggaaacctggagataagaaacagaaggaaaaatgtaaactgaggaccttttcttttggccaaattgaatgttctacttttaaaggggaggaatttagctgctttttttttttctgccaaaattgcttgagttttccattcattgtcattcattttacatttcaaagtgcaaactgcaaagtgtaaagttgtatggtggtaatacacacagtagaattttggttgacacttccagctctgatgaagtagagatgaaataaatctgaaacacatctaaataggcttggggtttgcattctatcccatctaagggaagctgagtagatcatagacggatgctactacaggtttcgttattggtaatccttcggaaagcgacacggaaacacattagaactaacctccactgccttccatttcatctaaacagtggggtgagggtctgggtgggaaggaattttattgaaaacaaagtctgaagtaaaagcaacaaatctttactagtgaaaagtcacctaattaatttagataaaaactttatcatcccacatgcaaaaagaatatgtggttttccggctttgttatttacattaaaaattacttgttcatgaagttaaaaaagcgcaattaccctgaatgaggtgaattaagaaaatatttcatcagtgtagcttgtcttttcaactggctgcctttttggagtctcttgttgatttatgaagtgaaaattctgtcttgtctttggtg

SEQ ID NO: 61649 - DNA, 1030 bp, Homo sapiens
tatatagctaaacatatacatatacacacaccataatttattatccaaactagtatactttactaataattatggcaatataatggatacaaactagaactctcctagtcaaaatgagaggcatagtcacctacttatatagtatattgtcttccattatgagacaagaaccgcttataaaaagattggttattctgtgctggggattttatacattcattctcatactgtgatggtggggagaagtttaataaagacttcatgtcccttaatagaattagtcactttctactgagatattgaagctaatcctgatgctctcatttatagtactggcgggattattaacagatttgcctttattggttttctccagaagtcttccttgtttgcattttttatgaaggtaattcgatttttattagtataagtagtagagaagtttggcaactgggcactccacagacatgctgtttcctcttcttcatttgcttttctcttgttaaagtcatcaaaatgttgacagctgcataagtctttgtaaagcattcataacatgacagatattacagatatttgtcattttacttccagtaagtgacagtcaaaattagctttttgtagtattggaagatagtgcgggtatagtgagtccagtcaaatttgtctctcatttctttaatgtacaagtgatttccagtcttgttaaggaccaaggactcgaaggatgtggggagtggatctggggttttactggaaattaaacgggcaggacaatggtatttcatagcatggtaggtttcagcaacgaaagagtccctggggccacatccttaaatcacactcctgatgctcagtccctacctcaccatcattaaacacagagccctcctcctctaagtgaagaccttcagagttggaggttcagtccttctgaagcaatctgttctgtttttagaaagcaccatttgaaacctgtttattatattgagcctaaagctcccactgtgtaatttctacccactgctcc

SEQ ID NO: 61650 - DNA, 1053 bp, Homo sapiens
cccaattaacattattgatttgagtcatactcatcaagatcaacttattttgtgttaatttccttcaatgcagagagagctgaaaccaagaagagaggagttaagacagaatgattgatttggctatgaggagcatgttttgtaccataatctcattttaatgcttcagtagttaagttgtgccaaattgcttttgaggaggaagtcattttctggttgagattctgcttagtccttatattggtcagctatttccacaataatgctacataagaaactacctcatttattctcttgctgaggcatttgcaggttgacggtggtttggctcatctaggccgggtggctctgctccagggtgcaggacagccagccttgatgccaggctgtgtgttggcttcaggtgtccaccatgtgtgtttgttctggggcacaggctgacccttcagggacagaggtcgcatggagcatgctcttctcatggtggatcagtggagtaccagagccacgccaaatagcacaagcacacttagggcctctgcgcacattacacagcgaaatttcgttgtcctgagcaagtctcatggcctagaccagtatcagtggagcagggaggtaaactctgcccacagtaggaggggaaacgagtgactgtttgctgaacaatatgggccttctggccctgtaactcttaggtcagggtgctgagttatttatctcatcatcatcatgttatcaagccaatttcttgacctaaaccgggagaaagcgcttttgaatttttcccaggattaaacttgtgatctgactcagcctcttgcccatgagctaacctgaagatgcagcagcttattgaagactctcttccagcctatcaccaccttcctttaggcgggtctaactttgctttcagctttcttgtgacattgtaactccttctttaatttgagatggggtgttttccaaggacttcagaatctgccaggtgagatgcaagacctaggttgaaattaaacctaggattaaactcagaattctacctaggagtaaaca

SEQ ID NO: 61651 - DNA, 1047 bp, Homo sapiens
ttcactgattcagtctcaaatgatccaagggagagaaacaattgcttggaaaatggccgtaggggataatggctattgacagcagatattggctcactctacacaggttcactccctccctccttccctccttccttccatccatgcattttttttttttatctagtcatccatttagccaagagttctttaacacctactaagtatatgtagattattgagggcactttacataggctagtaagaaaagtcattgcaagagaggacatttatgctgaggcgcgtgaatcagaatggaaagacctggggaggaacattcccgagagagggcactgcccttgccagtgctgcaaagtgtgaaaaagcctggcgagtttgaggaccagaggaggtcagtgtggctggtgagtgagaggggtgatgaggctgaaagagctttaaggtgaggttgaagtcaggaagcaggagccaggttggtcagggcctggtgggctctgcttaggagttggaattttgctctgagagagatgagatttgagtatggatcttggatggccttctgtttctgctttcagactttccttataccttccagttcctactttttgagaatcaggtgtggcagtcagacagaggtgggggggttttgtgaagaagggtgtggcacagggcttgaatcaccaggtgtgggaaaggcaggttgggcaagaagctgagactgggagagggattcagcccgtcttgcagctctgtggttgcttcaggtggtcagagttttcagggggaggcccatggtaggaaggcaattagtactggaaaagatcagctaaagcaaagcaacttacatggaaagcagtatgtaatagtaaatctagaaaaaaaaagtttggaatttaatcttgcaagctgaaacccaaaaggataaaaatatttggtatcaaaaacattttcagttgtagctgcagctatgctctaattctcagaaaagcaattcaactattaatttaatttttctccataagtgttaatgacagaattacacgctgg

SEQ ID NO: 61652 - DNA, 1013 bp, Homo sapiens
agtcactgttctggcacttgacgtgcagagcctcctggtagccttcagtttagtgcagtgattgagagcacagcctgagagctggacccatttgcattccagcccagcctcagccccacaagctgtgtgatcagaggcattttaccaaacctttccaaggcttggtttacttatctgtcaaatgaagatggtggtgcagttttcaggctgcaagtgagtgtgtaaggtcacttagctcataatatggtgacacatttcacaggtctcatgatcagatgaggaagcacatagtatcattcggccttttatacaggtccactggttacctgttcttggtaacagggtgaaggctggggtaacaagtcctgccgggagactgtaagaggttgcatggcactgtgggtcagagtagcatggatccagaccgcctgcatgtacattctggctctgccacttattagctgtgtgccattgggcaaattatttaacctctctgtgtttcagtttcctcacctgtgagatgggttagtaatgctacctattgcatagaactgcagtgaggatgaaatgagttgacccatgcagagtccttagagcagtgactggcacttagtaagctgcatagaagtattgtctattaatacttgcattgattgtgaaacataatttagcattgctaagaggctgtcttttcaggagcatggagtccaagtgcccatttcctgtacatttggctcagatacccacccctaaccactgcacgcagtctcttttctgtctgagtgggacacatctctttcccctgcagcacaatcactctgcctcccgctccgtcctggtctgccatctgctgacccattcgctgctcctgtcacgtcaaagatagcgtggcctttgtggagtgcccaggcagcgtgtcatgtcccagcgctgttgtacatcttgtttcagagatattttgctgtaatgttctgtgaccttttccattgagtgaggtagttggaaaggcactc

SEQ ID NO: 61653 - DNA, 1015 bp, Homo sapiens
gcacaggacagtccccacaaccaagaatgatcaagtctgaaatattgatagtgttgaggttgagataccctgatctgggcaattgttgacttcatgtcaggttttacagagttccttaacatatctaggcaatacttcaccagactccaaccctagcctcatcttcttcaagagcaagttctctctttgggagtctctgaagagtccgtcaaaaacatttcttaacatcctaagacatgcctctttagggttggataaagatgattttctaattttaaaatgccttcctagccccagattttgtgcttatattgcagagaagtagattgaataccggagggaaggacatggatcaaggtggaaagtcagacgtaagcagagctacatttgcagaaagtatgagttcagtttagtttttgcttatggaccacaaagatggccctcacctctaaaccttgaagaattccagaatttttctgggagaggaacatctctatcacatctgccacagcggaaggctttgtgcaggataacatatcattggcttgagaacagagtgagcatgtgtggaagggcctgtaattattaatatgacattggccataatttatcatgtcataccacccacttacagcagcctcatcctatgaaatgctaaatgcctttcttatcaacacttgatgggaaaatgctgttctggcatcttcctctaagggaaacagaaatctaaccatgttccttacagcctagaactctgtacacaaagatcagacttgtttttctccctgaaaatttataggtatttacaaggactcatatcctgtttgctatttagaggggcaatggagtgagaaagaattatgtagcaagtttctttttcttgagatttgctcaagctgctctatgacttaaaaaaactcagatattactccccatttttatgggcagcttgctgttttctattcttgctttcctcaccgactttcttggcaaagctatgcttgagtactcctag

SEQ ID NO: 61654 - DNA, 1043 bp, Homo sapiens
gccaaccttggcctcccaaagtgctgggattacaggcgtgagtcactgcacccagccatatatgtacattctgatgtattcatggcacttttgccctggtggcctaaatttagcctgatgttaccacttgtggcaggtcacaggctggatgccgtatctgggacctagggttttaatgacttgcctggatattggtgtagtatgcatgccaactgatattcaatcaacatctcctgccagcataaaaaagtttaaggaggtgagttactacttctatcctatgaaaaataacatcatttaacaaaacatctccaggaggcctactatgtgccacacaccattctagttactggagatgcaatccctgacaacgactgctctcacagagcttgtgttctagcagggtggggctgggggaagaggagttatctctttgtgttctagcagggtggggctgggggaagaggagttatctctaggtagacaaatgagtacttaataacatttcagatatttataggatgctttgaaaaaagtaaagcagcattgtaggctagaaagagactgggaggtgctgtctggaaagtatgatccaagaagccctctctaaagtaacacggctagagataagaatgacaggtagggccagctacatgaggatgctttgaggttgtgtacccactgggcacgggaaactaactactttggggatttgaagatataagagatagtcccaattgtaatttcctggattaattagagagaagatataaaatgtaacccatgaaacagtgtatttaaagctaagtggtaagaggtgcaaaatgctattgaaatgtaggggagaaggactagggtgtgtttaagtgaccaggcaagtcccgtcatacacacataggttgtgcttgggttgggcctggaaggatgcatgggaattccagatacatagagaaatgatcagtttctctctctagtgtgctttaaacccggcaaaatcagacacaccggggctgaggctctagaattaggatattcataaggtt

SEQ ID NO: 61655 - DNA, 1259 bp, Homo sapiens
gtggcagaaccagtacctcaaacacctttgagaaatggtgttcagggctggaaattgggcgaggtgagagaagcttttgccctgggcaccaaatttaagaggagacccaaaacctcaggaatcaagataaatgatagtttcatgcaatattttcaaactatcaaaataaaatattttcaaaataatcaaaatttaaaaaatccaggatgaacagaatgtcataattttaagtgaagacagtataaatattgatttcaaagctgacatttaagtactgaattcactaggggtggaaacaatgaggacaccaggaaactagcagctgtagccatgggtgtgagcccttccagggtgccaggagcagtgtttggtatcttacaggcatttttttcttgatacacatcgggggacctgatttgacctacagtaaatccaaatctatttgattataaaccgtcttagaaaaagagttcctttacaggctccataaattccattacagtccactttgtctttgttaaatgtatgggttggaaattacaattcttttattcacaatgatgattttagacacacagctcagaaagatcagcattcacttaaaaaatatattagcatgcttgtatctattaagcactattgctttgtaagctccagctgatgattttattaagtagactgcaaaaggggaagaaaaatcaaggataattataaattcataaatacataattcattggcataaaatgatttaatggaatggatgtggaattatctatttcctcaagaaaataacagagatattctgattaagcctataatcttgtgtatgtgaaattctagccaaactgatggggcacattttcttttctgaaactacctttgataagaaatgcattacaaactcatcagtttggcttcctgttaacaaagagacagcagccgtctggatcattctggattcacagtgaaactgccacaccatgtatcctccaactaaagctgtgcaagtttgacaaggggcagatgaatccaggagttattgtgcagaggtttaaatctatgcggcagctgacggttgaaataatcatctatatatcgctctgagctagctggggaaaggttgaagctgtatattttcaacatatctagtctaatggttaatctgttgtcttgtacggggctctcgcagggtggactggcagcacacgctgacagcttcgaggaattgctcacggtagatgtggttcgccttgctttc

SEQ ID NO: 61656 - DNA, 2076 bp, Homo sapiens
ggcagagaagcccacagatagtggctgagagttgaacagcttagtataacagactataaaagttaaatggagtcaatttgtttaatttctaggtcatggaataattgtcccaacagaaataagccaacaaaaataccaagagacagctatatctccccagaacattgatttccatcttgactatccagtaggccttgcaaaatttgtgtgtaaaatgaggaaattggaaggtcatatttctaagtttcctttaaactctgagactctgattatcttccttcttctgattgagaaaggctaaaagtcctttttgcttcaatccttactgttataaatccttctaaaatgctgatgtctattacccaacatcgtggtaggtcctgtgaggaacaattatgtgtgtagaaacctcgtagtatatcagtgttagtcttctgtctgtgagttcgcagcttctagggcaggaactgggcgcacagggacacaccgaaagagcccagaagattcttacaggtttctactttattgtcagcttgttttcttccaaggtgtcttttattttcctcaaggaaagcacagaaaaaggccctctccctaacccggggtcctggtattatctatgctccagtgatttgggggttattagtaatcagaacattgtcagctactgaagctatcccagaccagttcatatgcagtgtctctacaaatggccctgccctcccacaatgaatgctaactgttgacctccccaaagagcctcctcatcatatttgttacaccttgttttgttattgccaggtctccaggaatgaaatcgtgtagcaggaagcatatagggccaaacggggacaccatctccaggcaaaagaggcttcctagttggaatagtacagatttgatggatgaaaataaatgtgtgtcttagattttagcccagctgttagaatccttaggtcctgggatcattagaaaactgtgacttcaggtctcatcattcctcatccccctgaaaccccttctttatggcttgtccatccctaaaataggtctggagatcgtcagcaaattcaatgtgtttttgggagagggagggaaagttggaacacaaaaagaggagaacagatggggaaagaagacattcctgtcctttcaaattccatcaaaatttcttttttgatgatggtcttgatctcaactcatctttttctgttgttattgttgttttttgagatgggacctccttctgtcacccaggctggagtgcagtggtgtgatcatagttcactgcagccttgaacttttaggttcaagcaatcctctcacctcagcctcccaagtagccaagactacaggcgtgcaccaccatgtctggccatatctttgaggtccagttggtgttgagacttcacatcatcacctttcctaccttgctttatgagtagctgggctctgtttcttgttgattttgtaattaattagatgagtgcttggagcaaggccaagactgggcccaagtttttcacccatgccttaccactatccctttctttcagcagacctgatgtgtggataggtctagggatgagtggaatgagtatcaatatgcacatttgaaattctgagttttaccctgtaacactctctctttcctcctaccgatggccaagtcctctgatttggcctccagattacatttcgaaccttttctcaccattgccagtggcactgccaagctcacatgctcatttcttcttcagctagtctgccattgttgcccttcaacctttcaattagttcctcttgccaccaaaccaccaccaactttagtattctaaagcacagactttgtcatgttatcccattttaaagagagagaccttttgatggttccttgttttttaagaggataatttccaactttctgctattaaaatggcattcaaagcctttgcagtttggcctcaaccagtttccctagttccgttctccacataagcatccatcatctaacaattctctagaagcgtcttattctcattactttacacatttctggaaccttttcctgagact

SEQ ID NO: 61657 - DNA, 1105 bp, Homo sapiens
tataatttaattttacaacttaagagtataattttacacagagagtgttcaattcttctggaacatctaccaccagggagacaactcctcatcagcttttagttaaagagtttgttcatgatttgtataatggcccagaggagagctcttcctggccagtactcatatccttcaagcctgatgaatcgctccaccagatgggaggtcttaccttttaagaaagtggacccagaagtctctaggtgaagatacctgacagggagtcaatggaaatggactatgccagcagtagcgaaaaagagccaccttcccagttggtggcaccttgatctagacattctgattcatgaaggtttgtcaacatgtggggctcaatagtttttaactgtttctgtcttgtctttgagcctctcattgatcgttcttgctgattttgtgtgtgtgtgtgtgtgtgtgtgtgtgtgtgtgtgtgtggtggcacttgtttgtcttttgagatttctattttgcatttggtgtgagtgtaaaaatgattgggaaggaatgacaagtaatagcatgttttcttttttatgcatatgctgctttggaatgtgactgcttataattaacagttaatcttcttatagcacatggttttttgctgcttcgattaccagtttcagcctgttcctgcatgctaacaataagaaattttagaacaatgcatggtcgccagaacggctaacaataacagttgcaaacagtccctgagagccactggtttgtcactgtgtttcctcctgaactcatatcaaggaggaggtttacatcacccattctgatctgtttgcctctgaacaaatagtttcaaaagttatttcatccccatcatccctccccttatccttaaagacggtatatttataagaactttctttctccacaaatgtgtcagattctattattgtacataaacccaaaatggcagtatggaaatgaaaaccagggaccgttgctaatgagaagcatagcattccagagtttgatgggcttctcttctgctacagcatttgattaaaaaaattgtttttcaaaatgatttatctacggtgaagcaaaaaaa

SEQ ID NO: 61658 - DNA, 1061 bp, Homo sapiens
ttgcatttctttccatttcttcatagctctctatcaaggaaaagagtcaaattcagctgtctggccgaggagcaagttctcagggtctactatttactcattttctttttctatataacaaaccttgtctaatgatttacatttcttcccccagactctaaaagtttgccaaagtgtggactcctagtggacaagtaatgtctagtttgatgtgtttgaaggaattttctttgacttcaaatcattgacatatctttgatttattttttttctctttgctgccttggaatacggcccctactctattttaactgcacactggtagtgatatattgtgagtaaaacgggttcccagcagcccggagtccagttccccctgtctttctctagaagagatactcttttaattttctgtacagttttagtttcccttttacttttggtatttatgttgcatgtagcagtgacatcatgccccaactccttcatcccccaatgcagtctacagagtagcctggagccagagagtccccagggagcctgctctccatccatccaccccagtccccgggctctggccagcttcgggcactgtcttatttttctatttgaaaataagaccttgacaacagtgtgtttctcttgaaggccttgtctcaggacttttaagggacactgattaggctgaagtaattaccactataactccagatgcttcatcagctggggtaattgtcatgcttgcctttgataaattatacttggtctcctttgttattgagcttggattcctctcctaaaggaaacacatatgccacatatatattcccatgttgtgatacatatatatatatatatatatatacacacacacaatatgtaccatgatgtatcagagtatatgtacattcttatatgtaaaaattcatatttttacatataagagtagagatattccatagagtgatgtatttattgcagtacatgcttctctgtatgagaagtgcttgctagataattaattggttactcaactttgggactgtaagtatctcaattgt

SEQ ID NO: 61659 - DNA, 1035 bp, Homo sapiens
tccaattcttcctataaaggctgtacatggaatcaatttccatgtccttatcaatgtcatgaagacgttcagcttgcttccgcattggttacgggtgtcttgtaccattccctgcggtaatatgtggtgtgtgtacatgatgtttatgtatatctataggggtcccattaatgctctgtcatttaatggaaaattgttgtagcaatagcttcatcaggccaataatgcttccgtgttgaccaccaatagcagtttcaaaaggaatttattctgatggactttgcttcaaatcatgtgcccatgatggcagctagactgctccattatataaacccaggccctaataccttgatttgctttgatttcctcaactgggagcatgccagcctgggaagtaagcagtagtgcttaatgatggcattatccaactaaatgtatggggcagtggacattggactctggacaaaatctttggggaaagctttagactagtgggccccctataaacacaacagtatggtgtagccttcaaggttttattcagaacatgacctcacaaatgtatcttctctgtttgtttttgttcactgagcagtatattaattaatcctggaaaccatcttaagatccaagaaggtactttaggatttttcatcgcaagtgatgccaaagaagttaaaaggtaagagtttattttcaactggctttctttctggcccggctgtagacaccttgacccacggaagtaggcaggcttccataaccccaaaactccttaacatgtctatggccatcaactggtgtaagaaaaacttccacggactccagttcatgtagtgaattccacatctttgaatgagaataataaaattttagaactaggaagcctagttacctgctcatttattttgtgagggagaaaatgggggctcagagagctgaatgactgctcgaggtcatcctgattcctgatgattcagaacaacataacaagacaactggctccttatctagtgctctttacttaatattatc

SEQ ID NO: 61660 - DNA, 1038 bp, Homo sapiens
acttgtgcatattttattcagaaatgatttctctaacaatatattaacttgtcagagaactcaaggtaactcatgatctaaagctacagagacataaaactttgaaattcaaagattatttaaagtacaaaatttaggcagagaagatcagggttttgtttgtacaacacccaaattcaggatatttgagaatatgaagatttcattggcatttcattttcagttttaatcaatgtgtttggcataatataaacatttcaagtagcattctcaaagcctcttcaccatcaacactatttcaagggcctagagtgccttacccaacattttcatcacctcctgaaggatacccagtccctgcagtaggtatgggtaattgtgcacatgtgcgtgtgtgttggctatttcatgtatgttatgatggattggagcatctaagaataggggtttgggtgtccacaaccaagggttcagtgagtagctgaggcaggtaatctctctgagttggagggattagagctctctgggctcttgggctgataccctaaatcttattcataagggagccctcctgcagcccagcctgcctcccaaggccactgcctcctcctcctttcctttgtgtaaggtcaaagctgcttagagacagggaaggcctgagggctggtgacgctcccatggcctttgggatccccagctctctcctccctctcacagccccttgcagtttcccccagaggtctcctccctgagtgtgattcattccactcctggttagtttatgagaactgacaagatcgtggtccaaggtcacatggccaagggccatggaaaataatcagtcacagagaggaatccatctgctgtaacccccttgttagagggagtccagccgggagccacccagaccttgtgtttcccatgttgggacttgagtgactcaagtttgaggcaatcctaggcccaggtgtttgggacagagagaatgggatgggtttggattattctactgattcctggtagccaaatgctgacagg

SEQ ID NO: 61661 - DNA, 1154 bp, Homo sapiens
ccaataattttagccttgctagaggtctgaaaaaataggtggggattaaattatgaggagcctcagctaacaacttgtggaatgtggatattttcctgtttatatttttaatgtttcccctctctctgtctgtgtcatatttttgtttacactcagtaccctgggaagggagactttcatagtcactctgggctgccttaacaagatatcaaaaactgggtggctgaaataacagagatttattttctcacagttctgaaagctggacatctgagatcagcattccagcatggtcaggttctggtgagggctctctttctggcttgcaggcggctgccctctcactgtgtcctgacatggcagagagggagaaagagcaaactctctggtctctcttcttataatggcactaatctcatcatgagggccctatcctcatgatcttgtctaaacctaatcactccctaaagtacctcatctccaaataccatcacattggggtttgggcttcaacctacgactttggcagggatgggggtccataatgtagcctgtaacagagaactaagagggggctggggttggtaatgagagaagatgctgaaaacaatgggacaaagaagcagggggtgggccaaggagctctaatgagtgtctcctcccatcttcctctggatagcccagaatccctcttcttcctcagtcctgtatgtaggattagcagaggatttgcgtatttgggttatgttagtggtgggaggtggccacgacaggaggagtaggacaattcagtttttctttcttgttgggcatcacatcctctaagggaatcctccttatgagtcctcagttgttaagcaggattactaaaataaaagaaacgacttagtgggccccaaactgcagcctctctcacactctattctataccacttgatttgaggaattatagccttttctctttctatccccctaaaccatgtccaaaggagcttacatggttatttccagcgtgaagctgattgatcagctcgcaggacatcgtggatcagagtgcttcccccgcccctcttaaccgcctttctgatgtggctgcgtgcatccagtgcccagagcatgccggggttcttgcaagagggactggagggtgaggg

SEQ ID NO: 61662 - DNA, 1030 bp, Homo sapiens
actgattcaggtcctccctgtagtcaacagagataaaagtctcaataatcaaacctgtgggtacttcagtgaccagggaccaccatctgtcccctgtgggtccagacatcaggcaggaggaaaagttggggccatgtgtcagcgtcccagctggggctcaccatgggaagtgggataagggaggattattccagttctcttctttgagttcaggtttttatctacgggaagaagagggagattggacgaggttagattcacttgtctccaatgtcctgcatggggttctgggacagacaatgcctcagaaatgggaggtccaagaggatggtgactttcactgctagctgatgatgaaagggaaagggatgagggaagaatgggctgaattagaggctattccacccctctgatggttagctttcagggggaagggaaggagggagggaggctggtggggtgggagacaaagacgaattggagattaggaaagattctttggaatagtcaaaccagagaccaagcaaagcatctttttcccttgtaacttgagacctgtgcaaatgacacaggcttctagttcccaaacttaataagagtaagtgcgtgaagaagagacctgcagacacttaattcaaacagtctagaattctgggaataagttatagtacaagttatatgtggctggttatagattcagccttgatgtttatgttccctgtttcaagtcacacacatcagattactcacttgtcagctaaaaatagggccatcactggcttgcaagtcgagttaggttttatttctctatgtgcttcattgttcgttcttttgtgctccctcctctgtgcctggccccctctgccatgcccaggtggcttcacagtcccccttccccatggtcaatacttctttctaactgagggataaatgactctgaaaaggaaatgtatttcaatggggaccaatccattacacccgagagagagaggccaagtgcagggacttctggaggagaccaggaatgagt

SEQ ID NO: 61663 - DNA, 1019 bp, Homo sapiens
ccctcccattatgttgagatatatatttaaagtattatggaaatggctattataaatggcatagatagtttatatttttaagcctttgtaaagcattttggtctcatgacattcctgcacatcaagaatccctggtggttatcgaacttttatgtgcaggtaggctccccttgagaagaataacaagtaaattcaaaagagaggctgagaatcaactattctcagcacaaataaatttttctgattacaaaagtttccatcacaatgcttttgttgaatttatgatagggtttagttcataaatcaatttgatctacacataattttcaagaaagcatctgcagcataaattgaggtgcaactgcacttcataccactttttttctccttttgtttctcattttccactttgttctgtctgtgtcatctgtaagtatctccatgttttcattcggcagctcctggagacttcatggcaaaccaacatattgaatgcaggaaattccagggtggccaagaatattctccagaaatgtactgtaattcctattcctttaatacataccagttgatgttgggagaagttggccatgtgagaagtaaggcctgagatgatgggattgatgggcatctacatctctaaagctgacagaggaaacatttggcttagaaaaaaatttagtttttttttgtttgtttgtttagtttctttttttttttttgagacagagtcacccaggttggagtgcagtggcatgatctcagctcactgcaatctccaccttctaggttcaagcgattctcctgcctcagcctcccgagtaggtgggaccacaggcacctgccaccatgcctagctaatttttgtatttttagtagagatgggatttcatcatgttggccaagctggtctcaatctcctgacctcaggtgatccgcccgcctcagcctcccaaagtgctgggattaaaagcgtgagcgattaagattgcacctggccaaaaattcagtttttgctc

SEQ ID NO: 61664 - DNA, 1065 bp, Homo sapiens
taaccttgacctctttggctcaagtgatccttcagtctcagtctcctgagtagttgggattacaggaatgcaccaccatggctggcaaattttttttttttctttgagacagggtctcactctgtttcccagactggagtgcagtggtgcaatcatggctcacaacaacctctgcctccagggctcaagtaatcttcctgccttagctttccgagtagctgggactacagctgggcaccatcatgcccagctaattaaaaaaaattattgtagagatgggggggtctcactgtgttgcccagactggttttaagctcctgtgctctagcagtcctcccacctcagcttcccaaagtgttggcattgcaggcgtgagccactgtgcccagcctggattcgttgttattattcgtcatttattattatatttattttcttctgattttaaagaagttaaaatttagacttttttgtgtcccataagtacagtggcctcaggcactgtgcctgcactgcctgctggagaaattgactttatttctccctttccaacagccccatccttctggaaattttcacagataagaaaacatgctcagagacagatgccttatactaaaccccttcaatgtggtctaattgtttcaaatgagaaaattaaaataagcattttattttaagccctgtctgataacttggctttgggaaataggaacttcagcaacccagcattcaaaacaatggatacaacaaaaattttaagacaacttaatagtcttgcttttctcccgagttttggaaaaacatgtgccttttccattcttttatctgacaatgagtcttactggtttaagagatctgttcgctgagagtgcaacagtacaaaataacatttttttcatctgatgtttgcaaattcatctggacagggaagggcagacattggaaatgagtgaggcggatctggtgaggactgcaatgagagctgaagcctcacctgaagtggcttcccaggtccagctgattgttcctatgcagaaatgcaggctctagtggccagatctt

SEQ ID NO: 61665 - DNA, 1048 bp, Homo sapiens
gtttataccgcaagagggctgcatctcctccctgtcacatggcactgggcctttccctatagtcacaggctgacatgcattcagagactgctgagagatcaggataggagccagctggagcgaaatgttatagctcagaacagtttaatccaaacacaagggcagtgcttgtgcctaacacaactgtggtaggggtgtggtgtggtgtgtggagtggtggcagcttttacagctttatcatggggttcatgggctggaggagatgtgaactcttccttgtcttttaccccttgtcttttgacctgacagcctgacacatgtagctttggggagaccctggttggtgatgagtcatttgtggcttaaaaatagaactctcaaagcaacaatgcccttgggactttttgatgcatatgtctttgttcatagaatttgggagaaaagagagagagggagagaaagactctgtgtgtgtgtgtgtgtgtgtgtgtgtgtgtgtgtgtgtgtaggaaacaattatgtcctgcctaaaaattaagtggagaagaagagcatgggggaattggccaccaggctcatcacagtagcagagatgaggctgagagctgtctgtgtacctgtggccttaaaggtaccaatcagataatagctctccactgagtacaaactgtgtataaggcattttgctaggtactggggaattttgagtacttatgtataatgctagatcttttccattaagacatttaaattatacatatttttacaaggggcaggaagtccagccatatataaaggaaaaataagataacaaaacaagaacaagtaaggcatcgctaagcaatatatcaatgactaatatgagcattgcacacagtaagtgctgaaggttgaggagttgaaaagatagctggatgctataacatgttttggctgtaggggagattttgagttgaatagacagaaaactcagtctgccctcaactctaggagtccacaagagaagactctcattatggcctgtactcgggctttgtgattttcagta

SEQ ID NO: 61666 - DNA, 1043 bp, Homo sapiens
actatgtcaaagctcttaaaactgtgcaatgaaagatctccacgcattttctggcccttgtcttgccaattctttcactgtgtacctggtgtgcctggtctgctgaactatgaagcatactcgaacatcatacacatgatcttcctttttaaaaatgaccttgagaagataacaagtgacattctacagacagactccatttcttctcttttgtttgcaaaagtgtgaggctgaaggaggaaggaaagcttgggttacctgaccacattctcatccacccaccctcaaacaaatgccccacacatgtagaggatgtggttttctgactgtttatctccagtgagccagagctctaggtcccctgtgctagagggggcacagaggcattattatcacccagtcctcactgggtgagagggagaatggtgagaccattgtaggaagcaaggtggaatcaggggctgtgggccaggctttcgaaacttgcgcgaatacacatgcagaggtttatgctgctgactctgccttccaactttccaggctgtaggagtgggaatttattgagcatgagggatgctatcttgtgaaactttctacttcattcgggaagggtagtttgtctgtaagaattcaattgtaaatacaaaaataccatttatttctgaggtgagggcaggaaggagagatgtcagaagtagacaggttagggctttctctttggagacctggatttcaacccactgaaagtcttaacaaagaggcatgctagtatcattcttagcaagcccagtccattgttatggtcagattcgattctgcagaggagaaaatggagtgtgacatgtttggtgccaggaatgtgagcatgcacctgcacagccgatgttggtgtcatatcgtcagctgaatggtcatttagcaattttggccaactcccttgacactatagggcttagatggcattgctttctgggatgcactgataagccttttacataagccttttacaaagtaagaccttggtgccaaaatccttgctgtag

SEQ ID NO: 61667 - DNA, 1101 bp, Homo sapiens
ggaaacaaacacaagatggcagctatgttgttatcatcaacagaaccgagaataatcacgtatctgtaatagttatcagcatgctctgtacgagactcacactgtcttttctcaatgagcttgcctggggggcaataagagacaggcaggaaactgtgaccattcctttgtgagtccccaaaacagcctggctgcagctcactaagccattgtcttcctttacacacaaccaaacgtaggcacatggctaaataaacataatgaaaagaaatgggcttggtgtgaaattcttcccagatgcccttccctgccttttcagattattaggtactatctagttcagtgtcactgtgggtcatggtccatcagtagcttgtgaaatctatttaatgggtcatcaccaacatcataagaaatgaagcagaatagaataaaacatcatagtacatcccattatatatagtaaaggtaaacattgcttcgtgtgtgtgtgtgtgtgtgtgtgtgtgtgtgtgtgtgtgtgtgttgggggtgtggtggtgtcttctgaaccatgttgtaaagtacatttcttcctgagggttgtggtcaaaaacatttgaaaaatactattagttcaagctgtttattcacagacgagagggcagggatgatgaaattaccctgctaggtggatgcaggcttttgaacagataatgtgagagcttttaggaagagagttggtgagcaccaggagctaacatgggttcacctcagccatcacccagacaagcttcagaccagactcaaatgtgatggtcttcatgccacacaccaggggtcatgaatgggctggaacttacataaacacaatcaagatggataacgagcaggtacaaagcaacatcttaggagcaattgttaggataactagaactattcctgctcttctccaagccattcagcaggggcgcaattgacattctaaaatctttgaatgtttgtcatgtggaaaatggaatcgatctcatctctatggccccagcacttagatgggtgttttgatctaggaaacattttctttttctttctataacatctctgatttgccctaattcctgc

SEQ ID NO: 61668 - DNA, 1002 bp, Homo sapiens
ccacttgtcactaaaggaaagattcaactcttgagtcttggtgtacaaatgaggggacctattgcttctttaatgtaccagtctgtcctcaacatggagaccagtttcatctcctttgccttccatcagatgtggatgggagccctgtattctgctgagctaatagaatgcctgtgtccctactggaaggtgacagggaagtatgcatccagcaatctatgggaatatcaaggccacattcccttttttaaaatgaggatggcagtgtgttagaatagaaagagttgacatgaggaacagctgtgaggttatgaattctgatcttggtttggtcccagtcaattacgtggtcttagttcccatttaaatgctgaataagtcaatcctcaggggtaaattctttcaaaatgctcataaattgtgaaatcctagtgttggtggggaccttggatattcctttagtgcaatgactgcaaaatatgactgtgcattggattgcccagggatgcttgctaatatgtcaatagccaggctctagcatagagtatttaggctccagcatgggtattttttttttaacagtcggtcctccttccagtgtttgggaacaatgatctggtttatctgccagctcccaggtagaggaaaatttgcaatgaaatcttcccagcatggctactcttagccagtccttactcccttcccctcattgacaactttcattctgtttctaaggagtagggctcttaccaaaatgtcaatgtgacccacctccagtccactcttttcttcgcagagcgtaagaactagttctgtctggcactcctggaatagtcataggacagagaaaagagaggaaacttttgagttctgataaacacatctgcagcacacatcttgtgagttgctcagtgttctgtatcctcttgtcttttctggtgaggatttgatgatgaagttggagcatggtcttcaagggctgaaatccaagagtttctaagt

SEQ ID NO: 61669 - DNA, 1064 bp, Homo sapiens
taagattgtgggccttggccactgcagcatgcacatccctgaatccacactcttatggtatcgaggccttgggcaaatgactgaatttcccttgaccttcccttccacctgtaaaatggggacaatgatagtagttatctcacagggtaggcgtcagatttaatgagctaatagatgcaaagcccttgcatgtgcctggcatataataaatgctacattgtgtttttatcattaaaattatcttaatattattttgctgttgctgttattattgctgttgttattgcttagattggaacatgtctttgctatttataactgtgtgaccttgaacatatcacttagcccccatgtgccatgacatttgtaaaatggggaaagaggagtctgttccttggtgcagctgcaaggatgtcagtaggttggcacaggaaaggcctttgaagcagcatcagtgcagggcaagtgttgtgggttattattggtgacttgctcccctcaccagaggggtcttttgggtgctgtggagccagaggggtctgtccatggtgggttaggattatgcacttaggtcttgctttccatttgggacagtaagcatctgagagaagagtttgtccctgactataccaaattccaagttctgccaaggaatcctggggtaggccagaaagggaggcaggaatggagccagtggtggacccagcgtttccttccaaagcttttagactcagctgctaaagccagtcatgaagtggacgtgattcctgaggcagggcagcaggcccctctctcactacccccttcaccagccccaaccttcagcaacttttcctggcaggagaccacatcaccatcccctccccttcccatcacaggcatttcagaacacaaggggatctgggggacccacgtctaaggaactgtgactgagagcctgggaagggctttctcttgacctgggagagggaaaattaggcaaattgctgtgtttctccactgtaaacctgaatgggaatgagggaggagggagaaaaagccagacaaaaatggagacacatgca

SEQ ID NO: 61670 - DNA, 1976 bp, Homo sapiens
ctgcaagatgctggaataggagggagggagggaaggccagtgagagggcaagattattaatatgcttttcttactaaattggctttcagaatcaaggggaagaaccaaggtgggttgttaagggagtactgatttagatgtgctgagcagttgaaatgtttttgtttctcaaacatgaaagcacttggctttgcatgactgggttttaaattgctcagcaaagcatcacttggggctaacctgagtctgtgaagttccacaattcaggaatgatggttactgcagcactcttgtgtttcaaggttcgtcatgaagactagcatagattccactgttcaattaaagcaacgtttaccatgatattcctattttccatgatgcagggtcctgggaagcatctctttcaggaagggagtatgtattcaaggtcagtcagtatatgaatgtgtctgagacttggatggctcaaggggatagagctaggtgttatctggcagtcgcaaaagtgagagatgatgacaaggccaaggtaggtaggagaatggggatccctcattcatttatcccatcattatttattgagcaccaactgtgtcccaggcattgttcaaggttcaagcacaaagccgtgttcaatgggttcaggtagaaacatgcacagttacatcacaacagagtaaaccatgggaactgcatggtgcagagtagggggtatttgcatggcagttgaagacctgtgtcggacgctgatgcttctataataacccaacttggttcctctccacttttagagccaattaattaggaaaaacactttcttccttccctctctgtcattctatgttggcatttgtcccccttgggttgatgggcagacacaggtatgaaacccataacttcatctctctgggattcagtttctgggcagagtgggcaagggaggccagggtcttctagactcactaagtcagaagcatctcctcctgatctttggtttaatttttcttttgaaggtactcagtccatgatttcagattagggaggcaccacctggcaaagggggagcctgacaatgcagggcagttctaagtaccaggcttgggaccgattctatggagatatggtagatgggactaccctcaactgaataatgtgtgaagagaatttaagaccatgcctgatacatagagggtccagtgaaagttgaaggcaaataaccctggtaaagaaggcaggaaacacaaggaagccattcatttatttattattcattcaatcaacaaatatttcttaaatatttataccaacaaagcatggaacctctagccaaactctctggtttcaaatcctggctgttttacaatatctgtataaccttgagcaagttacttaattattctctgtgcctccatttcttcatttgtaacatgggaataatcaaaaagaataaatgaagattgttatgaagactaacacatgattgttattattatctttttgttcatttatttagctgtgtccttagtctgttgcttgattggtgtggtgttggggatgtggccaacggagacaggaaaggtctccgtctttacccaccttatattacaatagaagagtcagattataaaaaaataataaatcaataaataatactttaaggtagtgatgagtgatgcaggaaacaagagaagatgattgtggagtgagtgattactacgggtgaggtccaatgatagagaggactagtgaagagggaagacagtcagtctacacaaagatcatcctgttgaaaaatatgaaatatgcaagtctttggaatttacccaaaaaaaaaaatagagaaagcatttcttgagtttccaagagaggcaagcaggatgagccaccaaaaataagtacggttaaataaagattgattctgggaccaaataagcttcaagataattatttctcatggtagtgaatcagtatgtctc

SEQ ID NO: 61671 - DNA, 1054 bp, Homo sapiens
gatgacgatcatgataatactacactaatagtagttaagagttaccaattgcctattctgtactaggagcaatttagacctcatcacatgtaattctaacaacatccccgcaagacaagcattatagtcctttcatagatgagaacatctgtgcttagagagattaagtaactttcagactcaaacagctggatggtgactgagctgaggtttgtacccatgtcttgatgactaagcccagctgtgcccaccgggacaccttgacctagtacttctgagagccccagggtcactattcagaggctcccagagctgccagtaccccagatcattgcggctccctcatcctggcagtgaggaggctcaggcctccgtgctagtgccccactccttgattctacccgtccctccctccctgtggcctgcagagattccgactgctgctttgtttcacccagagcacctcttctgggctgagtgctgtggaaagggccaggtaggaaaggagatttaaagtagcttgactcagtttctcccctgagtttccctttggagacccgagaaacacatctgggaagtgaatgggaagatgagaagaagtaagcaaaactgggaagagtgaaggccttggaagtgcagaggatgccggtcgtcccaggtgctccggggagtatttctgtttagagtggcatgtggagggagtgctctcctggtacagcaggcgtccaggcagagtgagactctgctagactcaactctttcttcttctctgaaggaatcagagactgaaacaaggatggcttcatcagtttggccatagcctggaaagactgggaaacccagcagctctctggcccctgggctcacagacgacatagttcttggaagctgtcatccctgcctgtgatgactgacctgcctcttgccaggcttccatccttgcttcaaggcctgctaatcatcagctccactgggagatctttgcaggctgccctggaatcatagctccaggcctttgttctagaacatctgttgcattgtattgtacctattg

SEQ ID NO: 61672 - DNA, 1051 bp, Homo sapiens
actagtgtttatgaaggatttactaaatgccacctacaataccaggtgatttttctacatcacctcattaatcctcatatccctactatgagagtaggtaccgcattcatccccattcagtggagcccataggggaggaaactgacgtgggaggctggctcagttcccttagtgatggcagtctgatggaggtgctgacccaagtggacaccaaatgttttgtattgaaacataatacagtgcagcattatggggcagggatggggagctgctggcccatgagctggatatagtcttgatgtgattttatgtcattaaggaaacaattactaagagtaacacaccctttactcctgtagtcataaatctgtagtctacttttaaaatctactgataagcttccaaaattatgggttcctttaagaaagtttctctttagttctaattttattattgttgtttgtttgattgttttcttttctgcctacatatgtctgattttctcttcacaactgcatcctagatgccttccttagtctcttctgcttctcttctgttactcttgttttctgcttctatatatttatctgctgttttcctttctgtacttttccctcttctgtctgtacccattagtatcccttaaatgcctgtgaaaaggaattcaagtgagttcttattgcttattgggtagaagagggttttatgctttaatttaaaaatggttgaggatttaatagtatttctgtctttaaaagataataacattacattgcttttttactttatttgtattagaaaaatattctgactctccattaggcagttgtccttgatagagtgggaaaaaggctcagaattccgtcaagcaggtgtatcaagaagttgctatttggtctgttgtctttcctggttattcattattcagtttaacacagaaatcattaaacatacactgttttctatggtgccaaacatcaaatgaaacatgcttaggcctgtgaaccaagaacttctagaaaccagacaattaccaagggcgtcaaaatgt

SEQ ID NO: 61673 - DNA, 1039 bp, Homo sapiens
ggagcagaggcagagtcctcagtttcatcctgggagccataaaagttttctaagagtttatcatctccatcaagatgaaaatgggatttcaaggcttcaaataggaaagataaataacaaggaaaactccagcttttgtcaaagcaaagttctctttaccagttttatgagtctacctgttgtgcctgcaccctggcatctgtttcactgtggtatcagacaaagccttctccaggaatttatgcaaacctacgactggatagagaatttcaggcaattggtagagcttggaagacggctgacaagtcatattcttgggccgtaactcactctcagactcctcattcgttcctcaattcttcctcttccccttccagcataatgggaattggaatagaaagccctattaactgtaaggcctaggctgtgatttataggacattataacaaacgggactatggttcgttgtacttggctatcttttgcatttgaggtggccaggattctttgtcaggattagattttgcccccttggcctcagtaaatggctgcatgcaactaggaaaggctcagccagtgtttccagctgctcaagatgaccccatgtttcctttgaggaaagcagtgctatagagcacccatgtgccactctggatggccacgaaagtgcccagtgagtgctccttggaacttgtttctgatgtgaaagttttggtgggaaactcggggagacatattacatcctggtaggaggcacgtcctatggatttgcccttgatgcttctttttccattgtcctggcttaagccctgtgaccccttccttcactcattatagcagctacatgtcactctcctcatttgtcccatctccccgcttcagtccatctttcatgctattgccagatgaattttccccaaagccagctttgcttaggtttccccatggctcagagaccttcagtggctttccaaggtctaaagcccaaacacttcaagcaaatggtcagggcccctatcctctttccaacctgtcctt

SEQ ID NO: 61674 - DNA, 1006 bp, Homo sapiens
tcgtgcctacgggccccaaacagcccaatttggtgcactaaaagcctcatttttagactctgggtccagagtgaggctttttccagaaaaaaacaaacaaacaaacaaacaaacaaacaaacaaaaaacctacttcagggaaatgacaacaacagaaagccaccatttgccctaaaatttttattgtaaaaactattctctcctgtttgagtagtgagggatctaggacataacagtggcttctctggctttcttaaggaatcagggcacttggaaactcaattaaatgtacccaagcctcttaagcaccaaggctatctttttgctcatccagttaatttcagtttgtaaaattggccttgtgctgacatgatggagacggggtgagggtgggaagccagggtcctctgtgagcggaagcttgcttctctgttcacaagcctccaagggcacacatccttccctggggcatcaagggggaccattaaacctgtttgcaccacgtccctgggagagcaaacttctgggccttccttgtttactggaggttggttaattcggaaggtagatggactgggcatattggttccccactggcaggagcagcccaggattcagcaggttaacgcaaaggatcgagaaactatcaccttcctagaactgttcccagacttttagcaaacaggctgaattttgacctttttcccatttttctttttaatcctccctccccacatgttttgtggcttttggtgaaatggctgtcctaagggaaacaggacagttcattgaaaaggagagagaaagtaaagacccctttcccacaccaccttccctcagatgcagcctttgcttacactaaaaatagcttgaaacagaggctgaatcacaaaaaaaaaagtggcatttcaggggacagaggctgccagctccctggctgctgctgaagtctgttgggtttgttggtctctgagccccgacttgcccaggaaggcgtggggtttgg

SEQ ID NO: 61675 - DNA, 1043 bp, Homo sapiens
atgctacttgcttgaatgtatagggatgatttatcgatgtaagaagaaagaaaaatatcagcctctctctttatccccctaaatatgttgcatgtgtggcattttacattaacgttatatacatagcctggaccatttcatctttatctccaagggcccaaaagaaaatatgtgtcaaatatgcctttcaaataggaataatcctattggtttaacagagttaaatagatgtacattcactgatgtgctgtttgcgcatgaaattagactggttgaacccagtgggagtacacatgggcacacacataatcaaatatatcacattcattgcattcacttctgttaggtgccctatggaggttgtgacatttcccatcagtatcctctacttttctttctcagtggtgcctggtggcaaattcacacacacttctctctctctctgtctctgtctctgtctctcacccccctcatctatgccccagcttttattatattttaggcaaatctatgtaaaattcttacatcattggccaatgccttgtgtagcagaaagactagaggtttcacaggactgtacttttagtaagaatgtcccatagtgaataggtatgtcctgctctctgctattgggaatcagttggagttttattggcattgttttaacactcctaagggaggcttctgtttaaaggaaccatatgataatttccttccaggacttaatagtggttctgtatttcatcccatgcatagatactgaaatcacattatgggtatcagtcaaaaagtcaaagaagatacattctttttttactattaaacatgaaattttgtctttatctaatgaaagatacactagatttgcactagatttgttatttttgactcaacatcatttacccagatgagaaaacatgagtcagagaaataattgaattgagcagtctcccccgacaggtagtgagctgcctgttactagaaatattcaaagagcagcaggatcgcatttcatagtgctgttgctgacagttggttagact

SEQ ID NO: 61676 - DNA, 1031 bp, Homo sapiens
tcccactacagagacgctgctattctcagtactctaccaggtgctctgtgagcttgaggtttccactctggctggtgggaaggtgaaccgttcccagccctgtataaactctgggaaatgttctgtctgctcctttagggtgtttctctcccccaccttggatagctttcacacatgcctgtgtccaccaatacttagctaaagactcaagggggtccctctgctgacctcaagtattcactgggcagttctttttgctgccctggcctgtgaattccagcctccttggccttgctggaatccagccttcatctcctcaactcagggagacatctgggccctgctggggtcctccttctttctgctgtgacttggacgctctctccagacaggaagttgaggcaactgtagggctcacttcgtttctcctctctcagggattgctgtcttcccctgactgagctccagtgtctgaaaatcattgtcttgtctgaatttttagttgtttcaggtgggaggagagatctagtccatgctacttctttggagaatctttgaatggtgagataagattatttatttatttatttatttatttatatttatttattttttacctctagcattctggaacttcttgtgcttgttagaatttctcagtgggtgtcagaagatggatgctgtaatctgtattctaatgatgtcgtggcttatctctggaaatactcttgattggattttaaaactgagtgcttaggagcccttagagaggcaaatgctggtcacaggggccaagctagactctatgcaaacaggtcaggctggaatccccagttatcaagggactgaagttaacctgaaacgtttcctttaccatgacttaacctaaggtgcatgataatgagtgttaactgggtaccaggcttgcctttacaccaggttctgtccttatagcaaccccgtcagctaggtacccccatccctgttttccagatgagattaaggaactttcccaaatttagggtctgaat

SEQ ID NO: 61677 - DNA, 1050 bp, Homo sapiens
tctgaggtactgggcattaggacttcaatgtgaatttttggtggggaacataaatcagcccttaataggcacagaggggctaagtaacttgtgtgtagacacagagctataggagaagatggcaggcattctgactccagaatcccctggttctgacagaatcccctgacagttctgacagttcgagaccagcccggcccacatggtgaaaccctgtctctaccaaaaatacaaaaattagccaggcatggttgtgcacatctgtagtcccagctacttgggaggctgaggcacaagaatcactggaacccgggaggcggagtctgcaataagccaagatcgcaccactgcactccagcctgggcgacagagtgagactctgtgtcaaaaaatttaaaaataaataaaaataaaaataaaaacaaggaaacaatatgattgtactattcaaaggataatacttaatttgcaaacttcatattaattcctagtgtactaccagaatgagatctggtaacaggataaaagtttaaatcagatgatcaatgccatattttttccttccatgaatacatctccaggaatgtgtacataacctaatcaggaatagcttcaaggtcaaaattcgtggtccctgtgaatgtagaactcggcgagtggccaagtggccctgctgtgcctccctgcccttttggagcagcctttcagaaacttctggactctctgaccactgtcctctctcaagtctggaaacttgggaactaaccttgacctcgagttggctttccctaggggcaaatgcaggcgctggtggaaaaggctatggcctttatagtctctggcagctctgtgtgtccacacaactgtgatgctgtgacatagagttctgccactggattctatgactgaggatgaagtccaactaaattgccatgtctggaaccctgttggatcatcgcactggcaccctggagtcccttgggatcccctattcgctcagcattacatctgctgagcactgctcagtcaacattagtgaagacaactgct

SEQ ID NO: 61678 - DNA, 1363 bp, Homo sapiens
gcccagctaatttttctatatttttagtagagatgggctttcactgtgttcaccaggatggtctcgatctcctgaccttgtgatccgcccgtctcggcctcccaaagtgctgggattataggcgtgagccatcgtgcctggccaggcacctgttagtttctaaacaattgttaatatcattcattactttatttctaaaacagcatgattgaattgagcatttccttggacttggaaaggtatgattttggaggagggtgaacctgtgtaggctgttgcagggagttccttgacattatcaactgaccagtccatcaacaaatttatttgttcatttatttattaattcaaggatgttgggtccatttttcagttagactctggaaagataagtgattggtcctatcccttaagggaaatatgctttcattggagaaataacatgtacacgctgtgtgtatgtgtgtgtgtgcacgcgtgtgtatgtgcatacacatgtgtatcttttttttttttttgagatggagtctcactctgttgcccaggctggagtgcagtggcatgatctcagctcactggaacctcccccttccaggttcgagattctcctgccttagcctcccaagtagctgggattacaggcgcccgccactacctccggctattttttttttttttttgtatttttagtagagacaggatttcaccatgttggccaggctggtctcgaactcctgacctcaggtgatctgcccacctccgcctcccaaagtgctgggattacaggtgtgagccaccgtgcccggctgcacgtgtgtgtctttatgtgttcaccctatggggagagaaaaggttcatgaaagttgagattactgtgggtagggttgtcagggagggctttgccgggagggggaagctgcgctaggcaagctgtggctccagagtcttggaggcgcctgtaacagtccctgcggtttcaaaagaattcagagaggggagccatagcctggtctccaaatgtgcagcaccttctgggcaagcttagacttaaaggatatcattgtagataatgatttgcttatttcttgctctaggatatggggactgtttctttttttctgggatgctttaataggatagtaaaagtaaacgtgtccctgtctgatggcccttggctcagctggaagaagatcagctctgctgcaatttaggaagagataactggggtccatcacgtggctggttcagaccagggttttatgactgggatttgcctgctggagccctgggtcactgtgccagactcaaccacaggtcacaatctggaactggatccttgctgccagatgggaggcgggcaggg

SEQ ID NO: 61679 - DNA, 1097 bp, Homo sapiens
caaagagtggttcaaggtaaaagcaaggtcaagatacatttacaagccagtgtgttgtctgtacgtggcagccctataaggactggggttctgtgtggtcctagagatttcggtcctggagatgaaagactgtgagtatttacctggaatggaggcccagggaggaatgaatttccctactcctgtgagagctgtatgtaaatagactgtttctgtgttggaaagagcacaggcagagtctgtgactttaggcaaactgcctaatttcttttcaactgctaaatgtgaataagcacagcaccaacctcctaggtctattgtgaagattaaatgacataacctagtgtggtcttagcgtgttgtaggcactctacacactctatcgttagtagtagtcatattaatattaaactagcaaaaactgtttgcccaagaagttccagtaaatcattcccttcaatcagggtgatgataattttattttttagtattattaagtcattgctgtctgtaaggccatcaaagagctggagccacttgctggaatcaggctaggtcaatttctgaatgctggaatgaggttgaggggagtgaggtagaggatacatttttaaaaagtttacatgtaatcaaaccctggtcattcacatctcctgttagattcattatgggagttggatatttaagaggaatctttgccacaaattcatgtgtaaacccaataattctcgactgttaaaagtggtgggagccctagatattaggatatagggtcatttaaccccgtggttctcaaccaggcatgattttgcctcccatgagacattggcaaattggggtgggtgctgctggcatccggtgcgtagcggccagggacactgctcatcttataatacacaggataaccctcctcaataaagagtaatctggaccaaaatgtcaacagtgccggggttgagaaactctgtcctaacctgaagatgagacaactgaccaccaggaagggggagtgacttgctgaggttaggcagcacagctgcaccagagctgggatccaaagtttgaatcaattgaccagaggccagaggccagacaga

SEQ ID NO: 61680 - DNA, 1023 bp, Homo sapiens
cagatcagcaggggctgggttatgagagatgaggagtgggctgatccaaatgagaggtcagcttgagcagaggggaggatgtgggaaggcagagagtgtggaagccatgtgttgggagcagggtctgagaacatcaggttggggacagcccacgagggaccttcattagcagtgtggattttcacctgcactctgtcggcaagcactgaaggttgtcattagcacactggctgtcacagaccagaggggcttcccattcagtcaaatcttgctgcccatccccagtgaacggagcagtaggcagtgaggcgggaccggcagggcgtacaagatgctcgcccattccctccatttgaattgggcttgggacatcccaaggggctgctgcctgggccctgaacacatctaagggctatgggtttatggtctttcagctgctgtttatgtcacaaatgcctgtcacagaaggggcattaaaaataaccgaatggctaataccatttctcaaaataactacttgcaaagtgctttgctggggcaaatggctactaaaattagactccctggtggtatatgtagggtgtgtgtgtgtgtgtgtgtgtgtgtgtgtgtgtgtgtgtatgacttctaaacccatttccccccagggtgaggcccacagtttgcacccttttgttctgtggtcccttctgtcatagctgggtgtcccagaacagtgttcacccagtcaccccaagatgccctctttcatcctgcagtcctcagcaaattggagccactgccctacattgccctgttgtcctgctctaaggagcagaattttgaagaatcttggagggcggggtggcctcattgtagcagtggcctaattccttggtgtgccaggtaataatagcacgccgtggggggaatctcactcagcatgctgtccgaggggaaactgggccatggaacaatgtggcagccccactcaaggtgacctagtaactgagggcacggacacacgattttccaggccccagt

SEQ ID NO: 61681 - DNA, 1041 bp, Homo sapiens
tctctcttctgcagagacgaggggcccagatcgggtcagcctctgctcagctctgcagtcttgccagggggaggaggaatcaggctggggggcagggatagagggccgtgtgcatcagggaaggaggccctgagatgacaagctccatgagtcactcaactggccgctccagccagagagcatcaaggaggggtttatgacactgcctcatgcagcagtgatcagccatgaggtggcatccatccattgtcaggggacagtccatcctcctcaggcacatgcacagaggattgggtgcagaggagttcaccctcaacacctctgggtgttgggaggcaggagagcagtggggctggaggcacagctctgccaagcattcctgaaccaaagcaagccatcaatgagtgctcacaccgtgcaggcactgtgagcctgtgtccacatgatctcatcttgtcctcagggccatgccaagaggaggcactattcttcttcttctcagtttatggatgatgataatggaggcatagagaggttaagcaacttgtttgatgtcacccaacaatgctgaaatggggcaggatttggccctggccctccagagcctatgggcttaattgttgccttggtgggtcttagccttgagcctgcattagaacaacctggagggcttggccccactccagagtttctgatttcggtcaggtctgcgataggtctgagaatgtgtgtttttaataagtttccatttgaggtaaagcccagggaccacactagtctgtgctgtactgactcatcatcccgtctcagtttccaacctccaaaaccagagggttgagctttctaccagttctctccagttgaccagttaacgcagaaattccagccttctaatcacccataattatgtttagttttggacaacttaatatatgagagagcaatagtacttcagtaaactcctctactgctactgggtttctgtcacttgtctcctcttatttttgacaatttgatgttttgtgttgtgaggcttccttt

SEQ ID NO: 61682 - DNA, 1155 bp, Homo sapiens
ggattgctcaggatcactgagaaattcatttggcaaaatattgtgaatttaatggcctcttcaatttgaaataaagccacccggctttttgaaatagagcttcctttgggagcttagaactaaattcttggcttcatagaatgccctagctgggtggacggagaatcccaacatatagatgtatctagaatgtcagaagtgaagtgatctgtctctccaaatcattggtgctagggagaaagaggtgagcatgctgtctttttaaaggattcaactaactctcagagctttggaagaaagaaaaaaaatccaaaatgtgtactaggtcagtttttatttggaagatggattttattgttatatttttaaactaggaagtctcttaccactcccattctccttccctggcctagaggggtgggagttcagatccctgcaacattttaacccaaaaagctcttacctgtttacctttctttgatagagttgccaagtggtcttggttttgttttgtttttcttttagaagagaggatctagctatgttgcctaggcttgtctcaaactcctgggctcaagcggtcctccagcttcagcctctcaagcagctaggattacaggcatgtgccgccacactcagctcaccgagcggtcttgaacaaaaaacccaaattggtccaagtatggattatacactaatgatatttatcaccatcactatcgttgtcattatcagttttattatagtgacttccagttcggtatctattgtgggtgcttggagcttttgcacatgtaatcttatttaatcctcacaccaacctaggaggaaggtattattattattgcccttttccaggtgggaaaattgaggctcggagagttgtaagtggcttgcctgatgacaaagggtgggtgagtggtagaggcaaatttgaactcagtgaagaaagagttcaggctttgctgtcagatggactgaagttcttctcttggtgtccatgggggtgccagagatgtgggggttcttctttctccttccaaatcagacgcaactgaaagtctgaggactcagcttcaatctgagctctgatttctctagagtatccaggatggaaaaggggatggtaagatgaagtttgcagggagggcttcc

SEQ ID NO: 61683 - DNA, 1072 bp, Homo sapiens
agtagttgggaagcctgggggccagctgggagttgtcactgcgttgggaatctgcctcctgggcctttttattaaggcgtggagttgtgtgctgttctcttacctctggtccctgcttggaggaagaggctgaacttgtaccacctgggcaagccagtttgctgtgaccacacatggattaggtgccagatgaccacctggggaatgtgccagtcaggcagccaggatgcaaagtgattcgcttcccccttgccagtattttctagggcgtggtgtttgcccgcatcttctggtgaggcctggctatctctgaggggcagaccagcacacctgtgggtgcagcagctcacaggagtctgttgggcggcactgccaggccctcgggaccctgagtaaggtctgacgcatcagggcaggcagaggggaggccacatttcgcctgccactgatgttagcggggaggccccagacccaggtgccaggcgggcaaattgatttttcagcctgcgaaacttctaaagataggcacgggtggtgctctgtgctggcactgggagtgacaggccatctgtgagtcacagtcccgcccgctggaggagtgcaggtcctgggcaggcagcactgcggtgagaggggcccagatgcaggaggggagggctaatgcaatgagcttgagtcagccctgcttgccaggccaggatcctcctcccaggccggcaccaaggagagtgttctactgcctggctccaggaaaactgctgctgcctgtaatttatgcagtttctatggctgagtggagcagacatggcctgaatggatcattggagtggtttgtgcttccctcgccctgtggcctcacatatttaacaaaattggttgcttggtttatttcttgaatcatcacttgaaatctctcagcttcattctgaattcctcatccctcttctccccttgtttcctattttctttgaattatttggctggctctttttgatatttgtgacattatcttacatttatgcagcactttacagtttgcaaagctctttcacatacattatccaggcaacac

SEQ ID NO: 61684 - DNA, 1101 bp, Homo sapiens
ggggaccctgtcagtatcatcaggatagcccggactcagaagttagtctctcatagagccaataggaaggttttggcaaatctggattttttcacttgcattctggttttggttctgctattgactatcagggttactttgaaaaaaccatttgcttctttatgtcttgcttgctttatctgtaaaatgaagaggttgtaaaattcttctgtaaatcatttaattaccaccctcttcccccatggaaacaaacctagaaaatcctaactttgctttaaaaatattcagtacatggaatattttagtgttcatgttttctcttttgagtggggtttggccattggctggttcttggataaaatttggagggaggtattctccaggcttaaatgagtgaaaaagtctgggaaaaaataaaccaaccctacctccttcccacccaaggagtgtcctttgcatctggcatcgctgtgttttcattcgctggtcagtccctcatctgctgccaacctcttcccttcctggcttggtcagaaggtccagagagcccactgtactggcggggagaatctgtcccttttgcgcacatcattgggaactcaaagtcatctcgtgttggagtcaaatgacgtgttagcacacgcctgcttgggggatcctcctgcagttggcatattgcgtgacacacggggggattctcatcgtgctggaatgcatggccagccccttctttctccaagcacagttcagtgcattttccccccagttgctgcttctcgtaggagattatttctgattcgtattgagttgttactggaaaacacttcagagagataatgagctgggtagttttcctcttcatttttctttgttgttgttgaattcatatgggtaactgggctctccacttacactttattgattcctgaatttagggcatagctctgtaattggcaatttcctcagtgccacgtgggcagagagaagtactgtgcctggggctgctgactctgcaggaagctgtaggggcacttccttttagccctggactgacacagctgagtgcccgtgggcaagtcccttgttgcctctttcttggct

SEQ ID NO: 61685 - DNA, 1048 bp, Homo sapiens
atagcgtaattttttccccatctgttctgggcaagggatgataaagcattctgttggaagattgtgtgtaagcatcaaccatgagtctcactactttattgcgttgcaatgtctactttgttaagatgtcttgaaagaaagacttcttccatcctcctggcacaactgaatgtgcttggtatggggagacgtgtctaactgaatctaagcaactaattggaataggcaaaggaggaagtgatgaaagtgaagctgcagtttctgcaaaggtggctttattgtataaggtgcaggttattaccccaaatgatcaattactaaagttctggattgggcagtgacaagtgtctagagggaatgctgggcctagggaattgcattgtcatgtgagaataaggctggggccacctttacattttcattaaaaaaagatctggacagtacttgactgtggtagtagactttgtaaaggttattatggttacagctttgtttgcttgagatcctctatttttatagttcaatattattaaggtatgaagaaactgttttatggatgtcagttttactgtttctgacaacagcttgcgaggaagtatacatttgtgcaacagaccgctttggatgttaattctaaatttagaagccgccttcaatgggtgtggaaatcagttacacaaaattcaggtgcttactaaaaaaaatctgaatatccatgaagcttgtatggtccctggtggaactttgagcagctgagcctctctgaagatcctgaggttgtcagggtgtggcacagcagctgggggctgggccccgtgcatgcacatcagcatctgtgtattgaatataatcagcacagatagggaagaaacaaaccaccaccaccaaacaccctaagtaccaatctgggcatctgggcaccctggattttcattttgactctgtcatttactagttctctgaccttgggcaccatgctttgcatagcagccttggtttcctcattggtaaaatgaggctgttgaattctatatggctcaagagttct

SEQ ID NO: 61686 - DNA, 1080 bp, Homo sapiens
tggacaggtatacagggtgagtctggaagggtcctgagtacagaagcttctgtccctgttgagcgaggtacagacctattctattctattctattctattctattctattctattctattctattctattctattctattctattctattctattctattccattccattccattccattccattccattccattttcttaaaaaataattgcttataacctgttacatagatttcctggtcaaccagggggttgaggcctgccatctgaaattgctgttgtagtccagctctcctgctgtagaggaggatgctgaggttttgcctcatattatgcttctcttagtcacaaatctgaggccaaatgcaactgtactgagggccacccctgcccagcctgcccctgctgttacacctgaggctttgttaagagtcttcctgggtcatgtctgacctatcctgtggttttatgcctacacatccccaccgcccatgcacacactacacatcatggctcccggggaggcccactgggctctctctggccatcaactgtttcatgctcctctcctcttctgatcactgttcttttctgccccttctgagaatcagagtgaagattttgagacttagtgggaaggacttttaagctgatggatttaaatataagatattttgagagatgacttatgtatccagttctacaccagctcattcccaacctgaagtcccccaaactctgaaaagtgagtgtttttacctaattcatggaggggctggtggtgagtggaagctgccctgaactgcgaggcagtttatggtcttcattcatccagcttagtctgaattgtcgtgtgtcattgaagaaatgttagtgtgtgtgactgtgatgtgcagcccaaacctcagagattcaccttaataatttcctaaaacccgaaacaattggaattctaaaacacatctggttttgaagattttgagtgaggaatcatagagctggagatatatttgcagtgtgtgcatgttattgatttttttttttttttgagacaagatctcactctgttgcccaggctgg

SEQ ID NO: 61687 - DNA, 1076 bp, Homo sapiens
agggcctcctgagggtctcccagcctctggaataacaccttcactggtccgttctttactggccaccagagaggcctcttgaagacgtaacccagatcttgtctttctttttcttaaaacctcccaaaacttccccattgcccacagcaggagtctaccggccacttctttttgtatagtccatgagctaaggatgggttctatctctttaaatggttgaaaaaaacaatagacacattatattttcgacatatgaacatgataagatattcagattcaaatatctataaataaagttttattgggaaagagccatctgcattcactgatgtatcttttatggctgctttcaagcttaccgtggcagagttgagtaattgtgacagattgacagcttgttacagagaagtttgcccacacctgagctgtaggataaaattcaggcttcttcgcacacacctgtggccatttgtcactgacacccctgcctccctgatccctcctgctttgataaccttccatgctcttagcaactcccagctgccggcagatgccctgcatgggccatttccacctctgtgctttgccccttctcttctctccatccttgctgcttccttggctagacatcactgactcatccttgaagaaatccccttctccaagaaggcttcctgacctcccctctttccctttcatcctgtttggtttagtggctccctccctgtttggacaggaaaaacagaagcccaacgactccgggaggttggcagctgggcgctcagcacagagaaaggaggcctggggccaaaatggctcactgagtcagcagacccagtgcctggtatatgccaggtgctctagatgtgaagagcacagatgcaggccctgcctctgtggggctcacatcccagtgggagatacagacagttaatgcacattttaacaaatatataggggatgagagtccatgtcttgggagtgccctggccagtggctaggaagtggtggcaggtggattttctagataaggaacccaggaaggcctctgaggaggtgacatctgagtcccgaga

SEQ ID NO: 61688 - DNA, 1114 bp, Homo sapiens
ttccacatatattaagttgtttatgcctcataataaccctgatgcaggcatcattatttctgttttacagaggaagaaacaaagatatgaagaggttaaataacttgccaaggccaatcagctagcgagcatcagagctaggattcaagcccaggcagaccagctccagagcctgagctagactcaatgtcagtgatgatgtcgttgaccttcggggacagattctgcttttgccctggtgggtctgggttgagatgcattgcatttgatcttgctggagaaatttccagtcttctcagccctgggaaaatatgtatattggaacctcagagctacaccctgagggtatgtctcctggtttgctgaatttttaaaaagaggttttactctatggccagctttcttgccaggagatcagagaccgatgacagctggcagaatcggcctctgttccagctgtctcctacccttcctaaaactcagatgctctttgaagctgtcttcctccattgaggagcatgtgcttcttcagtgacagccggagagtgggactgggctggcccctgtccttctaaggccaccacctgcagcactcctagtcaccgttccaaggtcactgtggaggaaacagaagtggccgagagaggaaaggtgcttctcaaggaggctgagagtggagggagtaaggcaactgagcacggcagttgggtgggcccaggccaccaactgtttgtcctgcctgagttaagagtccagaattggggctgggtgtggtggctcacgcctgtaatcccagcactttgggaggctgaggtgggtggatcactaggtcaggagatcgagaccatcctggctaacacggtgaaaccccatctctactaaaaatacaaaaaattaaacaggcgtggtggcgggcacctgtagtcccagctactgaggctgaggcaggagaatgccgtgaacccgggaggcagaggttacagtgagccgagatcacgccactgcactctgcctgggtgacagagcgagactctgtctcaaaaaaaaaaaagtgttgagaattgggtatcaaacagagcctggtgtctgtcctggctttggcttttagcagcct

SEQ ID NO: 61689 - DNA, 1066 bp, Homo sapiens
gcaaccgaatggtgaggggtgacagtattgctactggtaggaaagcttggatggcagggacagaacggctgtaaacctggcacctctgggggagctgccccctcaccttgactttgaccattgtccctttcttttcactttcatgggacactagcgttgaaaaattggggcctttttcttcacactcccatttctctttatttaattattttaaaacatctgatgctgcagtgagatcagctgtgatacatcatctgttctattttgagctgcagggagacaaatggagaatactgctacctcccctcctggcgaggactgtgctcccaggagcccaatggatggaccgagccaaggcagctctgggcacaatttggatgctttcccctccaggggaatgcctgggtttccttattgtgcagatgccttgaactaacctggtcaaaaactagagagacaaaatcacagatggttgcacaggttgttggagtagcaaagacagcaccaagcagcagaaagaagatgaggcattgagtcctacgctcagggctgagcaccgtcactcctaattgaatggccactgaactttgtttcctcatctatgccaaagaaataacatttttcctaccactttcactgggttcttatgaggatcacacaagataatgtgtataaaaatgctttgtaaatggaaaagcactctgcaatttaagacattattatattaatagtaacaattaccatttccaattctggtgattcacttggggtaggagcccatagatctcatcactgctaccattactaccccacattgtacttcaaagctgcaattaccttgcacaatttcatttgatacattactgattatgcagtgttagaactggaaagcatcttgaggattaactaatccaaatgtatcgctttatagatggtgacctggcgcctggaagggagagacttatttgaggtccctagaactcaggactgtgggctgtcattcctagggagtaggctgttttactttggattatggttccctgtcctttctgaagggctagacatg

SEQ ID NO: 61690 - DNA, 1077 bp, Homo sapiens
cttcagtgccagggcagacatgggagacctgggaagcctgcccccagattttgctgtcaggcattggtgagttttgtgtccctcacaagtgggaatacattcaaaagacccctcccaccaactgggatggtgaaaagtataaaggacagtctcattctcagtgccatttagaatagggcagttttgatgaggagcaaggtgagtttcttaggtggtgtggctcttctcgaaatcaagggagctggagctggactcctgctatatcccttgctcagaactctgtactgcctggatctgatcattagcagagtctgcgccacctgctttggctcttggtccaaaaaatttgctgtatccttggcttagctactctgtgtccttgagggccaggaggttgccttgaagtccatgtggttcctggttgagtcactgacaaataaagtggccttggtgcttaccagggcccggggagaggagacaccatggtaatgacctcagacaataaacagaccattgggattggactgtggcctccagtgtcttgctgactcctgtcttggaaccaaatgcagaagctactttgtcctgcagctgatgggaataagctgccagcagatattttggtgcctagattatgaaaggagagtcaatatgtaatccacgggtataaaggtcatcacatggtccgagtctaaggcgatggtgttatttgtgcttgattggcggaatcttatgctgactgcttcttcacttcaccatttagagagtggacatcacacattagtcaatggcacacatttgggtttgaagataggttcaattgtatctccgtgttttcatgacatcttagagatcgtccgtccttttcactcatgaggctttggggtggagatagtaaaggtggctgatgtccctggatgtgagtgtgctagttcagcatgggacctcaggcagaaccttccccacgtgagccccagtgaccttctctgccgagaccctgcctcttagaggtgtgaagctcaaaggagatcatgtttctgaatacattttgcaaaggtggcaagggctgaccgtaaa

SEQ ID NO: 61691 - DNA, 1153 bp, Homo sapiens
aactcctgacctcaaatgatccacccgccttggcctcccaaagtgctgggattacaggcatgagccaccgcgcccggcgagattttaggtttttgacttgaagtgaagttaatttccatctgttaactgctgaagtctgggaccatgatgtcttttgcaaaagagtttttaaggcaagactgtcagtaatattctttccagggtcacttctaactgtacgaaactattcagccacgatgggtctgcatctttgcatatcattgtaaaccaaattatctacaggctgttgggctgcctgtatgtgcatttcaagttgggagtataagatgagtatttattttattttctggttccatgtcttgttcttgctccttcttcccttttagagactggacagtcctctctgtcttcatctttgggagtgaactggggctggggggtgggatcgagagtggcctctgctggctgggggcttcaggtttgtagattagtagacaacaaatagcgacctgatttaacaagtgcagaagcgcatggaactataaattcacagtggtggaaggaagctttggggcctcaggccctgtgcgattcctccccagtgctggaagcccaccctaccagtgtgtttatgatctcctgaggccactattccactggggacaaacccaccttacgatgaacttggaaagatctttctgtttgcactagtccttgtttgcttctagtctgtgtctgggacatgcagaacaagccttggtggatggtagatttcaaattctaaatccagttcaggaagggacagagctgggtggtgtttccatgtccgcagtgttgagacgtagaatgaccttaaccttaacttgtgtttcctccatgaaggccactttatttttctccctgatggcttccctgggttcttcgtcctcctgagacagtgtggtttccctttgcccctttgcccagagttcagaaaacgacccattctggttgtttcttgaagtttgccttctgaggtctcttcggtcttgtcagcagctgtgactggaggcttttgactgttgctgggccataaattcacctccttatcaatgtcacgtgccttgtatctccaaggtttagcccccttctcagtttcacgtgggggttgtaa

SEQ ID NO: 61692 - DNA, 1031 bp, Homo sapiens
tcaggcaaacccaagttcaaatcatggatctcacatttattagcagggcatctttgactgccaaccatgttgagctttggttacatcacctataccaagagcatactgatgcttactttgtagggttcttatagggagcaggaataatgggcacatagcaccctgcaaatgccagacacttagcaggcctcttgtaagtggtaactatcatagcttcatgaagtgctgagtttattttccctttgattcattgaacttatagcccctgaagggcgcagactataacaaataaagtttttgagccaaaaggaggctttagatcctgaagtatactgtcatagatcaaaaaaccatttagagtcagactgagacatgggcttatggctcttggctgttgcaaggctggaaagttagggcagggcagcagaggtaggcttcacggatggggtcctggcaggatggttacagttttgatggtggggtatcagtggacgaacatcgacagtatgggggaccaggagctgctgggctggcagaagggaaacactgtggcatttggtgggcaggtatggttgtccagcattgtacccttgaggagggacaaattccatccctgttatcccaagtccagaactcatagacctgtctcccaagtgatgtcacggtctcttggccaggacactcactgtctacccagaccagcttttccaagacaccccctaggccaggtttccccaagtgtgttctgtggcacacctgccttttaaattaccttgtgaaaaaaaatcagcaggcatggcgtggctgagcttcccctttggagggccacatcacaggcttggcggcatcctgctggtagagaaagtggttaaaatgccctcaaatgtgctacctgtgagcagtcttgcttcagtgtcaggggtgctgtgcagtgcccaaggttcagcctgtgatcctgggcaaagacgtcatgcctttgtgcctcagtttcctcacctgcaaattgaggtctgtgatagagcacagcctca

SEQ ID NO: 61693 - DNA, 1049 bp, Homo sapiens
tagaataataatttttgtgctagatttcccaagaaaacataggctgcctttccagaaaattctaccagccctcagatgggttcaccctcaccctccttcagccccaagatggtttgatcaagagctggagtccagaggaaagcaggtctgaaattctgtgggagataaaattcagcaaggagctccaatttcatgagcgtttggtctctgggatcgcaccaaacctttttgatcaaaggaacccaagactgtggacatgcatcgtgggacatctcttcattagtacctttggcctctgaatctcaaacagtgaatgactttagtcttttgaaaagagtggcatgtggactttttcagaaagtgaagaagaaaacattacaatttcctcctgttgggaacttggtcacagtcattccagtactgtgttctttgctgtactttttcacattattgtttttttccttgtgggatttcatcagagctctctattcacttgggtgtgacgttgtgaagttcaatcctgtcatagactatattgaatagggagctgctctggtagcctgaataaagccatgactttgaagaagttatttaacctctctggtgtctatctttccttgtgtataaaatgtggggattgaattctgtgagttctaatgtcccttcctgctctgtgattcgatataggagagagggaggagttgaggaatgagggttaaagtttctagctcagaatgtgttttgcagttccctagcaattcctttaggaattcagccttgggacagttacatatctttatttccatcttctgctcgtcttccagcatgtggtctacttctctttaaataactggggaaactgaggccaacttcctgttggagctgtggtttgttgaggggcctgagtgtggctgggcatagagttatttccattctcagtttgagctgttggccttgtagaagcttgggcttgatcaaggatggtctgcgtgtaatgaattatcgagatgttgtctccatggctgtgcctgagaaaacaacacgttttc

SEQ ID NO: 61694 - DNA, 1982 bp, Homo sapiens
tgcagctggccgcctgaggggacaccagactcagctcttttctagcgactgaaagtagaagtctgtccgtctatgaacatgcgggggaaggatccggaaccaggacccagaagcacctcctttgtagacagagggccacggctgcgtgcgatccaggcccaggcccacacactctgcccgtgtcacacgtgtgctttaacacaaaacagataacactaaagacgggttcagcacccacctttctttagccagctgatcagagatgctgcaaagagaacctttcggatcactcgtttacaagccttttctaagtatttggtggtttatgtttacttgaacggctccatgttgccggtgcccagcccctgtcccctctgtcaaccccctgtcgctttggtgttggtttcgttcccgtcttcagcaaaacgaccttggaacctcaatgggggctgctttgctttgggaggttcttgttggtgggaccagagctttgacaaacctcctgctccttggtggcacctctcctggaaggacgtcacaactccaggtgctcagactgcctgtggcagcagaaccagtgcctttggcattttcctcccacaatggggaaggtgactttggcattcttacaaactcgtctctcggcctttctctcctgccttccacagcctctcgtttctcctccatctgtgcttattacttgaggactgtgtctgctccgtgagagctgcgtgggcagggctgcagtggggtccaggtggtgttcagctgtgctgatgcctgccattgggtcctccttaggctctgtaagtcgtgacagccttcatcagtgcaatgtttgcagggtaattcttaaactttttagagggtggcaggtacatcagttctttttgatatgaaaacattcatgtttcagacattgaattgagagcttttaggggaagcataatggttattgtcactatcaacagtctaaaaagaaaaactgaggtctttttaatcttgattacagcactcacggcatgcaccctactcagtgtgggtgtcttcgtttgggggctttttttttttttgcacttctgaggctagatatgtctggctgaagatttgatgtggttcctccttaagctatgcgtcctgttaataataggtactgtactgggctctgtgtaagtgtcgttggggtaggacctatattttaatactgttcctaacatttcattttactagcgagaaatctttgatttcattttattctttgtaattctagacactagattgtagtttagccataactgatgttttttaaaaagggatatattttcttgcacagttgttcaaaaaagagacaagtttcagtcctcaatgctgtcctttgttttacaggtacaagttttctagctcagacaaactatgaaaaactgtagactattctcaaggtattaactcgcagaccctctgggggtaggggctgttttctaagttacaggcagagtgggactgagatggtacagtgtgcacagacaggtactgagctgacagactgggattttctgtactaaaatgttactttgtatcaaaagttaaacaggctttagtacaacaaataaaggtcaatttctgtaaggctgtgtttgaagatgtgagtttttaatctcttcctagtcagtcagctttcctgtatttctaaacttgagacagcttctcctctgcagcacgtagctggagttggctgatgtgtaggttctttctgtctcacatgacaatttgcagtccctgctacccgctgcatcagcctctctctcactccttcctgcccttccctgccacccatctgtccagtgtggcatgaactggtgactgcagccaggctgcccatctgtgtgagacccagattctgccctctggccctcacattcaattctgcaggcttgggaaaagcaaaagggagtgagctgagtgctctgggtagcattctcagt

SEQ ID NO: 61695 - DNA, 1123 bp, Homo sapiens
tcctcagagccttcactcgggaccacatggggttccaaggtggtgaatgtgaccaccaaaccctcctccagttttaaacaacagagctgctggtcaccaggttaggaagtgctgtgtaaaagactgtgtggatgtatgtggataatgatcagttttattattttatttatttttattgagatctagtcttgctctgttgcccaggctggagtacagtggtgcagtctcggctcactgcaacctccgcctcctgggttcaagtgattgttgtgcttcagcttcctgagtagctgggattacaggtgtgcgccagcacacccggctaatttttgtatttttagtagagaaggggtcttgccttattggccaggctggtctcaaactcttgacctcaagcgatccacctgcctcagcctcccaaagtgctgggattacagacgtgagccaccatgcccagcagtgatcacttctaaaaaacacacacacagggacagggcaagaggagaggagagactttacttactccctgagtttgcccacaggttgctcttcatggagcctgctgctgcagctggcactgtgcttgtgttctcctgagccttctgcctcctggtccctgtgcctgctctgcagtcactccttgttctgcatatgcgtacagatccctccaggccaagcctctcatggacccttcctcccaagcctgcagtcatcttgtgctctgccctccccatcatctccatactcatcctcttgccctgctctttctggagactctcatcccacttccctcctgggcctgcccaagtggtcttttcaccctgtcatccagccacagtgtctactgaagcccgccgctcctggaattgccaggcagctcttgcgtgctctcttgctgttcatgtgttgctctgttgtgactctagttaaagtgtgtgctttttaatggcaggaactctgtgttctattctttattatgtttctgagattccagcacagtgacttataccagggagacgccaggaagatcttgctgggttttagactgtgtctccctgcaaggactttattcatttggtgcaaggggaggtttactgcatgtatcaactaggatattggtttg

SEQ ID NO: 61696 - DNA, 1125 bp, Homo sapiens
ctcacacgtttaatcccagcactttgggaggctgaggtgggtggatcacctgaggtcaggagttcaagaccagcctggccaacatggtgaaaccctgtctctattaaaaatacaaaaattagccaggtgtggtggcatgcacctgtaatcccagctacttgggaggctgaggcaggagaatcccttgaacccaggaggcggaggtgcagtgagccaagatcacgccaccgtactccagcctgggtgacagagcaagatcctgtctcaaaaaataattaaaaagaaaaggcatgttttagctgggtgcattgctggcctcagtaagaggttcagttactgaggaagaatggagggatagctattgggtaggcaagaagcaatctctgctgagtgccttgcttgccatttgtttttaggttcttacaggctgcttggtagtgaccaagagctgtcggtttctgcagaacttcggcatttctggcctcagtcctgtgttcatgaacaagtcttgtataatccttatggagcaagatgctagtccagggctggagttgagtgataggagatgtcagacatcccctggtagacagcccttgtggaaaggatgcatttgtcctttaaagcaagaggcccttaggaacgtggctcccagggccctggtgtgtgtctactgtctactgtcctagaatgtgccctccctggcaatcaggtgtgggggtggcagtgagcagcagagtgtagggcagctggctgcctccctccctctcttcgctttttacaatgaagaccttaggcctagggagttcagtggatcacactgtagttcatggcccactgtcactatcagctgggacaagggttggcaaactattggccatggaccgagtctggactactgcctatttttaaatggtctgtgagctgagcatgggtttttacacttcttaaaatgtaagatgtaaaaaagtctattagccctttgctgataacaattgcttaattttgccgttttgccttcaaagcctaaaatatttactatcttgccccttatagaaaaagtttaggccaggcatggtggcgcatgcctgtaatcccagcactttgggaagccgaggtgggtggatc

SEQ ID NO: 61697 - DNA, 1001 bp, Homo sapiens
ctataccagagtctgtcacattggaacttacctgctgcaaggttttcctcccgggctggcatctcccctgaagccccctgtatctgtttccatcgctgtcccatctcactccctccatgtgttcagcagcttactttcagcttcccttccttgattgtaagtgccttgatggcaaggggcccctcttcacaagttagcagttgctggtctatagaagcttcttcgtagacatttgctgaatacattgctgtgctctggacagtgaggccaactttacctttccttaggaagtactaagttaggaaaatgagtgtgatccacatgggagggaggccatcctgatctttaaggcatgagattgatagccgggcctgggagcaggggcactgatttacggttttgactgcccccgctaactggctttggacctggggtcttgccttcatctccagtgcaccttagcatcctgtcccgaacgccgagccagtagaactagaggccacctctcagctccctgtggttctgagaccccaagaagcaggcagaaagcggttagggcattggccactgctttgtctttttgtgcctcctctttgtgcacagttgaggaactttgtttttttcctgaaaggattgcgggagatgccaacaagaagaccctggagccacgcgttgtcttcatcaaaaagtcccagctggagcttggggtgcacttgtgtggtgggaacctgcatggggtgtttgtggccgaggtggaggatgacagtcctgccaagggtcctgacggcctcgtgccaggggacctcatcctggaggtgagttctgagctgctgagcaggccaggcctccatctacctgcacagtgggcttgctgccatctcaggtggcaccaaagacggaggagtacagcctctcatctggtgagccagtcagggctgacttttgttgttgttgttgaggcagagtcttgctctgtcgcccaggctggagtgcactggcac

SEQ ID NO: 61698 - DNA, 1496 bp, Homo sapiens
agacattatgcaggtaatttccttctttttgagacagagtctcattgtgtcgcccagactggagtgcagtggcgtgatcttagttcactgcaacctccacctccgggttcaagcgattctcctgcctcagcctcccaagtagctgggactacaggtgcatgccaccgtgcctggcttatttttgtaatttttgtatagatggggtttcaccatatcggtcaggctggtctcgaactcctgacctcgtgacccgcctgcctcagcctaccaaagcgctgggattacaggcatgagccactgtgcccggcccagataatttcagaaagtgttcaaagttaagaaaactttgactcttctttgagttcagagtgaccagagccatgagaaaacttatccattagggagaagcatatgtgttcatgtgtgtgtgcatctctgtctatctgtctcttttttaaggggcaggtggcccattcctgaccattgctttacctctggggatggttttcagtggcagctccaagtcctgccatctcactctctctctcactcctctgcaatccctgcctaggtattccctcagagctcctcgtggagtggccagaacatttttgaaaatatcaaagactctgataagatgctgagttttcgagcccatggcccggaggtccaggctcataacaaacggaacttgatacagcacaataactccacgcagacagacatcttctacacggacaggctggaagacaggaaggagccaggccccccaggaggcagcagctcctttctgcataagccattccctgggggacccttgcaggtctgcccccaggcctgtcccagtgcctctgagcgtagcctgagctccttccgctcagatgcctctggggaccgtggctttgggctggtggacgtgcgtggccggcggccactgctgccctttgagaccgaggtgggcccctgtggggttggggaggcctccctggacaaggcagactctgaaggctccaacagcggcgggacctggcccaaggccatgctcagctccacggcagtgcctgagaagctctctgtttataaaaagccaaagcaaagaaagtccatctttgaccctaacactttcaaacgcccccagacaccccccaaaatagactacctgcttccaggtcctgggcctgctcactctccccagccctccaagagggcggggcctctgacacccccaaaacctcccagaaggagcgactccattaagttccagcacaggctggagactagctccgagtcagaagccactctggtgggcagctccccatccactagtcccccgagcgccctgccccctgacgtggaccccggggagcccatgcacgcatcaccccctcgcaaggccagggtccgcattgcttccagctactaccctgaaggagatggggactcctcccacctgccggccaagaaatcctgtgatgaggacctcacctcccagaagg

SEQ ID NO: 61699 - DNA, 1033 bp, Homo sapiens
atgtggtagtgctggagcacaggcctgccaggcaggtggggggtgcttcatgcagaggagagccaccccctggctccccaagttggcattagaacagtgagtgtgtgcagagggtggtccttaaccccaggcacattgagggtgaaacagggcattgggaacctgacacttgttgccgggtgactgtgggggtgtctcttccctgcccaggtcctccacattccctctgtcatgcactggggctggcctaggtggtcttacccctagattcccaagtgttcctgtgcatctggggatgggataggtgccggcaggtatttggagtgaggtggccagaccatccgctgcagaccaggaacccccttccccatgcctcttgagatgaccttgtcctctgctccttccaccaggacactgtgtgacaacctgaggcgggagcgggaccgtgcggtgagcgagctggctgaggccctgcgcagcctggatgacacccgcaagcagaagaatgatgtcagccgcgagctgaaggagctcaagtaggctcgggtgggcacccgctggagtgggcatgcatctgggagcctggggcccctctcccttctgggcaaggcaatgctgagtgcattggccagggcctcatccttctgcgtcgagctggctgtttgtcccttcacttcactctgccttactctgtcagtgtgtagaatgggttcgaatgtcatctccatgtagggttaattagaaattcttaggccaaaaattcttagacacagggcaggcaccatgtgccaaggcactaggaagggaggaccctgttcccaagcagtccatctggggcaggcatgcatgtgttatccattcattcattcccctactcactcactcactcactcactcactcactcgcagagattttttaagtacctgctctgtatgggccagcctccattagaggcactggagaaatggcactgacaagcataccaagtccctttcctcatgggctcacagtgcgcaggaagagacacagacc

SEQ ID NO: 61700 - DNA, 1059 bp, Homo sapiens
aaccagaggttaggagttgcagggaggcggagtagctcccggtgagcacgaccctatcccaaggagctttcacttgtggagcaggccgagggtggccgtcatcgtggtggaagcaagcagtacggggcctgatctctctctctcggtcttctgacccgaggatcctaccatgttatgaaggctggggggagcagctgaaaggacctcgaggtctgtgacccaccctgtcgcactgggaattcgtggcccactctcacggcccttgctggcagcctgattcacacggccctgaatcatccctggattgtcacacaggcccggatccaggcccctcaaggttagccattcaggggactgcaaagaggccaaaccatggtatagactcctgattctgccgagcacttgtggaggtgggctctgcgggctaccacccagaaccgggctttgtgtcatttcaaggctgcctttggaatgagtttgtttctgagctgggaaggcgggaagccgctgcaggagagcgttggctcgtctccccgcggctgccaccttgtggggaactcaggcaatgacagcctcctttgttccccagcaaagcagactcatttggagccaatggggttctcacttggcttaggggatgtttagacagtaaaacatttgaggtaatttttttttttgagacagaatatttctctgtcgccaaggctggggtgcagtggcacagtcttggctcactgcaacctacgcctcctgggttcaagtaattctcctgcctcagcctccggagtagcagggattccaggtgcctgccaccacacccggctaatttttgtatttttagtagagacagggtttcaccatgttagccaggctggtctggaacttccaatcttgtgatctgctcacctcggcctcccaaagtgctgggattacaggcgtgagccactgcgcccggcctgaagtaatttttaattggcatttttgaggtattgctcaccaatcagggcaatccagtttagatgctggacctttccagatgtgggtagaaggcgttggttg

SEQ ID NO: 61701 - DNA, 1156 bp, Homo sapiens
gtagagagagggtttcaccatgttgtccaggatggtctcgatctcctgacctcatgatccacccaccttggcctcccaaagtgctgggattacaggtgtgagtcatcacacccagccaattcctgttattcttaatttgtttacttggtcaatcccccatgtgtagctgcctcccatgccctctgcagtcccccatcctgttcccatctcctcctgaccctttgtgggctcttccaccccatgccttctctctgtcaggcctggtctcctcatgccatgccaggacccactcctctttccatgccagctgtgatatcccctctggggcgacctgccctagtgtaggtccttgtcttgctctgctttgcctaatggctttaaggtttaattgtttagataaaaggagtattccatattccaatgaaactgtattccattgaaaaacttgcttctgttgaaaaagttgctgtttattttcctttctccgatattgattgaggttttatgtggagtaaccagggcaggctcagcaagagaccctaagatggatatacttggagctattagaagtattttttatgtgccctctgattaggggaattggtcgtgtgaggtcaggcccagtggctggggcaaaagttggtatttagcccataggtcttgactgagccttggtaatggaaagccggcagcaggaagactgtcccttctcgcacctgctgcatggcacagagaagctgtgacaacatgcttcccaccctttatagattcaggaggtgggggtggtgctcttggagcatttctctaaggatgaaatgagagagtagaaagtgccgtgctagctctggtcagtactgcccacaacccattccccctgcagggacccttccttgtgcatgtcagtggagcttcctggagcaaacagatttaaagactgtaggttttcagtttctaaagaggcaaaaatatttttaacctcaaaagaaatcctgtggaggaatcttgcgtgtgaagcaggtaaggatggcggtgctgtgtcaaaacaaagctcccaggaagctgcccgaggggatggccctctaagggtttgagccccttctctgccctggggtgcgtggtaacttcccccacctgagggcaggcggcctctcccggc

SEQ ID NO: 61702 - DNA, 1050 bp, Homo sapiens
actgcagcttcttcctgtagggtaggcccaaggggtgtttccctttggtctcccagcatccctctgagggtctttgcctgcccacctgctgatatctgtccaggccccagtatttggaggcactaggtctgtaccagaggggcctgtctcccttccctggagatacatgtgccctttttggtgtcaggtttgtaagtggtgatttggatgtttctggaattgggctgttagcaggttttggcttgcctctgagtgctacagacctacctgccattggctcctgtccgctgtatctacgggaagtgttgggacctgaggctggtgatgccctggggtggggcggggtgtgaggggctggctggggctcactgagcatgtaccgggtgtttcagcacactccacagccggctcctgagtgaccagactcggctgaaggatgacgtggacatgctgaggcgggagaatgggcagctgctgcgggagcgaaacctgctgcagcagtcatgggaggacatgaagcggctccacgaggaggaccagaaggagatcggtgacctccgtgcccagcagcagcaggtaggcccagcccctggagactggccatttctcccaagtagtcctcattccttttaatggagaatagtattgagaagtaaatgctgggccgggcacgttggctcacatctgtgatcccagcgctttggaagaccaaggtgagagattgcttgagatgagcctgggcaacatggcaagatcccatctctacaaaaaaaaaaaaaaaattagctggacatggtggcacacctgtagtcctagctactcaggaggttgaggcaggaggatcattggagcccaggaatctgaggttatagtgagctatgatcatgccactgcaccccagcttgggcgaaggagtgagacgctgtctctgataaaaaaaacacagccaaccaattgctggatgtgcttgtagcttgggttggcactgtttcccggccctcttagtggaaagaagtagggagtagctaagtgtacacatacacacaggca

SEQ ID NO: 61703 - DNA, 1068 bp, Homo sapiens
gctactccctacttctttccactaagagggccgggaaacagtgccaacccaagctacaagcacatccagcaattggttggctgtgttttttttatcagagacagcgtctcactccttcgcccaagctggggtgcagtggcatgatcatagctcactataacctcagattcctgggctccaatgatcctcctgcctcaacctcctgagtagctaggactacaggtgtgccaccatgtccagctaattttttttttttttttgtagagatgggatcttgccatgttgcccaggctcatctcaagcaatctctcaccttggtcttccaaagcgctgggatcacagatgtgagccaacgtgcccggcccagcatttacttctcaatactattctccattaaaaggaatgaggactacttgggagaaatggccagtctccaggggctgggcctacctgctgctgctgggcacggaggtcaccgatctccttctggtcctcctcgtggagccgcttcatgtcctcccatgactgctgcagcaggtttcgctcccgcagcagctgcccattctcccgcctcagcatgtccacgtcatccttcagccgagtctggtcactcaggagccggctgtggagtgtgctgaaacacccggtacatgctcagtgagccccagccagcccctcacaccccgccccaccccagggcatcaccagcctcaggtcccaacacttcccgtagatacagcggacaggagccaatggcaggtaggtctgtagcactcagaggcaagccaaaacctgctaacagcccaattccagaaacatccaaatcaccacttacaaacctgacaccaaaaagggcacatgtatctccagggaagggagacaggcccctctggtacagacctagtgcctccaaatactggggcctggacagatatcagcaggtgggcaggcaaagaccctcagagggatgctgggagaccaaagggaaacaccccttgggcctaccctacaggaagaagctgcagtagggcccctggacagagacccagaggcctgcctgagccctgc

SEQ ID NO: 61704 - DNA, 1065 bp, Homo sapiens
agaaacctgtgatgaaatgtctcttctctgtaggctcggcgtgacagctcgtgcctgtaatcccagcactttgggaggctgaggcaggtggatcacttgaagccaggggtttgagaccagcctgagcaacatggtgaaaccccgcctccacaaaaaaaaatacaaaaattagcctggtgtggtggcatgtgcctgtagtcccagctactcaggaggctaacgtgggaggatcacttgagcccaggaggtcgaggatgcagtgagccgagatcacaccactgcactccagcctgggcaacagagaggatcctgtctcaaaaataattactaaataaataaataaataaataaaagtaaaatattaaagaaaagaaatttctcctctctttagaacaatgactctcaatcttgggtacacattaaaataccaatgcccaggtcaattacattagcatatctgaggataaaacccaaacgtgaggattttttaaaaactccccagggtattccaatgtgcaaccaaggttaagaacactggccatgagcagtgatctcagagtggggttcccagacctgcagcacagtatcacctgggaacttgtcacaaatagacattctcaggcctagccccagccccagccctcctgagtcaggtgttctgaagggagggaaagagaggcaatgatctgtgcattaacaagctctgtggatgattctggtgcatgctcaagtttgaggaccctttttctagagcagaggtcagcaaactttttttgcaaaaggccacacagtaaatactttaggctttgcacactacatagtttctgttgcaaccactcgactccacctttgtagcaggaaagcagtcatagacactttgtaaccaatgagcatggctgtgttccaataaaacttcatttataaaacaggcagtgggcccgtgggccatagtgtgccaactctcatgtgctagcacatccacgtcttcactcatcctgccttcgggccaactgactgaggggcatatcctcatgaatacaagctcagggatcaggctctgcagct

SEQ ID NO: 61705 - DNA, 1057 bp, Homo sapiens
gaaaatgcagattcaactcttactcttcacactttcactaagcatttgccttgctcagggggcagggagagtagagcagccatagtggtgcaggctggagggtcccagtccattgagatgagactgcctgcagagctccctgcaaatggccagagggtcaggagctgcaggaggctggaatctttgggggctggcacactttgattccatttgctgtactccagggtcgtggatgtggattttggtttttttctctttgcacaagatagtgaatgaaatattttccctcgttactcaagatcaacttttctgagcattgcccacgtgtgaaagataatctacatccctttatgcatttgaaatccttctgtgatctcctcttccattttctgtggttgacttggggcaatttgaaggcattgtgtgtccagattttgcttggagtgttttagggggagctcctctttctgcatttaaacaaagagtagcatgggcctgttttctgagcgtaggcatctaagaatgggctcatgctctagctgagggcccatgtgagcacttgaatgtactgagatgacaggtgtggaatgggtcatgatgaaagcttgctatagggttttagggcgaagaatgcttgtgctgttttatctttatttgtggggggataggaggtgacagcctgagtgtatagtacccaaagtctcatttaaaagctcactcctgctctgggtgtgacaaaggtgagcgttggatacctcagtggatgtctgcaggtaagtgtgtgcagcgtcctttctgtaaaacattggaaagagtcccagcagtttcaggaatggacttctgaagtccgccatttccaaaatgcacaccgagtactgtgaaaatgagggtgaaccctcctggacggtgttactttatcggagaggaagcatgtttggaacatctgagggcccgtcttggattggaggatcatctgctttgggcagggctgcccagagcgcctctgatagccaaactctcagactttctgtttctcggggcctcaaaagaagtcgat

SEQ ID NO: 61706 - DNA, 1039 bp, Homo sapiens
aatctgcctctaagtttccccttttcctcatcaccaccttttgggcatgttgtattttttttcttcttgcaactcttggttcttccctgccttccacatttgttgtggctttgtgctgagtacagtggttcaggtatggtcagagcagctggggtagatggaactgacttcagtatatctcagtggatgctcttggctttgggatcttctgcacttttgggatgctcaccatctctggctcccacctacagtgcccctccctatcattgtgtccaccgtaccatgtctccacacatttccaaatacttcctaggatggttgtcaaccactggctcaattctcagattactcctgggataggttctagcctcctccttgtaacaccttttcttttcttgccctccaatgtcagagggtgcagtgcttagcataaagatacggaggcagatgaagtagcctgtgaccctgcctaaccccttcttgggtctggaacctgcattctgtccattctcccagcctagcaggtgacctgctggagctcagtaactcgacaccgccttgctaattgtctgctgaggtcacagtgagctcttgtcaccgcccatccagcaggaccacagtccccgactgggttgactggttcagccactgttctggacactcatgggaaacaagtggcctttgtcatgagctggtggacagagtgcgctgtcagcacgggtgagggctggatacccagagtttttggggaaggctgcacccagggcagccagctcagagctgggaggcccagaacagacctcattttctctgataatggggagcacagagttgcagagacttttttttttttttttccctagtgacttgtgtcaacagacttcattggttctgcttggcagaggcctgggaggttacctgtgggcttgtgaggcctgggagtttacctgtgggcttgtgaggcctgggaggttacctgtgggcttgtgaagcctgggaggttacctgtgggcttgtgaggcctgggaggttacctgtg

SEQ ID NO: 61707 - DNA, 1020 bp, Homo sapiens
taatcccagcactctgggagcctgagtcaggtggatcacctgaggtcgggagttcaaggccaacctggccaacatagtgaaaccccatgtctactgaaaaatataaaaattagctgggcatggtggtacgtgcctgtacttccagctgctcgggaggctgagataggagagtcgcttgaactggggaggtggatggtggagtgagccaagattgtgccactgcactccagcctgggcaacagagtgagactccatctcaggaaaaaaaaaaaaaaaaaaaaaagtggagcgcagcactgttgctgcccatcctgaacagtcgacctccttgggaggagcctcagccagtgggagaaggtgggattgatggcattttgtaggccagtgcatgacatttgtgttccagaagtccctgacgattcaagaaagtgaggcctcacagtggagacttatcaatgagcagttgtttccatttcacaccagtgatgcttacggtacaagtgcttttcctgccattcccttagcaggtacggttcagtcaggtttggtaagaatccatactggaacacaaccttgagctcgatcctgtttcacctcttagactggtgggaactagaaagctggatgctgcctatcagcagtgggtgtggggatgcaggaactcttgcctttgcagttgcagctgtcctggagcctctggcagggtaccagcaaagccctgacccagaagcccctcccatgggtgtcagttccccaggttctcatgcaggtcctaaggggaaggtccagggtgttcactgcagtgttgtttgtggtggtgaggtagagctggatgtccattcctgcagagcaaatgggtataatgggtgggtatgagtctgtagtcccttgcagcaattccaagtgactggtgagaagcacacgtggcaggcagcatgatgtatttaaatgcacagtgctcagtgaaaacataagaaatagagcatggatggtgcagtgctattatgtagattgctgata

SEQ ID NO: 61708 - DNA, 1019 bp, Homo sapiens
aagaccctgtctcaatcaatcaatcaatcaataaaacactttaattcttaaaaaaaatatatagtggccttttcagtattcatggtaacctctattctcattccaagtaacctttcttctcatctgaccagaacttcttttcctgtttatgttttttttttttttttttttttccttcagacagaatctcgctctgtcacacaggctgcactccagactagagtgcagtggtgcagtctcagctcactgcaacctctgacttccaggttcaagagattcttgtgtctcagcctccccagtagctgggattacaggcgtgtgccatcacacccaggtaatttttggtatttttagtagagacggcgttttatcatgttggtcgggctgatctcaaactctgacttcaggtgatccacctgccttggccccccaaagtgctgggattacagatgtgaaccacgacgcccggcctacatttcttaaggagcctatgattgttgaatgccatggctggaagggatcttagaaaccactttgcccaaactccttattttacaaatgagaaacaggtctcttcccaggctggggttccttccaagacttctttaccaggagcaggctgggtgggaagtctcagatccgtggctagtttttcctgacattctcctggctttgtgggcaccagcctttacagtgagggtgagcaagtgacacagcatcccagtttctggacttgagctacagcctttaattcctgatcaatgaaaaaaatcttttatcagcctctgcaattgatatttatcttttacagatgggcacactcggccagtagagtttggtagcctgctcagggccatcagctgctgagaggctaggcaagccctggagtccttgtcagttttttgataatgactacctttactcggtactgcaggccaccctgtgaccatttctgtggtctgagccttgcctacctctccacctctcttcgtcacagcattcgtccattcattcagcag

SEQ ID NO: 61709 - DNA, 1433 bp, Homo sapiens
ttcactgtgctatttgacaatccatggtaggaaaaatggaagagcattttgttaccctgagtaatatagcacaacagtggcagtagtagacagcaactagccttagaaccagaaaactgggaatctcctggtgtttctgagggttctgtgggagctccttgtatactatgccaagcaggtgtcagagctgtcctccctgagctgaatttgctgttatagtcctcatgcccagaatagagcctagtacaagataggtgttcgataattttttgttgaacgaatgaatagtcagctgtgtgtagagtgaatgatgtatccttgtccagatcatcttcaaatatacatgcagattcctaagtggtgacctcatggtggcagaggctgtgggagaggaggaaggcttgagcaagccccagatgtacacagggatatcaccgcccacggtatgtctgtgatggaagcaggtggtgtgacattgatgtctgaagttcccaaggttgcccatcaggtactggtggtgtggagctggctgccaggagccatgtggagcacccacgctgtctaagagtagaaagtcattccctttctacacatagaatttgaatgtcaacttgatgtcctcaaaagaatactgaggaacttttctttaaaaaaaaaaaaaaaaaaaaaaaaaaaagccctgaactggagatctgttcctaactgcaaaatcttgaccttggcagagccttttagcttcctggtgcttgttttttttttttcccccagttcaacagtcaaaacagaagaggttgagcattgacgggagacttgctcattcctgtggggttttgagcacttcccaggtggcatttggtccaaggaggttgggtgattgggttggactcgattttgggggcccttccagctctacatcaggattgctgttaatctgatttaatgttagtgttgagtggtttttgatactctggttttccatttcctgaaaaagtaagcagagtaggataaatattttgtttcagttttttttttgtttgtttgttttgagatggagccttgctctgtcgcccaggctggagtgcagtggtgcaatctcagcttactgcaccctctgcctcccaggttcaagtgattctcttgtctcagccttccgagtggctgggattacaggtgtgtgccatcacccccggctaatttttatatttttagtagagacgggattttgccatcttggccaggctggtctcgaattcctgacctcaggtgatccgcctacctcagcctcccagagtgctgtgattataggcatgagccaccactctcggccgttgtctcatttttttttgtcccacctcattccaaccacctgtatgttctgccccatgcgagggggctctatagtcgtttcctgaaaccctgggaagatgtgagcc

SEQ ID NO: 61710 - DNA, 2952 bp, Homo sapiens
cgtcgggccgccgcagcccgccgaaggcgcgggtgagtggcagacccttggcccccgcctctgggacgcgccctccgcttctccctcctgctggccgagggtacctcgccggggccgccgctccacctggcgatggcctcggtggactcgctcctctggcccagttggggaggcggcggtgcgcggatcccgaagtcccgccgcctcccccagtcccgccgttcgctgtgaacaatgccccccgctgaaggccttcactctcaggtgcctcgacgacagggtccccgggggccaccaggtccagtagcgggtagggggtacctcggaggatgtccatcagtcccttttctgaggctcctcaccgtccgctagctttggcaccctgtgctagcctttaaccaagggtaccgtccagaagaatgggacttgggccaggacccctactcttaagttttggtcgctgccatcctgtgccggggccacaactgctttttcattttctggctgtcccagctcctttttctctgctcagagcccagtctctcccagactggtggctgattgtgcacaacgcctgcctgggtttctttggaaactgggcccggaaaagttggggaagttgcattgcaccatgggaaaatcctagtagtggctgctggggctaagttctctccctgagagcacagagctgcttaacgaggaaggctggtgactggttcccttgagggtgccttttggaacccctgtgtctttggtcttggggatgactgatttgtaagtgtgtgtctgggtgcaggaacggatactggcgggagtttctgacaagtggtaggcttgtcctggcctggccgtggagtgtggaagccagcctttttagacaaggcagctggaggaagaagacatggcactgagggaggaggagaactagcatttattgggcatctactgttgtggcaggcgctctgctttatcacgttcagttgtcgttgccactatgtgagctttctgttattctttgccagagagaaaactctggcttggagtggttaaaatgctcagaaagtattgggcaccaggaattttgaattataacctattgtttgatttaacttgttcagagccaggaaacaaagtgccatctttctaggtcttgtccctgttttaacagtgaatcgataggtacagtaaaaataaataaggatatatgtataaaagaaaaacaagtgaaccgagagggctgagaaactgcccttagcaacctgaaggtcaaaggctgatgggacccatttatttggctgttaaaagccccacttattaagggaatgattttataaggcattcctggtaacagctctcttacgttggccatcttaacctcaatttttgtagctgcaggaaactgacagagagactaaattgctggccacacagcaggtcatttcattggtggccctcccgtctccactttgagcttctgacttgcatctctgtccctcaaacctgcattctttccccccagttgtggtcatgtcagagttactgggcaaacctagtcctttcctgggatagtgctttgggagatgctaggaagggactgtcagatgtggccatgaggataaggacagaggggatctcaacaaagtaatttttttctttttaattgtatctatgtatctatctaatctatctctgaatgaagaagttaagatctgtttctgaaagtctttcgtaaagcacagaacttagtacagactggaagtctgcgttgggaagcatgtgaatcaacgctcgccttaatctctgaaaattgattgatggatcaattgccattaattaggtctcaccctttccgtgtctggtggagaatgtggggcctcatggggctgaagttctaggagctagtcttgacctctaaggaaggcagagattagggtttggattttatcccctagggcattgatttcagaccccagttttaccacaatgcagagttatgtgactttggagagggtcatgaaatccttagaaaaatacttttcaaggagaagttaagttcattttacttaatgcattagaaaaacgctggttgggtgtggtggctcatgcctgtaatcccagcactttgggaggccgaggcgggcagatctcttaaggccaggagttcgagaccagcctggccaacatggtgaaaccccgtctctaataaaaatacaaaaattaactgggcgtggttgtgggcgcctgtagtcccagctacttgggaggctgaggcaggagaatcacttgaatctgggaagtggaggttacagtgagttgacatggtgcccttggattccagcctaggtgacagagcaagactccttctcaaaaaaaaagaaagaaaaaagttaggacagcatttggtatggcaagatgccacctgaagcccctggggaagagggtgacatggtgtgtcagcaaacagtggcgtgttgggggcttttgtttttttgagacagggtctcactgtgtcacccaggctggagtgcagtggcacaatctcggctcactgcagcctccgcctcctggtctcaagccatcctcctgcctcagccccgcaagtagctgggaccacaggcacatgccaccacaccagctaatttttgtatattgtgtagagatggcatttctccatgttgtctaggatggtctcgaactcctgagctcaagcgatctgcttgcctcagcctcccaaaagtgttgggattacaggcgtgagccactgccccggcgcaggggaggctcctttgtgaagggtaaattgctgtgttgtaggtctccacttttttgcttttttttcttttagccaggaagtattccttatggtcaaagctcagtgcataagagagcggctctggctgaaggaatggaagtcttcttccttgaggagccatagtcaggaaaacccagcac

SEQ ID NO: 61711 - DNA, 1042 bp, Homo sapiens
ctcctgggctgtgagcaagccctgcccttccctgaaagtgcagaatccccctgtctgcactccacagccaccctttttagatgggaaggaaagggatttgccaaagttcagttgatgtggagtggcgctgggactcacatcctaattttctgacacttaagccaatagtctttcttcgtgaaaatgtaccttgtgtttagaggctctctgatgttcattctggttggtttcaggggtgtctgagtgcatcatcatgggaatcccaatgaacattggaaccgggctcttcaagctgcttcacaaggctgacagggacccgaaccctcccaagaggcccctgatcttcgacacaaatgaattccacatcccccttgtcacatagtccaaagaaagaggggaccatgcctgaccttgactccttgtcctgtctccagctgatgtataaagagttttgtgctccctgggacgggggtcctgaggtccccacctatgccagcaatcagagaagccctcttggcatccccaggagcagcttctcctctgatagggtgcagctcacaccagtgaccctgactgtgccacgctgctcgggagagctgagggttttattgtttgcttgcttgaaacctaatctatagacggccccacagctcgtgcacacactgcttccctggacttaaagcccagccaggtgtcatggtccatcccagctcactgcatacatccatcggctccccatggtgtcttcacacctgacgatgagccaggcctgagccccacacaggccagggcacattcttggattttccattccttggtcatgctggaatctctcaatgtgacatacttatgtaaatattgttactattatttatttgttccatttgagggatttggaatttttgttattttagttttatttttgaaaccaagcatctatagaaaccaagaaagtcagcatgtaagcgtcactggaaaaactggtttaagcaaatagagccgtctgggatttgtaactgaggtgcaactgtcatgaggccca

SEQ ID NO: 61712 - DNA, 1034 bp, Homo sapiens
agattttctgcatccattacatgctgaccacaagcagccatgcagaattgagttgcactgctgccccctctctgacctttactttcccctgtctgtacctatttctggtctatgccaggctttttctctgtcacagacataccctttccgaccctaatagcatctatattctctgttgaaaggtgataaccagaagcctctccccagcagttttgctggacttttctttggcatgctgcaatctcatccatacctttgccttctagggcacagatggagccaggttctgcagtgggtgctctgtgtgcccagagcattggtgagccaggcacccagatgaccctgaagactttccactttgcaggtgtggcctccatgaacatcaccctgggcgtgccccggattaaagagatcatcaacgcttccaaggccatcaggtgcctgctttcatttccttcttgttccacacatgcctgtcctgtttcctgagaaacaatgatccccgtgtcacatgcatatgtgtgatatcctcataggactgtgtcttaaactctgggtggcatgcttgctgtgttaatcctattttggtttttaaaaaagccactcaagaaaaagtctaaactggatacagtcaaaatagaagcaatggttttgttatggccacaagtaacatgaagagagaaaatgtttaaaatgactggaaaaattggagcaatgtgtcagtggagatttcatccttttgatgtcattattccagcctaactaggcctgactgaaatgtctgccacttgccctgtggtcatattctgtgagcccctggtgatttcatgatgggatttctagttgatctaaggctagaagaaatagaaatgtattacaatgccttcgatgacaaaaataatgatttttacctatgacctatatttaacaaaatgataatacgtagcattgaatgaaagatagtcggctgggcgcaatggctcacgcctgtaatcccagcactttgggaggctgaggcgggcagatcacgaggt

SEQ ID NO: 61713 - DNA, 1071 bp, Homo sapiens
tttattttaaactgctctttcttttgctgtattgtggatcaaaaatccattgaatcagccttttctattcttccagggagctgttactttgataccctcttaaggttttttggttcgtttgttttttgttttttttttatggttctgacctgctcaggcagctccttcatgtttataatcatggttaggatcaaaagcaaagggatacagaaatcagtaaatggtttcctttgtgtactaaatagtaattcaaatgtagcacaagatcagcaggccaaagaagaatgtatctctttccgtagatcaaaaataaaaacagcgagtgaagcttaaataagaatatttgtgttaaggaagctcctcgcttcttgtgttcatgtgtcaaggtgtgaaaggtgaaaaagagactcttccagattttaaaatcaagagtgtggcaaggctgggtgcctttgtctgtttttctcctccaaaggctttcttattctttttttttaactaacaaattagagttgtaatttggtttttcttcacgctcatgtttacgtatttatctgtttgtcctcaaagaccttaactgagacaggttatgaaagctataacgaggtaacgtacttagcatgctgtgaacgccaacagaaagggcccactccagcagcaccccagcatttgccagcgccagagagagcaggtttctgtcccggttctggcaaacactgctttgctttggactggttcctttcttgcccttgaaaaggtttaacacaggtgacctcctacccggcagcatttgtttattcagtgagcactggtttagccctcaccatatgtcacacagtccacagatcctggggatgcaaggatgactaaacatgtccttgccaccggcagctcacaatccgatgagctcagatttgctgagagggtccaaaatccactggccagaacagatgtgtctgagcccgtgaaatgttctccagccctagcccgtatcagagctgaggtgacagaggcactcctgagtggcattgagcccaggtccctgccagaggagaatgcccgtgctcatag

SEQ ID NO: 61714 - DNA, 1073 bp, Homo sapiens
agtgagctgtgattatgccattgtacaccaacctcagcaacagagtgagatcctgtctccaacaaaaacaaaaaaaagataaactgtttgccttatacaccaattttagaaccttgtagaagatgtacatgttcatatagccagggcattttgctcctctaaggttctgaaacatttactgatcggaaatcgggcatcttgcctcagtattttcaaatttctttaaatgttagattgaacatttgtaatccacagagacaatgaggacaacccaccaaggatctccttttctcccactaggcactgatcctgaaggagctgtctgtgatccgtgaccacgctggcagtgcctgcctccgggagctggacaagagcaacagccccctcaccatggctctgtgcggctccaaaggtctgcatgcccctctctcacctgctggcagtgtgttctccgtacaggctgtttggctccagaaaatgtgatagtcacagctccaaacagacatttcatttatttaagggatctttttaaatcagagagagagacttaattatttgcattttgggaagtttaactgctttgaaggaacttgttggtaatgtgtctggattctgagtttgagggtgctttgagcaacgtggtctttaaaaaaaaatgaggccagatgcagtggctcatgcctgtaatcccagcactttgggaggctgaggccgaggccgattgattgcttgagcccaggagtttgagatcagcctgggcaatatgccaaaaccccatctctacaaaaaatacaaaaaaaaaaaaattagctgggcgtggtggcttgtgcctgtcgtcccagctaatcaggaggctgaggtgggaggatcacttgagcccagcaggtcaggcaggttgaagcagaagaaagccagggattttttaatgtacttaatgatgtggcataattcttctattttgtagataccgaggccctcaaagcatttggttttatgataatgcattcaaattcaaaacctctgtgcttctatttctgtacactttttttttaaacaggataaagtccagtctc

SEQ ID NO: 61715 - DNA, 1015 bp, Homo sapiens
tcatttggttgttgtataggctgtacatgatggtacctttgttaatatttaatatcttatatgagtaacaaattatttatagtttatagagcacttcactgtatgttatttcatctgatgctcaaaatatcccataacataaagatgacaagtgcttgatactgttacccacagttcacagatgaggagagtgagggtcaactggtatatttcagggttaggactacacactaactggagtttctatatttttcaaaaattcccaagttttcctttaaccccccctccctccccccaaaaaaaagctttgaggagaatttctgtttgttctgctttaagtgtcagtatgggaacatattttctcaactgtctcaaattcattttggaataaggcaaagtaataaataattgttgtctaaatatataatcattcttccagatgttacaatccagaacagtgagttgatgagtggcagcatggacaaaggaaccctagggtcaggatccaagaacaatattttttacattttgctgcgagactggggacagaatgaagctgcagatgccatgtcacggctcgccaggctggctcctgtctacctgtgtaagtatctcagcatccttcttttagttaaagctgcaattgttagagtcttaagggtttacgttattttgttcttttactgccatttcatccccaccacacatatacatacagaaaaagatactcattccaggctaaatcatgtgtgctgttattaattaaattaactcagtactgaatagtttcacaacagatttgaatttgcttttcagttctcttctcaaaaccagcagtagctccctacggtcttctagacagggttagattataaaccatccttgatgggctgcttccaaggtccctgtggaagcactagaacacttggggctatccatgattcagttctccaagattactcaatatttgcctactatgctttcactgttctattttgtttgtttgtttgtttgc

SEQ ID NO: 61716 - DNA, 1024 bp, Homo sapiens
ttataaacacatgggtttttatttagttggtttattttaatcaacttctgctgttaatctttttgatacttgaaaccatgacatccttggccagtgggagccttcacactggcgcctttgttgaaattcactgctttggttcaatctaataaagcttctcgaatgagtctttttttttttttctttttttgagatggagtctcgctctatcacccaggctggggtgcaatggcgcgatcttggctcactgcaacctccacctcctgggttcaagcgattctcctgcctcagcctcccaagttactgggattataggcatgtgttaccacacctggctaatttttgtatttttagtagagatggggtttcaccatgttggccagactgggaatgagtcctaaatgatatatatcacttgacagaacatactggaaatctactttcttaagccagtgcccagtattccaggaagccatttttaatgtttcaaaacagagaagcttttggataaatgcctaagtcctcttcctgttttgttttgttttgtgttccacaggccagggtcaagccccaccggaccttcagatttaatgagtgtgtctgtacaccctataatgctgactttgatggtgatgaaatgaaccttcatcttcctcaaacagaagaagctaaagcagaggcccttgttctgatgggggtatgtagggtggcacagcccagcttttgcataacagctccttgaaaggaggcaaaggaaacttacatgaaaacaccaccacaactaacaacgccaaagaagccaggctctttctgttcttaaaccgaccactaactgcctatatatctctctttttattggtttcttttgagcctttgaagaatctcttagaaattatagtatatacatgagagttagggtctgtaacagatgcgttgaggggattttctggcctataaatgtgggttctgggagaaaatgtatacatgagggccagttatgacaaggtaagaaaagaatatagca

SEQ ID NO: 61717 - DNA, 1687 bp, Homo sapiens
cagcctccagctaccaatattttatggaccttttttatgtcaattgctgtgtttgtctagtatctttttttccccccaatggcttgctgcttttccacatagggatataccgtgattttatttagccaataaactgtcaggctctttccaacttttcactgttaagaacagcttttattaccttcctattctgtcacacggataaaaaataacaaaaaacagcttttgtgaacattcttgtagctaaatctttgtgttcatttctgaagttacaccccttggaataatgagaagtggaatttttggcttgaaaaattggaataaaagacatacacaattttaaggctcttgcagcatagcgtatcatccatagaaatctctgttgtcacttatccttagtgacagataggttagaaaacatagtgaaggaaaaccttgcccaagctatggaaaactaacatagtatctccatttctgcctttcttcgtttccataggaaaacttgaatcccttagtagttctgaatttatttaaacgaatcccagctgaagatgttcctctacttctgatgaacccagaagccggaaagccgtctgatttgattctcacacgacttttggtgcctcctttgtgtatcagaccctccgttgtgagtgatttgaagtctggcaccaatgaagatgatctgacaatgaaactgacagaaatcattttcctaaacgatgttattaaaaaggtcagtgcctcccatttccttgtaagtttcatagtatatctatccaaaaacttctggtcaagaaaatgtgagaaaaatcaaactgaccaggtttgtttctgtttgggctgtgctggttttagcatcggatctcaggagccaagacccagatgatcatggaggactgggatttcctgcagctgcagtgtgccctctacattaacagtgagctctcgggcattcccctcaacatggcacccaagaagtggaccagaggcttcgtccaacgcctgaagggaaaacagggtaggtttcccacaagatgtgcagaagccagcccactctctttggttcctttttcaggagtgtctgtccagcttctctgattggaggtcacaggctttcctcagtctctccgttcttattgttcccatgagcacatggtatgccatggggacctatgacatgtttttggctatttaggtcgatttagaggaaatctctcaggaaagagagtggatttttctggcagaacagtcatctcgcccgaccccaacctccggattgatgaggtagctgtgccagttcatgtggccaaaattctaacttttcctgagaaggtaagtgaccactcagctgctcaattctttgttttaaattcagtcttttacgttatattttggtattgcaaacaacaggcagtagaaagtccccagtaacccactcaacccacagtttggtttatatgagtgtatgtgtcttcccagtttgctttatacatagttggtggtatatattctgtaaaccatttgcagccacagttgtttctagtttcatgtgtatttactcatatatatgctatacttttttgcaactttttttccaattaataacatcttgaccgagcatggtggctaatgcctgtaatcccaatacttagggaggccaaggcaggtggatcatccgagcccg

SEQ ID NO: 61718 - DNA, 1020 bp, Homo sapiens
ttctggagtgattggtcagggatgctggaatgaacttaggaactgtgagtggtgggggatacatctaggggactcttttatactaagtacataatattttcatctcacactacgttaaatcactcaagaattatttattttgtttatttaccttgagaagatggtagatacgtgttcttaaaaaaataacaatagtagtaattcaaacaatacagaatagcacaaagaaaaagataaaggtaacaaagtctgcctactggctgtgagtactgctaatctagtgaacacaggcttcctctctgcatatccatagtatagagccatttgcagatctgtgtatatggtcacgtggttaagggtacaaaacagggcgatggcatttttaaaagaaaataatttttcattctcacttatgcttttatctgtcttgcttaatttgaaaaagatgatctgcaaaacctgctgccacatcatgctgtcccaagaggagaagaagcagtttctggactatctaaagaggcccggcctgacctaccttcagaagcgaggactgaaaaagaaaatctctgacaagtgccggaagaaaaacatctgccatcactgtggcgcttttaatggtgagtggaatgcacagaaggctaagcaatagcccttttcactcactgtcttctgtttagtttattaggtttacataatgttcgggagtcagcttttctccttataaattaggcttaagagcccaacaactgatgtcctattgggaaacggacctctcatctttcattgctatagtagtttcagtaatttcattaaccatactacaatctctggccaatctgagaacataattttttatttcttggtaaataaactaacccttataggtaccgtaaagaagtgtggactgctgaaaataattcatgagaaatacaagaccaacaaaaaagtggtggatcccattgtatcaaatttccttcagtcttttgaaacagccattgaacataataaagaagtggagcc

SEQ ID NO: 61719 - DNA, 1380 bp, Homo sapiens
gattacatgtaggtagtgagtacaaggtttggggcacatttgtgcaagacatgataaacacagttcattgagtgacctttatatgagccacagcagtttttaccccagagaagtgattctcaacccggagtgatttttctcctaagggaacagttggctaagtctggagacatttttgattgtcacaactgggaaaggtgggaagtgcttccggcatctagtggttagagggctgggatttttatagttattctaaaacatacagtccccacaacatatccatatggaattatccatatggaaatatcagtagtgctgaggttgagaaaccctgccccagagatacacataacctagtgaagtaagttgtacagattcatgtgtaaaaccattgtgttttcctggtattttatgtattccttaggtgtatcctgtgagtttggccttgcccagtgggttttatttactttagttcgctacatgactaatggctacaaattggactgcaacattctaggtcttggaaaatcacagcaaggccaagaaaagttggagtagttttattaaccagagtgtttatgttttcagaacgacaccgtaactatccgcactagaaagttcatgaccaaccgactacttcagaggaaacaaatggtaaggaagggcacatcaatctttgcttaattgtcctttactctaaagatgtattttatcatactgaatgctaaacttgatatctccttttaggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagagtaggtgtcttttcatttgttgatcagctcctgaagacctattttttcaatagcgttgtgttgtgagtgtggtaaaaagggcaagaccaagcaatctgggatacaactctgaaaggattaagagaaaaagttatttcataaaatgcacaggtggagtacgggggttcaaaattgaagtctgacatttgagctgagttcagaagggcagctgaagtagtgttcttggagatgggctaggggtaaggattgttttccagaggagaagtaaggggatgtgtttggaaaggtagcctggcaccaaattcacttagtttggattaagtctgcatctgggcttaaacccataggtagtcaggaaccaggaaaagtttttgattgtatactgagtgtcaaacactgcagagtgaactacagcagtgatct

SEQ ID NO: 61720 - DNA, 1848 bp, Homo sapiens
ccccaggaacagcaagtgcaaaggtgggcagagtggagatgagtagatccggaatctccatgatgtgggggttgtaaatgcttgtctgtcataagggagtaatggggagttgaaatgggaagagatcccctcagccacttcggaggtgccttgttttggtagtgcaaaagaagaaaaaatagtgatctgtgagctcaagtctggacaagaacagccagtctcccaaactccctgttgagagaatgttgagtggaccatttgtttcctgtgaggctattccatacctaaaatcccttgatgatcctttctgttccagcaaaaacatgcattaaatgtacttgaaaagttttggtttagaaagctgtgtttcttaagctcagactgggtcagtttccctaccagagtggtgggtaatgattttaatgtttacaagtcacctggatgtactcttttctcattcagcatggcctgtatgagaagaaaaagacctcaagaaagcaacgaaaggaacgcaagaacagaatgaagaaagtcagggggactgcaaaggccaatgttggtgctggcaaaaaggtatagttcattaaggaaaatatagaaacgtcattaattgtaggtctttagtttctaggaaagaagggatcttattaatttttaaaataacttttcttaatgtttcttcttttccctcttcttctggattacagaaggtaacatgttttaagaaactatgtagcatagtgtcttaacacctcagtaaagtagcttggcccaccccttgtcagctcacagcacaatctggaggccacattggttcattgatcccagctggtgggcacctttcaagcctatcacaagaagttttaattttactaattggcatagaaccttcaatgcagagcggatcccattccctgtgattttacttattaatatggacactggtttaagaagcagttggatcaatgtggcccgtgttttcctggcacactggaaaggcaactgagatctcaggattgctttcctctccagttggccaagacaagtgattttagcgataagcagctttttaccagctttgctagctgtaaatagttggacattgtaaatcattgaatagaattaaggtgttgggttgttaaattaacaaataatcaagtgttctgtgaactttttttttttttttttttttttgcttttcctctctactttcttggatttcttgttcatcagaaatgaagtgtctagcaggtactgagattgtaagcacggtgtggggatgcatcaccttcactgagtttgctttgatgatgctttgcatgttggcctttggacgacagttttatagtatggtcgattataatgccagtgctatttaggctggtgcaaaagtaattgcagtggcaaaaaccacaattacttttgcaccaacctaatatgttttaagatagtatattatgagcaaaggagaaaacgtttaaaatcatgtttattttgtaaactccaaaatgcatgttacatgtgaagtgactcactggaggaaggtgagtactttaccaagtaggcacttgggaaatgctgtgtccacatacttaggaaatggcttcagttaacactgggcttgggaagggctctcttatccaaggagcagtcttctctggagccatgaaaccagcctggcagcactggtaataaactagtctgtgaaatctggcaaagcctctgtcctgtttggatatacgcaaaactgccttttaccatttccattgctttttattacttaatctcccaactttgtgcctggtgtctttttttttttttttaaaatagaaaatttttgaggtaatt

SEQ ID NO: 61721 - DNA, 2274 bp, Homo sapiens
tattttttgagacagggtctcttgtcacccaggctggagtacagtggcatgatcatgggttactgtacctcccgggcttgggtgattctcccacctcagcctcccttgtagctgcgactacaggcatgtgccaccgtgccctgccaattttttgtagagacaggatttagccgtgttgctcaggctgctcttgaactcccggacttgagcagtctgcttgtctaagccttccaaagtgctgggattacaggtgtgagccactgtgcccagcctgttacctcatttaaaacaaattttgcacatctgaacagcctaaaattgtaatgtgataagtggggtaggagtggggtgggcgtagtgggattttgaatcaatgaaggcccttgttcttgtggcatccttttgcagtgattccctgccaggcaaggcagtaaacctgggattgcctgcccaggactgtaatcacattgatgtcccagcgccatggagtatgtaatgaatgaactgccagcagaactactcactaagaactactccctgtttgtgaggattgtacctgttgagagaagttgcaaaaagaattagtcaaaagaattagtcaaaatttgtcctctgacctaggtctgaaggacatttaacacattgattgttctcttcatccagcctttgagccctatgagttagtgcccttagcctttgagtcccacaggtatggaggagctacctgtggggacctgagccatcactattcctgcttcaagttacactggtgcctctcactagcactgctctgaaaagccagctggaaaaatcaatgcatttgagtacataaattctttggctccaaagaaatgccatagcaatattgcttttaattcagttttgtttagatgttagaattggtatttgttcttgctttttggttgcgatggagttatatactaagttacttatactaaggcattagtagtctcatatctgaggagcaattgtatttttagttcagctaaattaatgcctctttttaaatactaacttgtactacttttgtggctgtgaatggtatcttttattgaactgaggcagcttttaaaagacttgcctgatcatttagagcactcccattgaggttaaattagacttgaatctgtaatgattctcgtaactgttcctggtgtgtgtccagcacaatgttgctgggcagagcagaggggcagaggctcaggtatgtacttcattgacaagtgggcaaggccatcctgggtaccacattggcttaatgatctcttcattgtgaagtccggctacctcgtttgcataagaactacagtaatcaggcaaggcattgtcagaattgggaggaataaaatcagtgagtctggaaggagtgctctgtatacaattgcaaagaacaaaatggtcatctttaaggtacctgattgcatgcacttaaatgcagattattttggagtttgaaaagggactattaatgaaatctttcttttccctcctttctctttttcccttccccgccactgattcagtgagctggagattggatcacaggtataattcaagcttttcatgtagtcatgtagatcactagactccttggtgtactgacgtagcaatttaaaagcagatcatgtgtagtacatctagaagtagatttacaaatattctgaagagttgtaaccttttaaaatactaacagtgacatggttttgtttttaaggtttagcaatatttagcccattatttttgttttattcttaacttgaatgtttgtaaattttatttcttgatgctttcattgtgttatgataacatcaaaataacttgatattctaggttactaataattgttgtgcatgagtgttactacttttggaattgaagactttaaagaattttaaaggcagttgttgactaaacttctttctcttgattcacagccgaaggagtaaaggtgctgcaatgatgttagctgtggccactgtggatttttcgcaagaacattaataaactaaaaacttcatgtgtctggttgtttgaaatgtatttgcagtttcctgggactgctaggaggttagtctgctgatttcagttgctgtccaagttcacatgctccatgaagcattcagtgaaaacttaatgtcatggggtggtgtttgtttgctgcttggtttatagcttaggtgggttcatctgggagtcaagcttgtaaatgctgtgttaagaaccatgtccgcggtggacgcagtgtagtggctc

SEQ ID NO: 61722 - DNA, 1036 bp, Homo sapiens
tcccacctcggcctcccaaagtgctgggattacagccgtgagccaccacatccagccagctaattgttttttatttttgtagagaggtgatctccctttgttgctcaggctggtctcgaactcctgagctcaagtgatcctccctccttggcctctcaaagtgctgggattacaggtgtgaaccactatgcctggccagatgtgacttttgcttgaaatgtgctccagagccctgcctaagtcccgctcctctgagaagccttctgtcccaccaggtctggagggcaagtgccaagaaatgctctgagctgtttcttcctgaaagtggggcagcttgggctgtcagcatggtttctagcaccgttggggccatggaaagaaatctgtcttcctacagagtcactggctttttatccttccccttctgtccgtggacatgtaccctcttgggagagtattgatcagaggggacagcactgatcatgcctttgccggaggtctgtgcacacatccgcatgggcacctgttagcatgtgcttgctagagctacagatggcttcctgctgccccacaggtggggttctttaccttactttgccccttggtgggtggtgaccagtgggctccttcctggaatatttatgcatgcggaaaaaacatgaacttacaaagaaaaccaagtctattcaagtacacttagcaaaattaacatttgtgatgaagtaacaaatgtttccttattaatgcaataataactatcttgtggcaggtctaattactactataattcaaagtagggatggaggccctagtgacatttgaaatatctgtaacagctgtgatgttatatgaaaatatctgtgatttctactggccacaaagtctctggaagtgctcaaagtacagggatttattatctacattcatgatggaaaaatcttagaaaagaaccaaaaaaacacacaaaaaagaaaaaaaacaaaaatcttggaggtcagggctgggcgcggtggctcatgcctgtaatcccagcact

SEQ ID NO: 61723 - DNA, 1120 bp, Homo sapiens
tagtggctgccgcttggccctggttgtgggcagtgggcttagagagaagtggctttggggtgtgtctccagggcagagttgataggtcttgctgaaaggatgggtgtaggaggggagggcaagagggtatttgaggacaacgtacaggatcgtgaccttgagccactgggtggacggcgggagtagtgttcaccgggagaggagttggaggtttgggtggaaagacagagttatgctttggtctggctgtttctgaaatgccttatggacagccaaatggagctgccaatcaagtgattcatcttggggtccccagagaggtcatagctggagccacatcactttgagcatctgtccttggagtgaggctgatacctggtacttggcaggtgccttgtcctgcccacttgcctgagggtgccgctcacagcccctctctcatgttcactgtgtgccttctgggggttaggctgggtagggattaatgtacccattttatggctgggaagacagaggctaagggagggcagtgattggcccaagaccacacaggcagagcccggaccctactcctactccaggggtggattctctttccacctgcaggccacttctgcataactgggtgagtgagggaagcttcagtcttttctggatctctgcttcttcctctgtaaattcccttttttgttttcatgatgcatccaaggtcaaagtggctgaaagatgccagagccagggctattctggctgttctggtgaccagtgttggccaagggctgcagtcacccattggtgagtgcacaaaattgctcctctcctccactttgtaagggaagaagtgaaggatctgagtcgtgaggataagggaaggacctctgaaagtcatagctcacagccgtaagtgcttataatgctctgggcacggtgctaggtacagcaaagtgctacagaactggagagtgagtactggaatcatatccatttcatgaagaggaaacgaggcagtcttagtgaaatcactggctcagcttcacacagtgaggaccagagctggaattcagacccaggagtttggaatacaaagcccaccccttagccacatcactccacagtggtg

SEQ ID NO: 61724 - DNA, 1060 bp, Homo sapiens
tgatacattctagggtgggtgacctagcagggagcccagcctggcccagggggcctgaattacctctgagatgtgacgcctgagacctgaaggagaagttggagtgagccggggtgtttactctacataatcgcctacgagataggtagctgctatccctacttgacggatgaggaaaaagattctcagataaaacaatatagaagcggctttcctatggtcacccagtaggtagcagagctgggatctgaacccttccttgtctgacttcaaattccatcaggccctgacattctccagctttcatggtgttcctgcaatccaagtgccgcttatctctctacaggtgaggttaggggttgggaggatgtcctgagcagggagcaccaacttctctggctgcaggaggggagggagggggtggccggctgccctgggtgccctttctttcccttccatccagggctggaagaaagccatacttctgactccaggaagtgctttggtggagctggaccggcttctgagctgtctgtggcgtgaggctgggataagtgtttggtcacctgggatggggagccactggcctgaggtgacacagacaaaggggagccaggagaacctgtcctggctcactgtggagcaccccgaccctgctcccctgcagcaggctcagctataaggcattgccagcctagccccgcggtttcttttgctgggataaattcagtggaaggagctgtgtaaaggcacaggccctgccccacagagaatccttgtcacttacatgctccaagaggtctcagaactaggggacttcctcccctccctcctccttgtctggagctggcattaggccccacatcttccagacccaagaagggcatttactccaggagatggctgggcagaccctcagtaggtattccacgaaagtgttcatggcttaaacccaacacttgatttctccctgagccagtctctgtgaatgtcctcaccatcgtcctgtgtcactcctggcctcctgctaacaaccaaatctattgactctccagatccc

SEQ ID NO: 61725 - DNA, 1060 bp, Homo sapiens
gtctggctttcagggctgcggggctgctcggccggtgctggggcttcgaatgtgacgttcaggagctgcgacctttatttggcagtggcaggacggtatccagtgtctcgagtagctccacgttggtgggccagttccatcttccaggagatggcagccaggacctagaggtccatgacgtgggtgaggggctgcccgcagggtcagagcttggagctcactgccccctttcttgtctcccataggactcacggcagctgtgttctgatttcgtactactgctggggctgccacctcctcctccagacgctctcagcagacttgagtcctggtccttctgcagaggcctgagcaggtaagtgggatgggctggccctctggtgctgtgcacctgctgacgtggggcagacagggagtgcgggctgcccagagtgcatggtgctgtttcaggggcccagagggctggggaggggaaggggcttctttctcagtctttatttgttccttggccttttcctctcaaagaaagccacacagtggagggtggtgaatgtcctgacttgggacctggacatgggattttattctgctgccaactcccagtatcgccttgggtagccctttccttctagagggcctcagctttctactctagtccatggaaataacagtaatgatatcctctaacccgacaagcacttaactgtattctgggtactgtgcaaagtactatagagttattacttctttcagcatcacagcagccttatgagagcattgctgtaatcaccagcattgtacatgtgagaaaactgaacgtcactcactcaggaagtaacttgccccaggcggcacacctggctgagcctagggttcaagtccaggtctgtgtggctccagtgcgccagccactgcccgctggcctactctgcctctggccttgctcctagcttctttttgggggtggggatcagggcaattatgggtgtcttcagaagtgccagatcctgtcccaacttaagaaaaagggagaggggcttttaccaggtgacaggctcct

SEQ ID NO: 61726 - DNA, 1002 bp, Homo sapiens
acggcacccctcccttgctcagtgcatctgctacaccacagaccccaagtcctccactgggccaggcacttttctctatcttggagtcttcacatatgctgttccctctgcctggaatgctgtttgctgcatcttggtctgcctctccctggcttgttgctcaacttcacttctccagagaggccacctgggaccttgagtctctgctgtgtggctcctggactcattgtttgtttctggcaagcactgcttttacttttgtatcatttgattctttgctctcgtctgagtctccgcaagggtagggatcactatcacatcagcatgcttgctgaatgtttgttgaatgaatgagtgaatgcgaagtgcctttgtcattgcatctccctggattctcccggtgaccttgagacatactttgaccccactttgacacgtgaggaaattgaaccccagagagtctgagagcatatctgtaatcacataaccagtaactggcaggtgtggggagtcaggggcctgtttatgccagggcaccccatcatgtcccttcagagtccccctctgtcagatggggatgatatggtggcagtgggcagtggcctcatggtcagtgccgggcctctactgtgggtagacccgctgacctcccactttcattgcagcaggatggagctggagtgaggtggaggggccgcaagctgctgaccggcgtgtggaacactggtggtttgcagatcactgaggtaggtgtgccacggggctggcgggaggtggctgggtcggacgcaggtgagtcctcatgagggcaggtgctagccctagcacgctggacctttgactcgggcctcagccctgaggggcaggagcgggcacaagccacctttgctgggacctcatcatgcccccaatgggctgtccctctacctggcacccagggacctcttggcctggcctttctctagagcagctgctaggggtgggggctgcaggtctgcccgg

SEQ ID NO: 61727 - DNA, 1053 bp, Homo sapiens
gcctcaggggagcggtagacggtcccagaacagccgtgaggcaagatgtgcttgctgtttcccaaactggagctgaagaagggtgagaagcacttaatgggggaggcagatgtgagcaaaaagcttccaaaggctcagcaaccataaatttcctgctctccgttaaccagtcagctccctgggggctctagaaagttttctggggcccagctcacccagcagccagggtggacggacacctgtgggggtcacactgaggtccctgcctcttctctcctcctgcactggccacagcccagagctgagacatcagtcaagcagacctgatacccagggagcagggctgagagcgtgaccatgcgccacacgatgcacagcattatttctcgtggagtccgcacacagcctccgaatccttcttaatacggcccacaagcacattaacaactgggatgctagacatcaccttgttgctatgcccagaggaagctgagggtgcacaagctgggtgcctgtctgtggctttcagctgcccttcaacacagaactggccagggactgtgctggggacatggttcatagcctgccctgagctttcaaggagtatacagtctagtggggaaagagcagatggctggcttggaggaacagagacaaaaaaaggccatggggtgcctgtgtgcagatgaaggagggaatgggctggggaaagaaaggggggctgttggctcagtacactcaaactccgcagcccttgctggtgggaggaggtaggcccccgggggagctccgctttgggtagtggcaccagccctgtctgcagtggacggagacgagcacctgaaccttccatgactccctgccacactgcctgagcagaggcaaacaagaggtagatcataaatggagcatacagccaagtgcagctgaagggggcttgcaggtaacaaagaggaaaattggctccagagggtagagggctctggaggggctgttctgccgccagcctgactcctaagaaacaccccactttgggagaactctctaggccag

SEQ ID NO: 61728 - DNA, 1156 bp, Homo sapiens
agaatgtttagaagaaaaggggaggttctggggaggtgagcagaggggaggattccaggaacctctgtcttccttccaccatcagggacagaaagcgctggccagagtggctctccctgcccctgcctctccttccacccctctcccgatgtgcacacacagcattgtgagctgtgagcgtgagaataggccttggagactggcaggtgtgactcatggctctgccatgcacttactgcgtggccttgggcaggtcacttaacccctcaattccctctattgagggataattgtgcctgccccacctggcagctggagaactaattaaatgagataatgtgtgtggagcacttagcacagctcccagaggcgcccggataagtgccctgcaaatgcaatcacccgccccctctctgcctcctctcctccctctgatcctcactcacctctctctgccttcccacacctgatccatggactgtgtctttccaggccagacctttcaatctttctctctgggaagatgggctctatgtctaggagatgccaatggagccgtgtgagcgagtgtgaatggagggagagatgagtttagaaatcccagcctgctcttctgatccagttcccctgtgccagccgcacaagggccaaagtgtgctctgcatgaagcctggcctttgctgatccattgctgcccgtccccgagtctttactgcctcctcagggtcctcagctgctgtcagatgaaggcttgcttccaagcagttcctggatttttacctgctcagccataaagccctgcaaagtgatgaatctagggatgagtagctgcttgcacaagtgcaggcaggagagacggggaccagagcccatatttttgcagagccaacatttttgcacctctcctacccacctcactgcccaggcgagcaggacggtgaagccttggctgtggataattgtcgggagcatcccaggccaagccttggtctcccatcagaactttggaggctggacttctctgttgccagggaaaccggtgtgttcccaggaaaggaaaccacagcactttagctgttaagacgcccccctccccccgaaatgagttccctccaaaacggattcgccccaaaattgttgagtcggcagcatcctg

SEQ ID NO: 61729 - DNA, 1082 bp, Homo sapiens
aactgggagatgggactgtccaccttcgggctggccccacgtggggtcacgggcagtcttgtctggaggccggcggctggactgaactggcttctggacagaaagattcctggaatattaagggccgaaggtgctttcaggtcccctatctacccgctctgcctcaactggttttactctgaggagcctggggcccatcagtgttttgttcaaggccaaggggcactgggctgggtccaggtcccaggggggctttgctcccaggcagggctgcagctcacaggaaccgaggggtgagtgtctgggcttgcaacacctgtgagacccaagggtgggtagatggatggcaggagggacatcgcagaccacagggacagcgctgtgtcctgtgtttcttaataaaagaacaaatggctagcggattatggaggcacctacaggtgaggtgacatttttaaactgttgaggtcaatgatggagaactgcggttactaaccccaggaatggaggagatggaggctccagtctctggagtaaaagggtcaaaggcctagagagcaaagggtctcaggcataaagagaggaagggtgcgctgagggaggcatgcaagagacagcttgttgaggggcaggctgggatcttccatttgttctacacctgctatgttcaggcaccaggccaggccctatgcagtgctaattttcttcatccttaaaaggctcagagaggtgaagcaaattgcccaaggtgacacagccggaaagctgctgggctgagattcaaaccctctacctttccagctgttaatgtgctgttctttgcactccccatgactggcagtcagagcttcctggtagtccccacctccggctgtgactgggccccaggagatgaccttcttgttccacccaacctgcccaaatccagtcacttacatcactgggctccctgcacaccggccacctttgggaggtgacacgcacctggtggccagcagaggtcgcccttcgccacaagagcgccactcagctgggccgctgcctccgcctccgggctcctggactcctttaagcctttacaa

SEQ ID NO: 61730 - DNA, 1009 bp, Homo sapiens
cacacccagcgtccggggccactgtctccttgcggtccttagctcctgtgcacatccaggatccagcgctgtacatcagtagcttcctgtcatcccttgcccacctgggtgtcagcccactacactgacttgaaggacaggcggttcgtgacttgcatccacgctgggtgctgcgtaaatgtctgtcagatggccagcccggagcatgaggacatggcggccctggtcacccaggcaggaattgaaaggctcgaggtcttggcccagctctggctccccagcttgtctgtgtgatgtgaggggtgcctgcctttcttgaggtccctgcttgtaaggagcagcgtgggatttactgtgctgtccagtatagcagccacacatgtatttaaatgtacattagtaaaattaaatgaagttttcagttcctcagtcacagtagtcacatttcacgggctagtggctaccagattggacagtgcagtggtggaatgttcccatcatggtagaaagatctgttggcagtgctgtgcctgaagtggtcactctgtggcccgcgggcctaccctgttggcagctctggtgactgctcctctccctttccccccaatgcacgagggacctccctgcccaactacccggggctcttaaaatggggccacccggtgtccttcccaagccagtgtcagacagtaattatgaaacccacatctgtcatttaccaggtgactttgagtaagtcaccaaggttctctgagcctctgtttcctgatcagtgcagtagagctacttgtccctgcctggcagggttgcagtggggagtaaatgagatggggctaaaaggcgcttaggttggtatctggcccatagtaacgtctcagtagctggcagctttcatcactgtcaggtggattcatcccctcgcagcatgggcttagttccaaaactggctgggcattaggttcccctcaagttcctgagcccgagactgggttctctccacccagctcca

SEQ ID NO: 61731 - DNA, 1036 bp, Homo sapiens
ctaccttccaagtccgaggcttcagtgtccaccagggcactggcaaggtcctgtatccacttgcctggcagcgccctggggaatttgggatccagacgcaggaggctcacttagatccaggactttgtgagaggcccctgagcaaaggaaggatgactgtgaccccaaagatatccatctgctcagtgtccatcatgccctgtgtggatgcatgggcctgcacacatggccccacacacaggtacatgcacacacacacacacatgctgacacgcacactcacacacacactcatgcacacactcactcataggcaccccacccttggggttttcctctccgttcagaaaacttaattgtagcttaaatttttattttcagccaactttgtttttaatgttgagtagctatcacttgtttgtatatacttcagaaacaaagtccctgggagagaaggaggctgttttcttaagctgaatcctagaactccaattaggagtgattgttccacttctgaggttttccagccgcttcctagcaagccctgctgagcccctaattaggcagccaggggcgcccctgttcagggcccagcacatctcagggtggcctgtttgagggccagtcttagggaagttcagggccagaaccccaagtggacctgcagggtactggggatggtcctctctgttcagggagtggactgaggtcattgcccgccatcccagggccctggctgcctttggggacatcagtgcagggcacagaagcagagtcagggtgccctgggtttagggaagccccataagccgggctggacggcccttggcccaggcagggtcccatggggaggctgccgagtgctgctcttgctctaactggggatccacccacgatggggcctggcccgctggtctctattcactgctaagcaaactaaagctcacaaaagtaccacaggaattagagccagggccacccctcaggcaggtctgggtgaccaagtcctgccttgcagtcagcgtgatattccatg

SEQ ID NO: 61732 - DNA, 1100 bp, Homo sapiens
agaagaagaaaagaaaatagttaaatggaatttaaactcaactcctcagttgcactggccacacatgtgcagtagcacatgtggcccctgcctcctgtttcgggcagcacaaatcaacatttccaatactgcagaaattctgttggccagcagtgtactgtgttatcccatttcataggtgtgaagttgaggatggttggtgattgtcatgcgtagggtctcagttggatgaggcaaagtgggacataaacctgtgcccatcagtgcaacatagctttcagcaccaacattctaggctctccaagcccagcccagatagctcccctttcatgagccttccatgagtctgaaggccatggactgttttctctgcatcctgatgctgagcccaaggcctgccccagggcaggcactttggggtgagtatctggagtgggtgatggaaggaatgactgactgaacatggtctgctgaaactttggggcgaactcactcccctcctgatagaactaatgtggggagggcagagccagctgctgaggagtgatggatggcccctctcccaagataaatgtggcagtcaaggtaatcggattgtgtgtgacggtctaatttgtaggcgaggggaggaagcgcccagccatgcctcgccccagccgcccgtattagtttaatcaaatgcccagtatctaaatgactgggcccaagtgatggatgatgtgagctttgttaaatgttgttgccctgtcgagccaaacttcccaaggccctgcccggctcctggactgtttaatttgttttttcttgcttggttatctctgcgtggggcagggaagggggggctggagctctcctgtctgtcttaaagcctctggtttttcatggaggagaagagagaggaggccagacctaggggaggagtgggagggagtcaccttctgcctctcctgagaagccttcctgggtcgctgcacagtcttgaggagcccaactccccagaacccttcaacagggcttcatcgtgcaccgtgtggcttcttctgttccatgcagactcaccctcaccctgtgcttctcactccattaatggggtattttgg

SEQ ID NO: 61733 - DNA, 1044 bp, Homo sapiens
ggtttgggaagatttgtgggtgttttctttgtaataaacagtgatgccctaggctcaccacctccccaaggcttagtgtcagcaccgggcccccaggacagagcccatactctggattcatgagcccaggctgggtggaatgaagccacttgagaggtcctgggggttgtcactggcaggaaaaaccaagggcttggaattggacactaagggttgaggtcaaatcaaatcaagggagtacatgacaaggtctctcggtgctcaaacacatggtctcttgccgtctgtgaagtccggacagccatgatgtgtagaccccagggtctttttgaccctagggaaggcccagcctcactccaaccacttcttcttatgctgggtgggagaggacacagctaaactgcctacacccacctgggaagggtaaggaggggacctcctcagaaaagtaaattatgcagggaagaaattgattcacataacccctccttacccttccatctccctgagagccagcaacgggcagtgatgtttagccccgaggaaaaattacatgcggaatggaaagcaggcgctcagggtggctcctgctggaatgagagctggagtgcaggctccgtggttcctgggcatgcgggtgtggctcagttctcaccttgcagatggagtgggactgttgacccaggccagcctggggactgcctcctcacctccctgcgcaggctgaccttgtcaccttgcctcttgagcttgcctctctcctgcccagaggtccttggagcaaaatggaggtcgagaggcatttggcactcacgcctcaccacggacactggtgcattcttgggtacctcttggcctcaatctattgctgggggagggaggactgaggcccattgctggggccctgaatgcagggactgtaaccacccatccccttctcagggcacctctcccctctccagcacgcttgctttgctattagtgctacctaatttcctactgaggtggtctagagctcctccgccattgccctgccgccagcaa

SEQ ID NO: 61734 - DNA, 1021 bp, Homo sapiens
gtgctagcctcgcctgcttcaccgcagtacctccagaacacacaaggtgctcagcagccagttgttgaatgaacgttgggtgagtgatagaacaccttggtactgtaggttagaatggatcgaggtgagggagtctggtcacaaggatgcagtttggagaggtgaggggagctcagtgggttcactttagacgagttgggtggtgcgtgcttttacgttttacgctgagacatttgaggagtgcttggaagtctggattaaggctcagcattggcagttcgagtctgggatgattccctgctgctgtcccagccccagctgtggtcaccatgaggtgagctggaaggccccaaggtcctcggcaccagcccctggacaggctggagaggatgacaggggatggggcttggtgaggagcctgagagcccagtttctggggtgcctgtacccagctcagcacctgcttgataagaacctggtgccttgggtgatgggggagaggggatttgtttaggggtcagaagcagtgcatttgcaggtggttgtgcctctatttctcctcccccaaagaaggctgttacccatcagagatcttgctggaggagagggggcagtgggtactgccatagctgtactgtcagcttggctgacggggggtggtcccatgggcctctgtggccagctctgcaggccccctcctgaccctaaccccctttctgtggctgaacctctgctcccaacagcccctcctgcttcttggtttcttttttctttctttctttctttcctttttggaggggaatggagtcttgctgtgttgcccaggctggagggcagtgacgcgatctcagatcactgcagcctccacctcccgaggtcaagcaattctgctcagcctcccgagtagctgagattagaggcgctggctaccacacctggctaatttttgtatttttagtagagacagcatttcattatattggcaaggttagtctcgaactcctgacctcaagtgatctgc

SEQ ID NO: 61735 - DNA, 1037 bp, Homo sapiens
tggggagaagccacgctttgcctctgatcgaagtgtgagggagtgagcttccctgagggggatctggggtggtgggcagctgctaagcttgccctgactcaaggtctgtgtcaggccccctcactcctccagtttccacttggcaccatctctgccacccttcccatcatcctgactctccccctctttgcctccacggaccactacttcctgcacgcgggccattctgaccccctcttcatgacagaaacttttgtatcctccttcaagggtgtcagtcccatcttacagttgagaatactgaggcctcccaagagggctgagtaagtcttctggcgtcacacgaatctgggagcaaaaccagcatggatagcacccagtctggggagagttgggggggggtcttggtgtggcagagcatgatgaacaagcacccactgactgtcctgtccttcctgcagccttgttgtcctcctggtgcgaagagctcggccgcctgctgctgctccgacatcagaagagccgccagagcgatccccctgggaaactccccatgcagccccctctcagctccatgagctccatgaaacccactctgtcgcacaggtaagtgggtgggtgccatgggtgcaggtactgagcagacacccctctggtctcagatctccttggacatgtccctggggtgggggcctctgtgcaaccatgaggatgttgcattttctaaggtgcagttgtttttttacatcttcgtgggtgagccctgtttctccctctcaaacaggttgaaagcactgagtttgtcactttggtggaggctgtttttcttcaggttctaggcttctggcagaacgttagaaattctgagctcagcaccttccctctttcttgaccagggtattgggcaaacccagagaaaccaggggctgacagggatctcaggaaggccacggggttggtggttccagccaagatggggacagagccagcccaggccagccaccctggagccaagtaagactgggctgggtccacca

SEQ ID NO: 61736 - DNA, 1053 bp, Homo sapiens
aagggtattttcccaggcactggggcacagccaccaacaggacctctgggcaagagagacactcagatggggaagaagaaaccactgactcacaggatgtcatgtggccgtgagggtcacctgattttccagacagggaaggtggctggagggtggtgctctctcctcttctctaaattgtctgtcccgggagaagttgtcttgttccttcaccaacctggctctcccacctcctgcacaggtggcaggttgtcgatggcccagaactgaacactaggtgtgtgttctgctctgaggggagtacgaggacaatgccacccaagttcagccttggaatgcaggggcacagggggctcctttctggaattgcatcctgttgactgtgttcctctgtcacattggggtacacattggggagcacagccctaacccaggcaccaggagagacacaaaggtcgggggagttagaatcaggcccctcataatggtgtgagcaagaggctctgaaagtgtccctggagttcaggggcacatgtgctccaggaagaacggcctcaaggggaggtggcctatgatctggacaggcagaacaaaatgcccctggatgtcaggacgagaaggggcccaaagcattatctggttttgtgggtgggaaacagcaggagcaaatgaggagaggcgggccccatcccgttgttcaggtgacctggctatgtgacgttggcaacattgaacgtgtttcccctctcctttctctcccaccacagcccaactatggaaaccagcaatatggaccaaacagccagttccccacccagccaggccagtacccagcccccaaccccccgaggccactcacctcccccaactacccaggacagaggatgcccagccagccgagctccgggcagtacccgccccccacggtcaacatggggcagtattacaaggtgagtcccagcctcgccaccacccacggggccccttccctcctaaccacctcactcccctaactccaccgggatcactctgaccctgcgtgtgtttgcccca

SEQ ID NO: 61737 - DNA, 1078 bp, Homo sapiens
ggcacaccagtgagtcatggcttcttcgattctacacggccccgccccagcgactcatcccctcttcttccacccgcctccttgcatccttccatggctgcgtatagattttcctcccagcctccaggcgcccaggcagcagtaagaaaggctgtctgtgagctgcctaccccgccttgagtgtgcccctgggtatctcacctgctctcaactctctgccccttctgatgcccactccccaggcagcctgactgcgaagcccctgctcccggcccactggggggcccaggtggagctgccaagagagggagggagggccctcacctgggggtggtggcagagcgctcatatttggcttgatgtcaggcgggaagggtggtttgacgtcttggctgggggacaggtatggagggatgctgctcccaggggtcatggggggtgtggggttccctggaacaggtgagtgggggtaatttgccacaggaaccggcctgggaggctggagggaaagaaaagacacgcacgagttatgggattacggagacagaaggggccatggctatggacatacaccgcactcatcccaggggcctggagccatgcccctcgggaggagagcctcctccagggaaactcttctctctcgcagatctctgtcctgctcagaagacagccctgggaagggcctccccacccttcatctgggtctcaccactgagctcctgtgtcaggtgcctgtggagacccttacccatccctgtgataaatggggacacagaggctcagggttggggacttgctcagcacaacccttggaggacaggacagcgggaatgaagcccaggcctcctgtcacccgagcaggtgggcttcccacatcacgactcaaggccacaccctctatgcctaccccatcagggtccccaggtggagtcggggcctgcagaatctggggcccaggttccccaggaacccctctccctctccttgttttcaagactagccaggctgacactttaccctggggctcaccccacctggagccgtggattctcagtcctgagcatctctgtcccca

SEQ ID NO: 61738 - DNA, 1011 bp, Homo sapiens
gtgctcagaaccagaaatggccgtggcctgggaggacagctcccagcaggtctagagatggggttggctggcctcacagcaggtcttgtcaaatgagtgcctgttcatttgcccctctgtctctgtcctggggatccaggagttgacccctacagggaggacattccagggagatgggagctagagctgtggggtgtgatgggaatgattggtgtgcgggggtcttgggggcagtttgggtgtagagggagtatccagaatgggagaggagaactcaggctgggggaatcattggggtcagggatggggtcctgaggatctcggaggttgtggtgtgtttagaggtgtgtgacctggctcggggtcacggaggccatggacagccccctggcagagctgccctgagcaccctcgttccccacctaggtctgacctggagctgcagttcaagtgctaccaccacgaggaccggcagatgaacaccaactggcccgcctcggtgcaggtcagcgtgaacgccacgcccctcaccattgagcgcggcgacaacaagacctcccacaagcccctgcacctgaagcacgtgtgccagccgggccgcaacaccatccagatcaccgtcacggcctgctgctgcgtgagtgtggtgggccaggggcagcgttggcacaggcaggccctgtttcacggcatgagagtgcggaataccctgccccactctggtcctcagccttgtccctgcgtcaccacccccgtgcccacagccgccaaagatacagcgtccccttacctgtgcccagggcctgtgcaataaccttcaaaccgttgggccttcaaagccactgtgccctggcttcagacgtggcctcttcccctggacactcagcctccgtctgttctccacacatgcttccgattcacccctcctggcccctcctccctacccttcattcattggtgcagttctgtgttcctcaaagccatgtcctgcttgcctcattcaccagcagt

SEQ ID NO: 61739 - DNA, 2327 bp, Homo sapiens
ggaaagacaacgtctctcgggggccaggggtcatcggtttgacccctgacctataagccaagataccccataaacacactcagaaagcagagaaaaaggacaagagtctgtgtttgagagggggtctgccattcctgcttggggactggtggggaagagggccaggacatcttctgagccaggacgtccctgaggctccacctccaagctcagacagggcccaggcttggggaacagagagagcaggtgtacacccaaccaaagtgattgtgcccttggttggggggcgcgggcatataacctgtcagaagcaaacaggagcggcaacttctaactttgctccaagccactctctttttaaacagcaacaatttaaagctatgaagtcacctggagaaaaggaacgttgctcttggacagcaagcaaaccatttctctccgtctgttctgtttttctcctagtccctctcctgccacctctccaagacttccgtgggacacccacttccctctgtcctagttctctttgtccaatcagatggcaagggcagtgcgtggaaaggccggggaggtgcagaaaccagagcccagggcaatggtgtctgtccagcccctccctctgtccctgtgctccaagctgcccccggctgcagcccaggccatggacatgtgcaccagtatgtacctgcaggcatgggggggaggggggcgtgtttctgggcctgccccagacactgcccttggctgccagcctaccctgcctgcactcctccaccatcacaatctcacccaaactcctgctcactcaagcaaaagcagcctctggccttccctccaccgctttgctccatctggcttaccactctccagggcctcctggggagcctgtcctgtgttcactttgtttcaggctggtctgtgccccgtgagccacatggcctagggtgatgccaggttgtcccgtcactggggtcccatctgtaaattctttgcgcccttcccggctgctgcctggggccctttcctgctctcccgtccgctgtgggtggtccccagctctcctctgtgggttttaccggaaaggtggccccagctgttgacttccagtcactgtcccagacggcacaaggttttctgtaggaaagctgccattgccccggccccttttcttcctttgtcccgttgtcgaggttttttcaaatagcgtgttgttcagtatgcaaatcaattattttaagaatcgcttttgtaaatatctttgtgaatattttagtatcgtctttgataatattcaacattttcatgacctggttatagcctttgctggtgtttttaaaatacctggactcaatgacaaagaccgagtcttctttttttttaaacaaaaacaaaaaaagcaaccagggctatttgtacagttgaaggggtgaacagaatgggcggctgtgctgggagttggaagaccgggcagcccgctatttagagccatccctcagtcagctggcagggacaagccaacgccaggtagcatgtggccacccttgcccagtgtctgtggcctggcaagtggccacgccctgtgtcagaccatctgggaattaagctccagacagacttacagatgccttccttaggagttcttgcttcttgcgttgatactttgccccagaaaggcctgggattcattctggttcttatcagggtgtgtccacactctgctcacaggtggatccacggctttccagtgcggagagtcgagatgctccctgcagcccaggccccgggcacctcctgcaaccatctctgggctcagcacctgaggcgggtttcctgggtcccctctccagcaagcctccaccagcaagctcggcccagagcttcccttccggctggctctgaaccgtgcgtggtgcctacagcctgcagtctggagacaagctcttccggagtgctctgggagccaggccagggtgtgagggaggtgcagaggcatccggggcgggagcaagccccaggttgtgacaggtgcaggtagacaacgcccataaacagagatggtcctgaactctggagagatccttccctgatcctttcggacgactacttggagccataagtaacctcagcaaaaacgaggcctctgcaagccacttttccatgccaagcatccacccggcccacaggcatgtttctgccgccactccgcaagatggacagggagccagcaggcaggcgggaagggccaagtacaggcaatcacccccatcttcttggtttgaagctttatccatgtatcatgttccgtgtagccattttattttttaaga

SEQ ID NO: 61740 - DNA, 1035 bp, Homo sapiens
agttctccacgtctgtctctctcgctcatgtaatatactctgaccctgagtggaaaggggtttttgttctgtttttattttacctacatgtactatttagcttcagtgtactagtcctgccacctgtgtatttttagggtgctatggaaataatgaaaagaaacggggatttcagaagaaaattgtaaccaaattcatactttgtataatttttgatatcatgatcacaggtgattcacacgtacacacataaacacacccaccagtgcagcctgaagtaactcccacagaaaccatcatcgtctttgtacatcgtatgtacaatgcaatcatttcatactttaaactggtcaaaaaactaattgtgatttctagtcttgcaaagctgtatgtagttagatgatgtgacaacctctaatatttatctaataaatatgtattcagatgaaacctgtatattaggtgttcatgtggttattttgtatttaaagatcaaattatttgactattgctagacatttctatactctgttgtaacactgaggtatctcatttgcccatgttaatttttttctaaataaattgacaaaaacaaaggtttggcgaattagctattttgtggatgttaaggagtggtttgggtgtttttgcttttgttttaaaccacaccccccgccctgttaccctctgcacacacaaaaaagaaaggcaggtggtttgggtgttgaattggaagaacccctgtccatgggggtccctggaaccagtccctggtggggcaagtgcagtgtgtggccggatggttgggggagttggggtggctgaatagggccaggtggctgcagggtgctaggggcccctgtggcatgtgactcagagtgtgcaacagtgtcccatctttgatggtcccttgtggattatgctgggtttaagtagcaggaagctattcatattaagccacagagggtgctgttcagagcacacaggagtgtggcttcaatggagagtgagcattcactgcacccatggctccct

SEQ ID NO: 61741 - DNA, 1072 bp, Homo sapiens
tctcctccctcttgcgcctctagctcactaatcccgcctctcatctcacctttctctaaccctctcagactgcaggacctagggcagcagggaagcttatttggcctgagccttacctgcaaagggctcaaaggtagacttttgctattatattcaaattgcaacgtatagatgctcatattttggaattaattacgttttagcagtttttctttttttaaaaaaatctgctggtaccttaataaacatggaaccagcaaccttttgccaggtgtctgttctccgggtctctgggcctggaggcgggagtgtttcaaagcacttcacgctccgcggccccaccggctggctgcgctgcccgctgcggccggcaggggtagtccacggacaggcctggaggaggcgggacgggggcagggccgggaacctgggcaagccaataaaggctgcggcgcgcggctgcgcgggactcggccttctgggcgcgcgcgacgtcagtttgagttctgtgttctccccgcccgtgtcccgcccgacccgcgcccgcgatgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggaggtgagaccgctcgcagggccggcctgggcgcgggacacgggcccggggagagccctgggccccgggcggcgcggtgccgggcgcgctgggtgaccttgggcctccccatgccgagctctgggcctcagtttccccatttctgagaatgggcgtcagaatgatttcttccggcctccctcggagcactggagcgggggagacgggagggagggcacgtgtggaggagaaagctcaaggtcagatcgcagagagggagggctcagcacctctgggccggcccgggcacgagggaggggctccaggagccttctggggctgagcctagatcc

SEQ ID NO: 61742 - DNA, 1180 bp, Homo sapiens
cttatcttgttattacggttttattaattttgtagagggacagggagtgggcaaggggaagaagcagcttatttgactaaccagcccctctgtggtccaccagcgtcttggcttggtgggagggctctcaatcagcagggccccaggagggaagaagaagtggggcaaagcctggcctcgccgctcgggagctttgccatctgagccacgcctcctccaggccatgctccttgaacttggaaatgtcaaccggagcccttacaccagccctccagcatctaatagacttgaatctactctaaacgaatatttaatccaacctcactacattgtagctcagtccaacgactaaccctgaaatgggggtgttccagccttcagcgagatggccaagcggtcccctgggggctgtggcagcgggcttatccttctctgttgccaaccttgccgtccgacctcctccgcccccatgcggtgaccccgtccgtgtctgtgtctgtccatacgtgtgagtccagctaaaaagacaaaacagaacccgtgggcccagctcggaaggtgcgtggagaaggctccgacgtctccgaagtgcagcccttgggatggcattccgttgtgtgccttattcctggagaatctgtatacggctcgcctatagaaatatagcctcttcatgctgtattaaaaggacttttaaaagcaaaagaggctcacaggtttccttgttcacgcaagcatgtagggaggctggactctttcagaggcaggagacggggcaggcatcagagagacttggggctggcctcagctcccctgggtctgggtcatcttgtcattgccctgcctccatgccattgatttgcctcctcccagcctctctgcccccaactgtacactctccagggcaacggccctccccaggttggccccagactgggtgagattgtcggcagatgaggtcacgcgttcactcagcggggggactcccgggtgaccatatataggagtgaatctgcctcagagacggcagccctgggccgctcccacttggcacactcggccaagatcaggatatgggcccagacagggagcatcacacagtgagcaaacagatcagtccaggggagacggggcaggggcccctcttctgaccaaagcctgggctgtcatgaggtggggc

SEQ ID NO: 61743 - DNA, 1696 bp, Homo sapiens
agcataacactagagagcagagggcccatttcagctctgttgttctgggattcaggctggccggtgctgtgtcctggagctttatttggggagtttcacccagaatggtgggagaaacctcccaggtgccaggtaccccgcatcgtgacccttcacttggtgtcttaggaagtcaagctgagggatgctgagtcctcccctgctggcccctgcagccccagccctgcttttcatcccccacccctgcaaacatggaggagccccctccttctcacctcggtctcctagcccctgacatggagaaccctgagacaagccacagaacccctcttttctaaaatggagacaataatttcctacctcccaagggagcagagaggcctcgtggcacgtccgtggccagggagcccactgtcctggctggcggcgggatcgtgcgctcctctgtctcccggatgagaagccccgtttccatggtcttgacccttcctttctcccggctgtcagaactgggtctcttgattttgcccctacattatgcctctgtgggaaaaaaaaaaaatcagaccaagaaatgagcctgaaattcagtgtttaccatggctcaaggatgcccatctggtgtccagttgccttttgtattcaaatgaaaatgctttgtacaactgaggagttacagtgaagtgttaaccaggggtccagggagcgagttgaaaagatggagtgagtgtatttgcagccagggagctgcagggtggatttgaggggccataccctctgagcacttaaaaaaggtatttgctccaggccaggcagcaggctgtggacacccttgccaccactggggactgccactgaggactccccgagcacgttgttccccgtcttctccaaggtgttgaggtgagctggggttggccccggcccaggcttctgtcccaaggagaagctgccactgacagtcatcctaccgcactgctaaagagaatgttcgcagtggtgggcggcgtgcctgtgccaacccttccagggacccggccatgggggaccttggcccaaggatgcctggggcctgccagctgtgctgcaaaggtggggggcccacaccctaaaactaacccaggccccagaccactggaggccagggcttccctgcacgggctaaggggagttgggatatcaccccaaagtgaccttgccagtgagctgttcagcaggtagccactgccctgccatctgtgcagagccagccaccttgggggctggggttcccgctttgaggcccaccttccatactccccttgactcggctctggctgaactggggaactctcttgtggtcagcaaagcccctgccatgcaggccaggtgccattgagaattaagtgctcagagggccaggagcccaggggatgggaaagtgtgtggttttagtacgttcaaaagggacaatcgcttgcagttggtagatctagcgatctagttgggagataatggtgtttaccccatatgaagtattcaatagttctacttgtgaatttgtatttattttgagttatacttgacacagaattccttttttaaaaaaatatgtgtgtattttggaaaaaaaattcatagatgttaaaatttctgcatggttaccagtttttctcacaacactgaatttggtagcttttcccgaaaaaatcttcac

SEQ ID NO: 61744 - DNA, 2214 bp, Homo sapiens
ggtcccagctacttggaaggctaaggtgggaggattcactgcactccagcctatgtgagagtgaccctgtctctaaaaaagacagtcagccaggcgcagtggctgatgcctgtaatcccaatactttgggaggccaaagtgggtggatcacttgaggtcaggagctcaagaccagcctggccaacacagcgaaaccccgtctctactaaaactacaaaaattagatggatggtggtgtgtgcacctgtaatcccagctacttgggaggctgaggcaggagaatcactcgaacccaggagacagaggttgctgtgagccgagatagcatcactgcactccagcctaggcaacagaaatgagactctgtctgaaaaaataaaaataaataaaaaataaaaataagacagtcatcttatttacttctctatcacacagacacacacacacacacacacacacacacacacacacactaggaaaaagtcagtgaatgttattaacctctcacccagatcccaaaagggcaagttgaggttgtggaggagaaagatccttcccaacagcccttagctgataggcggcagagctggcatgcaaagctctgtctatctgactttggtgatatcatgtcatatggagacgttgcagaagacaccagacacagagttttccagaacagtcttcaaaacaagctggcagtgaccccttcagtctccatggaggttctgccctcagtcctgggcctgcaaaacctctgtcagccccagagatgaagactcagaaggcagatgccagtcagggtgggtgcagctggcaggtgccagtgaattcccaggggagagcgctgtgcctgtgaagacacgttcccctccatcaaacacaggagggtgctgccctggggacagaaagccagggactcagacgggctgggagggagtgctgcagtctggggtgggcactggtcacaagctggccctgagccccaatacagtgtagccagtggggccagctgcaggcggtaggcagtatgtccctgcagtgcagggcttggaaacagcatgtgtggctttccagccaccctacctaccacctcctcactgcaggccccagggatgtccctaacgtcttggagcctcagttgcctcatctgtggaaactcccttccccatatatctgtgacctgtttcctccctgtgccactcacagggaggtggtgacattaggtggcgacattaggtggcctgacttaggtggcagtactttgccacataatgtgtaagccatggggagtgagggttgtgtggggcctgctgagtctggcctttttggcctgtcctggaagactgggtccaggaagaggccctggccagtcaagggggtgggggctgcaaaccagctttgttttggtgtgctggaggggacacttcacgactgtactgatcagaccgtcctttgggagccaagcagagtctgtgtggctgggatctccaggatgaggtgacagggacccagattctaactcaaggtgggaagtcttcttacagtgcaggcagtaaactgagcggtgggctctgccagcaggcagctctccagccctgagggcacccaagccccagatggaggagctgttggaggtctccctgggacgtccaggaaagcagggaacgtgcccttcctaggtcctttcaccttgggatcttggcttaattttgatagccctccaccagctggtgtccccctcccaccgataagacaaacgacagacagcttctgcatgccgggctgtttgtattcattatctccattgagttgtctggtgagaacaagcccatgagaaagctgttatcagcatccctgttcacagatgggagcatggagaccagaggggacaggtggcctgcccaaggtcacacagctcttaggtagcagagccggcattcgagcccaggtctgacaggaagtccaactcctctcttccctggccaggatgaaagctggacagggaagccagtcacctgaaagcctcttgtgatgtggttgacgtgcctgtctttccctccaggccttggctttgtgactttaagcctgggagcacagggatgggttttatgacccctgggccaggggcagaagggtggtccctggatcagaaccctcccaccacagtctccccacctgccttctagaaccttctgactcttccattcccagacc

SEQ ID NO: 61745 - DNA, 1021 bp, Homo sapiens
tgtctgaaattctagcaggctatcaccaagtggtagtaatggcgcctgggacaaagaggcatgattactaaaggaagaaactatgtaccaattttatataccactttttgttctacattaataaataacaatggcattaatattcctgttttgtcttctgtgtgccaggcactgttctaaatgttttgcatttactcctcagctcatttaatcctcagaacagtcttatatggtagttactatccttatccttgtgaagtaacttgcccaagatcacagagctgggatctggatccagagcgtgtgcccttaaccattatgcaccacttcataaatgggcagttccccaaggaaagttactatggcaacatcatctcatagcccagcacttctttaacgtaatggcatatgaattctctggggctcttgttaaaatgcagttctgattctgcagatccaaggtggggctccagactctacatttctaacaagctggtggtgctgtcgctgttggtccggggaccacactttgaataaccactgtggagagcctgcatttaagcctctccaactcaaagcctgcgagggcctagtagagaacgtaaattcagctctagttggtgggagcagaggtgatgtggaggaagcacgtgcatgcaagctgatggggcagccactccttaacctcaaccagcaaggattctagaccagtgtggtcgtatttctgtgtgaaatctcccatttgcaaatattagggtaactcattcaacttttaagaacacttgcagcttgcacgtgaatgttcataatagcattattcataatagtcaaacattagaaacagccccagtgtctatcatctaataaatggggtaataaagcatggcatatccatacagtggaatattatttggcaacagaaaggattgaagtgctgacatatgctgtagcatgaacaaaccttgaaaacatgacactaagtgaagccagacacaaaaggacaaatgttgtatgtttctac

SEQ ID NO: 61746 - DNA, 1048 bp, Homo sapiens
gtttcctcatccgtcattagggttaagagtgctgattcaatgaggccgtggcagtgatcagagataatttcatgtggcatgcataggtcccatgcctgtcacttgggaggtctgtctggcctctgcctgagggcgtgaatccaagtgtgttttcacaggtgtgagtccgacttgggcttgagcccaggagtatgtggctaggggagttcgcgactggtgtgggtcacggttggggaaagggtcacagggctgacttctttggaaggccttggactgagagctccatgaagacagggcattcttcatctgtcttgtttccatatttctggaattttccacagagcctggtgcagagtgggtgctcagtgtaaattaggtgaacaaatgaatattgaggtggtggccagggtcggaggtaagaggtgcggctgtgttcctaggagcaggctttttctttaattttctctcaaccgtctcacggagaggccgcacattcagtggaaagtgtcgttttggagtcagcaaattgggtttaagttctggctccatggctgtgtggccttgagcaggttgcttggcctctctgtacctcagtttgctctcctgttaaatgaaagagctctggagagccaggtcagaaagcgtgtggcacattgtaggtgctcattgaatgctagtgtctccagctccaccagagcagccccctcacatggaagatagaaaaaccaaggctctggccgggcacagtggctcacgcctataatccccacactttgggaggccgaggcgggcgtatcacaaggtcaggagatcgaaaccatcctggctaacacagtgaaaccccgtctctactaaaaatacaaaaaattagccgggcgtggtggcgggcacctatagtcccagctacttgggaggccaaggcaggagaatggcatggaactgggaggtggagcttgcagtgagcggagatcacgccactgcactccagcctgggtgacagagcgagactccgtctcaaaaaaaagaaaaaagaaaaaaaaagaaaaac

SEQ ID NO: 61747 - DNA, 1069 bp, Homo sapiens
cctgctgggtcagagtctgcattttcacaagcttcccccatcacccatgggaaacactggtctaggaatttcttgcttctcagttccccattcccggaggctgcctcttgggccttctttccatagcctacaaggggttcttggcaggaaattcccatctcgttggagaaaatgctgtggcccagccagacccctgccctgctcaactgcctaggagatatgagtgcatcagaattaagctgaagttgggcagaggctctaacagcctctgtcactccaacaacctctgatgagaccatttgttgggagtgcagctgccaccagaatcaacaaggcctttcagacctgggagagggtgcagggaggagtgagggggtaccctcagcctgggctcagtagggctaggggtttcttctgaacaaagggcatttgtaccagatattctccaccttcacccaggaaggcaaaaggttgaaaccgcagttggaatattccaggttagaaataagaagcaacgtcccaactgatcaggagcaagccagccaaggacactgaagactccatccccttaaatgtgtggccagtgtgtgtgaggtcaagaggcagagctggaacggattcccagaggccctctgcccaccgtcctgccctgagaccattttgacttcaaggggccaagggactcacctaaggtcacatagcaaggagccctgggttctgattccctgtgcctggggcccctcttcattgcaggccttcctggaggctggggagtgaccttgatgaccttagcaacctcccttgaagcagcctggaggttttgagcatgtcaatgggaggacgggaggggctggctttgtgagcctagcaactcagtgtgtctcactgtgtcttagccttcatggtacccaagatcattaggaataccccaggggcagaagtcctctgagacagatgcggtgagtcagggacaggaaacctggacccaaggggtccaggtagaggaagcaagtagaggcttgggaggcctgacattgatgaagagcctggggaccagtgctgtgtatcc

SEQ ID NO: 61748 - DNA, 1074 bp, Homo sapiens
agctccctggaggccccatctcatcacattcacggggaaggaatgcaggctctgggccaggaatccagatgtgcaccccctcccctgaaccccacctctgcctcctcagcctgtgagggaagaggggaggggccctgccccacactctgtgctcccaggatagggctgggggaaggcttcaggcactgcagggcggagcatctctttcttggagtgagaagggagggtcgggcagatcgaggcccccacctgatccaatgcttcagtatgacagagtgggcctaccatgccagcccacctacaggatggtccctgacccactgatagacatggttttgggatcctgggaaaagagggtagtagtcattttaagtacagcatgagattatcagtgattttttttcctattagtttttcctattttccaactttttttataatgtggcattacttttattttacgtttgtaatggaaatggaatcctggaaactctggaaatgcatgtagtgttcccctccagatgttggaaactgacgtgtggttgggtggggctgggtcccttcaggaccagtgggaggccaaaatgtgctgtcattcattacattcccaaaccctgctcagaaacggccacaccatgcttcaggttcttgccgcttagagtacggccctggcagagatgcatcagtgcctccagggagctattacaattgcaggctctcagagcagcatcttagcaaggtccccaggtgatctgtgtgcccccatcccagactctgcatacatagtgggagctgacccactgacgactttcctgcagaccccacatctccagtgggtcctgtcctccccctcaatatacacagtaagcaggaggctattggctcccagcagagagtgagtaccctcagcccccctggggttctctggatagaatgaggggcaaacaggcaactgaggatctagttggtccttaagggcatgctcatggcctgtgcagtccatagcctgttgcactttgtccagctgagccccagcacaggggcccccagctcatgtgcacacagccatccaca

SEQ ID NO: 61749 - DNA, 1138 bp, Homo sapiens
cctccagagggtggggtgtcgagctgccaaggagagggcacccgcttagaggcctctggctgcccagggatgcctgtggggccgtccgtgggcaggggactgtggccgcaagatgggggagaggtttttcagggtgtaattagtgcactttctggcacccaccaaacttccccttcctcttgacaatttgctgccaaacagcctgattcctgtggacttgcttaaatcttatccaggggaaaaaaaataaaaataaaaaaaaaagaaagaaagaaaggaagaaaaagaaaaaaatattaagagggttgttatttgtgaaattgtgtttcccagccatgagggtgagtcacaccatttggggcttcaagtttcttgtttggatgaacttttctctgggaggctggggcggatttggagggggagggggccttctggtgtggggaaagtcttcgagtcaagataaggggagaccctggtggttgggaagtccaggtgctccaaggctgggtggggctgggctggttgtacctgaattgcctgggggagcttgaaaaatacagattgggctgcagtaggcgggggcgttgttgtttcacgggcatggagtttcagtttgagaagatgaaaaagttctggagctggacggtggcgatggctgcacaacagcatgaatgctcttaatgccactcaactgtacacttaaaaatcattgaaatggtcaattttgttgtgtatattttgccgcacacctaaaaatacagatttcgggccctcgattccaggtggctgctttggtaggtctgaggtggggcccagaaaactgtttgttataagcttcccaggtcattcaatacaggttggggcacactcatgtaatctgtaaaatgggatagtgactcatagagttgtgggcagaatcagctatctgaatacgtgtaaaatttccagtgctggggtcacagtaagagcttggtctgtgtcactgttatcctgtgatgtggtttttatcagaactctcccccatgccgtggaaggttgacccccattggctcccacagctccagggacgggggaccctctgcttctcaaggtggactgctccatcttggattcatctgagagctggagtgcccatcag

SEQ ID NO: 61750 - DNA, 1056 bp, Homo sapiens
gccctctcttctccctctgggctgccctctgcagcttctaccctcctgccctaactcctgctacccctcacctgctgtgcctacctactgtcctgcagggaaggaagaaaagagaagaagtccctcttgtcaggcttgctccggggagaactggagtcagccttggaaatctctgtctctgcaccccgtattctgcagcagaaccaccatgcccagggcctgcacccctcatgcagcgcagagacactggtccttcatcttgccagggccgaggggcctagcatatgatgtcacagggcctctgtgccaagtagagtggtccgcacctggcattttcctctgactccccttcctataggggaggtcaagccttggaggccatgtagaggctgaaatataacagggcaacacgtgctggctgcgttaccttgggcaaatcgctcagcctctctgagcctcagtttctagctctataaaatggggccaataatgcccatttgaatagtattcttgccaggtaagaggggactaagaaaggtaaaagatttagtcaaatatatgacacaccgcatgatcagagtaaaccacaggccgagcacggtgactcatgcctgtaatcccagcattttgggaggctgaggcaggcagatcccttgagcccaggagtttgagacctgcctgggcaacatggtgaaacctcatctctacaaataataaatacaaaaaatcagccagccgtggtgccatgtacctgttgtcttagctacttgagaggctgaggtgggagaatcacctgagcccaggaagtctaggctgcagtgagctgtgattgtgccactgcactccagcctgggtgacagagtaagaacagtaagaccctgtctcaaaaaaaaagtaaactataacgtcttcccaccttcctttccccaacagccaagcaaaaaccttggagaagttccagcactgggcaggagtgtgatgcatggtcccccagatgcggtgtgagggtcacatccttcctgctacctgctggggtcactgacctagggaggaaag

SEQ ID NO: 61751 - DNA, 1068 bp, Homo sapiens
gtagaggcggcggcggcggcggcggcggcgggctcggaggcagcggttgggctcgcggcgagcggacggggtcgagtcagtgccgtttgcgccagttggaatcgaagcctcttaaaatggcagatgatttggacttcgagacaggagatgcaggggcctcagccaccttcccaatgcagtgctcagcattacgtaagaatggctttgtggtgctcaaaggctggccatgtaagatcgtggagatgtctgcttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtaccagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccaaggtggcagtggtggcagcagtgatcctccgaacctgcagaggccccctcccccagcctggcctggctctggcctggtcctaggttggactcctcctacacaatttatttgacgttttattttggttttccccaccccctcaatctgtcagggagcccctgcccttcacctagctcccttggccaggagcgagcgaagccatggccttggtgaagctgccctcctcttctcccctcacactacagccctggtgggggagaagggggtgggtgctgcttgtggtttagtcttttttttttttttaaattcaatctggaatcagaaagcggtggattctggcaaatggtccttgtgccctccccactcatccttggtctggtcccctgttgcccatagccctttaccctgagcaccacccaacagactggggaccagccccctcgcctgcctgtgtctctccccaaacccctttagatg

SEQ ID NO: 61752 - DNA, 1032 bp, Homo sapiens
gagccctggagatgaagagccgatccgaagctgccatgtagaggaaagcatctaacaggccagaggccccatgatgatgtcgaatgcccatcgggcacccagctgagccctgcaggtgttaactcagtcttcgtcacagcagtctaggcatacactcaccattagcccatttgtaagctgaggaaacaagcctaaggagggtgaaagccttgccccagggcacataccggtcctgctggtttcagagcgggcttttcacctctgtttcttcctgtcctcttgtggactggtatctgtgtttaccatgacccagccccatgtccctccagcctcttatcctgcttctccctgccttttacagacttgtaatagcaaacagccaaaccccctcccgccagtgccttcgcattactgaaatctcagagctccctatggtcacctctgtcatgggctcagcatggtgtcccacaacagtctgtccttgtctgtcctcctgctccatgatggtgaacttgggagggcagagcctgcctgggctctcccagcctccttaataccccacagagggtcttgggagtgtttggggaactccaccttcctccctgggaagaggggaaggtttcccctcctctgccagtgggatagggggagactttcctcctggtgttttcatgtggtctgtggtgtcccgaggctcgaggctcgaggctttactgggcctccctttctgaccacctgggagctctcatctctgcctttccccgtgtggtgggggactggcagggggctaaagggcttggtgttgctttcaggtggtggtccctggggaggtgctgcctaccctcctccgcccagcatgccccccatcgggctggataacgtggccacctatgcggggcagttcaaccaggactatctctcgggaatggtgagtccagctctcctgctgaggcagccctggggccacacctgcgtggccagaggaatcaaagctgctggcctctggggctccagagttgtctatgtgtgtgt

SEQ ID NO: 61753 - DNA, 1089 bp, Homo sapiens
accttttgactactgtgaatgaggctgctatgaacatgggtatacaaatgtctgttggagtccctgctttcatttcctttaggtatataggttgagtatcccaaatctgaaatgttccaaagtccgaaactttgtgagctccaacatgacgctcaaaggaagtgctcattgaagcattttggattttggatttttggattttggatacacaatggtaagtatgatgccagtattccaaaatctgaagtcatctggtctgaagaccacaatgtctgaaacattgctgatcccacacattttgaatgagaggtactcggcctgtatgcccaggagtgagattgctggatcgtatggtagttctatgtttaattttttgaggaatctccatactgttttccatagtggctgcactattttaccacatggtttttttatctttacagttttatctcagggtcttttggatctcatggtgctaaaatgaaggtgttggcagggttgtgtctttgtctggtggccctagaggtgaatgcttccttgccctttccagctttagaggccatttgagttccgtggcacttggcccttttcctccatgggtggaatccctctcatgcttggactctgtccttcttattcttccttttcatccttaacccagcaacaaaggctctctgctttgaaggacgcttctcactggattgggcccacccggataatctaggctagtctccccatttcatggcgggtaaccctaatcacctcaggacagtcccttttgccacctaaagtaacgcattcacaggtaccggggatgtctttgagggacctaatcagagaagctgatggtagctgagtttcaggctctgaaaagccctccctctacccctccccttaccagcattttcctgaggccccgggaccctaagggttggctggacactcccctcactgtgtgggctgggctggtcccctggcgggagcctgacacctgagtttagtgtgtgcccaggatctgtgacccttttctccctctcgaaatgtcagagcctggcttctttggccactaggcgtgttggtcacagagtg

SEQ ID NO: 61754 - DNA, 1098 bp, Homo sapiens
tagttcctggcatgtgggtggggagttgaatgcttaacagcacctgtgtaggctttttgtttagtgcctgggaaaatatggtcagggttggtggagtgctgccctgaggctggctggctggcttcggtgacttaatggcacctgtgaccagcaagggcaggacattggggctctggagtgcacgcccagggcccccacccccttctcagtagagctggagatgttcatactcccactcacatcacttaaggtcctgccttgaggtgggggagagaggggaatgtcctagatgtgtcctccctgcccccagaattcctggggcctacgtaatagaggctaccgaaacaggtgccacccagagagtgaaagaaatgagtcagagtccaccggggttcctgccagtattcagtatgtgtcaagggcctcacagtgccagccctgtggcaggtggtggtgggggacaggaagagaggcctgtcctacagcctgtagcactgatgctctcatggggaggcctagaaaaaaagtgtctggctctggcacttgggtgtgtgacctttgcatgtcaagagtcagctcagccttcgttcccttgcttataaaatgaggatgataatacctatccaataggagcattgtggaggttaatgaggtaatatatagggatgtaatatatgtatctatcctaggagttagaaaaaggagagcttattagaacattagagaacatggaaaacattttaggacaagtgctgtgagagttccaagaagagtgagcattgtggataggagatcagggtgggcttcctgaaagagatatggtatggtttggctgtgtccccacccaaatctcgaattccctcgtgttgtagaagagacttggtgggaggtaactgaatggggcaggtctttcctgtgctattctcgtgatagtgaataagtctcacaagatctgatgcttttataaagggaaatttccctgcacaaactctcttctcttgtctgctgccatgtgagacgtgcctttcaccttcagccatgattgtgaggcctccccagccacgtggaactgtgagtccattaaacctctttcttttg

SEQ ID NO: 61755 - DNA, 1057 bp, Homo sapiens
cacttaaaaaagtttatcttggctgggcgcggtagctcacgcctgtaatcccagcactttaggaggccgaggcgggcagatcacgaggtcaggagatagagaccatcctggctaacacggtgaaatcccgcctctactaaaaatataaaaaattatccaggcgtggtagcgggcgcctatagtcccagctactcgggaggctgaggcaggagaatggcatgaacccgggaggcggagcttgcagtggagccgagatcgtgccactgcactccagcctggacgacagatcaagacttggtctcaaaaaaaaaaaaaaaaaaagtttatcttgaagatggaatcttcgtaaataaaatttgtttctcttataatcagaacgtggttgagggtggatggaggttgacagaaggcaatgataacagcaacaaacctaattgcatggtttctgtctttggtagaggaattctgactgttgacataccagatatacttgattttattctttgcatcttgcttattacttattatacttgcatgcattcctttcctgatttttgctgttgggttaagtttctcatcgtcatcttccccacgccacctgtattacgtttcaggtttggttgtgaatgaagagaggagccccgtctctctctctctctctctctcactcactctctcactctttcttgaaaaatcagggtcgaggttaagtgtgtgttccatgagattgtcttggcaccaggctccttatggactgttgtccctagcattctcaagggctgtggttttcaaacttgagcatgtataagaacaatctggaaggcttgttaaagcatagattcttggactgcaccctgaatcattctaatttaggaggtctgtgatgggacctgagcacgttaattgcttacaggctcccatattgtataatgccgccgggccacatgttgggtagcaccgtctaggtgcctcccttaactgcatggcccaagacagctcactttcacatccccatggcaggccctcctagctgctaggggtctggaaagcagtcctt

SEQ ID NO: 61756 - DNA, 1172 bp, Homo sapiens
taccattgcagtttatttgtaaggaactctccccagtgtttgagggaatgcgggagccatcccaggtgctgtgcgtgccttcgccccttccccaaccttgatccccagtttcaggaagggattcctggacttgtatctcccatgggtgcaggccaggcccttaagacttaggtaaaatggtctgttggtttaaaggagacacgcgaagtttgttacctagagactttggaggggaaaagttaagccagccagtgctagcccaagctggaaacagtcagcccggggcatttctgtctctgccctccaatccttgacctctctgtagagattcggcgtttgtggtagctctcccctctgttctctgcgctgggcatggagtggagctgtgaggccgagcccctgccctgccctgccctgccctgcccacgcaacagggactaggtttgcagggcagggcctggtatgctcacccttcactggctctcattgctttcctcattccttttatgcggcagtcaattgttggggattccaggggattaacagggcccctttcctcaaggcattctttgtgctgcaaggtgttccctgataagagaggccaggtgaggtgccagggcagtttgttgccctggcattgggtgcccactacttcaggctcctgcataccttgctatcttttctttgactattgtctgtgctttggtttttcatctgtaaaatgggggtaatagtaatccctgcctcacaggcttgtgagattcagtgcattcatttatttaataacaatacagagctcaggtacggaccagtcagaacaggtggtgactgctgcaccacacttgtgtatcccagatgggtgtcacccacattagccataaagtgtgtgaggcaggcctgggtcataaataatcaggtgtaagggtcaataaatagtagcagtggaaggttcagctaaagttgaaatgcacttctcctgaaccgtctttctggcttagctcatgctaagctcatgctctctgtcttactggaatgccctccctcccctgtctggcctagcattctccaccctcctgggagccatccgggtgcctgctcccagcaggagggacgggatatgctctgagctcactcagcccttctggcactgactcggttctcatctctcgcct

SEQ ID NO: 61757 - DNA, 1063 bp, Homo sapiens
gaaggtaattaaggaagcattcccattttactgatgcaaaacagttccttgtccaggtttatacagcttgcaagaattaaagttagatattattcttggtgtgggcctttcctatatccccgtcttttataagagcatgtcatttagttgagaccttctgcattacttctgaaggggtacaaaagacatttctgatgattttctcatctcgtgtcatttaaatggtgctcagaaagtttggataggactggaactctagggctcaagccccaggctctgtccctatctaagcaatagggcagctgtcctgccagttgggttcttgcttctttgtgaaatgttgagcagaagctccaagtctctctgctgtggcttgtgtggcaagaaccatcctgaggttctgtgcagagagccagcctcacctttgagctcagtggcctctggcacagggaaattacagctgggcagtgtcctttgccttctctggcactgctagtgcaggaggcagtgttagctgctacaggaatagcatggagcgggcctgcaggccagaggggctgagacaagccagtgttcccaccagacctagaacgttcaccagaaagcaggcctgcagtgacacagctgcagaagttcactattttgtgcctgtcctgcttcagatatcctgtctttataggggcacgagtgaatctgagccctgcaaaagagagaaagataatgctgctttgccgttttctagtgcgttaccgcattaaaaattgctcttcttatataatctttatgacaactctttaaagtgcccttgtttttaagaagacactgaggttcagagggataaaataactctcagagtcaaagagagaaaacccaggattattggcttttagcccagtgtcttctgtggtattgccttgccttcctatccacacccatataacttgatgaagccggagttctgagcccagacaggaggctgtgcaagtgagattagaatggcttgctctttgaggggtggggggccctacagcttgaggaaacaagaggacataatcagctactg

SEQ ID NO: 61758 - DNA, 1047 bp, Homo sapiens
tttttcttactctagaaaataaatgaaaaattaaatgtagttgcaaccatacaacagcatatttgtattggagatgagtagactgcatttaaaaggatttttgctcattctttaattctgacaccaaatgtgaaaaaaggattgagttcttaatgttgaagctttaccatgactcatgcagtttccctcattcatctagcacacagttcctgagagtcaagggtatctgcatctcagctcagctgcattctccccattgtcccccttcaaatctttccacctggtatttagcacctgttttatacccagccatgttctaggcactgagggttccaagaaatggaagacatagtttctaactattagaaacatttgggaatgtaagagacaacactcaacttagtggtaacatgcagactcagtacagaaaatgtcaccaaacagggaagataggatatgcacagagaagcagggctttacttcagggtggactagccagggagatctttttagaacggggatacctttccagagggtagggttgagctgaagagagaaggaaggttatggctagaggagcgtgtgtctgctgggcccttgtgttagtttggtctagtgcagggaaggggctgggagatgatgtaggagagaagcattgtgggcaggaggagaggatgtgtttgggtatggctgctcccaagctgtggttaggacagccataacaggagccttgcctctgctttccactggagaagacaaggagcctgggctgcagagggaacctgacaccctatgtggaggcccacagccagctgggacagatgtccctgaacccttgtgtcttctacaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaaggtgtgtgtgatgggaggcttttagacacagactgctggggattgtgctcagctgtg

SEQ ID NO: 61759 - DNA, 1049 bp, Homo sapiens
tgctgcctgtctctgccctgccgtgtcagtccttggatatcttgcatgttccatccgctacctggatgtggcctgtaggggcagccacctttcctagaagcaggagcaggtagcgatacccaggcaggcctggtcctccccacttttgtgggactcggggattgagcttgcaggcataggggtgtagaaagcagtggtagcgaggtgactgaaggtggactcccactggggatgggattgagtgtggggctagatccctggtctgtagaagggagtaggaaccctgttagttaaattttccccctcaggccacgttagtaggattttgaagagtcagccacactgtggctcttgattttgtgcctggtcacctgcttggtctctggtgatttccctcggggccagcagacactgttggaggtggtgaggcctcaggttcttctgcttcatggttaactcactctgcttaggcatatttccaccttttccagggcctccgtttttctgccagtggattgagaggtggtggtggtctccagcagtggtctcactcttggcaggctatcagagtacccagggagctgcgtagaatgaagttttgagagtctttggtctaggtgaatgccagcgtttcagtttgcttatcttccattatagtagtgtcctctgtaactgtgaatcagggaggttattcataatatctccacatccattttctcccttaattgcgtatgcttttgatttagacagggcaagtagccattttggtggagcgcaggccctggcaggggggcagtgtccagtgccgctctcaattaaacgtgaagatgtgaagatgaataacactgtccagcttgcagagtggacggtggtgaggcaagctttcaagttgcacctactttctagttgagtgacctacacaagtctttgattttttttttttttcttcctggaaaaaaaaagttgtctacttttctcatctgtaaagtgagaagaatcaagtctgccttttctgtctcacggggttgcagtgaagcattagtaccctg

SEQ ID NO: 61760 - DNA, 1154 bp, Homo sapiens
tggcatttgggagagctggagttgggctgtcctgcatgggtaaggtttggggagggactggaacaaggggctagtgaaccttctctgggtttttcctgcctgactatgcgttgacagtcccagctgttgggcctgtgctcctgtacactgcacggccttgagaggagttcggagccctaacatccaggagagaggccccacagcagtggaaggaaatgggcctctcccgaatctcttgtttgtaccccgaggtctgagtggtgatcctggggatgctatgggactctcagcagtaggagtgtgtctgtccccagtctgggtgcccaccagctgtgctgagggtcctctcctgtgtccctgggccaggcagacagggtctttttctggggcttgttaggggaggtcagccacagccccagaccaagtaatttacacaccctgagtgaggggtgggagcagtgggtccaggaagacttagggagctggtgaaagaaaaacttaattctgacacttgttaaactggtaaggtagactgtatcaggactattacgatagatgtaggaattatcgcaatggattttgcagtagaggggagagagtgggccaactccaaatacaacaaagaaaagtgggaacttatagccaaggagcggagtgtgggggctcctgaaaatttctaagagggtagggaaatttttactaaacttagctaactgaattcttgctgcaggcaggccagggtgatcaggttttacctgggagatagtacaggatgagaaatacgttcagatatccagggtgattagatattgaggttgggggattctggttaacaggagttttgctaaaactaggctcttagagagaatggagttaggaaccctaggtcaggaccagatgagtagagggctcagaggaataaagtttggtgagggacagaatctctgtcagtatcccgtggttggcagtgtcctgtccattcttcttgcactggcctgtccctcaggagacaggtgtgagtggtcctgagcttgggccagtgtaagagtaggggacaggtttctctccttgtaggtgtcccttcttgtaagtgtcactctctttttttccagaaaccttggtccttttcagcatctgctggccccttgtccctt

SEQ ID NO: 61761 - DNA, 1030 bp, Homo sapiens
ccctgtggtctgggcggtctttgagcttgaggtcattaggaggtgtttatttctgtccgccctggtggcctagggcgtaggaatggggtgggatgggatgggatggggtggggtggggtggaggagttattctacatagatagagttctgtttatgcagcactccctgccatacacatctctcactcaaatggtctggccagtcctggttctaatggtcattgtgtcattcccctcagcagcaggaaaggctggaatggtttttgtattgttccttagggggaaaaatcacttggaggaagtatatcagtgcttctgagtgcagagtatttattgacacgtcagttaaaggaagcttttaaacaacatatatgtatctctttagtgaggaataaatctacaagtgcatctcacagctccattttgcagcttccatttcctggaaggtacatggagtttagtggttagggaatggggttttgagctgggattttggagaaactgtttttagcctgtccttggaattgggccaggcctagaaatctgttgaaatagctttctttagttgctgaaactgggatgtgttcatagcactaggacctcgagctccactgatgactgagtggggagggctcagagaagggtccctgtggatgcccgggatgcctgggtttcagtcccgtctcctgcatcgcctacattgcctgaatcttagggtcttacagatttatcatgaagtgggcttggcagcagatggtctggtttcttttgtgcctttgtcagaatctgttcttgctcttcttaggaaaactttctatttcaggacttggggtggagtcgaaagcagggagccctgtgagttggtgagtctgtatccctgaggctgccactgcctgaccccctccttccccttgtttcgtttcccctccccattactctgccttgttctagggaaacaccagaagctgcctgcagacagctacgggtaaaattgtgtgtccagccacaaactttaggcattttaaatatta

SEQ ID NO: 61762 - DNA, 1002 bp, Homo sapiens
tgttctcagattctagtttctgcctctgtcaagatcccccttcgcccttctcaagtccctgtgcttgcctggaacacctctgggtaagagttctgagcagctgggcaaggagcaggagtggccggtgccaggcttgtcggccacctgcccactgctttggggagtgagttctgccgagtcttcccggcccagctgtgcccttgggtgggggccaggcacgtgcctgggttgctattagtctcccaggccccccacttgctttgtgcctcagtgctcagcccagtgctcccgttcctcacgcgagcactcagctgctgaaaagcctgtgtgctggcagctcagcctgcagccacccccgctgcaggagccacagccattttcctttgttctgccatctccgggctcttgaatctcaggctggcagtgggcagcaggcagccagcacacagcgctggtggggtggaaacccttgtgacatgaatctgcccactgagccaaaggcatggcagccccctggctgcacccctaattcctctggctgtacccctatctcccagccatgctgagagaagcacagagtatcccctcttactggatcagaaagatagtgacacctacagtgggaacagagagaggtctcacctgttttgggccactgaggtgcacactaaagagagagagagttagcctccgggtctttggcagaaaaagccactctcaggcacaaaggatgctcgttcttaatctcctggtctttgttgaaaacagaggcaggattggttaagaatattttttattttggtccttatggttgtgaggacctttctctaactgaggggaactgtaccctgcttcttcacatctgaatctctcccttctctcccccaccactttttggtgggcaaaatgagcattctcttttggggtacaatttcagctatgtgtggggttgcaggcggggtgaaggccactctcacccgctgtctgacttctctatctgag

SEQ ID NO: 61763 - DNA, 1057 bp, Homo sapiens
ctttctgggaaaaacacaatggatgtagaggctgggatttgaattcgggcttactgggtgaccttggtgggtcacttcctggggtgtagattcttactagaaaatggaagtgttgctcagaggaactttgggaacattttagctgtaacccttggagttctattaatctaactccaaaatggttctattaatctaactccactacctggaatctctcttgccaactcaggatcctttggaagaaaatgtcatcagatggaattaacaaagagcccctcttttcctgggcatttcttcctcaggttcttgaggggtggtgatgatcacctcaaaagatgcctgtagttttcaagtggaaaccgagccaccctgagcccaaacacacactcccagtgttcaggcgctgagtgtggcccctggagttcactgatgagtagtcttaccttggacctcgccttggcttttcttggaaatggcacattacttttgtttattagtgtagcccctctgttgtgaagtggaatccagggagagggaagtaaagcttttaattttacctcttgccaaagtgaggccaagctcttaaatgtaaaaacaaacttgttaaaagtaaaaatgaaaacaatatccccattcctcttctttgggggtggagactgtgtttaaattttgcctctattttgtcaacaggttctaggagacaaaatgttcttttcctggtgacctttcaggctgggtttctgccctttatgtgcctttcctggcccagcctccatcctctgggcccgcccacccaaaccagcactgcctaccaggcccccctgtgcctgttgcccgtctgacttcctcccattgtcttcggggccagcctgtgtcactgctctaggctgtgtttctgccggcacgaacacaggagggcggtggtcttggaagaggcaggtctctatcatttggttagagtagcttttacagctgagaaatgggaataaaaataatctgtgaggatccattgggatgcaacaaaatcccaaacaaatcccaaaattaaagcattcct

SEQ ID NO: 61764 - DNA, 1137 bp, Homo sapiens
tttgtctccacggcctcattctcggtgtcttacatgcagcagtgccctgaacatgtagaaacaagtctttaggtgtttgtctcccacagcaaaagtcttttcaccccatgggcttggcaggcgagcctgtgcactgatggattgctgggtggtttgcttcaaccttgctgatctagggaggccacagggcccagcccagtcctcctgaggtctggaggcacagcaccttggactccctgggttcttgttcacattgggaatactagtgtagactgggcccagactctccacgtttgtttgcaactagctgaggaagaggctctgatgtgctcttaccaggggcatataaaaggattctgtgtatagacatttcatgtagacttagattttcagaaacaggcctgtcatgatgatcagggtatgggtataggacacgtgcactatgcctgctttggcctagcatcctcccttgagtgggcagcttcaccttcaatggcagagggaagtaggttgggacatcaacttggaagtcaaggtgccaggcctccttttgcctagccatttgagaagtgggggtggggtgggtagcaggtgtggggtgagtggcaggtgtgggtgaccaggccctgcctcacctaggtgggcaggtgttgccctgaggctgctggtgcagttgaatgagctgcctgatgaatcattctgaaaatctctcatgggtgctgggcgtggtggctcatgcctgtgatcctagcactttgggagcccgaggcagtaggatggcttaagcaggagtttgagaccagcctgggcaacatagggagaccccatctccctatgtagctgggactgcaggtgtgcactgaggtaggaggatcacttgagcccaggaggtcaaggctgcagtgagctgtgacggtgccactgcactccagcctgggtcacagagtgaggccctgtctcaaaaacgtaaaagtgaaaatctccaatggggcccaaggcctgaatgttttgtttgctttttttttgttcctccaagaaggaccacaaactctatgtttcagttacttgaagccagttattttgtagtatctcccttaatttaagtttgtttgttgtttcctcatggttagctgcaag

SEQ ID NO: 61765 - DNA, 1050 bp, Homo sapiens
atgaattcttattttattcaatgagttaaaatccgttgttattattgtttattttgccgctcagattgttccagatttggccagtgggggctttttcaagctgctgtgaatgacagctcttcaaaacatgcatttccaagtctatcacagttctgttgaactagttgccatatgattctggaggcagctcctgagccgttctgctgtcctgtggagcatggcgtcagtcacagtaggcccatggtttttagtgtgcaccttgtgaagccttcctttcccccagccacctgaagataaaagtgtcctgctctgcctgcttccatgttgggtttctgggtcagagtttctttgaacaaagcctcctgtagcttaaaaaataataaaaatagtaagcttggaagtcactggactaggtgacctccattccaggcccagtgcttctcccactgaggactcccctgactcaaatccacccactctgctgctttcctgatgacagcactgaggtagacagaggcctcctctcaccaggttaatgaggaggcccctcggtgtcctgaaacttggcaggttttgggttgtgagtttttggtggtggaaattcacagtgtttcagtcactaagatcagggtttttacaggatgccaggcactgagaccctcagaccctttggagagcctggtggagctcagagctggggcccagcctctcctgcacctgcatgtggaggccatccagggctggcggtcaggggcttgatggccttggaagctgggggcccaccttccccacactgtgccagggcagtgtttgtcaccctgtgataaaggaggggatccagcccccctgacgttgtgcagctgtgtagtgacttcccacagtaaagagtcaaacttcttcactccagtgagcggttgctgccaccatgatgggttttttttttttttttaaattaaagtttttttttttcttttttgttggaaaccacaggttcacatgccacggtgtctgattttgcagtgtttctggtggcccctggatttggcgttt

SEQ ID NO: 61766 - DNA, 1119 bp, Homo sapiens
cagggacaggcattctgtggaggtgacttgtgggctgaaaacttgagtactaatgaagaggcagccaagcaggagtctggggaagaatgctccagatagacagaatggcagctgcaaagggcctgaggcaggaatgagctttgtgtgtgcaaaggacaaacagaaggccatgtggctggagctgagtaagtgggagaagggacacaggtggggacagaggcatgcaggattcaggtcacaaaggatcatacaggtctcaataaatagttggaattactttctactgctttaaataattattggaaggcttgtaagttgggtggtgtgatctgattttgtagtgactgcagagtgaggggatggatggtggtaccaggttctgagatgggatttggggtagaaggggtacatttaagttatctcatagccagcctcagggagatactatttcctttgtcgttgactgtcctggagatggaagtcttggccaaccaccatcagaggaagggctggaccagatgagagcatggaagatgggtgtgttgactgagaagaggagaggtctgaatattgagccctaggatgctagaggttgggtcgaggaagaaaacccactcccaagttggctgagagcgagtggcctgtggtaaagggaagaccaggagattgtgtattgtagaagcctttaaagtagaaaggcacagtcaaccatggtgcagggaggtgaagaaggatgaggacaggacattggtaatggcttagacaaagtggaggttgttgatgttgacgggaccactgtgagctctgggtaggggatctgggcgggtggatagaaacccagctggagtcggctgaggagccaatgagaagtaaagaagtgaaggggatgactcttgacagttcttccaaggatgcttgccttaaagaggagaagaaaaatttggacactggctggagatggtcaagggattaagggagatatagcatgtgtttattgccagtgggattggtccagggagaggcagacattgattctgtgcaggagggcctggggacatgatcatgcacagagtctttgaaaaccattaaacatagtttatgaatatctgtgtgggggta

SEQ ID NO: 61767 - DNA, 1054 bp, Homo sapiens
ttggttagtgggtacagaagatctcactttgatgtgcagaggaagggaagctgggagaggcgtacactggaggagtggcatctggctctttgtctttgttcatttataccccccactggttccacaaagcacttggacttttctaagtttgccgagtgaatcctctagagggatgattccgataatgtctgcaactccagggttggtttccaacacaagcattggctttaatctgcatgcagaggttggatgaagtccttgcctggatctgcttcagagatggattaaaagtgaagaactgagaccctttctaaatagactgtaggcctgtgttacacaggaaagtcctttgcttgcctttagtttaaaaaaattttttttaaatgacattctgccattggctttctcagtgacttgggtctgtttgagcctacccttgtaaaatgtgtgaattcacctctgcgcagcctgtttctgagtgagatgagagccatggacatctgtgctctgtgaccagcatggcttaaggcctattccttcaaagtcacagatgcctcctgtgagtagggcgaacatgtaatctgtggttcaacttttgacagtaagagaattttgagagagtcttgcgaattttgccagaacaacaggtgtaccccaggcctctcctgtgcaaacctgggcatgtggccaccctgcacaagaaagggaagacaagcccaaggtggaaagatcaactctcttcccttacctctgtgtagggcatctttgcaggtggggtcttattctcttcctctgacttttattatgctcctctttatagaggacttgccacctcccaggatagtctgctgttcctgggctcttctgactgatggaaaattgcccttatttgagctgaactctgctcctttgatatcagaccccaaggcctgatccctagatcttcagacaaatgatttcttcatttccatctcagtaatgcagtcaaaagggaaaagtctagtgttttaataatgtatatagtgtatttttgttttcactgctgggaagatgt

SEQ ID NO: 61768 - DNA, 1047 bp, Homo sapiens
tttcatatcctgtgagtagtatccttgcagtcttaagatacgcattttcacatcagcatctgctaatatagaacatctactaatatagaacattccaggttgcaacattatctttccaattgtatttttagaaattcccatattggacatttaggttgtttccaatttttttgctatcctagataaggatgcagtgattagtttatgtaatacgcattcttccctttagggaagggagggaaattatttgctgagatagattcccaggagagattaattgggtcacaaggtgtgtacattgttttgacctgcctgaacatacagtcaaaatcacatccccagaacgactgccccaattcataggaagttgactgtcttttggcactgtgtgtgtgtgtgtgtgtgtgtgtgtgtgtgtgtgtgtgtgtatgtacatgtgtgtatttcatcatttaggcttgccaaggcagagggcagggattgcttaatcagaaactccactagaacttaaggagtggcctgtggtgctgatgcctgcatggcctcagcccctgatttccccaacttaggcaagtgtgaggctgggaccaccagttgggattactgaggaagggatgttcaaggtgctctgagattattgcctggcacacaggactgttaaatgcttgcacgtactttcaagtcttaagtagtttggtgtgcttgtataactctgcctccttggctggtaaataatcagcatggcatagtctacaggagtgatttttcttgtttgtactttttttctttaatggaaatcctttttataatgatcacttctgttgatgtctgatttagatagaataacatttattcatttcaactgtacagttcagtgacagctgtacatgccacataatcaccatcatcacaatgaagatataaaacattcccatcaccccagaaactttccttgtgcccctacagtcatgcctgccccaccctaccccttccctgggtgatggttgttctgcctcctgttgctataaattaaactctttggtatct

SEQ ID NO: 61769 - DNA, 1079 bp, Homo sapiens
tgtctcctcccacctccaggctgacttcaagagtttctccttttattctggattatagcaattttatacatgctggtatagttgtctttgtgtttattctgtttggggttcattgggcctttgagatttgtgggtttatagttttcatcagatttggaatattttagccattatgttttcaaacgcacaccctttttctccccttccctgtcccatttccctaggacattgtttatctagggcacagaggctcggtttagttttttattttgttgagtgttttaccattctcctttagtttccatagctttgtcttcagctttactgatcttttcttccatactgtctcattggctgttaaacccatctagtgaagtcttcaattctaatattgtagtttctatttctagtcgttacatttaggtattttttatgtctccaatttctttccttatcttatttatattttcctttaaattcctgaacatatttgcaatacttgttttgaagttgttgggatttcatcttctttgtcattcttgtgtcttctatttactgaattttttctcttatagctcacttctttccttttcttgcctatctagtaacttttgattggatattagttatagtttttctactaagtattcttccctaacagtattaagtcttttgtgtctgacatctttcatttaatatcatatgtgagattcattcatgcagttatacgtagttgtagatcatttattcttgttgtgtaatattctattgtggggatatataatttgtgttatttacagttttaggctattaagacctgttacagtgatataaaaacataccagtgttggagacctgagtatagggtatcccaggctttgtgtggctgagcaggatgacatcccatctttcctctccaggtccagatggttttagtgtgatagtttacagctgagcttttcagactatggcttgcaggccaaacctggccttccgcctgtttttacacatacaattttattggaacacagccacacccattcatttatgtattatctatggctgctttcccattataa

SEQ ID NO: 61770 - DNA, 1042 bp, Homo sapiens
tgtcataaggaagccgagccctagcatcccttctggctcccagaccttccgaactcccactgacaagtggcttggttcaggctttcaacacaggacagataactgcagctcctcccttggcccactgggctctcaggccaggttgggtctggggtctgcaccctctggtcctttttggcttcaaattctattcaatcgtcagcatttcaagtggccacaagcatctctgttgtttcctgaatgccccaggcctggattcaggatttcttattctggagagtaccaggaccctggggtttccgtctggtgtaatttataatggcaaaactcagccagtgggaggtgcatgggtccttgctgcttattttgctgattgacagactgaggcccaggagagggatggcttcctcgagaccctgactctgtgagttagggacaaagctgagactcagtcctggcttcctccactctctgctgttttctttccatcatcctttcctacctcacttgaaaagcctccagaaggccgtatttccctaagctctgcttcactgttgtctccagaagcccagtaaaacaggtgcctctggaaagcacttggtcttaggacagaagctggtgctggaagtaattgggggtggggtacagaacaccagtgtcaagagaaggagactctgtcttcaggacagcagatgcttgtggcatatccttgaacgcccctcacatctctgctctgtctgccgtgcgggagggcatggccaccttgagactggctctgtgcctggagtaagcatgtcacgtaggatcttccttcaatctttacaaccttcctgtgacctaggaaagataatccctgttttgtagagaacataggctcagagaaggtcttggactcgcatgaggccctgtcactaggtagctacaaagcagagactggacccagggccggctttgttcaggggaagaggctctgtgaatgtcaggctgagtcagcgtgtggattgtgcaagacccggaggccagcagggcagagcctgagagc

SEQ ID NO: 61771 - DNA, 1018 bp, Homo sapiens
gaggaggctcagccctggccagtgaatggcctgggccactggatagctgcttatctgtgcctggagtctatctccagggctggagagctggggtgtgtggcagagatgctgggctgtttccccctgtcctcaccctgtggtggtgcctggtcctatgcagtctcatcctgtgttgggaacctctgaggggacctgggtcagccctcccaaggggtgatgtcttcgtatacaccagatagtgcactgaaatgagttcagggttgcagaaaggggaagaagcagcacagcctgatgtctgtgacccatagtctctccagggtggagtccgctctgagatcttttcctcttccttccctggggcatagggtcatctgaggttgaaggagtttgtccagatattcaggaaggtaggttcaggttatctgtcatctgcggggcctgaggggccatgtgggatgtgagctaggagcatgccctacctggcagtgtggactttgctctgtgaagcatgttcacagtgctggtttccaacctaacttccttctctctttcctctgccccgcttagttggctggagttgtcttccttggagtcgggctgtgggcatggagcgaaaaggtaggtgtaactgtcgcaggacactgagcttcaggcagccaaaaccagattcgttggacttcattttccctcctccaatctgttccctgacaacaagcatttcttgtgcagtgtcaaggtgtataattgtcaatctttacagacacagctcttgcgtactctgcccacatgatagtattggctgctggaggtatgggctgggctggttgggttttgagccctgtggatgtggagagctcagctcttgtatgcagctgtgcccagagcaggcttgggcaatccagcttcctgaccctgtctgtgcctctgggagcaagcgggcaggtccctgaatacaggcatgcttattgtggaagcccttatcctccaggatgagaaagagcaggcagcagggagcggg

SEQ ID NO: 61772 - DNA, 1059 bp, Homo sapiens
cccaggatgccaccctggagggtccaggtggaactgctggggtaggacagccattcattcctgtgataggggtctcctccttgtccagggaggagggctgcttcatagcaagtgattgacacattggcttggagctttctcacactttttcacgcatttgagtgttatcagcaatgcagtgacatgggtagggataaatagcccctttttacagatgaagcgaagttgtgcagagtcacccagctaactctaagtgtggggttctggggccccgatgtgggactctcaggtgcagagcccacgctctgctgaggatggtggttctgggtcaggtggggttatgtgtgtgggggtgcaggctggtggggtggtgacttctgctcccgtccccttcccctgcagttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctgtaagcacctccccagcgggcccccgatagagcatgcacctccctgtgctgcctggagctgagtctagcaggggcatcaggccttctctgtgggttgtctgcctgcagcttggcagacagcagggaggccgtggaacaagccactccacctctggtctgttccactttgccggcttgtggttgcctggtgggccagccctttcccattgggattgggcaggcaagtccagctgtacccgaggccacccaccccccacgtgcccggccctcctctttcggccccagatctttccaatcctgcccaatagccataccagctgcaatcctccttaggcgctgcataccgtaaggcacagcttcttccccccggctcatgactcaccatctgacgctattcctatccccttcctccccgggaccttttccccttcctccctgggaccttttccccttcctgtttaagaagccagggctgcctggaggaag

SEQ ID NO: 61773 - DNA, 1020 bp, Homo sapiens
gcgaggctctgtcctccaggacttcctttaggctgtagggagtgtgctcttagatgcaaagagaaggaagaccccaccccactccagtccttgttctagtggtctttggtgatatgaatgactgctgttctaaaagggaggagtctcgaggaatcttcagagaccccacctgttagccgtggatatgagggatgtgtccctacagcttggggaactgtcctcctttagggacctgcatttcacagggagaaagtgctgtaaactgaatgtgtgtgtctctccaaaattcacatgttggaacttaaactccaatgtgatggtatttaagaggtggggtcttggggaggggattgggtcatgagggcagagtccttatgagtgggatgagtgtccttatgtaagaggcccagagagcttatttgtcactccactgtgtgaagacacagtgagagggtgccatccatgaaccagaaagtgggccctcatccgacactgaatttgccagtgtcctgatcttgaacttcccggcctccaggactgtgagaaataaatttctgttgtttataagccacctaatctatagtattttattctagttgcctgaatggactaagataagaacctatatcaacatcagcttccctaattatgattttttttgccacttatattaatttgctaaggctgctgtcacaacataccacagacagaaatttaagccacagcaggcatttattttctcacagtttggaggctagaagtccaagatcaaggtgctggcgaggtgaggtgggtgccttcagagggctgtgatggaagggtctgttccaggcctctctcctggctgcaggtggctgtcctctccctgtgtcctcacgtgggctcccctctgtgcatgtctgtgtcctgatctcctcctcttagcaggatgctcttcatattggattagggggcaccctgatggcctcattttagcataattacctctgtaaagagcctgtctacaaatacagtcacctt

SEQ ID NO: 61774 - DNA, 1051 bp, Homo sapiens
caggaccccttttttgcgggaggggtggctgtgctgtgccactcgctctgcggtgctgtctctacgtcttcagtcgcagctggggggtgaggagaggcgtgcagtgggagctcccaaccccaccctccgctccctgccctctgcctttgggccccagcaatggccgctgactctgctggtgttggtttcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccgtaacgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcgcggtgggcatggttcttcactgagagccggctctccttttcttaaagtgtgtaaatagttt

SEQ ID NO: 61775 - DNA, 1122 bp, Homo sapiens
ctggtggctgttgatgatgatttttttttttttacacaattctctgtagactaggagaagaatgcttgtgtttttcggaagtgtgatgcttctctttgactgccaaactcttttatggaatatatctttatattaatgctgttttggtcatttttgtttggggtcactattgagatattgctaagcatctcagtggtaaacgcggctgccagaggaaccaagggatagggtatgtagaccttacagaaggatggatggtaaaggcagtccatcatcagcacaatctgacttacatttcattgagtaattttttttttttttaagattctgtatggcagcactttcagttgcccttgtgtgccggccacagccgcacaagttggcttgtggtttatcccccgctataagtgagagctggagaaacttcaactccataggtctagaggaaacattgttttaggttatttctgtccacccctgtgcgatactatttattgatccaagcagaagagcttggggacactgagtcgaagtggggacatgggattgaagcctgggcactgctgctgcatgagctgtgtgtcctgggtgtgccggcctttctgtgaagggggttggtggcagtgcccacctcactagatgcctctgacccagcctcccctgggggagtgggtggccacagaccctccctgccagagctcctggaaggctcctgcaggcctgacccatctattcctgtagacctggtttaggatgaagtctcggtgcgatttttgcagagttgggtttatctttcaactatagacccttctggctgttctcagccatatcatgtgactctgaatagttggatgaggaatggaaagaaagcaaggatgagagccggtcacgtggcagtctccgcccagcatcggctgtccgcacagaggcacagggcaggcctcctgtgcactccccacctagcactggcctgtcctgaatccccgccttccctggttggaggccagctgtggcatttgcaccctcttctcacctcaccatgcacatgctaactttaaagccttggggtctttcctgtaccccctcctcaaccctggtccaccccctctcaggatcttgtca

SEQ ID NO: 61776 - DNA, 1171 bp, Homo sapiens
tcactccacctgcagccaattcagccacactgcctttgcatggaacccagggttgcaggccgcgtgtgtagatgctgatttaggcccaagcactcagctgtcagcaggaaggaccatagtgttttcttctagttttagatatgcactcgttctgtgttttaaagtcacagctgtgagccaatatgggaagaagtgaagtggcctctaggagggactgagcaccctgtccttggaggtatgcaagcccaggctacacccttcctgtctgggatgatatggctgggggtgggctttgtgctgcgtggaccatggcaagcctttccatctctgagaggtagtggtccttcccgtgccttctgttaaagataattttttaaaaaaaggcataactcatatatattacatgtacacatgtcaaagattttatttaactcagtaattgagagtgctgctaagattaacagccagttcaaaagagaaatcacaatgaaccataaatctgtatggagtaaaggaaagttgaaactggctggggtttttttttttttttttttttttgaggagaaaggtcaattgaatcttattcgtataatatgcacatccatagacaagaattattttgcattaactctacaacttagttgtaaaaatagctcaaaggcagtgaaagactagaatcagataattggaagggtgcaccctaagcaatgcatagttctattttctttctttttttttttgagacagagtttccctcttgtcacacaggctggagcgcagtggtgcaatcttggctcattgcaacctctgcctcccgggttcaagtgattctcctgactcagcctcctgagtagctgggattacaggcgcatgccaccacaactggctaatttttgtatttttagtagatacagggtttcactgtgttggccaggttggtctcatactcctgacctcaggtgatccacccgcctcggcctcccaaaatgttgggattacaggcgtcagccaccacgcccggccccaatgcatagttttttactgaagacaaccagaatctctgttgcttattccaaatttccttccaccacttgtccatccagcagagccacttttaaaataggacacaggcagaaatttaaaggagtcaatatctcatggtgaaaagtga

SEQ ID NO: 61777 - DNA, 1074 bp, Homo sapiens
gagtgaggcagccggactagaatgacccccgctagcgcccattttgtgcgatagaggggatctcgctgggggcggggtgatccctggcactcccaggtcagcggggcaggaggccaagagacaccgaatcgcggggacgtgagcgtcacccagccgcggatggcagcccgggagcgggtgaagtccggtttccgggaagacgtgcttcggggcccgcctatcaattctcctgggcctggcggggtggagggcgggggactcggccaggcctggggcgctccctggcggccgcacggggaggcactcggcttcgcaacctgggtgtgcctggcctgggtgtgcgggaggaccccagaggaccccagaggaccccaggagcaggggtcgcgccgaagagcagagtccgcggctggaaaccaggcaggggagccacggagtagtcacacaggttttctgccgcctttcaactggtcttattttgctttcatttttcaccagcccatgtggggtgtttaatgttgcacgcgaacgcagtttcttccgggcccggaaggcccacgcacgcaacaatgttgtgcaagtgactggaaaccacctgagtgtccctccatgggggtgggttgcccagcatggacctctactcctgtcacaatgaagtcgactgtttcgtcgagggaagtggccaccgttgataaaatgaaaagacgccatgcagaatactgtgcacagggtaatccattttttttcttttttattgatcattcttgggtgtttctcgcagagggggatttggcagggtcacaggacaatagtggagggaaggtcagcagataagtgaacaaaggtctctggttttcctaggcagaggaccctgcagccttccgcagtgtttgtgtccctgggtacttgagattagggagtggtgatgactcttaatgagcatgctgccttcaagcatctgtttaacaaagcacatcttgcaccacccttaatccattcaaccctgagtggacatagcacatgtttcagagagcacagggttgggggtaaggtcacagatcaacaggatcccaa

SEQ ID NO: 61778 - DNA, 1139 bp, Homo sapiens
ctttgggtcctgttgcctggcctcttttgctgtcctgggtagaggagatgagttcgtcgctggctgcaagctgaggccaactgacaatgctgcacagagaaggggcaccgagagtggccccggattgagcagtccgtagtgcagagcagcccctcgggcgttctgcctggccctgcttcccctgctggctgcccttctggtgcgtgcatcccaggtggcatcatgctgcagcagatcctgcacgacatgtacatcgaccccgagctccttgccgagctcagcgatgtgcagaagcacatcctcttctacaaaatgcgggaggagcagctgaggcgctggaaggagcgggagacttgggaggccctggcccaggacgagggtctcaggcctccaaagaccaagcgaggtacgtggctgggagtcacagagaggtaggccaccagtcccccaggaggtagaaaaattagcagggccaggctgtgcccttcttcaagatgggcactggggtgatgagggctgggggcttgaaacccttgtcttgtgggcatcaggtcccatgagcctgtgcttttgccttttggccaggaccttagggcttcgaggctgctgcagaggctgtccagcggcccttattggagtcggggagttgggacttgctttgtcttgttgtggaaggcccgagttctgggaagacaccattgagacttcagattgtgctccgacgtggttggcaatggtagggtgaacgacggcatatttgtgacccttgccattggttctgggccagagtgtggtgtagatatgcagttcctttctccttggcatgcgtggcacaccagttcttggctagggccccttctgtggactgtgcctctccctccagatcctccggcaggaggatgctgtgggttgtctctggagccccactgggcatccggagagagggcatcagggaacgtcccacacaatgaatgaccatccccaaatggtcgtagcaactgcagatgagaagcaagggcctagcctacatttcaggtgttttgtatgcaaagtcatgtgccagtcaatcctatggactggtacacctgtgggtgaaggaaatcatccaggacccctgggccagaaactggcaggctgct

SEQ ID NO: 61779 - DNA, 1026 bp, Homo sapiens
ttttttttgagacggagtctccctctgtctccttggtgcgatctcggctcactgcaagctccgcctcccgggttcatgccattcccttgccttagcctcctgagtagctgggactacaggcgcccgccaccgcgcccggctaattttttttttgtattttttagtagagacggggttttgtgttagccaggatggtctcgatctcctgacctcgtgatccgcccacctcggcctcccaaagtgctgggattacaggcgtgaaccaccgtgcccggcctatgttgcaaatatttttatcagtgttatttttttcttaaatttggtttcagtatgttcagatgtacataggattaaacttttaattggctaaatctatcagtctatttattttcattatttgcttcatgcttagaagaatctgtgacatcacaagcttataaaaatctacattgtttatatgtctttcctgattttacttcaactagttttccttcactttggagggtgatgtaatagagggctctttattttcttccaaatggcagccagtagtccccatattatttattatgtaatctgtcttttcccttctcatttgacttgctgccttcattggattcttacttgttacttacttgtggacctttttgtggatttttcttctttgatttattattcctgagccagacttaattgtttaattattgtagctttaaaataaattttaacatctgttaaggtaagaaccctaccattactcttcatttccaaaatgtccttggctaatctcacccatttttttttctgccagggaaacttgaattattttgtcattatctcccaccctcttaacaacaaagacctcggtgattttcattagaattgcatcaatttatagctgtctttgtgaaaaatggacatttttacaatattgaatcattgaatcttcttgttcagaaatgtgatatgttattcaaaggttctttttgtctttgttaattttttaaaatacctttaaaagtgctg

SEQ ID NO: 61780 - DNA, 1028 bp, Homo sapiens
aatgggaaaatatattctgtctttttcttacgaggaactgcagagtcctatgtcaaagggtgtggcaacagagagggaagaagaatttgagccaataatataatctgtcagaatcccaatacaaatcttttctttcccagataaaagagtcttagttaattcagttagatttcatatgcaggttaaacatgactactcgaatgatttccttccctttcctcaaacacatgtggatttgtgccagtgttatccaaacagcaaatagacaaagaatctgaagatatggggtccattctagaacttagcggctctgagaccttggatgtgtcctttaaattccccatctgtgaaactggcattgtaacatctacttcacaggacacttacgaagattgagccaacaggagtgctttgtccaccataaaaagccatgccagtgtgtttcctgatgtttcctgggatctggggtcaaccaccagaggctcctttgggaaatcaggtttggggaaatgggcacagagtgcagagtgagaggggactgggaacaggcttttctctgggaccacagggttctaggtagagtctcctgggttacaaagagtgatagtaattccttgtttctcctttgttcattgttatgttccaggaattgggagagagattgtagttatatcaaactacttgtgagaaatgctagtacatataaccttggctttggggaaaaaggtattttcaaaattcgacatgtatctaaaattattaagaatgttctctgtctgaacattggctcagtcagaacccatttctcttcctgagctttacttctacaaaaacagtcacaatgtggtctatgatttattgtctgggtgacaacccattggctgccttgctgcttgcccatagggcttggcacagaatgggactacccggtgggtgacatcattggcattggtaaattatctccatgtgaccctgctcaggtgctgggagtggatctcaagcgtggcctcacctgggcttgggtgggc

SEQ ID NO: 61781 - DNA, 2060 bp, Homo sapiens
acagggtgtgtggtgatgaacaaaactggtgccttccctaccctcatggaacttacattcacttgtgagaaacaacaacaaaaaattcaaactgatgtaacctaaaagagaattttcagctcataagactgaaaaacccacagataggtctagcttcaggctttgcttgatccagggagcttaggcttttcagcaaccagactctctccatctctcagctctgttgttttctatgttgttttcattaccaagcaatgcatcagcctgaggttgcatgcctgcattctcccaggctcaaatccagcagaagaaagggcctgcttgtctctcaacagccccagtattagtcccaatagtctgctttgttgggtctgggttggtcatatgttcacttctggaccagtcactgtggtcaggcaggtgatctgccttgattagctagccctgggtcatatgatcatgcctagagtaggtgggtggagaacaccctattggaactgcacagactgagagtacgtggcgtcccaaaaggtcacagttcccttgccagaagatagccactgaatgatactgggcaggcaagaccaatctgtgttcaccacagagggaaaaataacctggcttctgctctagcgaagctgtcagtctagtcagtgagactgatattaaacaatcatgccataaatgtatacatccaatggaggtcagtattatacaggatcttgccatagccagtttcagaagtcattttactgggtgataccactctctcatgaacagcagcattggtgattagaacctggcaggtcagcttggagcagacattcataggcatggatattgcctcttgtgcataaatatatctgggaccaagaaactcgtccagtgaaacccttgtctgagcagttagccatggttaaatttcatttggcgttataaaaaaaagaaggcctttgagctcattcatcacaatctctgtggctttaggatgctttgagatactgttgagaatgaagagcttaataattccagcctccttaatgatactgtctggaaagtatggcggtcagaaaggaaagtcacaaaaatgaatgagaaatagctaagtggtaatggaggtgttgtcagccgttgaggcgtagctgcggtgaaagctttaagaaatatgcacgtcagataaattgaggtccataaaaagtgaaacgtcgtggctggcctgcctgcgtttctttcttttgagggtgaagtcctaaccgagaaataaaaagagctcatttggttactcaggttcaattctgagctaataatttcagggaacggaatggaggtggaggggctgggaacagaattctgggttggctttgaggatttgctaacatacggatttatggctctgttattgcagagtgtcttctgaaagtatacttacaatgcctttcctttcccggggtgcagctgattagtgcccatggagtaaatattgtaatagtgaacatgaagttgttggtgctatctgagaacatctgtatggaattcagggagacgaataggggaggtgtcaggaaggatgcaccgggatttgtgctcagggtgtagtaacagaggagttaggcactgttggccgcactgaggtggggccagcggggctgcagtggcctgcctgtgatagtcagtgctggcacaggaagggtgaaagcaagcctggacttgtttgtcaggccagtgttcctcagctcttctgcattccctgccttctcatctttactcactgcagcctgtaaccatgggagagagggtagctaccctgaaggatctctgtccctgtgtcacagccctgtcctgttctacagaggcccaaccgggagtgctatggtcagtatggcagcctcaggtgcttgggcccagagaagctctggacacctgcagatgggcccaaatgtgtctctcctgaagtctccatcaaggcccccaatctaaatgctgggcttctgcctcagttcccttaattataactctgttcacttctgccactgacccttggactttgtggcttaggccaa

SEQ ID NO: 61782 - DNA, 1018 bp, Homo sapiens
tcttacagtgcgtggaccatgttttaataatccaaaataattccagtgccgaaccctgaatttaacatatggtagacattcagtaaatgtttgttgaatgaatgcatgtcttctaaaagttttccaacacaaattagcagtggtttcttgtaaattatttcctactcgccactctataaaatcatggcaataatagaagattatgaaggatttctatggaggacataaatgctgcatctttcataatctccattatcaccctcattgatattatcattggaattatctaaggtgagccccagtttccagggcagctgattgacaccgtcctgccttccttatttaacctcttcttttgccactcgcctctatctttgaatcatattttggccttggttttgcaatggttttatgtcatcctacagatgtcttcaagacctggggtgagttatcaatgcaagaatggttcttagaaatctgatgaggcctctgctctctgggatgtggccctctctatgcaggttactccaatgattagctctgtcctcattgtccttttaattcccttgtcaacttaatctcagtatgttgcttatattaacaagaagactcacgcaataactcctcgataactctcagtgatggtatctgttggtgcatacttgtgttccacagttatggccatatacacagaggtagtatatgatgaagagaagattacagtctttacagtcaagaagacttgggttcatatcctaaccctggaacttactagcattataatgcttgcagcattgtgtttggtgagaggaaaagaatgaatggattctaggaatgttagggaacgatttactttacccgatggctgtatcaaacatctatgccccacttcttctcttgcctcacctattccttagattcttggtcacttctctaccacaagccaccagcactataaccagttttgcgtgggttctgctcttcctccctatgttgatcagtgtcatgtgagcataag

SEQ ID NO: 61783 - DNA, 1102 bp, Homo sapiens
atgatttatcttggagagtgttttgcatatgcttgagaagaatgtgtattctgctcttattctgtggagacctctgtatatgtctcttgggtccagttggtttgcagtgttgttcacatcctttgtttccttatttatcttctctctgattattaatgagttgtcttttttgttttttagagtcagtttcactctatttcccaggctggggtacaatacataatcatagctcaatgcagccttgaactgctaggctcaaactatcctcctgccttagcctcctaggtagctgggactataagtgtatgccactatgctcagctgatggtttatttttatttttattttttgaggagatgggggtctcattatgttgtgcaggctcctagtcttgaactcctagcctcaagcaattctctcaccttggcctacatgagttgtcttttaaggagtgtttgcagaagctctttgcagtacattggctgaatctcattagctctctttggtcatgcttacatgcaaaaaggctggaaaatgtagtccaattccaggtatcgtgcacctctaaaaataaggattatattcagaaaaagtgaagaatagataatggggagcagactgcattgggtctaacatattagatcagaatctaatatttttaaggtaccgaatgtatatcctatcacatcttgatttggatgaggcttttcattttatagatggaggaaactctgaagccttcccttgtgtgtctgtgatatatgagcttttaacttctcatttatgaagttacaatagatatataattcttaccttattgtgtgttctctaagaagcacagtaaaaataaaatgaagctttaaaagtttaaaatgatactgcagggaattcaagatgaaaaagatatacaatgccaaattacttccacccatgttgttacataccctattaacagcatgcacaagagacaattctatttctagattttagcaccccatttcataatttttacttgtgacgaccagagaatatgaagtaggaagatggcctgtggggagatattatgcatttttgttattgaatctcaccactaaaaattgtg

SEQ ID NO: 61784 - DNA, 1017 bp, Homo sapiens
actacatttgtaaaaaccatcacagactctgtaatcacgtccagttattaacagccgttctgtgttacacataatttttgcagtcatctattttgattggtcaaactgggacttaaacctagtttgttcctccatcttcagctgtgttctctgggatgggtttcttgcattacagtggatggttgggcaaagaattcatcgctgaaaattaaaaaggtcgctttatttcctgttctactaaaaaatagtttgttccttgactctgactctcatatgtccttctcttaattggttagtaggttgttttacttatgtttttttggttggttttgccttttttttaaactagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggtaaagataatctgaatgtttttatattgcttctttttccatttgtgccctttctttttggcagagtatggctgctctgcctttagtgtgttatacgtcagttagccctgataatatccccaatcagctctttctccccattagtttgtatcattctggtccctccttatcccatatgaaatagaaaatgagtttctgtaactctgtcttcgcttacagcttctggagtttctcatttagaaaatttagagtacattgtgagggattgagagttacatagtgtaacggagatcctggagcacatagtcagaagtttaagaacccagggatattaccagttggccaatagcttattaataaattactaaatatattatctcttatttagaggttgataatatctgtcaggttagaaagaaacccatttttataatagatttatcttctggcattcagattataaggtttgaagtgtgaggtaatgaggacaatataaagaa

SEQ ID NO: 61785 - DNA, 1073 bp, Homo sapiens
ttaactgttccactgttgaaaaagagccacaatggaagtagtagtcttccctcttcttggcttcatgttaaggaaagatgctgttcttgagtccatatcccagatgacaaaatatagctaataatgcttgtagaatgcatatcttaaaaatgctaacagattctcaccctggtatttggttaggatttaaaatataacaattctaggtatgtaaatctatagtttgtgaaagaaacaatttttctgaaattgaaactaagaataatataatgaattactaacttccaaaggtggagcacagggaaggtctacatttatttatttatttttacatttagttttttaagttggctaataaatttccatagtgaagttaggtatatagaaagtaccaagtttctttaactagagttttctagtgtaaagggatcttgcattttattttattaacgttctgttttcatgtgggtggtacgtgtctttgtttgcatgtgtgtcaggaatatgccaccaaaacaagaattgggatccggcgtgggagaactggccaagaactcaaagaggcagcattggaaccatcgatggaaaaaatatttaaaagtaggtggctatctttagtttttaacctagaatctatggatatgttttaagaggtccatgaacaacttcctaaaaatatatgtgtatttgtgcattttctgggaagaccacattattattctgagatctgacgacccagaaaagattggtactttgcactggattcagtggttatcaatcatatttcttccagtggaaattttactttccttttttttaaagaaaaggattattaatatgccatggtccaaaaggtatactctgttgagaaagttcattttaagtgtgtagaatcctcattcaagcatataatatttgtgtatgtttcagattaagaataaatcaccaacacatagatgttaataaaagcctagctgtccaagaagaatcctttaactcactgctcacatagggcctcaggagggcagtactttaatatattgccagtttggttcagtttggatatcaacttt

SEQ ID NO: 61786 - DNA, 1062 bp, Homo sapiens
gctccttaataatcttgcaaaatgtctttacagtgggagagagccctaatcagtatccttcaggtcatttctttctgatttgaccctagagaccaaatcatgcaaattatgtagtgacagcctagtaatattcttagtaaacgaattagactaaaagaataagatgccctttatgaatacctctattgagttagagttgattagttgcctctcagtaccctaaaacgggagcctcctctcacttgattctgctgcataaacactgattatattttctcttttttcttgatttccacgtaaagcatcatttgtgttaataccatgcagtatggtatgactgttaacatttccttctcattttttactttccatgaatgtcatgtgaatatacttcaacctcttattagtaaaataataggtatcacagaagtagctccacgtctacaggtatactgctccctcaaatattgttggagggaggttgaagattcaccaagcctgatcctttcttttttgtactgatttttacacctttgtttcaggagtgtttttttctactggttacctaacattgaggcaatttctgtaccccatatgcactgattatggcttctattaaatatggtacatgatttgattcccttgataaatattttaaaggctttgtccagatgtgccagtactaacctgcatttccttctgtgttctgcagttgatcagatgggaagatggtttgttgctggaggggctgctgttggtcttggagcattgtgctactatggcttgggactgtctaatgagattggagctattgaaaaggctgtgtaagtaaattgttttaagtaaactgttcctaaacaactccagccttaaaacaaaaattcaaattttcttctcattcctatctttagtcactttggaatgttttgtgtctagtctttgtgtatacacacaaatagagaatctctttttgcttctttgacatttatttattcaaatctaaataaaaatcttttagcaaggttatatgtgtttaagcaaagagaaaatatgaaatatgtt

SEQ ID NO: 61787 - DNA, 1993 bp, Homo sapiens
ttacttatttataagctgttagcagtccttattacataaagaaacagcagtgtctgtcttagaagttcccacattttaagtttatcatcatatgctttcccttttgacagcagtaggtttgaccttgagttatttgttttaagcttgtttatctcaattattatatgaatgttgtagaaactagtggtaagctcagattcaaatagctacatggaatttgatggttactaaataagtagattagtgtttgcttgtgagtgtgattgattaggaatagtgttaatgttgtgatatagaatttgagtagtcaccaatttgggctgtagaatttggtgggggtagtattatctaaaggcagaactttttgaatcatagtgcttaaacagtaaggtataatataaagtggcatgttagaagtgatattttccttttgcttgttatttagtaaatacttaatgagcacttcctctttctccaggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggtaagctgctgtgttttaacacttaattcttggtgcatagtttcctgtaacctgaaatactccaatatcctaattgattgagtcatttattttaaaagtttttttaaagatttatgctaatttgactggattttactacctgacatcatataaaaatcatggcaacatggtcaaccattattactggctttaccaaacacatctaaaatgggaaagttggtctggagaacatgaatattgctctgatgcaagaaccttcctgtgaaatgggcaagtggctcattggaggaatgagtatcatggattttgaactaatgcaaataagattagacagtacatgtacccagatgtcgtcttacctacacagtataccaaggagatttttttttaagtaatataaatcataaactcagttatcggaaatccttttttaaaaaaaatcttgttttcgcattttgatttcaggatctatgtttcttccacctaccaccgtggctggtgccactctttactcagtggcaatgtacggtggattagttcttttcagcatgttccttctgtatgatacccagaaagtaatcaagcgtgcagaagtatcaccaatgtatggagttcaaaaatatgatcccattaactcgtaagtaatgctttttatttaacactgttactctgtcacataaggatgcttgtgtgtatttgacctgttttggtttatggctgtattagttttctagggatactgttaacaaagtatcgcagactgggtggcttaaaacaaaacttgattctcttgtagttctggaggccagaaatctaaaatcaaggtgttagcagagttgtacttctgagggccctgagggaaaatctgttccctgcctctcagcttcttgttactgctggcagtccttgacattccttggcttgtagatggatcattccagtctctgtctccatcttcacatggtgctcttcctgtgtaccagggattaggatttcattatattttgttggggggcagaggagggtcacagctcaaaccacaccaatggctttgtcagatttcctgttttacttctgttgcagttttgtctgttctctctttagtaaactatccaaaaaaacctcttgattttattgcaacttagtgtaatacttaggtattcattccattatcagaatattttgtctatttttgtgagccagtgtcagggtgcaataaataatgtgctcttactgctcagttaatttttttggtagtgtattttgcagactttaaaactgaagaaatgtattaatcaagtattatttattggaaaatgtatataa

SEQ ID NO: 61788 - DNA, 1626 bp, Homo sapiens
ttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagcacacacattttcaattctcatgtttgagtgattttaaaatgttttggtgaatgtgaaaactaaagtttgtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatgattgctaagtgtttttttatttttgcatatttattgaactgtctaattgaatacagcttgctcttgtcacctcttcaagctttcaagcctttatagaaaagcttctttgtggcttacactggaaattatgaaagcagtttttctcctaagacttttggtttctcgcattgcctctcagactaagcactaaaaagcaaagcaaaacagaactagttctgtcttaatgaaatatatcaacccaaaagtgtaatgaggaaaatgcttcattagtttcccctagcagacttttacttctcttacactgctacaccattactttcttgagacatttgtaagttctttgatacagaagagttatatttagaagtctttaatgaagggaaagaagtctgtatgatgactgaggtgattgctctttttgacaaatgtttattacagtaatgcagaaatactgttaatcatctcaaagtacataggaggcttatttctgaaacaaaggtttcagccagatgttgattagtctaatttttccaagtgaatcatatgcatgccatttgaatagggatttcttcaagaaagcaacttagtttcttgccagtatagtatagtgcagtgtgataagtacatgatacttgtagctagactacctctatttgaatctcaactcttatttcttatgtgaccttgggcaaattacttaacctctgtgtgcccagtttcctctcctgtaaaatgaatatattggaacctgtcttataggtttatggttaaacgtgcaggcacttagtaagcattacataagtcttagctattgatgc

SEQ ID NO: 61789 - DNA, 2005 bp, Homo sapiens
ggttttctttttcccatgattttctaatacttcactgtcctgtaagaacagatatctaaagcattgtcttttgataaatgacctcagtaactaattattacttatttatgattcagaggggatcttctgaagtacaaacaagctcaccccacccagttatgtacttttttgaagatttctttttctttttttttttttttttttgcttaagcaacaaaaatttattttcttacagttctggaggctagaaatccaagtccaaggttccagcatgttctgtttttggtgaaggatcacttttatttttctgagaccgaagtgctgggattacaggcatgagccaccacactcagtcaaggatcactttctagcttgtagatggcagccttcttgctgtgtcctcacatggtggggttgggggaagaagagagaaggcccagttacgtacttttaagtatgcaggctgaacggactgaggtcagcaacacagaatgacccccaaacaggaatataaatggaagttaagaaagggcacgttactggtttggtatgatctgttagtagagttagggatttaataggttcattccatttggtacaccttgagggaatgaactgttagcaccagctgtggggaaacacaaggatgaatggctggaaacccatcattctagaagacagcatccaatgagcagtgggagtgggtagttgctaggaggatctaattctagagagagaaggcagtgctggaggcagaagcctttactgtgggtggggaatgttaatcattagaagccactgttttaagagattaaatcaacatttattagacactctaaagtagtacgagagtagttaaatgataagaaatagcaacacacttcaatgattcaaggtaattataaaatcattatccagaaattacaagaggtttattcagactaattgccaccggagttcagaggacggaagcaaatatgaggagtgcatatagggacatttgagtccaaacgcaccagcccagaagggttggtactttgtggaaaggggaatgtctggcctggctcgcatgtgtagcatcatggggacttcctgatctcctttgcagagaacccaaccttctctgcctgcaagaccctgacaaaaatgtgggtattcttgaaaagctataaaatgtccttcaggactctgctgtgtgacaatcaaatgacgccacccttaaccacactgtttctcagaagatgcaagcatgattgccttcctcatttaaatagaacggttatttaaaaagaagttggataaattatgacaagactttcactgttattaattctgagtggcagaaaaaaatgggcatttgataagaaaatggggcttttggtatcttttttagtacattatagctgcccttaagtaattttgtaaaaggcaaaggacacatggggagaaaatgaaaattatggaaacactttacaaggagctttccagatccgggaactagtggaatggcccaggaaagcagtctctccgccctgcggaactgaacccagggccttcagggtcctcctagcctggctccttctgtgaggttgaagtttaccccggagtacatggccctagcttcacctcccacatccctgccctttcctgggtgtgctaggtgtgggggtgaaaatgcggaggcaaggtgacacatgtctgctgggaagcctgctgtcaaattgcaaagtacagaacagacgctgacaaacaggatccatctcagccctacctgcagttttccagctctaagcaccggcaaaagaggaaagctttggcactgctaatcctcctttctacacaacctccctccctcctgcccgagttcctcctcgcacttgctctgtttgtcctctcacctttctctgtcaaaatctgcacttggatatgagcctaggatcagtcatttggaccttaatttcagtgtgtgtgcttcctttgcctcaaattgtggcaagaaaaatag

SEQ ID NO: 61790 - DNA, 1062 bp, Homo sapiens
catgtgagggtgatgctgctgttttatctaaggtggttagggaaggctgtaataaaaactagtatttgaacagagatcttgaagaaagaatgtgatctatgcagatattaggagagagagagtacttgatgaagatagaactggaatacaaagatcctgtggctgaagcttgcttgacctgttctaggagtggcaagtaggccagtgcaggcattgaggggaaatgattggtagatgaggtcagagaggtgggttgggttggggggatatgcctgatcatatatggcattgtaggccagtgagactggcttttaaaaggtggggagccaccagagttttgacttgttataagtagaactctcagctgctatgtaggggtggcgcataatgagattatttagcaggcgcagcagtaatcctaagtgggagatgatgattttaggcagggattgggagaagtgcccacattttgtatacattttgaagccagagccaacaatttaatgatggattgaatgtgggctgagtttggcctgaaaaactggacaaatggagttaacatttcctgagatgggtaagagcgcagaagaagcagggttttagcgggggaagtaacgagttcagttttggacattttaagttagtaatctgagtggagatatggtgaagagagctgggtatgcacaagtctgcagttcacagcagaggtctgggttagagatatataaatttgcagttattagcagagagatagtatgtaatgcctcgagaatggattaaaataatttagggagtgaatgtggctggagaagtcccacaagttagccttgggatcctgtaatgttttcagagggagagaaactagcagaggagaccaagaagccgcacgcctataaagaaggaagagaattaagactgagttgtatcagtgaagccaagtgaaatgttgtaagaaggagcgagtgagtaatcagctgtgtcagatgctattagattgaggactaagataaagcaatatgaaaatcattggtgaccttaacaagttgtttctggtttagtggt

SEQ ID NO: 61791 - DNA, 1041 bp, Homo sapiens
tgccaccatgcctggctaatttttgtatttgtggcagagacagggtctcaccatattggccaggctggtctcgaactcctgacctcaggtgatctacatgcttcagctgcccagagtgctgggattataggcgtgagtcaccacgcccggcctgaaaaaaatttttaaatattaaataccaatactgtaaatttgctatactttaaaaaattattcttgcagaaactaaaaaaaaactgacattttcaagcactggtccagatattagtcttagttcaccactaaattaaagctcacagatggtattaaagtgtctcagagattatatcattagatgatgtaggcaacatatattttttcaaattgttaatgaatggattttttagacacctaacagattacagtttaggtaaagtgcatcaaagacagcatggctaccaaaatgaagcagactcacaatgtctattttattttatttcaaaattataagcaaatataagggaaaatttcatgaacttttaaagacagatggtagctcatcaacgaatgaagtgataatattcataacgtaaacttcatagtggagctgtcagactagtttatcttaagaccaaagttcaagatgattgatgtgatttgtgttgcaattatttgtacatttagaaatcgttattcttcatagagaatagcacattcaggttctaacattattcttttcccccacaaactggtggaaccacaaacaccagtaacagtgtgtctctcttgtgggctcatcttgtgcctctaagttattaatactgaagatgctcttgggagataacatgtattaccctcatcttaggcaggaaaatagaggcatagagaaaggaaagaatataattttctttccgtggtctacttgtgacaggcggggaaatgttaaagcctttctgactcacaggctctttaatctttaacatgtattatttattgatttgcaaaatgaccctaatatgtaatatcaataccagttttcttatgtttataccgaaagtggtt

SEQ ID NO: 61792 - DNA, 1208 bp, Homo sapiens
tgccaccagaagcagttctggagaaagcttagctcaatccccagacagtagtaaatctattaattgtgaaaaaatggtaaggtcacaaagtttttcacattccattcagaattcattccttccaccttcatctataaccagatcacattcctttaatagagctgtggatcttacaaagccttatcagaaccaacagctatccattagagtgcctctacggtcaagtatgctaacaagaaattcccggcagccagaagtactcaatgggaatgaacatttggggtatggatttaataggccttatgctgctggtggaaagaagttggctttaccaaatggcccaggtgtaacttctactttaggttatagaatggttcatccctctctactgaaatctagccgatctccattttctgggactatgacagttgatggaaataaaaattcacctgctgacacatgtgtagaggaagatgctacagttttggctaaggacagagctgctaataaggaccaagaactgattgaaaatgaaagttatagaacaaaaaacaaccagaccatgaaacatgatgctaaaatgagatacctgagtgatgatgtggatgacatttccttgtcgtctttgtcatcttctgataagaatgatttaagtgaagactttagtgatgattttatagatatagaagactccaacagaactagaataactccagaggaaatgtctctcaaagaagagaaacatgaaaatgggccaccacaggatatgtttgattcccccaaggaaaatgaaaaagccttcagtaaaactgatgaatggatagatataagtgtctctggtaaatattacttaccttaagtttttttgctttcttttaaataatataactgaacttacatttaggattatcttcagatagatttcaagatattatcagtttcacggagggatagatctagacaaaattgaggtgggttaacgtttattttcctgtgacttttgctccataccccatttttcaccctatccaagacaatattaataaaaccactcttaacctttgttgttctttggctgttatacacagcctattcctgcttagtatatgcagtgcttctaaatgacttcccctgcttacctcaaccagtgtggtatgccattaaacaaaccatctcttctcttaggatagcatttcattgctatttgt

SEQ ID NO: 61793 - DNA, 1697 bp, Homo sapiens
tataggtcttctaaaagagactgccggaacaagtttatttccttatagggaggcaattatgagtaccctacattatttaatctatgaagttaaatagtgtacacagaggaaaaggagtttcctggccagtgtttaaaaataaatatcttgggaaatataggaatatgagggtttatttacatttttggaaatattacagaagtgaaagatgactaaatgaattttcttttcctctattagaaaatatttcagtaggttattttaaagattttggctcttgatgtttttattgcttaggatatagaaaatgctacagttatgagtgctttttttgagccagcttttttgctatgatatatcaaattattagcacttatatttttaggacacgagaaacaattatatttttgtgaatcagtaaccttttttctcttgaagacaggagtgaatgtacaaaacatacttctgggaataatttggtttcaccagatacagactacagagctggttcttcgtttgaactctctccatctgatagctctgatggaacatacatgtgggatgaagaaggcttggaacccattggaaatgtccatccagttgggagctatgagtcctctgaaatgaacagcatagtatgtatggatttatatactcttggaatattttgtttaccctactatagagagacttgtgatatgattgattttgtaaaaaatttatgaattaactttactactttgagaaatggaaattcatatttgttaagagcctataaaatatctgactctaatatgaaataaagcatggagaatatatgacatttgacttaaatatactcaacatgtttacatatatattcctcatacatatgtgcatactatattagtagtttaatctatgccagtggttctcaaagactgggggaggaggtcaatgactggaggtggttttggttgtcatattgatgagtgcttcttggcatctagtgggtagatgccaaggatgttgtttaacatcccacagtccacaagacagagaccacaatgaattatctagcctaagatggcagtactgctgctgttgagaaaccttggcctgtgctatactgaggtaacattgaagtgccaactctcagtgggataatacaatacaagtgtattattttactcttagaaagtttgttgtgggtctggacagctctctagggcagctgtctttagtgatctaaactactttgattttggggcttgaccatcttttgaggtcccttcttttcactatggcagaggaagagagtgccagagggtctcacacatataattacttgcattggcctgcaggcaacacttggcacttccgttcatgatctgttgaccagaactaatcatgtggtcccatctgagtactaaagggacaggaagtgtaatctttgtgtgtgcctggaaggcaagggaatcagctatgggcaagtgttagaagacctgccatgaatttatatgtgcatattttaagaaacatggcaagtaatgtggataatatgccatatgggtaaagtgtaattggtatgtttaaagtgactcattgcagttattcagtatataaaatacgattttccagtagttgtatgggaaaattggtagtctgtggatatattaaattccaagtggatttcaggcaatgtaattttctatact

SEQ ID NO: 61794 - DNA, 1025 bp, Homo sapiens
caaaggagataatcacttagattgaattgcagcacaattctttctggagttaaaagacaagacttcccaacagaacagtttattcagtaaatgacagaaagcatcactgctattgaatctgaattagtgacttgaaagatcaagtagaaaaatattgtagaacacagaggaaaaacataaaccattggaaagttataggggaagaataatgagacttgatgatctgggaaatttaatggtaatttttagggctggtagtgaggagtgagggatttacttcctcggaataaatcacatgctaggtaatgcattttactttgacagaattgtaacaacttctcttggaaactttatgccctttctgagtggaagtagaaagaaaggatcttagagcctgccttatctttagcagacaacagaaagttacccaaatattagataaaagtagaatcacagggaaatttagtctttgaggtcttgattggggacttgtgaaaagtaggagggaactcttgggaacatcccacataaacagtactttagatttttctagaagaaggcaaacaactattggctattttgagtaaaggaacattaaagaaagcatgtaagaacatggatctaaaatatgtagcctcctgaggcaccaaagataaaatagtatctaggtttggtactataggaaagtgggaaatttttctttttatggctcttaagtcccgaacaattatacacacccattacagttttttggctgggaggatgagaatgttacagggactgatagagatttagggagtctaataatgtgctttccactacaggttttagtcctttatagcttctggttgttgatgatattatgcaggtttgataaagatttagatgggggccaggcatggtggctcatgcctgtaatcccagcgctttgggaggccaaggtgggcagaacacaaggtcaggagattgagaccatcctggctaacatggtgaaaccctgtctctactaaaaacacaaaaaatta

SEQ ID NO: 61795 - DNA, 1733 bp, Homo sapiens
ttaattttaaaagtgtgatttgtttgtgatgaaaagttaatttgtgcttcttgagatcagtgaaaattaattgtagcagtcctttataggaatgagttctcttaaaaatctgctgtttcctgtcattttcattctgaaatcagagccaacttgtgacagtgatgaaaaccacctaaaactgattatgagtgtttaaaatgtataatgttgatttcaaggttaatttgcctgttttaaaacagtgtggcagttaattgtttacatgactgtaatgtaaaagtattataatttacttcattttgaataatattaagttcagttttcaccagaagaactggttatgcttttagaaatcttgatattgtgattaacataaatggctgatatttttaaactattatttttatttgatttacagcatttaattatcaagctataagagtcaacttttatggagtatgtacatgtttatagtcttttgcttttgaatctgtctagtggagtgtgacaatatgaaccgctttgaccgaccagacagaaatgttcggcagcctcaggaaggtttttggaaaaggccaccccagaggtggagtggacaggagcattaccacctcagccaccctgaccactatcatcaccatggaaaaagtgacttgagcaggtaattactgttctgacttagatttcatttgctgtcctctgattttgaattataattctccctttcccagaaccctcaaaaaacctgtttttgtctggtttgtttttagaggcaccaaaaagcacttcaagttttatgtggtactaattggaataatatgtctaatttgttctttttggcccaaatattttttcattagttttatcttaaatataaatactctatttatatctgctttttggacttcaagttatggtatgattttctagctgtcatttggaaatgattaaatgttaactgtgttaaatttcttagtttttccaaataatatttaaaattagtgccaagtgattggtcttttgctcatgtaataagttaaaatttaaaaattccacaagtaccattaaaaacagaagaaggtactgtttagtgctgaaggtactatttagtcttttctttttcaaagtagaggatagtctttaaattggtcagatcttattttgtaatgaggctccgtagtcattcaaacctggaatcaaaacctgacctggcgcagattagctttgcaagcttagataatttatttaaaccgtctctgcttcactttactatctttaaaacataattaataatatctttatctcagtgtttgagaatcagggataaaagtgcctagagtagtgtctagtttacagtaggcactctgtggaagttattagtttttccttttcactttcttatctcattccacagggatttcaggtcattttggagtgcatttacaatacaaatagtacaattggtttaaagaaataatggaagaaaaacatggtgttgtgtagttcctaaagtgagggaaaaaattgattctaagattctttgcagcaaaagcaaagaataaaatttgatttattacaacatatacagtacgcataagataaaggatgtgtttttttcctgaattaatttgtcagaaaagttaagcaacattttcaaacaactgtgttccttggatgtcagcagttgtaagaaaagagagggtccctggtcaaattagtatgagaatgaatag

SEQ ID NO: 61796 - DNA, 1036 bp, Homo sapiens
actctcaatctttggggtgttggtgctggttttgagacacctacatccacctcagcaagttatggaatgggtggtacaaaaagaaacctcctctaagacgagccttaccccagcataccttaaaactattaatttctctctgtgccttaatattagaaaggtttgggtatactagccccagggccttttcaatattgcatgtgcaaaagtcctgtttccattctaaaacttcctgagtattgcttcgctttcttctgtcccttaactcccgttattattgtcattagttataggatcatgccttatccgtaactcaggggtgttgggaagactggtggttgagaactaatacatccactcatgttctcatcgtaatactgctctgtctttttacctggcctaatcttcctctcttcttttctgcccagacctcctttttttctacaccttttgatatgctatctggaattctctcatatcctagcaaactcacattcttcatctcttcacctacattctcctaatcataactgaaacctagctctttcccaaatatactacttccccagtaacatttttacaccaaagattcttattttccagtcaccctaatacttcactgtttagagatggggtttttgtcctcatttctcattgtcacttctaaaggaagtgattgtaagtcccattttttgagacttagggcatttggctgtatcaactcttctttactggttcctacctggagcttacaaaaggcttggcccttagcccactttccctctttattataagctttgctgcagtcctgagtggctgcagtgttcatgtacatgagtcatttaaccctctgtttgcttagtcctgtaggacagtggtctccaacctttttggcaccaaggaccagtctcctggaagacaaattttccacaggccatgggtgggaggttgggggatggttttgggattgggatgaaactcttccacctcaaatcatcaggcattagttagattctcataaggggtgttcaaccta

SEQ ID NO: 61797 - DNA, 1904 bp, Homo sapiens
cgatagggttcgtgctcctatgagaatctaatgctgccgctgatacgacaggaggtggagctcctgtcagataagcaggaatgcttacatgcatgccctctgcttacctcctgctgtgtggcctggctcctaacagaccacagactggtactggtccctggttaggggcttgggcaccccagctgtgggattttctatatacaagatatgttatctgcaaatagtttttaccttttcctttccattttggataaaaatgtctttttatcttttgcataattgctatggctacaacctctgttgagtagaagtggtgaaagccaataggtgtgtcttgtttctgatatggggggaaaataaatattttaaatattttattgttaatgtgatgttagctgtggattttaaaagatactttctatcagtttgaagttcccttccattcatggatagttgagtgtttttatcatgaaagggtgttggattttgtcaattactttttctgtgtctatggagataatcttttttttccgctttcattctactaatgtggagtaatactttggtatgttgcgtgttgtgttggtatgttgtgtgattcagtttgctagtattttgttgaagattttttttgtgtgtgtatgtgtatatatatatatatatatatatatatatacacacttaagaaatactggtctgtagttttgttttgtttttcttcttgagatatccttgtcttgttttgatatcaggaccacacagattgaattgggaagtattcctttcacttctacttttgggaagagtttgtgaaggatttttgtgaattcttctttgaatgttttgtagtattgaccagtggagttatttgggcctgggcttttctttgtggcagttttttggattgctaatttaatttttatagatattctgtagatgtctttttggtcttgttggtttataatgttgcttaaatcttctgcttctcatatatctctaattgttctgtccattattgaaagtgaggtgttcaagtctccaacttcactatatattgtagggaaggtgtgttagcaataaattctctgtttttgtttatctgggaatgtcttaatttctcttttattttgaaggatagttttgccagatgtagacttcttggttggcagtgttccttgtaatatttcaactcccatgctttctgatgagaaatcggctgttaatgttactgagcgtgtcttccacatgatgagtccccccgccctgccaccaccaccccccccagctttttttctgcattaaggattttcactttttctttggctttcaacagttaaattataatgcgcctctcttttagtttatcatatctgtagtttgttgagcctcctagatatacagattaatgtttttcatcaaatttgggacatgtttggtcattagttacgttctttctgcccctccccacttcgctctggccacttaactacgggaatgtatgagcatcattccttgcttgtcacaaaaaatttgaaaaaaaaaaaatacaaataatgtgaaaactacttaaatcagatttctccctggccaggatttgttgttgtgtttttttgtggttgtttactgacttttctagacagattctgtaaaaagtctgtattttaaaaaaatatttgacgtctttgcttggtttgattagtggtcagctaatggttggatggagatttcattgaatgccttgaactagtaagtctcccagcctccaccagggggctctgtgtgtttgcttaggcacacctgcagtccctgtaagtagtttgcagcttaggcacacctgcagtcctgtaagtagtttgcagctctgccttggccttcacttcctgcttgtttagagtttcaaagtc

SEQ ID NO: 61798 - DNA, 1844 bp, Homo sapiens
ttacttccacagattattcttgccgtagctcccttttttcttcttccacatttccttctaacagtatatataggggaaatgaagatttctaaaattttgtctcccatttgttcttcaccatgctagcatttggtcttcaccatgctagcatttggtctgggtaaattcaggttgaactgaatgtccacaattactatattaatctagtgtttttcttcccttctttctgacagcatgatggaagtggttcattgcatgatattcaactgtcattgccatccagtccagaaccagaagatggtgataaagtatataaggtatgactatgtagtcatgctggatttttcaaaattctttttaaatactaaaataatgatacaatgacaatgaaaacaataataaatgtattaatacctaaagcatcaggtttgttcttaacttttgctactttgttaagttgaaatgatatctctgtggtgctttaatttgaatttatcagttggataatgatctgtccttgtattactactgttgcaggatttaaaaagaaaatatattgctcataatgataaatgataagagtttttaaaatatgagtaggaatgaaagttaaaatggttataggtgcttctcatatataaatcccaaaattgaagaagtatactgaaaatgagattaatttcttttttcatgtttaaaaatacagaatacagatgtatttttgtgagtgaaagtgtttttttataattcttatttatgtctatttttagttgaagaaaactcttttattttgcaactatttaagcacatatttatttcttaagcacacacagagattcttggttaatttaatgtttccaagtcaagttatagttagcttttacatcccattttcagggtacacttattagtgtttgctagtcatctacagtaacaacctgaaagcaatggtggcttataataatgaaatttatatttcacttacatattggctgtagatcagctgggactctgcttcatgtgtcttcctcattctgggatccatactgagacggatcagcccctattgtgggacatgttattgtgccagtgggaagagaactttgataggatcacatgtgaattctgcttggatgtggcacatatcactttcaaaacaattcaaggggccaggcctggaattaatagggcagaaaagcattatttgctcgtaggttgcagagtgatttattgggaagaagattgtatataaagcaatcaaaatcataagagtatagtacagtagtcaatctcattctctcatcttggcttttcaacttgttgactacctgtccttgcccagattgcttcccaaccctgagctttcatcctactctcagtataatacattaagtcagcaggttcacagcaggccatctcttaacactcagttgagaaccattgacttaggtaatctctgatgacctcccagtttagaaaaaaaaaaattgtgaatttgtgactgacattttaaaagcaaagttgacctctttcctgaatttgtgtgtgtgtgtgtgtgtgtgtgtgtgtgtgtgtgtgtgtgtgtgtgtgtgaaaaagttttttacatgtaaagatttttttttttttttttttttttttttttagacggagccttgctctgtcacccaggctggaatgtagtggcgcaatctcggctcactgcagcctcggcctcctgggttcaagcgattctgctgccttgatttcccaagtagctggaattacaggcatctgccaccatgctcggctaattttttatatttttagtagagatggggtttcaccatgttgtccaggctggtc

SEQ ID NO: 61799 - DNA, 1168 bp, Homo sapiens
actaactcgcaaattactttagtaagaaagtataaatctatttaatgtttttgttatgtacaaatatattaaatgaaataatgaataatgcctaggaaaacacaacaatagcaaagcaaatacttgtggctgccacccagtcatggcaatccttggtgttgtgtgtggtctctgatgccattgtcctgtctttttcttgtctctgctctcccattatgccattggcaaggagttgagaagttagtccattacttctctgacaaagcgtggtacagtacaatttcggattttttcctaccaccttcctcataatcactttttttggtttttttttccagtttgcatgatgcatgtcagagcctgcatgaaagtacaggcatgttacagatggctctatttccaccttcctttttatggttaaaatgtatttaataataacaataaacttgtatgtacccaggaaaaaaattagctaaattctgtgtctgttatgcagtagcattattacactttagaacatttcctgctttctatttggtgcactttgacatatttttactccatcaggacttgacattttagctgccatcttttgctaataaccctagaacaagaatgcttatgaaaactggcatgagtgcttttccgtatgctaatgctgtagatctttgaagtgtcgtaaaacagtaaaggtgaactgttttgctcattggtgggtactactttgccttttttcatgttcattatgtttcccccaatgggtcactgtggaatcacctctttccagaaatactgctccacactgtggcttgagtttagtatctgaaagttatcctgggtaggctagatcatctaagaaggaaataggacattatccaggaaagttagttccttaatattggtattatatctgcctgtagtgttttaaaatatattaaaataatcatctggttatactgtatattctgaaagcctgtgaactcatcagaactaaccaaattgcacagaatattaaattttagtgctgtattttaagaaattatctgatggttcaaattctggctttgccacttgccaaaatgtttgaatttgaacacgttaacattttttaaccccagtttactcatttatagaaagaaaagaacagtatgtttcacctaggggtctc

SEQ ID NO: 61800 - DNA, 1218 bp, Homo sapiens
atctctgccttgcttgctagaggttaagaggtagcttgttgttcaacttgctagcaggggtaattagcggcaatccagtccttagtgggtaaccacttccatgtagtcttccacataccaggagcaagttgtttccttgttcctcacattataggtgtttcttattcctcgtgaaagagactttttgtttttacagtagtggaattgattttccaaatatagttaccaaataaataataaagcaagacactgatttggggatagggaaattatatcatgccacaaaaattaatttttaataaaaatataaaattttatttcgcatatagaaaccactgatttagttaatgtaattcactagtagtatagatgtctaacttgtagtttagacatttatttataaaactgttaaattcctctcggttgactcaacattttgttattctttaaaaactggatgttttctaattcattaatatttgatatgaagctttattgcatttaatacaagtagcttgtctttctgactctgctgtatttccgtttatttctctgataagcagtggtcagttgggtactgtgagtaatcaaaacagtacaagtggtgagtacaaaacagtacaaatttatagtgcacaatggccctttcctgggcatttctggaggtaggttgtcttaataatcagtttattacctgtcttaattgaaaaatcatctttttatgcttttcactgatagcacatgtttataccttttttcttattggcaatagacatattacaataaagtccatttttaaattgtcactgatattttcagaagtcttaaattgctttaagagttttaacttggaactagaatatcttaccatgtttgagggtgaaaaggaaaaacaaatccccattcaaccaaccaattgatcgtgcctccttcctaattactttttattccctttggtagattttggtttgtttaatatggtcctgctctattttttcactaatctttcaaggtttttgatcactttggcacggtcatttttatctagggaaccccagggagaatctgttgatttaattatgtggtgattttagtatcttccgttttgcgggacagttcattcatttttgtgttgatgtgctgtgaaaatacccagtgactttaaagtctgggatatttagcttgaggcagcaattgagctgacttgtttatttcaaa

SEQ ID NO: 61801 - DNA, 1322 bp, Homo sapiens
aattttttctataataaattagtactttaatgttttctttttctcatttaattttggatcttgttcagtgtttactgcctgtatcattttttgtttgcattatcactcttgtatgtgtctaatttgcttgaatattgcagttcattttttaattaaaagaaactccacatattttccatattaaagccataataagtaccaacacagcctaattggtatttatattaaatctgggtggaatttctaagaacttgctgctaatgttgtttttaattttaacagcctcaagtactacagccttccagcagccttcccagacccacagatcacacccagggaaaactaataaagccacaacgtatcgaggcccgcagtgaatgctcaatccaagacatgcatcagggcggtgcacatccggaagaaagctttacacacgtcttgcaccaagaaagcaactatggtttggaagagcagcctttttcatcaggcccacaattaacaatggatgtggctaagagtacaccttctgaagcaaacttaaacattactgtaaatgctcaagagccttatcatttggcaaacaatcaaattagtgacatgcagtttatacccacttctcttcagacacctcccgagtcaagtacagtagaccaggctaagagagttggaagaaatcagtctccgccagtgggttatatgtctcagcccaagtccttgcagcttttaaagccatccatattgagttctttggtaccgcctccagtttctgaatcatctccaagtaggactcccacttgtaaaaagtcaccaataatcacaacatgtaattcagcaaaacttcagccaacatctagtcaaacaaatcttgcaaataatcagaatctgaaagcatctaagctccgccccccctcaggctctttcaaacaaaaacaaacaaacagcccccaactagagcctcaaagcttccaggccaagacaagcatcccaaggccactaacacaacgaaaagaaatcatgcagaatccaaatggcaatttgcattctggggattgtttggcctctaatcgatattctcgtcttcctaaaccaaagatacattaagtacatagccatcacctgccaatttgtttcttaaaaacaatctcttctgtaatagctttatgtgcagcttgcagcttgctactgtggtggaggttccattgaaagcctgcaaatcttaaattaaaatgtggaagcttctactagtttggctccttcattttatatcctggttgaagtacatgccatttgagcataattatctcaggtaaacacgaaagttt

SEQ ID NO: 61802 - DNA, 1979 bp, Homo sapiens
ttcataatattttactgagcaggcaagaagtgtgctttgctggtttagtcctattaaggtctgtatttattgtggttgtcagaacctcaccccttttcacttgtctctcctgtgaatatggctactattttaactaaagatatggtgataatggaagatggtagtctgtaagcagagttctggccagtgttttgtatatttaaaaggtctatgcaaaagctttgtgatgaataaaggagattaggcttttaatggaaagtctatgtaagttttatttttccttgccagggtcagtcagctaatgttactgttgattcatttcccaaattccccagactgaaagtgtttcttattacatataaatcagttatatattcctttacatcttgttttacaaacacatgtgcatgcacacacacatatacacacacataccatttatgtttgtatttgttactgggtaaattttggagcgcttgagatacaccttgaaacctgtacctaaagatgtattcatttgtaacatatgttggtgctagagttttgctggtaattcaggcttgaacccttaggcttgtggatccatgatagccattttaaggttccacagcattatgtctttaattgtaatatttatatttattgattttctgctaatatctgaagactgaaataatgaacttgaaacatttgcacaaaactttgatggggtataaatataccatatatagggattgtaaactattttctatagcaaaacaagttaaaatattttgagaaaaataacaaatttaaataagactatcttgagaaagctggagttcataatattctccccctcccccatctccagtctcctaggtttcccttttctgtgttttttgtttttttctgtttgttttttgagacagagtcttgctccattgcccaggctggattacagtggcgcaatctcggctcactgcaacttctgcctcccgggttcaagcgattctcctgcctcagcctcctgagtagctgggactacaggcatgtgccaccatgcctggctaatttttttgtatttttagtagagatgagatttcaccttgttggtcaggctggtctcgaactcctgacctcaagtgatccacccacctcgtctatggtgtatttttgaaagacaattttttaaaggtagatttgggaaaaaaatagaattgaagatgggaaattttgttttattaaaaaggtgctagaagatgtttcaaagacaatattcttattttaatacgctgtagaaggtaggtgtggaacctccatgctaccatgtgcacaaacctaattatgctttgggtcacttgtcagttcagtaaatctgccttcctcttctcccaaatcatgtcatctttaggttgttcacctgcagctgctttaaatgaattagtatctttcagatagataaccttacaaggagaatgtttgttttgagcagctgaccaaaaatatatcaaacaggattatggccaaaaagtcactcaaatttctagagattcctttaaaagatgtatgttgatgaaattgcccctttataagaaaaacaacagcaagtcttttagtagaaatttgaaagaagtgtttgctaccattttgacccattattcccttacctatcagatgaatttgccattcactggatagaaaccattcttggatttggtaagaggtgagcaagacaaatcttgtaccatactcttatgtaccagcacttctgatggagaagcagtgaagttcagaacgttcttcacatagtccagatactgttagagtcaggcaaatcagcaaagcactttgttatggagatgacccatgatggctgcagttgtaagtgggcatacatgttctatcattttgaaggagaaagaaaaccgttctcacatgttgcaaatatgtgaatcatactatattcccctaaagtaaaaccagtgacttagtggttt

SEQ ID NO: 61803 - DNA, 1045 bp, Homo sapiens
actggtttcctggtctctagggcactggggatgtactttgaaatcaccgaacaggcttgcaattaagatcaataaggctgcagcaccatttcaatttactttccatcttacccagtagtttttgtgtttttaaattcgtttgggtggttatgtttgcatgcttaagcacacatttgaaaattaattatagctgtactacccgatgtttttccttggggatgatggccttgttcctttttaaattctgatgcttgaattctattttctagtgatttttcacatctccctttaagtttttgctgcagcaatttgagagagtacttttgattaaatgattctgatggtgggcaccaatctacaactatgtcattaactgaagatacatgttttaatcttgttgggaataagcttacccactttctccttggtaaagcgtttacttaacaaaataatacccgagaatgtaaggtctctaagtcattactaacaaagagcaaaaataatatctgcagtattgtttttcccattgattttaagtcagtttagagtacaaactgtatattagaatttgcctgtaaaatgaattctaaaaagcagatgtaaagtctctcctgaaaatgttggcatagtaaataaaaataaagttcataattataaaagttctcttgtctttctcaacattgactcccatagtttgctttttctttgatatcttttttcccacaaagatctaagatactgttcatttgcttatgtttttcccaactctgatactttattttacatgctgccttcacacacatcttgacaccccaagccctgattgagtaggagttgatcagtattttgttgttgtgtcttcacaaattctgtaagagatctagtactttcgtttccattgtaataaaatacctgctttatcttagaatattgggataatggttaatggacatttcaagaaacattagcaccttggatttagaatgctgtacaaggaagaaaacacttgtaattttaattattttgtcattgtttttaagcagta

SEQ ID NO: 61804 - DNA, 1007 bp, Homo sapiens
cagtaaggaacctcactagtaggactaaactattttaaaataagccttgaagagaaatgtttaacatctttctaaaacattttattgaacacaattcacatacagtatatttcacaaatttagattgtgcaacttggaagtttctaaaaaatgcataacataggattaccatttacccaacaatttctacacctggatacacactcaagatgaatgaagacacatgtctgcacaaaatcttgaacacaagtttttatagcagcattactcataaggtctaaaaagtaaaaaatgtccaaatgcccttaagctaatattgtataaacaaaatgtggtgtgttcatagaatattatttggtcacaaaaagaaataaaataccagtacatgttataacatagacaattcttgaaaacaacaagctaagttaaaaaaaaatccaattataaaggaacacatattgtaggatttcatttatataaaatgtccagaataggcaaatgtctagagatagaaggtattccagggctgtggatagggaggtggggaacgaagagtgactactaatttggagagtgataaaaatattataaaagtagattgttgtgatggttgcataattctatgaatatactagaaaacatggaaacttacactctaaatgggtgaattatatgccaattatctcaacagagctgtttctattttcctatgagttttaaagggcataaaaagtagatacaataactggtcctataatagatgtttgtagacaaataaatgaattgttaaacgaggttagaaaaatttaaattggcattattaagaaaaaatattgaatattgacatgtaaacatggagagagagactgctcctctcaaataataaaataaaaatgataacaacaacaacaaaaatgcagataataaaaaaatatatacactttaatctaattttggctaaataaaataccaaaaaagaattatgtataagtgtgtgtgtgtttgtg

SEQ ID NO: 61805 - DNA, 1074 bp, Homo sapiens
atctattcatttattcatccagcagggagtatagagcacattcaatacctggattgggctgggcattggtggagtaacagtgctacagtaacattaccttgtaaccaacataatgaccatgttgcaacagttgtctatgaccagaaatcatcctattcatttattcactcatttattcttacatttctataataaagagatcatttgctcctgtcatgcacctaacattgtgtcaggctctggagataaaaagtgggtgagaaagcatggtctccaccttcatggagtggcagttggcaattcagaggagcaggcagagaagtgactcagtacagcacagcaagacgagtaccatgattagggaagtttctgtgattgtcagggcacatgggggctgtattagtttcttaggggtactgtgaacaaagtgtcacaaactgagtggtttagacaacatttattgtctcacagttctggaggctgaaagtctaagatcaaaatgtgggcagagctgatttcttctgagggctgtgagggagaatctgttctcacctctcccccagcgtttgacagtggctggcaattttggtgttctttggcttgtagatgcattaccctgctctctgccttcattttacacatggcattctgcctgtgtaggtatctgtgtagaaatttctcctttttataaggacactcgtggtactggagtagggccactctaatgacctcatttaacttgatgacctctgataaggactccccaagtgagatcaaatttataggtactaggggttaggatgccacatatttactttggggggatgcattccaacccatcacaggggaaatgtcttgaacagaattttgaaggtagtgatgtgttccccaagatgtggaatgtgaggagttgtccgcatgtttaggaaggagaactgttccatgtggcatacgagagggaccagaggcaggagagagcactgtgggcttgggaaacaaaatcttgcacaggacagaacataaagtatcggagcggctgctggaggactaagtgggacaagtccttcgaggcct

SEQ ID NO: 61806 - DNA, 1041 bp, Homo sapiens
cactctgttgcccaggctggagtgcagtggcacaatcatggctcactgcaacctctgcctcctgtgttcaagtgattcttgtgccgcaggcccacgagtagctgggactataggcacatgccactatgcctggctgattttagtagagatggagtttcaccatcctggtgacgctgatttcaaactcctagcctcaagtgatctgccccctcagtctcccaaagtactgggattataggtgtgagctactgcacctggccaattttattgctattttaaaaaactttttatatgaggtggtagattttatttttattctttcttgttttggaatgccttgttttattctgaatatagttgtgactgaattcttagtggttttactaatataaactgaagtgtaacccttatacagaaaaatttctaaatcttacgtgaatcacagtgaattttcaaaagtgaacatgtacatacagacaacactcacatcaaagaacatcaccagcaccctcagagctctcccctgtgcacccctttcatcaccacacccaccaaatggaaccagttttgatatctaatgcccttaattaggtttttcctgtttttaacttgatatcagtgatatcaaatgttccatactcttttgtatcgtacttcttttgctcaacattatgttagtaagattcatcattattgttgtatgtagttttagataattcattattgggttttacaaggaaagttttattatcatacaggtatagagaggccaacaaatcaggggacgactgccattgaaaagataggttgttacagttccccagaggggcatgcgaagcacactagacagggccacagggtcagtcaggaggtggaggaaaacctgagcaagcttcatacttatttttcaagacagacttggtgattcttgactctttgtattttcttatacattttaaaattagatttttattttccacaaaaaaatttgggattttgactgagattgccttgactcttgatcaatttgggaagtgttaa

SEQ ID NO: 61807 - DNA, 1053 bp, Homo sapiens
caacacttagtgttggtagtctttttaatttcagctattccaaaggcaggagtgagtctcactgtggttttaatttccatttccctgatgactgaagatgttgagcatttttcacattcttaccagccatttggatatcctgttttgtaaaaggcttgttcagaactttctcccactttactttttcaattgggttgttggactttttctttttgatttacaggataatttttaaaactaaaaatgctgaatatgggtctttttgggacatatgtattatgaataccttgtcatttgtatcatctttttcactatctaaatttggtgtcttttggtgagcaacagttattactttttaataaagtatgattgattatttttaaatggttactgccttttgtcttattttaaaaatctatgcctacattaaggcaaggaagctatcttcctatattttgttttagaagcttatttatttttattttaccttttacatttagatctgaagctgaatgactcctggggaaaggttgtcactggggaaccatctaagtgcatctgttttcacttagatttgttatttttattcctaaatttgatttccttttcatactactgtaaatggaattgtttcattaattttatttttattttcatgatagtatatagaaatagagttgatttttacatattgatcttgtatcctgcaaccttgcagaatttatttattagccttgatagttttttgtgtgaatatcttaggactttaaaaaaaataaatgagctgtgtcatctgcaaatatagatagttttacttcttcctccctatttccttctagatgttttaaaatttccttttcttgcctgatttgcatgactagaatctccagtacaatattgagtagaagttgcaaaagtggatatccttgtcttgttccttgtcttaggggaaaaacattgagtctttcatcattcagtatgatgttagctgcagatgtttcatagatgtcctttatcaggttgaaggagttttcttctattcctaattcgttg

SEQ ID NO: 61808 - DNA, 1027 bp, Homo sapiens
tataatttctctctccagtcctcatttttggtaaaaacaaattatgatgggacatgttgttcatagaataaactttagtcttatacttggcgtgattatttgcataaagtacaagaatgattattaggccttttggattggctttgatggaactctgttccacaaggaatctcagataagacctcttaaaggtgagctcagacatgggttcatattctcaaatacctgtgagttgggtgatcctctcctagattttggatgtattttgaaggcagattgacagaatcttcttagagcttggatgtgagtcttcagagaagagtcaaggacagtgccatcacttttggcctgagttataagaatggtgagaccatttgctacaatgacaaggaggacagaggagtgggttttggggggaagtggaaaccagtgtgtttttggaaatgttaaatttgagaaatccaattagaagcttgaaggaggcagctggatctactatgctggagatgagaggagaggctggagctgcaggtacacctggggactcaccagcacacagacactgtggatagccatagtatagcattagagggatgcttaagggaggagaagggatctggggactggcatcagaagggttgctgtaagggctaagtggggagcataaagcaatcagctttcttgcctcccatccttcagaattcatgggacatttcttacctttagattttacaatttggaagtctactagaagagctgggactttttttttaagtataaatattttgctcatgatgacacaatttttatttagttacaaacctgtcatttgagatgaaaatggccctttcccagagtccctcctaccaggtggcttttcagagagaagggtggatactccagtgccctgggcactggctaagaggtatgctgaggggagccctggctgtcctgagcaagtcatctctggtaaagactgagcatcacatgctccccccttctctaggtttgagcccagctattccat

SEQ ID NO: 61809 - DNA, 1030 bp, Homo sapiens
aacatctgaggaatgaatatgcaatgagtttgtgtgattctgcctggcactgactcagggccctgggatgctcttgcgctccaccaaggctccttgctacagcatccagttcggcagtctacacagaatgtacttttggcctgtatgagataacctgcaaaacgagccaccaagttctacccaagaacaaagggtattgcttctcctctagcagagaaaagtgtgatttctgcaaggtcccccgaagcctggaaatcactcatgttgctctcttcccctgccacatactatggttgcacatctctaagagttggggattccatgggggaccctgtaacggcacctctgtgatatgataaatagatgtgcctcttttgagtaaggtttttaggggaggtgaggtctcaggaccctgggaaaaccaggtgggctataattcaccctcggtggacatgcagatgagagggtagcttttatgaatgcctaattcttctttactaagcaaatcgggtatcttctgttgatcagcaatgtcccagttctagcactgcagaaagaccagcaaaaagaccagcaattaaaatgtaaccgaggtaaagtcactcactagcatgtcaaaagccattaagccaatgctggtttataagtttatgtgctatgattagcaagcaagtagggaaacgaagcaggtctttacctagaattttaaaaataaacaatgcaatgaaatgccattagccacttcaccccttcattcagcaaacatttatatggcacttattatgtgcttgccacttgctagactctggggatggagtttaacacagtgtagttcatttcctgaccttgaaaaccctgctatcttgagcagtgtttctgtgtgggggcttggtaaaatatctgacatttctttagtggactattgaaaacagatgtaaaactggtattatataataatctgtaactcactttcttactattgagcacatgtaggtaatgtttattaagtctttcaatgatcatgttaaaa

SEQ ID NO: 61810 - DNA, 1040 bp, Homo sapiens
aagatgcattagagtgtggagaaagaaagagatgtggttctgagagggagtaactgaggaaatggcccgaaactggagggtcagggaagacttccctgaggcagtggtccttgaggtgagacctgagagtgggaaaactgaaccaagtgggaaaactgatccctctgtgctgagggatgttagtcgaggaactgaaggaaattgggatgttgggaacccagcaagggaaggctacagtgaacacccgagggccaatggagtaggcaaaggttgagactgcagggtgtcgtcaaaggttatcatctttatttaagaacagagaagagccatggcttggttgatgcagtgcagctgcactaagcaggatggggatacaggccatgtctggccattgcagaagaaggtcatcccagacactggggaacctggcacatctgggaggttactatgtggtaccacagaaggcagagttctcatccacctcattcctgacctgaatcctaggtgacttctgtgaaatcttcagagaagtgactgcaggagggatctccttgaagacccaaatgtcctgttctctgaaaaggtttctttaatgctccttctactctgtctctctctccaagccaggattagttgccctctctgtgggctcacaaccctgtagaaacctctgtagagtcctctccactcactggagggttctcgagggccaggaccatgtcttgttagttggaatgcagcctgagtcccagggacagcagccctttatggatgtgctgaaggaacttcaccttcgctaagagttctaccacagtctaaagccaggcaaggggcagttcgccagctctgcaggaagcacaaggcatcttctgatgcttcgtggcatctcaaatgaggctctgtctttgcactgcagatgggcccgaggccctaggggctcctgattgctatgtggttttcaagcccttggaagggcctgccaggctgccatatgtatgggcaacagccaaatagcctccttaagctacagtctctgctat

SEQ ID NO: 61811 - DNA, 1061 bp, Homo sapiens
tagagaatgggagcttctcccttgtgctatctgtgctgggctgcacatctctgtgatactgggagattgtgtggacagggacccaagggtgttctgagctttccttctgttaatgaacaaattagttggttgtgattattggacacataggagtggccagtgaaggaaaacagaaagagctggcctggtctctgtcttgtcagttttcactctggaggggaggcagaaaacacacacacacacacacacacacacagacacacacacacacttggatcttcttgtagagacacaggtataaacagtctcaggaacaacctatcacaacaggtctgtacacacacatacacagacaccccggacacacacacacagactccattatgcagacactcacaacacacacacacacacacacacacacaaacacactcaaacccacatgtacattcatgccatatactggcatactaacatattacacacagacacatagatgctcagacacaagagctcccccgacagacacacagacacacacacatccatccatcttctaatatagaggtgagcatagaggcaggatggagaagacccagatgggaagtgtgtataagtgtgtatagccattacaaaggaatcagaagcttgtattggttccatgccccatgccttccatgtaaatacattcattttttaaccctaaactattggtaattttgtctctagagactcaggtgtgttcattcctttgacatacacaggcaagaaagcaaaggaacttaaaacaacgacagtgcatgtatgtacagctcttgagtttgcaattagttcagccaacttttactgatgctcaactgcaggccctgtggaatgtcctgggcatacagctgtgaaaaagatgagctccttctgttccatgagctcctggactttcaaagtgaagtcatgttcaggagcctgggggcactgacacacactcacacaaacaccaacacacactgtccacacacatatatctgtgcacatatgcacacacacagacacttgcacacaagtac

SEQ ID NO: 61812 - DNA, 1060 bp, Homo sapiens
ctggagaccttcttgggagaggtggcttgggataatgcttttcattaaggatgggcggaaaggcctgtcttctgagagtccatggcagtgctgattcagaaccccagggccaggtgcctgtggcttgcacggggcgctttcctgccccgccttggcctctgagagctccagctgtgctctgagcaggacagaggaagtgactgtaccttgaagaagagggatcctcagaagacccagtggagccacatgggctgccgctgggctgtttcagcggtaaatctcccaggatgggacatctttggggagttcctcctgcaggccatggcagggctttgcctctagcaatgggacatcttctggggactcctgagttgaactggctggtgggggtcttctgcctggggattgaaagtgaccatgtttcagaaatcccaggctggactgctgctggaaactgctagaggaattttgtgctcttctgacttgctgactcaccaggccttatgggttgccctgtgtgctttccctgaggtttcaggctttggttcccaccctcgttttctccttggcagcatcccttccaccacccccatgatggaactgggcacatgtgggtacccctgtgcaggggcatgctggaagctggcgtcctaactccatgcttagtaatatcccttggtagcttgaaatctaccatggtggaaatatttacatcaaggaagttggtaaatgctacaagtcaggggtttatttacttccagagagccagttaaacctctcctagcataccactgcccctggggctacagcgtggcttgacaagctcaacagtacttgcctcattctctatctgtttggcctaaggtcattgccggaaggcacctatctatctcagggcagtgtttccagaggccactgtggcccttttggtctgctgtgaccaaatccctaggtctgacacaaggccttcttgttgcagtccggtctagctcttgccatgatcctggattggcctgaaccagtgcactgaagcatcttttacgtcagacacactgtcctt

SEQ ID NO: 61813 - DNA, 1041 bp, Homo sapiens
atggagtaaagcgaatggtagaagaggaatggagtaaagcgaatggtagtaggagctgcagtgatgatggtgacaggccataggaatgggtgactgtctgaggggtaggtgctgggacatgagccccagcatgggcagtttcctaacttccccaggccactggcccacttgccgtaaggggtttctgtgccaactctgggagaagcaggcgggtagtgtcccctcttccctcccctggcttaatccactcccccagagcccaggagaggagtttccaggtattgggagctggacacaggccagttggtctacagggagccccaggctctgtaccaggccaggttcttagtgcctaaggtcccccgccatcgcctcaggaggagaaaggaaaaaatgaaaacatggaatcagtgcgacaggggtctaattaccctgggtagcatcaagcctccaattttgggccctggtgctccttttaatttggggtgtttaaatatttacctgcaatggaggggaaaaaatcttttgggctgcaaggctattctggcagcaatgcactgagaaattcattaaaccacagttaattaggggatgaaagatacgtatatagctcattagctcaacccacataatttacatctctgaggatattcgaggactagctcagcttaggctctcagaaatggtgtcttgaaaggaaacctctcactttggctatttctttgggcatgtggcattagggagggggccatggctgccctctgtctgtccatccacgagagggtaaaggggcccaggcctcgctgcctcttgtgttcgccgctggagccagaggtggggctgactggctgtgctcctgctgccagggatgattaacgagggggtggcagcctccttgcaggcgcgctgcttagcataatggtgcggtgtctgagcaggctttaagctgcatcgaatccgatttctagatcagagacattatccccgatttaatctgtaatagttagagaaattagggcgggagcatcagatccacgtgtc

SEQ ID NO: 61814 - DNA, 1019 bp, Homo sapiens
tgactcttctgcttggctccctctttcaaggacctttgtggttatattgggcccatctggataatcccagataatctccctattatttatttattcttttttgagacagagtctctctctgtcacccaggttggagtgcagtggtatgatcttggctcactgcaagctctgcctcccggattcacactattctcccgcctcagcctcccgagtagctgggactacaggcgcccgccaccatgcccggctaattttttgtatttttagtagagacgggatttcactgtgttagccaggatggtctcaatctcctgacctcgtgatccgcctgcctttgcctcccaaagtgctgggattacagatgtgagccaccgtgcccggccctccctattttaaggatagctggtttgcaagcttaatgctgtctgctacctgtgccatgtagcctaacatattcacagatctggggattaggatgtagacatctttgagggccattattctcctaccatgttggcacacctgtctgtgcccaatatgcattgtccacctccactttccttccaccctgataatcttttgcatgcttgactgcactcttgcttactgcggggcatcctcttttgttcgctgggcctgctatagtcacttgggatggatggctatgtttcctttctgtttctacaaagctcaccctggaagcatcacactgtaagcctgtggagcctccacagacttgcctgtgttctccaatgacatgtcagcttcttttcctgggcttggctgctgcttgtgcataaggaagttcctggaggaaactgctgttcgaatagtcagactgtaagttggtgctgccgcttggacccagggcctcttttctgcctgagcaggttgttcttcagaacctcaccgtctaggcccatgcctacctacaccccaagggacggccctcgttgaagtcaatcttgctttgccgcccggggtcccacagagagctgctgttcctggtcccctcaagg

SEQ ID NO: 61815 - DNA, 3230 bp, Homo sapiens
accaatatttcttgctctgtttcctcagatcaatgtaaccactgtgcgggaatatctgccagaaggagacttttcaataatgacagagatgctcaaaaaatttttgagttttatgaatctcactgtaagtagcttttattacagcttatatgattttaaatttataatacattgacagtagacataaaaatactatggccatagtaagtgggagcaaaaagggattttcttttaattttaataatcgtgttctatttcttcaaggtaatcattgcatgttatggcaaataactttatcaaacccacaatttaatctcggtgtactttgatttgtagtgttcagtttagtaaatctagaggtaaacttttatttatacttcttaaaatctgttaaatattaactgttacttcctttccccttcaccctgctttcagtgtgctgttggaacaactggccagaaatctatctctagagtgattgaatatttggaacattgctagctgctttacctttgcttcaggtgctcggtaatgctggagctatccttagacaaagaaaagtcaagtcatgaaagaagtccttgaagatataccaagaacattcatcagtatcattcgtgtttggatttttaaggccacctgatttcttcgtcatgcattcggcatttgctaaatgacagttactacatcaatctgcaactatcaaaaatgaggggaaaaggttcaggctgttaacaattccatgcagtatttaaatacatttactttggcagagtttataccctccccttgttttcttgctttattctgggcaagtttgaaggggaaaatttgtgctgctgttagtgcaactgctgtgtatgttgagccactgttgtcatgccagccaggtgcaaaggcagcttagctactgaggtagcgaatgttctgaggacattctagacaacagcttagttcctttttcaggctcatttgcttttgcttttttgttgaatgattccaatcgtaaataaagcttttaataattttgtgaattttttggttgttgttccctgaactactgtctatatttaaaattagatggaatccaaagatacacgggattaatagtatatttttttattcttgattaggtttgggttattgaactattttttacttttgagaccacaaccatattcaatatcataccataatgtgtcatagctataggcacaagaaaaacaacagtttgagagaatattatataagatgatgtgccctgttaaaaggaggaggcaaaatagtcaaacccagggtagtttacacttaatgctagggaggctcttaaaacattattagattttgaggaaagactctctagatatattttctaatgttcagtacaataaatataaggaagctaaaacaccaatgtggaattcctgtttccagataacatgtatattcttctatagagtgacaggatcaattgcataagcgcaaagccttaaattgctggtttagagaagacccttttttcattcagattctttgttcgtagagcagttatttgaaaaacagttatggaacacaaaacattttatagatttaatatcataacattgcaaatttttcttgtattattcacaccactggttatacttttttttttccttttttattgattgggcctgaatacaggctttctagagatctttttcattaatacttttaaatacctttcaggtagttacatcatgtttcttcattggatttgtaaaacttgaagccataaaaatattagtttggtgtgtattggggaaaatagctaaaagtctaatttttacccatttagactttgttatttccttgtataaagtgacaaatcggggctcttgtatcagtgccagctgtaatgtttttaaatgcagtggctgccttctattgtcttcctatttttgataatgcagattgttgggaaatctgtaaggaagtaactgattccaggcaaattgttttcttccttctacccaccccaacccctacccatcaccttttaagaacatagtacgccagtgtaacgtgggaaccattgagattgtatttgccctgagtattaaagctagcttagcaaaatacttttaaaaacatattggtaaatgatacccgtaaaattaaattagttatattttattttaaaatgcaaaatacattgatatttattaatcattggatttagggaaagggacagatttttggtgaacctgacttgtggcagatggtaaggaatattataaaacatttggatgagaacaatcagggcgaactgcatttttctgttacactggtaatcatttgaaaattgatttacctcagtgtttaacagttttttgttttgttttgttttttaaataataactaattgtcgagcactgatagagatgcagattttggtggggggaggtggtgggggagataatcacttcaccaactgcagtgcatttgtgtgtttttaaccctcagagaactctgcattttagggtacttgaggctgacttaactaaaagttttaaagtaaccttttttccattgtaaatatttctgtaaatactaccaattggaaattagaacagtagagtacttttctgaatccaatcctatttttattttatacagtatttctcagctgtgatctttggagcaaaagccaacggcaggaaaaaatagtttgtaccagtttcatgaagtatgtctttgggtttttgtaaataattttaactcaaataaaattgctactttcaatacacatgttgtctttaacataagtctattggaggacagaagtgtcacaaactttatatatagccgactctaatgggaaatacactatcacttaacacatttaaccagtttttgttaaatattttattatttctccatgtttttaataatactcatctgaatataatgtgaactcaacaactcaggccaattagggactggattttcagttaggcccttggcatacttaactgttttgatttaggttattttttgctcctatgagtatgatccaagacatctttgcttctgaggttttacactgctttttagtttttcagttttcttcttaattgtcagcccttaggcatcctgcatttacaagtagattcctcaacttctccttactgcttttagccacaaaactagattgaaggatctctcctgggagtttccattactctccc

SEQ ID NO: 61816 - DNA, 1249 bp, Homo sapiens
gaccaaagttctcatcgtggctctggaggccccgcaagatctttatatccctttttcttatttccaatgacaagattttaagagcaaatcagaaacccatcacacacaggaaaggaggaagaggcaggcctcaaaagcagtgaaaaaaggccgggcgcagtggctcacgcctgtaatcccagcactttgggaggccaaggtgggcagatcacaaggtcaggagatcgagaccatcctggctaacacggtgaaacggtgaaaccccgtctctactaaaaatacaaaaaaaaaattagccgggcgtggtggtgggcacctgtagtcccagctactcgggaggctgaggcagcagaatggcgtgaactcgggaggcggagcttgcagtgagtggagatcgcaccactgcattccagcctgggcaacagagcgagactccatctcaaaaaaaaaaaagcaatgaaaataatatttaaatttaaagatttttagatactctgttttttacacactataggtttagtcatatttcagtcacgttctttcttacataatcgttcttgaaattgtgttattaccacatatgatttatcttgggccatctttcccatgctaattcctatttgtgtttgcctgtatctatcttgtctctaaaaagagaatgttcttaaattgtgggaaatgttgtgaattcatagagccccagatttatttgttgccttggagattattatgattaacaccaaaaagctagctgataccacaaaatgtaaaggaagtttggtttacctaatgtgtaagtgaaaagagatagacaagaaagcatgtggttgttgcagtaaatgctgctttgtggtctgatcccattttcacttgccctccatgtcttctcactttgcagctggtgcattgcagtggtcagtctcctcactgctcttcctgctttgttgcccctccattcctgggacattgcacattgccactggagctaacttacttcagagcacttactgatcacgtagctccttgcccagtcttccttggctcacagccaggaaggggactcatgactgtttagtgttgcaagaccctggacttaagactgcttctccaatttccaaacctactggacacttttaaaatttttcaaataggccatgctgtatcatgccttttctttttgtacctgctatattctgttaaaaaatgctgtcactgtccctcccattgcctcagaaacgctgtatgtcat

SEQ ID NO: 61817 - DNA, 1033 bp, Homo sapiens
tcgaactcctgggctcaagtgatcctcctgcctcgacctctcaaagtgctggcattataggtgtgagccacagtgcccaccccatttctctctttaaactgctgtcctccacatgttgtcctctgctagcccttatggtcccgtgctgactacagctaggtgtctcatcaaattaagtagtgcctagcagtaatagggcctcttcctctatagtttttttttttttttcataggtgcattggctggaaatacatatctttttaagacaactgtttgtttatttcccctgtgggaccccatgccactctcacccctcaccaggtagacttctcatcttggccagcattgggtcacaatgcttttgtctgaaccagtcactggctgggaacatgggattactgtgagtggattagatcatcaggattcacttaggagaaatacaaatgtctagacaatcaggctgagtcagcctgaaagtgaaaggttgtgactatggggatagtctgctgccttgggaaaaacaaatatgaagggtaaaactgttgaagaagggtccagcagaatcattgtgagtgttctctttcagatggggggttgggcataggtggattatttttaagtgtaaagtccatttgtaaagccagattttgaaatggaaggcagattgttttctaggagcaagggcattgagggaacaagaaagagtggagacctataggaggggggcattagtttcagcaggaagcaggggccatctctttttgaagctggaggactggaagaacagagttaatgataaatgaatggctttatttgagcaggaactcatgctggctctgtgtacctgggcccatctacccaccccacgtttccttactttagccatctaattctttgtattgcctttttttttttttttcactttgtgtatctaagtcctgtgtgtttttctgaatccatcttgtccatctcttccatacttaacattttaactaacctaaatacaacagcccactctgtgtggcccctctgg

SEQ ID NO: 61818 - DNA, 1097 bp, Homo sapiens
ggctgattatagggttgtttaaattgtttgtttcctatggaggaaaaatggcaagaaaatgtgttaacatttccagtagtttttttttttttttttgaggcggagtctcgttctgtcacccaggctggagtgcagtggcgcaatctcggctcactgcaagctccacctccctggttcccgccattctcctgcctcagtctcccgagtagctgggactacaggcgcctgccaccgcccccggctaacttttttttgtattttttggtagagacggggattcatcgtgttagccaggttggtctcaatctcctgacctcgtgatccgcctgccttggactcccaaagttctgggattacaggcgtgagccaccgtgcccggccatttccagtagttttatttaaattacctaaatagttttaaagtaaaaactttagtacagtctgtattggaaagggaatgtatagcattttttacatgctaatcctttccaatataggttttactaagtaaggcctggagtggagtaaattaaattgattttcactttttaaaaagtgaaataaagttgatctttatggctttattaggaaggatgtgcctgtcagagttaggctgttaaagatgtaagaaaaagcagttctggaaaacaagctagtcagtgctttaatctcatgaaaaaggaagaattacatacatgaaataaaattaaaaatcaaaatagtatataatattaaaaactttaaaatacttgttgagctttttcaggtacatcccaaaggtcagaatactaatgaaaaagctcttgtggccgggcatggtggctcatgcctgtaatctcagcactttgggaggctgagatgggcagatcacttgaggttaggagttcgagaccagccttgccaacatggcagaaccatgtctctactaaaaatataaaaatttgctgggcgtggcggtgcacacctctaatctcagctactcgggaggctgagacgcaagaatcgaatcgcttgaatcctggaggcggagtttgcagtgagccaagatcgtgccactgcacttcagcctgggcttcagagtgagactgtttcaaaaa

SEQ ID NO: 61819 - DNA, 1169 bp, Homo sapiens
atctttgaggtctacttggcatttgattttcaggcaattctttctagtaacttggagcatttcccaaattgtgtcagtgttttttctatgtgtcagtactataccagcatagggaaaataaagtaagtgaaggcaaggaatttagcatattcccttttgacttaagaattttccaattttgtatttttttgcttgaatttcttgtattatgcaaattaagggaaattattgagactcattcttgcatcattattagatgacttcattgaatcttagcagcatttatactttcgttttggctttcagtagggtgtagagcaaaagcttttacttatactcacctctttttatcacataaccatcttagagttagtgatagatttaaaagcaactataactttatatttgcatatatgcatattgattggcaatctctttttaatgatcttcaaaaataatttttatcagctattccttgagcgagagcgggcagcccagctagcagaaagtaaaacagatgagttgatcaaagatgctcccaccactcagcatgataagagtggagagtggcaagaaacaagtggagaaatacagtgggtgtcaactgaaaagactgatggtacagaagagaaacataagaaggaggaggaggatgaagaacttgacctcaataaaggtatatttactttgaatggtgtatttaaattgaagatagtggtttgattttgtttttttcttcaaactattttaatttgcagattgtcttaatctggctattgcttgaggacctctctagttcagtccagacaagctttgatacttaagtgcttgtggtagttctcccacagtgaggaaggtgcgtgccagtggcaggcatgctagtgacgggaaagatccagttaagtcactcttccttccggggccctcctttcctttacttatctgtgaagagacatataggagacataataggattttttcagttttcagtttttgagattgttttttcagcttcactttaaacttgaagatctattgtcagattacagtaatagttctcaaagtgtaagtactagatggtaaacacagtaagaaatatactgtaggctggtggctcacacctgtgagcccagcactttgggaggctgaagcaggaggattacttgagg

SEQ ID NO: 61820 - DNA, 1203 bp, Homo sapiens
tcgaggagacatgtcaatttgaatgaacttaaattaaaaaataatgatttatactgtcaacgttggtagtgaaggtaataaaaataatgatttgctctaatgcgtatgaaatatttaatacttgtctttacattaacatttgttatgtagtaataacatttactacctcagaagtgtccaacattagctgttaaccatttgccctgtttgagaaagggttgtggtctgtctcttatattggagagatcaataacatgcgagacaatttggaaataaagagattactagtggtaaatgtagatagtacagatataaacttctgccataagtttttaattttaacattccttgaataagttttttaaggtatcagatttttccaaaataaagtgaaatttcatccgatagcctttaggttcaagtaaatagaaatttgctgtgtacctattattatttactataatagtctatattttatttccttttaagagcattacagcattgtgaagaactgattcagcagtacaaccgtgctgaggacagcatatgcttagctgacagtaagcctctgcctcaccagaatgtaactaaccatgtaggcaaagcagtggaggactgcatgagggccatcatcggggtgttgcttaatttaactaatgataatggtaagatttttttccatttttttctcattgaaagatgtatattgcatgtgaaaacaagttatttttgtttctccttttcctggggtagtgatttttttatttgtcataatgtacttgacttactcatgtgtaggtttaaattgcttttaagagttgatatttttagaagcctagtagcttgacccagaagtatcaatagtatgtttcaatagaggaatgactatacaattctaagttaatatccatgttaataaatctccattattagtgttctaaggaagaatcagtaaccattttcctgtatccatttcttatttcagagtggggcagcaccaaaacaggagagcaggacggtctcataggcacagcgctgaactgtgtgcttcaggttccaaagtacctacctcaggagcagagatttgatattcgagtgctggtaagttgaaatgactttttcagaaatgagtatcatatctaataaggtgtgcaaaatgttaaccttagtttgggtttaagaaccaaccctttaatatattgt

SEQ ID NO: 61821 - DNA, 1022 bp, Homo sapiens
tgaccaggctggtctcgaactcctgacctcaggtgatccacccgccttggcctcccaaagtgttgggattacagatgtgagccaccgtgcctggcctattttatatatatttagcactctcttttttttttttttttttaatagatacagggtcttgctatgttgtcccagctggtctcaaactcgtgggcttaagtgattctcctgccttgacctcccaaaatgttgggattacaggcattagccactgtgcattgcctgtatttagtgctcttaccgcatgcattctggttgtttgctaccatgtttttacccttccttaccaaagattattgaagttaaatgtttctgatttcattttcttttttaaattaagaaaaattgtgtatgttgtttctgatttaaaaatatctcttttgtatacttcataacctctgacaactaccttgtaagaggaagtatttgatatgacaggtgctcttttgttgtgattaggaaattcaggccaaatgtcttggaagtggcagtagaggtcagaattgagtgtttgtaaaagagcacttatctctaggtttttaagcttttcagcagaaaccatgatcaattcggagatagcatacagaaagattaaataacatatgctgaacctccttttgtcttcaaagccccagtttagcccagcctgaaaacagttgagttaccagtgacagtatggtaatcctgaccagcattcaataccagaagaacaaattattttaggttagacatgaggaacaccttcctgaccaaagggttgtaaaatattaagaacttttacagaacttcctcagtatgttttaaagggcaactaggcgtagattagatacggtttctttaagaattttgtgtgatatataatgcatgaagaatcaactgacagagtgagcttacttgatttgtattaaacttaaaaatcgtggacttggtgatttaaatagtgtctttagaaatactagacccattagggattatatttccttgtt

SEQ ID NO: 61822 - DNA, 1140 bp, Homo sapiens
acaaaatgacagtgtggattccagcttgataatttcagctgtataacttttgtaatgtacaaatcaagctctttacaagggggataataatagtggctaacccacctaggatttttattacagtaaaatgagttaatttgtatgtttgtaagaaatatatacatagtagatatttaaaaatatgtgtatattaaaaatacatataaaaaatttaaatttaaatgatttttaaagtatcttttgtatcatttgtgatacatattaatgagttaaattagttaatgtgcaaagcctagaacagtacttggcgtatagtaaatactaagcatttttcctcattcttgttttaaatggacttttctctgttcttctgcactttatttagacctgtttttctatatctgtatgtagcttcttccattccacatttatttcttcccacatttcatcacaattaggctaatgctgtcacctccttgcaggtaaaattcccaagtatgtctccagtcctggttctgtcttattacagcaacctcttcctgatatctctgtcctagttcttgatatctgccctagttctctggcctttagcctatccagaacaataccacatggagttaactttctccaaatcgctgctttgaaaaaataattttaatttctcaaatctctgattccttattgtctttggatatatgtacaactttcttattgaagtcagccttatcaaaggcccattgcagtcttactctagtttatctgttttttaacctcttattttggaggaattcaaatataaatagtgtaataaactgtaatgtacacattatcaatcatggccagtctggtttccatctgtaacctcatccattccctctcctgtattatttgaaacagatccagatattatttcgtccataaatacttaagtacataatgcctagaagaaaaggactcttttaaaaaatataaccccagtgccattttcatgccacacattattagttgcttaatattttatgtttagtcaatattctaattttcagtagtctcaaatttctagtctcagtagattttcttaatctgtaggtttttaaaatctcctttttttgtcttggatttgtacgttttgtatcttgc

SEQ ID NO: 61823 - DNA, 1594 bp, Homo sapiens
ttgaaggggagaaacttagggagaaaaaccagatcttgtcagtctttgctagttaaagcatttcttttgttatgctgaagttctttattgcagcaggaaccaaattgctctttgttgggaagtggctgtctgctttaaaaagaaaaacaacagccaaagtgaaataaagggcaataaaaactttactcaggttgtgagtgtggctcttagcttttgtactcttctggtggtggtcctaaagcattatttgtatacagttttgtcatcatggccacatgatgaatatctgagctgctaagcccgcagtatgccctttaaaaactagtcagtctgcaacactaaagtgaacaaaggatttgtatgcagaatagacaaaatacaccaaataataagaaaagacaatcagtcttgcaggaaaatatggaaagaataatgaacaggagtctcatagtagaaacatagttaatatgtgaaaaactgttcaaggttactgtcgttgtaaaaatacaaacaaaagcagtatgttaccattttgtaccctcagacaaaaatgttaagtgataacttgtacttttgaagattcagggcaactggcactcccacactttgctcctgagagtgttacttgttaaatccattgtggtaaattaatccaatattgatttacagttaaaaaatacatgtaccctttgacttagcagttccacacttgacctgtatactgtagaaataagagtacctatatatatgtataatattaaactgacaaatgatagactaatagcacattttctctatgaaaagctggttaaaaaactttgttcaatgtggactattctgataaaattgaaaattagttcaattttatgtataaaagtggtgttaaactacatgtagcatgcagtaaatttttgtaaagagaaacaatttctagagttattgctaaaagttgatattcattaatgatgcttctggtttttagactgggcatttagctatggagacattattatcccttacttctaaacgagcaggagactggtttaaagaagaactccggcttttgggtggtctggatcatattgtagataaaggtatgatatttacatttagaatgtttttatatattatttaaagcctgaagaaaatactccattgacgtacttcaaaaaataattgtatcagtttggaaatgtctattatcattattattttttagttgcatcctgcaaatttctaacatttaaagaagaggccggccgggcacggtggctcatgcctgtaatcccagcactttgggaggccaaggcgggcggatcacctgaggtcgggagtttgagaccagcctgaccaacatggagaaaccccgtctctactaaaaatacaaaactagccaggcgtggtggtgcatgcttgtaatcccagctacttgggaggctgaggcaggagaattgcttgaatgtgggaggtggaggttgcagtgagccgagattgtgccattgcactccagcctgggcaacaagagcgaaactccatctcaaaaaaaaaaagaagaggccattaacattttgatattgggggattatggaaacaa

SEQ ID NO: 61824 - DNA, 1040 bp, Homo sapiens
acctgttatcccagcattttgggaggccgaggtgggcggatcacgaagtcaggagatcgagaccatcctggctaacaccgtgaaaccccgtctctactaaaaaaatacaaaaaataagctgggcgtggtggcacacaccagtagtccgagctactcaggaggctgaggcaggagaatcgcttgaacctgggaggtggaagctgcagtgagccgagattgcgccactgcactccagcctgggcgacagagtaagactccatctcaaaaaaaaaaaaaaaaaattttttagagggaccgctgaataaaacgtttttgaagtttccaacatggttagtaatataagttttaagcattaacttgtaaacaaaagtcattaatagtcttatttcctgagatgtcaggagttgcttacatgaagttttttttcttttctttttttggcctgttgaagaatctgtccctctgtacagctgccctcatgtatatactgagtagagatcgtttgaacatggatcttgatagagctagcttagatctaatgattcgacttttggaactggaacaagatgcttcatcagccaagctactgaatgaaaaagacatgaacaaaattaaagaaaaaatccgaaggctctgtgaaactgtacacaacaagcatcttgatctagaaaatataacggtgggttccttcttccttccttctaagatgagaattactttcagaaagtctttggttagttgcagtagctgtgtgactgtgggcaaattattttaattctaaccttggtttacagtttggcaaatttcttatgtttagatctgagcataatttcattccttgcctgaacttcctaaactagtttatctgtatttaggctttttgcccaataaatagttgcacattttctgttgcattttgtctaatccttttctctttattttttaagaaaaaaaaggggccgggcacagtggttcatgcctataataccagcattttgagaggccaaggcaggtggattgcttgaacctgggagtttggg

SEQ ID NO: 61825 - DNA, 1099 bp, Homo sapiens
gttctttttacctctgatgttcaagtaataagttagatttatttaagcatattgtgatctggacgcttacatttgtacccaaatgctcaaaaagatgatcttttgtatttcctaatggattgattgaatactataattttgattaaatttttcagtcatttggagtatatccaatcaaatataattaattaattgtgatttttatcagaagtattaatgaaaggcagctcagattttaagcttttaatggtggtagtagtaacgtaaggaatgcactaaagacaattacgttatttttttaaaatacagtgtacctaatcatgcactaggcatcagtatatttttaataatgtgttttgcctatggtttttatattgtgatcatgtatgggcaatgctttgacccttttacccccttcctatttgctggttttggtattacacaaactcaaaactaatgtactagctgtttccagcccccctaacctgctctattttcttgtagtgttattagcttggctactaaatgtgccatgcccagttttcgaatgcacctgagagcacatgggatggtagcaatggtctttaaaaccttggatgattcccagcaccatcaggtattttttaagtttctgagattgagaagccttatgttgaaaactactagtctatttggctatcaaaaatatcttcactgaatattctataaatatatcctaattatagattgagttcattttatttgctaaatttgtagtgcttatggccagaagcttttgcttaatacttattttatcatgaaaacgtgaaaacattttttcttaatgtgtcattttatacttttaaaattgtattttgttatcttagctaatgtagtatattgatacagaattttgtaagcataattttctctataatcagaaagcactgagaagaatcttttaatattatttgatactaatgaatggaaaaaaactggtttggaaatgcagccctaattttttagaaacgtttttgtccagtgttgaatctggaacatggcctcattgtgataaggaataatttcttcattttccttgcctttgatgcttttgcataat

SEQ ID NO: 61826 - DNA, 1057 bp, Homo sapiens
cttcttaaactgattagactccttttgatagtataaagaaatcattttgtatattagtagtaatatagcatgctcctgttatagctatttatttttaccctaaactacttcacactcttgtgctactaaaattcttttgactctgtctggtttttctgtcctgtccctttctgcttatgaaagctatttttgcatgcagttgtggttctttagtctttctaatggtactagagacaaacgacaaattgtgtgaaataaaaagtttaaaaaagaccagaagaaatccttgagtggttcttctgtgtgcagatatacatatgtcttacctgttagtgcatggaattcaaagtatttctaaagacctttgagaggcctccctgctccctgctttttaaaaagctttatttacttttttttgaagctgaatttgccagatagatgagacgttcctatttttatatatttatttagaacaactaatttaatacctttattaataggtgaggctgtcttcaaaggaaccaaatcaaaaagatgatggagtttttaaggctcctgcaccaccatccaaagtgataaaaactgtgacaatacctactcagccctaccaagatatagttactgcactgaaatgcagacgagaagacaaagaagtaagcagccatatacagtgtttactgcatgttgatagatttttgtatgtaacatttagccatttaatatcttcaacaaatatcagtatactgatactcagttttgaaccacaaacttcttttgtcctaccatcatccttgttctaaaaatatttttgttgccatctaatgaactattttatgcacttatgtaaagtacagtgagcccatagatttaaatatgctagttcctagttaaaaaggggtgaactttttttttcttggcagttatatactgttgttcagcacgtgaagcacttcaacgatgttgtagaatttggtgaaaatcaagagttcactgatgacattgagtacttgttaagtggcttaaagagcactcagcctctaaacacacgttgccttag

SEQ ID NO: 61827 - DNA, 1943 bp, Homo sapiens
gtccaaaccatgtatttgaagttcaaaacataatttaacgtcacttttgtagaggatagagaggatgaggtgttacctttctattttgtctttgtaattatgcagttttctcttgaaagtgagggttttgttcttttacttgatttgattttgtaggtttactgtcatttattctcaattcggaaattcagtgttaaaactgaaaatcccctggaagtttaagtaaattgatagggcagcacaataacctcaattgatgtgtgagggactttacatctttgtcctgcttagtgtaacattttgctgcagaaatcatgtatgttattacatggtacttttttggatcccactgtgtcttggaatatgtggtatatgtattatatttaccttgataaaatttgagaactcttgagtggtggcacacagctggctgcagtggtttgctttaaatgagcgcattgtctgtcataaactgctggattcccattgttggaagattgtgaggcatgaattggtagtaggaagaataaagttttgccaaagaacccattgaactattattattatcatcattactattttttaaatttttttgagacggagtcttgctttgtcacccaggttggtcttgaactctggggctcacccaggttggtcttgaactcctggactcaagtgatcctccttcctcactctcccaaagtgctgggattacaggcatgagccatcatgcccagcccatgttgagttaaatgtgttgattacttagtaagcctagcaagaggtttaccttttttttttttttttgagacggagtctcactctgtcacccaggctggagtgcagtggcacagtcttagctcactgcaacctctgcctccggattcaggtgattctcctgcctcagcctcccaaatagctgggattacagatgcctgccaccatgcccagctaattttttttatttttagtagagatggggtttcactatgttgaccaggctcgtctcaaactcctgacctcaagtgatccacccgccttggcctcccaaagtgctgggattgcaggtgtgagccaccatgtctggcctaggtttactttcaagtgccatcttttcttggttagtcatagttgcacagagcactaattactgattttgtgacctagtactacagtgattatatttgccatagacatgagaatgggaattatggtgggactgttcccagatagtatccatcctgctgtttctaggacatgtttatgcatataaattattctttatgatttttagttgagagtcttttataaggatggaagcagttgatctttctctcatttctctagtcacccacaaaagctgtatataatgccagacattggaatcatccagattcagaagaactgcctgggccaccagtagtaaaacctcagagtgtcacagtaagtgaactgtacttatttattttgtgttttttaataagctataaattaagcagttactcttttaattcataatttgtaaatctttgacttttctatttaacagtttattttggctttctttactgaaacttattagtttcagtttaattcattggaaaactgaggattgtcagtaagatagcagaaattctagtgctgctaggttaaacaatgaaagccataaaaaataaggctcttgttactcatgacccacatttcatggaatttatagtatttagtgtttaagagcaagattgtccatatttgatgtttgtataagagctatgttgtgtattacatcctatatatatttctaagtggctttcagtgcttaatttgcttttcagagacaaatctcttcctgtattctagtaatacttttcaatccaaaacattaggaaaaagattcttagcaacttattttctccagaatgactggtaatatcatacatgatttc

SEQ ID NO: 61828 - DNA, 1051 bp, Homo sapiens
gttgattcgggcagagaagaaagactttgcagctttatttcttctcgttagatgtggattagattctctacagtgtttcatattgcatattacaatttctaattcttgatagtacagatgctgttggttttaatttaggagtttctgtagtcttccttcaaataattcaatactctggatatttaacatgtgttatgttttttatagtttaagaccatttgagattgtatgattatgcttaaaaggaagttgtaaagagctcaaagattctttgtaagacttttcttctcctgcttctgattccaattgtcttttttaaaggatttttataaatcctttaaagaaatttttgacaatccagatccaaattgtttttttctacttcccccttttgaattgccgctaaagtactgtgcacacatacacacatagttatgcattgcagtacttcttcagagttcatttagttgtacttcgtgctgattgattgaattactggtgatatccttgggtggataaagctggatgaattcttatcagcttactattttgtcttcatatagcacatagtttttaaaacgtataaataaatttgctcttcttgttcataaagtatttatggcttaaaaacattccttttttttggctgtgcgctgtggctcacgccagtagtcccagcactttgggaggccaaggcaggtggatcacctgaggtcaggagttcaagaccagcctggccaacatggcaaaaccccatctctactagaaatacaaaaattagccaggcgtgctggcgcttgtaatcccagctactcgggaggctgaggcaggagaatcgcttgaacccgggaggcgcaggttacagtgagccgaaatcacaccattgcactccagcctgggcagtaagagcgagaaactttgtctcaaaaacaaaacaaaacaagaacaaaagaaacccattcctttttttcctggcttttatgagccagcccagtgggggataacatgtcatttcctcttagattttcaggaaggaatgctttctttcctc

SEQ ID NO: 61829 - DNA, 1455 bp, Homo sapiens
cagcctatacctttactttcatcattcccctgtggtttaaagctaggcccttctagcactatcttttgtctaactctttaaggaacattctggacttaattttttcttcccatctgtccttcaatatgacactggatagggggcttctgggcaattaaaatttatcagtataaatcatggttacatatttagttgttttagaatgttgtaattacataaacctgcagttttaaagttgaatatagctttatactttgataaacttcattttttgttttataaaatgagtttatacgggttgtcaacttactagcaaaatcttacaattgaagagactttaaaggacaagtactcccacatctcacccaagaacaaatgttccttccacacagtgtcttcctttagcagttagaacccactctcatgaaatagcatatttttctgtcagaacagttttacccagtgttacctttgttatatgtatggggactcactgactatcttgagatccagtcatcatgtggtattgtgagatccactatattctcaagtactagaaacctgatatattaattgatatgaagcctgaaaaaaagaatgactgtagcaattggattggtgatgagggaaactggcaaaagtgtggaagttaatagctgctgccattcacttacagctcctgggtgggtgatccaaagagttgttgaagctgagcaggttctggctgggcctaggtatggaagagagggagtcggttttagttggctttttttcatcattgtttttgtttggtgtttactacatgactttcactgtgctagggatacaaaaatgaataagaagagtatcttaaaaaggcagaattgttttttcctactggaattttgagcagtcttagtatttcctcagtgtgtttgttccaaaccagaagcatattgcttccttttatataggtagtatttaacttaaatattaaaccaggtaattaaaatcattgatctgtataagtcaaaaaggcttaggaaaatgtaaattattttctctctgtgatccaattcttgtgcttttttttcctttaatactttattctggaaggattttaataagtaatgaaagtactgttaatctttttttttgttttggatatggagtctcgctctgttgcccaggctggagtgcagtggcgcagtctcagctcactgcaatctctgtctcttgggttcaagtgattcaactgccttagcctcttgagtagctgggactacaggtgggtgccaccatgtcctagggctaatttttgtatttttagtagagacggggttttaccatgttggtcttgaactcctgatctcaagcgatccgcctccctcggcctcccaatgtgctgggattacagatgtgagctaccgtgccctgcctaatcgtattttctttagtataggtgcctttaaagtt

SEQ ID NO: 61830 - DNA, 1187 bp, Homo sapiens
tttgttttgagacagagtcttgctctgttgcccaggctggagtgcagtggtgcgatctcagctcactgcaagctccgcctcccaggttcactccattctcctgcctcagcctcccaagtagctgggactacaggcgcccaccaccatgcccggctaatttttttttggtattttttagtagaggtggggtttcaccgtgttagccaggatggtcttgctctcctgacctcgtgatccacccgcctcggcctcctaaagtggtgggattacaggcgtgagccaccacacctggcccagaaagcatgaactcttaagcatacgtgtctgtgagaatttcctttagtgtctcccaggaatatagagttgttaatatcaggattgagggctgactcagaaagaagatgagggtgaagaaaacttgtagtaagaacatagttgaaatgatgattcagaaaagttgtcacttgctggtgagaaaaagaaagataggatttgataaatagggttgaaacatacctggatttaactacctattgtttctaggtaaggttttgatcattgagcagttcttggtactttcgttcatgaaatgtcatccagtttctgatttctggctacagcttccctacatgccattatttgtagctgtcatatgtgtgctgatatacttagattatttcttctgcttgccctgcttgtggtttgacttctaccttttcattcagctgctgcctgtcatccctgcttgtaagcattcattgtctgtatagtcaggctgactgtacaggttttcagtgcttgcggggttggttgtgttttacctgggatgttggccatcttgttttgcagttaagactgctgctgggtcattgatgaaactaaccataacgtcaatctcagtttcaattctccaatatttatacctttacgttctttttttgttgttgagacagggtttcactccagttgctcaggctggagtgcaatggtgtgatcatgtctcactgcagcctcgacttcctgggctcaagtgattcctgtgcttcagcctctagggtagctgggactataggcacacgccactgcgtccagctaattttttgtattttttgtagagatggggtttcaccatttttcccaggctagtctcgggctcctgagtctagccatctgccggtctcggcctc

SEQ ID NO: 61831 - DNA, 1914 bp, Homo sapiens
cttatgggcagccctatcccagataaataaaaacactggtagaaggtttttattaactgttcagttggtttaggttttactaaatgatttttaatttaagcatctttatttgaaaagcccataatacccctaagaaggtttggctgagtcatttacatgtcattctgaatggattcagttgcttaaccctgctgaaatttcttgtgagtttacaattttaagggacttggttgcctgaggaaaggtcagtagaaggcatgagagctatacactgaaaagataggagaggaaatgtctgatatgtaaatgttaatttcttcacaacttaaaattatttgcagttcttccaagattgatcatatactattgattaaccacatatatgttatttattaacttttatgttgataccactcatgtttttatcctttgacttatttttacagataaagtggagaattttcatgaagaacatgaaaagaatagtcaccatattcacaaaaatgctgatgacagtactaagaaacccaatgcagaaactacagtggcttctgaaatcaaggaaacaaatgatacttggaactcccagtttgggaaaaggccagaatcaccatcagaaatatctccaatcaagggatctgttagaactggtttgtttgaatgggataatgattttgaagatatcagatcagaagactgtattttaagtttggatagtgatccccttttggagatgaaggatgacgattttaaaaatcgattggaaaatctgaatgaagccattgaggaagatattgtacaaagtgttcttaggccaaccaactgtaggacgtactgtagggccaataaaacgaaatcctcccaaggagcatcaaattttgataagctgatggacggcaccagtcaggccttagccaaagcaaacagtgaatcgagtaaagatggcctgaatcaggcaaagaaagggggtgtaagttgtgggaccagttttagagggacagttggacggactagagattacactgttttacatccatcttgcttgtcagtttgtaatgttaccatacaggatactatggaacgcagcatggatgagttcactgcatccactcctgcagatttgggagaagctggtcgtctcagaaaaaaggcagatattgcaacttctaagactactactagatttcgacctagtaatactaaatccaaaaaggatgttaaacttgaattttttggttttgaagatcatgagacaggaggtgatgaaggaggttctggaagttctaattacaaaattaagtattttggctttgatgatctcagtgaaagcgaagatgatgaagatgatgactgtcaagtagaaagaaagacaagcaaaaaaagaactaaaacagctccatcaccctccttgcagcctcccccagaaagcaatgataattcccaggacagtcagtctggtactaacaatgcaggtaagaatttaaaaaatatgtataataagtacaatagttcccccttacctgcagtttcactttctgtggtttcaattacccaaggtcaaccatattctgaaaagaggtgagtacagtataataagataaagatcccattcacataacatttattatagcgtattgttaaaatcattgttctattcttagtcattgctaatctcttactgtgcttgatttataaattaaactttatcataggtatgtatacgaaaaaacatagtatatacaggttttggtgtactattcctggtttcaggcatccactaggaactggcatgtattccctgttgatggctgggggggctactttaaatgtgtttttcaggcttgaatcaacagctgcatagtttcttcctagatactcaagtttagcttgttatatttattaaaagtacctgtt

SEQ ID NO: 61832 - DNA, 1042 bp, Homo sapiens
atgtggaagttattcataagtaattgtttctgtagctttgcggacaatatatctttatgttaaatctgttgttggaagttggttggtgagaccaaccagctaagtgggataattgcttcccagtctatgtagctaaaatgtagttctaatgctgatactgtggactgactctgagtccaaactccattttaattggtctgtgaggggaaaatacatactaaaatacaggtaaatagatgttcaggaacatcttgtccatcttccttcctccttcacaaagggtctcttagtggtcagggaatggtgtagcactatgaatatttctttttttctcctctcccttggtcatccagagttgcaacaaccttggcagctccctgtaggataagaagtgaatttgagggagtgcatttaattttcatggtagacttatcctgtctctaatgtgtgcaagttagttgttcttataaaccatttgtaagtttgtatgtttgtaagtttgttatagttgtggggatgcttttgtactttgtgacttttcctttgtctctcccctctaaactggtcatttctcttgtgcctagactgttttcttgcattatgtctgtcaattttcattgcctttactctcactcagaaaaccttgtaattttaattgaaatttagaaacccaaacctaaatttttgataaaagaggcctctctaaatctcaagtggttcctaaccttttttgctttagggacccttctgagaatgataaagttttgaactcttttctccagatgcaagtattcatgtacctacttgggtctcagaaatcttagcagtcttttgcaggtcatggttaggcattttatttaaaaacctgttgcaaattttaacaactcattcaaagtgcacaggtgaagttccgtcatatctttccagtggagtgttgagtgtccttctcgttcatactatttttttgctgtagaattatatcacctcagtgaaaagggcttatccaggctcagaattattatgtcatttgtcctggcattac

SEQ ID NO: 61833 - DNA, 1032 bp, Homo sapiens
gatggtctccatctcctgacctcgtgatctgcccgcctcacctcccaaagtgctgggattacaggcatgagccaccgtgcccggctgtgttgatagattttaaaccacaaaactggttgtattttaaaaatgttaatttgtaaatatagcatctagtattctctcctaaaacgatatattttgttctgtcttctgtaagggatttgagatttataataagtgaaaaaggtgcaattaattaaaagactgaagagctaatattgagggtggcagggaagaggtggggtggagaagtgggagcactctatcagcattaggataagggtggcagtatactgtaattgaaaagaaaccttagttcttgacgtcttggcaaagtttagcaataatgagaggttataaaaatctcctattttgaaaggaagtaaacacagacaaaacttggctgtactgaattcttaaggcaaatttgtcctttgaaggttaaggtatgtgaaacagtacaatgtactgggccttgcatagttttactaaaaatgttgagcattttttcactctttttctcactcttggatgagacgatgagccagctgttattgtcattcccttgatcctcagggttaattctaatttggctgtccttcctgctttgcccacatttctcctcaggcgttgttgacaagttaagtttaggttaaatttccattaaaaaacagcgtaaaggacctgtgcagtggctcatgcctgtaatcccagcactttgggaggccaaggcagttggatcacctgaggtcaggagttcaagaccagcctggccaacatggtgaaaccccatctctattaaaaatacaaaaaattagctgggcatggtggcgggtgcctctaaatcccacctactacggaggttgaggcaggagaatcacttgaacccaggagacagaggttgcagtgagccgagatcgcaccactgcactccagcctgggcaacaaagcaagatgccatctcaaaaaaaaaaaaaaaaaaaggcatag

SEQ ID NO: 61834 - DNA, 1416 bp, Homo sapiens
ggctggtctcaaactcctggcctcaagtgagctgcctgcctcggcctcccagcctctatacagataattttttaaggtaaaaatgatgtttataagaatagtaaattaattcatttggaacttaatatgcttcattttaagttagctttatggatatcgtattataagttggttaatcattaagtttttttactttgtaagtagcgtaggaatatgtactcattgtggaggaaaattgacatggaagcatgtagggtaataaatcagcctttctttataccccttcctcatatttgtttatttaaaagtctgtgtggtgagtgtcaaaagtcatgagggaagaatccctaggtttttatttttatatgcactgtttaacacttgtatttgatgattatatgttttcttaaattttttttcacagagaatatgaaactggtgtcaaaatgacatccagatttgggaaaacatacagtaggaaaggtggaaatggcagttcaaaattcgatgaagtcttttccaacaaacggactacccttagcacaaaatggggagagaccacatttatggctaaattagggcagaagaggcccaatttcaaaccagatatccaagaaattccgaagaaacctaaagtggaagaagaaagtactggagatccttttggatttgatagtgatgatgagtctctaccagtttcttcaaagaatttagcccaggttaagtgttcctcttattcagaatctagtgaagctgctcagttggaagaggtcacttcagtacttgaagctaatagcaaaattagtcatgtggtcgttgaagacactgtcgtttctgataaatgcttccctttggaggacactttacttgggaaagaaaagagcacaaaccgaattgtagaagatgatgcaagcataagtagctgtaataaattaataacttcaggtaagttttgattttctttattctccgccaagagagctttgtgcaaccaatttatttaaatgatttaaattctaaaatatatattgtgttttctttctgcacttatgatacatggggaccattgatagttttgtaaaagacatttaagaactttaaagaaaccagttggaggttgaaataaacaacttggatgttaacatttatagactgttgcgcagggtacgttttgggaacagtcataagtttataaccccaattccaataagaaatatctctttttgttgtgttaggatcacaaagtatctcatttctattactgtggaggatttggatggttattgataatgaaaatgagatgagtatttaaaatgaggattagttaccaatggtagactctctgccaaaactagttcagaaagattaagggggtattgagtggagacatttaaagaattgaacttgattccaaat

SEQ ID NO: 61835 - DNA, 1932 bp, Homo sapiens
actgctgattgacttagctccccaaacccagtcaagtgtgttgatttcagccccgagtcctttcccgtggtttcatccgcctctggccgccactggggccttgcactgccttaaggattcggtggcagaggcttccggggcgtcgaaagtgacctccctttcctgggcggcgcgggttgggaggagaaaagttgcattgagtgtctagtccgaggggtccatcgcgcccactgcccgtggcgccccggctgtccccaggtgaggatttctggttagtcaggttcgtcccgtccgctttccatctttaatggaagcccttaaagcctttggggatcgggaagacgctagattagggtgggagtgaagtataaaggctttttgcttttttttttttttttttttttttaaatcacagcgcacttctctcaaaattcgacctgattttgggctagggcaaaagccgaacgaccgaaaagacttagtcgtcaatcattctttcctttttagttaggacagtctttggagtttaaaggttgagcaagattgtgtacttgaaacacttaaaatttaacttcaaggacgtctgcacacttattttggaatctgtagtgctttacgcttagataatgccattgcaaagacattttattgtgggaaacgataaaggcaatcaggaggagatattatataatgaacttctctgtacccatcgcttggatttagcagtgactattaaacaaatttatttcatctatacacttctcattccttaatgttggaaaatcgctgacgttatttcatcagtatttcactatgtatttgtaaaagacgtggtcttttggcacaaaattattattatcattattattattattttgagacggagtttcgcccttgttgcccaggctggagtgcagtggcgcgatctcagctcaccgcaacctccgcctcccaggttcaattgattctcctgccccagcctccggagtagctgggattacaggcatgcgccaccacgcccggctaattttctatttttagtagaaacgtggtttctccatgttggtcaggctggtctcgaactcctggcctcaggtgatctgcccgtcttggcttcccagagtgctggaattacaggcgtgacctgccgcccccagccagcacaaaattattttttatcacataaaataattaagtccttagtgtcaggtattcatctgaagacttcaaactttcaacagtgaatgctttgtggttatagaaccattttaacagtttttctgatgttggcataaaggaactcaagtctagatttttggtttggcctttggttagtatttttagatgattagcacataagtgaatccaaaacattccatctttgttggtgtgtatgtgtacgtacacttacagacctgcaggatctcagctttacattcttgaaggaacagagaatcgatttttattttgttgtccgtggtagttgcccagtatcctgttttgtttaggctgtacttaacaagaaagacagtaagacttgttagtgttagagctgcagtggaagatgaaatacatctccttcaggaacactgttttctcttaacgcagatatgtatgatgactaaattattaccttgtcaaattaaaattgggttctcaccaaacatgggggggggtctactactgaatttatataaaactcagacagtgactcattataaatggtaagaatttaagttaatcaagggaaaacaagtgtagatcaaaacatattcaaaagtataggtcaaatataatttcaattcttgtagctttcaaagtaatgatttttcattccttaggcccttgttcactttttaaagttatattcgatgtattcatgtttgaactgtagaaaggtcaaagtgttagacaaacggttactgattgatc

SEQ ID NO: 61836 - DNA, 1029 bp, Homo sapiens
aggtcgagggcggctcttgaccacgcgccccctgcctcccagctcccgggcggcggcctccgcaggcccggcacagctgcacagcccgcggtccccaggcaccggcgggtccctggaggggaagcgattgatacagctgcctgcactgcgccacccgcccggctgcccatctccgtggcacctgcgtctcccggctgggccgggagctagaagtggctgccgagaccgggagggcccggccagtcgcccgctcccgctcccgcgcctggtcctcggcccgcgacctcgcggacctggactacaactcccgtcgggctccgcggccgggccaatggcgggcgccggagcatgcggggcgcagcgcctgcgcggcggtttgagtaagcggctgcgcgattggctgcggggtcgggcggccgcgcggggactgtgggaagcggagtgacggagcgagcggctgttggaggaaggaggtgggggccgggagcgcaaatggcgttgagatggttcagggccctgttcaaactccagcactgaccattcaccggcggaagcggcggcgcaggaggcggcggcggcccagcgggggcacacagcaggctctgttaccagctccagcagtggcggccagcgagagctaggcctgggcccggccggcggcgctcgaggcggggagggaagttgcggggccgccgctcctgcccccccaaccgggcttcctatttaccgaaagcagagtccctcgcctctctcggctctcacctgccggccctgctctcccgcgcgagggttccgcgcccgcccgcgggccgtagggagcgggagaggcggaggcggcccgtggccaaagcacccgccaggctccgagggtaagtgaggtgtcgggcggccgcctaggccgggagggagccgggagggtgggggaggcagaggctgggagcgggcggtggaagtctcactgcctcgcccaccgggccgctgaggaagttgggcaggggaatgacctgaggaactctttttttccccttt

SEQ ID NO: 61837 - DNA, 1036 bp, Homo sapiens
agtctcccaagtagctgggactacaggtgtgcgtcaccatgcccggctaatttttgtatttttaatagagatggggtttcactatgttggccaggctcatctcaaactcctgacctcctgatccgcctgtcttggtctcccaaagtgctgggattacaggtgtgagccaccgtgccaggcccccagaataatgtttaactaaatatctaggcaacccacggcttagtcaagttgacacatataattaaccactacaggcctacaagctttttccagattaactgtgcagtggaggaaaaaaataattttatctgagattatgggacactataatgagctctaactctattttctggggatccagaacacctctttgatccactggtagaaattgagtttatggtgatcaggtgacaaatggtgttttagcttgattctgaggcactataggctttccctgtcccaatgacatcaggcctggagatacgccagatatcagagaccagaaaggccaattgtgatataatgtgttactgccctgtggaaaaaccacacatccatcctccatagagggcagacttactttggtcaatgcaatgtgagcatcagtgacatgtcacttctgagcagaaggtttaaggcagtgtgtggtttgccatctctctttttcctctggcaacatctagattgggcctactgtcagcctgggtacgcaaataaagatggcctgaagcagagctgaagttactccaagatggacatacagtacgagaaagaaaaattttcattgtaagcttctgacatttgggtcatttgttacttcagtataacttagcctaagctgactgatacatgctcaaaaccattctggagttattcccactttcctgaatagccatatatagctattgtgagaatcacaatacccccttagttcatgcaatgaagacatccaagtggaaacccctggagctaattatctatgccaaaattgtaaatcaaaatcaatactgaattgctgggagaatcacgaaga

SEQ ID NO: 61838 - DNA, 1027 bp, Homo sapiens
agcacgttatggccaagagggttactcactggcaccacagcatggtcagctcagcgtggctgcgttaaaaggaagaggagaagaggaccctttccaggcataccaggggaggaatagggaggggatgggaggggacaggagggagatgggaaacgtccttcgtgaagtctcgattaatcaacagtgcatcaattccaaaactgatgggtgccctagtggtgagaccaaatgatagcagtcttcccaacgtgcagaaaacagaaagttagtgaagagcatttctttcattattctccattgaacttccctttggccattgctactacttttaagagcacaccaaggacacacgtgacaaagaaatgttaacaggaaatccctgttagctcttgggcttaggcagccttgtttttctgggtacgcatgagctaatgcttgtgtttgtaaacttgcatggtcatattttctgctttgaatgatggaattcaatcaaccttgcccagaattaggcgaagagcagcagccctgagccttgggagtttgacttgaaactccaggacaggcgacctctgctccctggtggcctagaggaagtactgcatctccaaaagggccccaggctcctcagttccagcagagcccagagagcccacactgttccacccttggggctggggagcctgccctttataacctgcatgcatatcatggccacaagggctggggtctggaaaggccaagtgcaactgggttctctgggactttttaatccctccatccctcttattacatcggtttttctggctttggaaaaaagcatcactgtcatttcaagactttttgccttgaattgctaggggatcctgacccagggataagatgttgccgagactgataatcagccaacacagtggtattcccaagtagaaaacagtgaggaattatgtgtatgtgtgtaaaaaagaaacaacagatagacagacacatacacacacacacacacacacacacacacacacacgagggt

SEQ ID NO: 61839 - DNA, 1090 bp, Homo sapiens
tctctcctggcgtgacggcgagccaggctgaaggatgcagaagctgagggctgcgaagcgccactgcctgctcgccccccgacggagtcggggttgcgacgggggaacggagctgccgggccgggccaccgaggccggggaggttccttctctgggtgggttagccccaagcaaggaagccgtcaaatcggggtccagattctagcctgcctctgtgagacctctgtgttgtgggggctggaaaagaaaaggaggtggatccgggagtctgtaaggccttccgatggagggaagcgactgccaggcagggggaatagggttagtattgctggagggaggcaggaaaggtgggccagggccctgtttacttgaaagggggcgtactaaagcctgttttgctgcttggggagtttctaagcgggcatctgctgttgagtctggcagcctgagctcgtttcggctaagcagttcaccagctggatgacttggaggcagccatttaagctctccaagtctcagttcctcatctgtaaaatggacttgcaaatattatctgcctccttggattgcagcgagtaataaggcacgtaaagggcctggcatgtggaagcagtcattttggtgaaggcagcaccacgcaatagaaatttcctattagccacatttttaaaaaataaaagaaagcaagttaaattcattttaatatattttctttgactacatatatttaagatatcaggccggacgcagtggctcacgccagtaatcccagcactttgggaggccgaggcgggcggatcataaggtcagaagatcgagaccaccagggtaacacggtgaaaccccgtctctactaaaaaagtacaaaaaattagccgggcgtggtggcgggcgcctgtagtcccagctactcgggaggctatggcaggagaatcacttgaacccaggaggcagaggtggctgtgaagccgagattgcgccactgcactccaacttgggcgacagagcaaggctccgtctcaaaaatatatatatatatatataatttcaacatataatcaatataaaataattattaatgtgccttcaa

SEQ ID NO: 61840 - DNA, 1006 bp, Homo sapiens
ctggaatccttaaatgggaaaggcgctcacctccccgccccggagcggcgaggctgatatttgtgatttggctccggacgctgtggggaggaacaggggagaacaaaatgagtttcgggcgggggtcgagtgagaggagcagccggcccgcccccgagtccccgcgggaaggggccctggcccccgagctcccggagctgcttcacctgttgtcctgcgcggcctccgctccgtggcctggtgattccgtacttcagttttggaaaactttctgctggattgcctggacccttttttctctttccagactcctagtggaaagatttggcaaggaaaaaaaaatgagcttgcgtcagggaagaaaaataatatgctgtgtgttagggtctggcgtttgagcgtggtactctttcatgctctcagatgttttaatttggtcaaactcctgcaggttttctcttttaagcggttaacaaactgttcagagtacatagtatgaacttggcacctgtgttacgtcatttaatccttacaacgattctggtttattgtattcctcattgttttaggggaagaaaccgagtcgcaaagaggttaactaacttgtctaagggagctgggatttgaacccaggaacatcgtattctggcaaacgaattaggaagaaaaaaaaccaaaactgtttgcaaacacttttacgtttaggaacatttttcagttactcttacttgaaattatcgctattttgttgctggagttgaaaacaactactttattgtatttacttgtgagaggagttaaactttgaattagagtgtaacttaatgcgtctcattgttttcagttgttgaaataaagaatgtgaaccagaattatttagatttttaaatttgaagctaaaatatgggcaattctctgatctaggaatggggtgagtgtatgaaaggccgattgaaatgtagaatgcgtttttagtagaaccagactcagttcttgtttaattttt

SEQ ID NO: 61841 - DNA, 1058 bp, Homo sapiens
ccctttacagaagaggttgaggcacttagcaggagctccttcattaaattccttctgttactggcttcttaaccttccgtcaaagagggagaatttttttttttttttttgtctttcttattagttaacaccttggggtttttttcctttccttctaattttcctgcttagtggagcgtgagttattttctctgtcgtatttgggttctttaaagtacaaatgttcttaagattttttcagtttacaaaaaccttttcttaagtctgctactccttcaagctgtcttgttgctgcttttccttttcaaatcttattaacattttaaaaagcttgttcgtaataaaagtaacacatggttgttaattgcgaactagcgcaacattgaaattaaaatttagtcattcacaatccatctctagagattgccaagtgtagtctgcttttcctgcctttgcctggttggtggctagccactcatttcttaaccccttgttatctggatttcaccttcacaaggaactataacctaatcaacacatttaactacctttttctaagtcctctccttgagttttctgtaagatttaacatcgacttcacattttcagatgcctctccttgggtttcattcatctatactcgctgtattctaacacagggtccaaggcagtaagatacaacagatccttccctcatggagcttaaagtctagtggggaaatacttattgaaaaataaagtctctagttaaatataattgtgattttaattaaggtgcagaatattataagaacttcaaatggagacctgatctggtgcttgtggtggtgggagaatctgggaaagataccttaaaattgctttgttggaacccaggcagattgtgaaggatgagcaagagttaactattaactagatgaagaggggccttttgtgacattatactgactttgttcctctccgccacttttctgccttctgtttcttctttcctctttaatatgcgttctccaagtttcacttttcagatcacttttctctatgtctctagtccctta

SEQ ID NO: 61842 - DNA, 1059 bp, Homo sapiens
tgtatttttagtagagacagggtttcaccataatggccaggctggtctcaaactcctgacctcagatgatcgcccgcctcggcctccgaaagtgctgggattacaagcgtgagccaccgcgcccagcctttaattcatctttaaatgaattgtccccattttctaggagttattatcttttctaaaaataacataacttttttggattaaatttagatatcctatttatatcttcagcattgaatcaatattttattaaatatacattaagggagcttcagtgatactaaaagagtgtgatgctgttgtaaatttgccattgctttcctttttgtcaatattcaaggattgtcttggaccatgggccaagcctgaattgtaagaaggaatggtaaagcatggtaacccattaaagggtaaagaaattaaaaaaaaaaaattgtcagagatatactctttaaagggccagattttttttataagactttaaaaagaattgatgattcttattttacacaaagatttttagaggaaagaaaaagtatgcaaaagagaagatgctctttgaagctggccataaccctgctgcaagcaaaatcagacaaggatggaccagaaaaagagaacaatttctattctcacttatcgtgtatttgtaaaatcccaagtaaaacacgagcaaattgaatcaaacagtatattgatactatcggataaagctagcccaagattcaaggatgatttgaccttagggattatattagtgtcatttacactaaataaatctaaggaggaaaacaatacaaccatctcagttaatggtaaaaaatatattaaatgaaattaagtaactctttgtgatagactagttttaagaaaagaaagaaccttcctcaacctgataaagggtaattttctacctggggcgtgtagcaaacccaacgggtaaaatacttcccgtgaaaggaagaacaatactaagttcatttttagtgttctttttagtgctggagaccccagccaatggactaagagaagctgaagcgaaaaagttgtaaa

SEQ ID NO: 61843 - DNA, 1024 bp, Homo sapiens
tatttttagtattttgagagtaggtgctgtattttcttttctttccttgtttcttcttttttgttttttgagacagaatctctctctgttgcccaggctggagtacagtggcatgatctcagttcactgcaacttccccctcctaggctctagcagtgcttccacctcagcctcccaagtagctgggaccagctcacgctaccactccagctaatttttgtattttttgtagagacagggttttgccatgtcaccgagactgagttactgtattttcttagcagaatattgtcccagtgagctttttccaaaagagaaaaggtacagccaataaaagtttgtggttgggtattgggagttggtgttgttctgttttgtcctgttcataaaagttttattctctttagctctcatgctttagttctaatttattcacagatttttgcccagtaacttgattttatacttggctttctatattgtggctccaatttttcttcccagtttatactcttatttttcctttctttttcttttcttttcttttttttttttttttgagacagtcttgctctgtcgcccaggctggagtgcagtggcgcgatctctgctcactgcagcctccgcctcccaagttcaagcaattctcctgcctcagcctccagagcagctgggattacaggcgcctgccaccaagcccggctaatttttttttttttttttgagacggagtcttgctctgttgtctgggctggagtgtagtggcccaatctcggttcactgcaacctccacctcctgggttcaagtgattctcctgcctcagcctcctgagtagctgggattacaggcgcccaccactatgtccagctaattttttgtatttttagtagagatggggtttcgcagtgttggttgggctggtcttggaactcctggcctcgtgattcgcccacttcggcctccctgagtgttgggattacaggcatgaactactgcgcccagccaatttttgtatttttagta

SEQ ID NO: 61844 - DNA, 1079 bp, Homo sapiens
gatctcaggtcactgcagtctctgcctcctgggctcaagcgattctcctgcctcagcctcctgagtacaggcacgcgccaccatgcccaactaatttttgtatttttagtagagatggggtttcatcattttggccaggatggtctcgatctcctgacctcgtgatccgcccacttcggcctccccaagtgctaggattacaggcgtgagccaccgtgcccggccacaacttgaattttcatagcaaactagtttttattgtcaaattagaaatttatgcttgaagcctagtgcttcttttgcctatgcatctcatctaaaagtaatggcacttatcacgtcagcctcatggattgtggtagtggttgttatccttggaattaccggtagggtaacagtctccaggcataccatgggttcttcagttatgagtggcatagcttatgtacatgttaactgtgaataataaacgatttttccaacttactgcaatactcttatttatgtctgtaatgtgaattgtccagaggagaagttgtggtcaattgatgattaggctgatggtttctgctagctctggcaaaaggtgaatccagttgctttctagcacttttcctactaaccctgcttctcaccctgtacctaataccacatttttagtttagtttttgttttgttttgtttgagacagggtctaactttctgacacccagactggagtgcagtggtgtgatcatagctcgtctgcagcctccacctcccaggctcaagtggttctctcacctcagcctcctgaatagctgggactacaggattatgcccccatgcctggctgtttaaaaatttttgggtagagatggggttttgccacgttgccatggctggtctcaaactactgggtttaagcaatcctcttgccttggcctcccaaagtgttgggattacaggcatgagccactgcacccagaatcacctttttttagtttggaagatgacatctttttttttttttttcttagagaagctagagggtaccaaattaaagtctgtcagttttttctgtctccacctcaaagatc

SEQ ID NO: 61845 - DNA, 1096 bp, Homo sapiens
ggcaattggttcaggatttgggaagaaaacgtatggcattaggattaaaagtacaatgtttagagtctggctgatctgggtttaaatcccaaatctaccatgtattaactgtgtgactttgagaaggttacttaatcactatgagcttcagttttctttttttttcccgtttttatttttatttttatttttattttgaggcagagtcttactctgtcacccaggctggagtgcagtggcgcgatctcggctcactgcaacctctgcctcctgggttcaagtgattctttgcctcagcctcccaagtagctgggattacaggccaccatgcttggctaatttttgtatttttagtagagatggagtttcaccatgttggccaggctggtctcgaactcctgacctcaggtgatatgcccgcctcagcctcccagagtgctgggattatagatgcaagccactgtgccggcctgagcttcagttttcttatctgtaatatgggattactagtggtatctggctcataggcttattttaaggattaagcaagataataaatgtatagaatttagcacagtaaccggcacatagtaaatgtttgataaatggaactcggtaaatattattgccataattttgttcttaaatcaaccagcaagtgtttgatgctattattaggcaatgttattaaataatggaaggtgtttctaccagtgattcacagtgttttctgtatccagcaagcttttaatacagctgcttgtattattctcccgtataaacttctaattactctctgaaaatacagttggtttcctgttgatagagaacaataacagtagcttacacttagtgcttactgtctgcctggcactgttctaagtgccatacctatattaactcctttgatcctcattttacagattgggtacggaggaggttaaacaacttggtcaaaggattacaacagttaagtggtggagccaggattctaaccttggtattcagtctggctacagagcccatgctctttcttatctttatgttcttctctttacttcctaaagaatggtagatgcatttcaaacatcctgac

SEQ ID NO: 61846 - DNA, 1026 bp, Homo sapiens
gcatacattctgatgacaagaaaagatgttttgtaagggaaatgtggaattaaaatgaactttttgtgtttgtttgcaaataattattaatgttgaagaaattttgatgttagctctgagttatgaatgttagaatatatttagaaatgtttgattttcatttttccatgtcattaagaagcttgcatatgttttttaaagaattgccttctttttaatgtgttttctacaactaataggcttagaaatttcagacacaaaatctttgaaaaaatgacttgtacttacttagcgttttgttttgactaacacccctggtggttgttgaaccacaagttcatagtgttaaaagcctgtggtaaattacccagtaagctaagtgattaaagttgtttggaacattttgctcatgtacatcttatttttatgtgtatacatatttatagatctgtgctcataggactatagcactatattgcaaaggtcctaacctttattcacacaacttccagtgtgtacaatgtgacttgcagagctgtactgtggagcatatcctttcctgtgtcttttgtttacctctgagtaatgaagtcaaatcttacttgattttccttggctggtctattttattttattaagttctgggatacatgtgcgggactagctagtcttaaattcagtctttaggaaacgttttctgggctgggcacagtggctcatgcctgtaatctaagcactttgggaggccgaggcaggcggatcacttgaggtcaggagttcgaaatcaggctggccgacatgacgagaccctgtctctacaaaaaatataaaaattaacctggcatggtagtgttcgcctgtagtcccagctactcaggaggctgaggtgggaggattccttaagcccaggaattcgagaccagcctgggcaacacggcaaaaccccatgtctacaaaaaatataaaaattagctgggcatggttgtatgtacctgtagtcccagctactcgggaggctgaggccgg

SEQ ID NO: 61847 - DNA, 1819 bp, Homo sapiens
atgcttgaatatttataattatttttggtaggcctccttgtacttcgtattatttatttgttctttatttttgtgcttagacttcctagggatattgaactttctagataatttcatgggtcttttcaaagagccagcattttggttttataaattaactccacttttttgttatatatttaataatttttgcttttaacatactaccttttcttcctgcctttggtacccattcttccatctcggttacacataatattcttctatttttaaacatttttctgttgtttctgaggatttaggagcagtaggaacacatttgtttattctcccagccttagttagagctgcttgtatattttcaaaagcttcttgcacctctgtctcctgatggtctgtaatttttccagcaacccaggatttaaatctgggaaccacctatgacaactgcatctctgctttctatcagatctagaagttgctaaattttatcagccccccctctataatagttttcttccacttccctattctcattgcctcttggttgggatggttacttcttgtgtgaactactgtaattaccctttggcttatctacctcaccctgtccctttcatcccatgtaatgcttcaagagtgatttttctaaaccatggtgcactcacttctttgctctgaaacctccagtgatttctccttgtctgctgagtaaagttcaggctactttacactagcatttgagaatcttatgaattaattcctgcctacacttaatcattctttattcctttgttctttaggaaaaatcgtaattggtaagataaaccaaatataaaactatatagtaatgctgtttttcagtcttactgatctcactctattccttatctttaccatgcttttctgactttgtgcttttgcctctggatttcccagtctggaatgcctctctcacatcctagtatgttgaaatctgtccattattcaagtgtgagcttagatgccaacactttgatgaaggcttatctgatcccattgcctagaattaatcttctcttcccatgtctttggatttgaactgcagcttctgtgctctgttactagtcattccattttcgatagtctaccagtaacttctgtgccttagatccacatttacactggcttgtcaggattggtcagtgaatcaaataggtagtaagtataagcttctagaactacactctccgatatggttgtcattagccacttgtattttgactactgagtagccacatatggttagtggctactttattgagtaacatagagactttcatgattgcagaaagttattttgagcagtatctagaacaatgcctggcaaataatagacaccagggaatgttgttcctaggtatcacatcctcatagtagacactcagtaaatattagtttaactttcctttcctcatctgaattttattagcgtttacctgtgccatttaaaaagtaacagtttatggcagctaacacagtgtatgaacaataaatatattttgggtgagtaagtaaatactacgaagcatccagaaagcatcttgctctcttttggggtggggagagtaggggagtggaagttaaaaaaaattcactactcaggccgggtgcagtggctcatgcctgtaatcccagcactttggaaggccgaggtgggtggatcacttgaggtcaggagtttgagaccagcctggccaatatggtgaaaccccatctctactaaaaatacaaaaattagccaggcatggtggtgcatgccagtaattccagctccttg

SEQ ID NO: 61848 - DNA, 1047 bp, Homo sapiens
tgatctggtctttgtcttctctgcctcttcaccctcatctcccactacactatctcttattctcaacatttcagacattgttctctctttgcttttctctccctcaagatctttgcccacggtgttccctgtgcttagaacttcccgtctttctttgcctgactgactctatttttcagatctcaacttaaaggtcacttctcagcattgcttccctttccgcttcatctagattagaggggggtcactgcccctattccttcaggacctggcacttttcttcctttgcacttatcatgagttatgattgtgtatcatttgtgttttcttgtttggtgtcttgagtatcttaattgttttgtttaaggactctgaacttcatgaaggctgggcctgtttggctctgaacagtgtattcttggtatctaatacagaatcatgcatagcacagacacttaataaacatttagggaataaattaataattcaacggcaagaacactgtttccataggactccagcattggaagggataacgtagattatttagtctagggccaggcggtggtggctcacgcctgtaatcccaacactttgggaggtttaggcgggtggattgcttgagtccaggagttcgagatcagtctgggcaacatggcaaaccccatctcaacagaaaatacaaaattagccaggcttggtgacacgtgcttgtggtcccagctactcaggaggctgaggtgggaggattgcctggagcccaggaggcagtgagctgaggttgtaccactgcacttcagcctgggcaacagagtgagactctgcctccaaaaaaaaaaaaaaaatttagtccagtctccctttctatcatgttggtcatgtctttgacaaagatgctctcaaactttattccttatgtactctgtgagcaaagtccctgggttcttttggttgtatctcaagtggagtggttgctatgtcctttgcattcctgtcattcttctctcaagtgcttaggaggcctggccaggtggaatacagtaagat

SEQ ID NO: 61849 - DNA, 1457 bp, Homo sapiens
gttttcattatatctactagaatttgcaagaatgttgatggttacccttatgttttaaatttaacttttcctgtttaagtcttaatatagttgggaattttcatgttattaataaaataattagaacagccagaaaggactattgagattgtttaatatacttcccttgttgtacatatggctaatctgaggtcaggagaggttgcagcctattaactaaattatttgaagtttgaaattatagtgcctaaaaaaaaaaaagcaaggatacctttaatcttttaaaatgtatttcattgtttaaaggtgtgtttgggcatttgtttcccttttagtttttgaaaaatttccaaaattcagttgtattccttaccttttaaatatttttgtctttcaggagtcgtaagaaagcagtgggagttgaagtcattgtcaagtgcttgcgatcttttacaagaaaatctcactgaatgatagtcatttaaattggtgaagtagcaagaccaattattaaaggtgacagtacacaggaaacattacaattgaacaatgcctcagctatacatttacatcagattattgggagcctatttgttcatcatttctcgtgttcaaggtaaatcagtgttcattttagtaatgtatgtgtgtatataaaaagcactatttcttgcttctgttctttcaactcatccctgtttgaatagttaggcccagcctactagggcagcttttaggaaagaagcaaagatgaaacacgtgccaaataattttttaacttggctgtgatggaaacattttcaagtatttttgaaatctcagtctgagtctgtcttctccttcacaacataggcgtaatgatacacagcattaggtcttgtgaggattaaatgagataaagtatgtaaagccacctcagttagtagctgaaagacagggtaataggtagtccaggctgagcttcaaaattcctctctcctttaaaatacaataaggagcaagtgtaaataataattgaaaaatcattttattggccaggcacagtggctcacacctgtaatcccagcgctttgggaggccgaggtgggcggatcatgaggtcaggagttcaagaccagcctgggcaacatggcaaaacctcatctttaccaaaaaatacaaaaattagccgggggcctgtaatcccagctactcgggaggctgaggcaggagaatcacttgaaccccgggaggtggaagctgcagtgagctgagatcgcaccaatgcactctagcctgggcgacagagcaagactcttgtccctgccccaaccaaaaaatttcattttattgttgttaaaagactttagaaagataactgacacttgtctgtgctgaatactaaaatttcttcatagagcactgacagtttgtttatgaccaataaagtaattttgctactatgtgttcacagctta

SEQ ID NO: 61850 - DNA, 1064 bp, Homo sapiens
tttggtcattaagcctatttgtatgtttcagagaaaagtttgtttttatctattatcatatacaatatggaagtactgaaaaaatgggtaaaaagagacaaagttattttaaagtatgttttcaaaacatgacataaaattttataaatcagctttctgtgatcacatgactgattagcaaagagaagtcacataactcctatgtggaggacttgtttaattgaaatccttttcttcttgacaaagggttgtcactggccttttagatcttggctcagacataactttcatttgtcttaaaacctctggcgttgccaataaatcacgtgtgaatgcaattctaagtcacaaaacaaagtattaaaggccatctgtacctgttcacattcagactcaaatttcgttagtactttctatgtgaatttatgttttgttttgttttgtttttttctgttttagaactaatggacattgctttgccatcatagaagaagatgaccagggagaaaccacattagcttcagggtgtatgaaatatgaaggatctgattttcagtgcaaagtaagatataatttgggacccatgagacaaagaagggaggggccatatgaaagcatcgatttcccccaggagaaacatgcctggtgtacacatcgctgtatgttcacatcagtaaatatattggaggaatacctactgtctagattctgtcctgtattcatatgtagaatttataactaaatcatttctgaaaagctaattgtttgattacaatttccttttttatttccatagacagcacctggctctgttgcccaggctggagtgcagtgctgcgatctccgctcactgcaacctcaagccagcctcctgcctcagccttctgaatagctgagactacaggtgcatgccactatacctggctaatttttgtattttttgtagagacaaggttttaccatgttgcccaggctggtctcaaactcctgggctcaagcagtctgcccgcatcggcccgcaaagtgctgggattacaggtgtgagccactgtgcccagcctgat

SEQ ID NO: 61851 - DNA, 1844 bp, Homo sapiens
ttcccacttagtagtgtttgagctaccttcgtcatccctgtcagcatccttcatagagaagaaaaaacaagacaggagttgaagaattgttcgtttttctccttatcatccactgtcatgtcagcagtacatctgttgcttggagaaaccccatgctgccaaagaaaccctttcttggtttttctttgcacttttctcttctgcaaggccaagctcattttagctttcctggaaccgtttttggatgcttgacacttctttcattcatcgttagttatatgattttcatttcctcctccatgtgttttctctgaatctgggattatttcagactctccagtttaaccctaacttttttctctctctccttatgatcatttaaaagtaaaaattgtttaaaagttattaataaaacttcatttaaaatataaaatatgtatttggacatttccaaatgctcttgaccatcttcccaacagaatctgaagtcacaggctcatgtttacctttttaaagtcatagctgattatactgaggcttttccttaatttccgcttacattcttgttacttgtgtagtgacaaacagttctttgctattcacatgttggtcagaatggcagttctccccaggctgcagcattcaacttgtcagatattgtgttgttaatccaataaaacatcacatgcaagtgctgctgcgcttccagtgactgtgtccttctctgtgctagctttctgctctcttagggacagtctccttgctggctggtggtctgtaatcagctctcaagaatgctttctgtagtttgtccttccctcaccatggatgctcaacttgcctctgcatcaggctcatgacttccgacgtggctggggtaggcagggtctgcagcgcctctgcacgctcagctgccttgctaaccagccttttctttggactacgacaccctccactttttagtctgatcttaaatctcatccacatctcagtaccacagtgagattatatgtaccagaccagtttatgattgtaattacctaagttcgggtttggtgttctaatctagtgtctaacacaccatccacatagatatgttcttaagaaaagccattttgcagtcttcactatttcagcacaaattttaatctttcaataatctgtttttacatataaaatttgcaggcccctttcactcactgaaatagaaattgtattttatgaatactaaaaagacatatcagtttaaaataccaaaccatttctaattttatcattactcttcttttaggattctccaaaagcccagctacgccggacaatagaatgttgtcggaccaatttatgtaaccagtatttgcaacccacactgccccctgttgtcataggtaggttagccgagaaaagtcggagcatgcttctcaaatatcttctctggttttacagtaaccaggctacctagaattgaacacgtcagattattttttcatttcaattgtttacattgtttacttttattgtcaggtccgttttttgatggcagcattcgatggctggttttgctcatttctatggctgtctgcataattgctatgatcatcttctccagctgcttttgttacaagtaagaagatatttattttgaagcaaaatattttgtcaaatattagatgtcaaccgctgtttgtaaagccagttgcagaaaccattaacttgtattctctggttgtatatctcctttatgtaactagactatagttctcttaagggaaaaggaccttactaccaattaattaattgggcacaatttcatacttcttgtatgttcatgattacttatgatt

SEQ ID NO: 61852 - DNA, 1150 bp, Homo sapiens
cacttaatatggttaattgattaaaaaaaaaaaaacaaaaagatgcccaagtaattcaattggaaaaaggcagtccatttaacagatggtgcaggaaatatcaggaatccatttaccaagaagttaatctcagtccttacctcctcactctataccaaattaacttgaaatgtagcatagacctaaatgtaaaagttgaagtataaaacctctaaaagaaaatgtctgaaaaaattattctgaccttgggcagacttcttcagtacataaaaaacacaaatcatttttttaatgataaatcaggctttatcaaaatttaaaacttctgctatttagaagacaagaaaatgagaagacaagtcacagattggcaaaacagatctgatacagggtttttgtgcaaaatatataaagaccttttgcaactcaataataagataacccaatttttttaaaaaatggacaaaagatttgaacagacacttccccaaagaagatataagaatggcaaacaagcacatgaaaagatgctcagcatcagcagggatatacaaattaaacacagtaagatactactgcacatccactagtatagctaagactgataatattaagtggtgccaaagatgtagatcaactagaaatctcatacattgctggttggaatgcaaaatggtatggctattttgaaaaatagtttgacaattgcctggaaagttaagggcatactttccgtacaatgaagcaatccttctgctaattatttacccaagagatatgaaaacttgtccacaccagaggcctgaatgtgaatgtttatagcagttttatttataatagacataaactggaaacaaccccaaagctcatgaattgctaaatgaataaacaaatgctggtacattcatacagtggaatattactcatcagtaaaaaggaacaacttctaacacatgtagcagcaacagtgggtgaatttcaaaagtactttatgctacatgaaagaagccagacacaaaaggctacacaaaagtgattctcctgcctcagcctcccaagtagctgggattaaggcatgcaccaccatgcccagctaatttttgtatttttttttaagtagagacagggtttcaccatgttggccaggctg

SEQ ID NO: 61853 - DNA, 2024 bp, Homo sapiens
aacatacatctactattaagagtgaatcatagtgtctatattttttcttgtgtaagaatccgttttagttccatagtttagcaaaagatgcttactagattggtatatcttgtccagcaaccatttttgtgcccatgttttctcattcccttatagggatcgtggaagaataccaattgccatattacaacatggtaccgagtgatccgtcatacgaagatatgcgtgaggttgtgtgtgtcaaacgtttgcggccaattgtgtctaatcggtggaacagtgatgaagtgagtggaactcagtcccctgaagaagtgattcgtaaatgccaccaaatatattctctgctcactgaacatctctttacttttcagtgtctacgagcagttttgaagctaatgtcagaatgctgggcccacaatccagcctccagactcacagcattgagaattaagaagacgcttgccaagatggttgaatcccaagatgtaaaaatctgatggttaaaccatcggaggagaaactctagactgcaagaactgtttttacccatggcatgggtggaattagagtggaataaggatgttaacttggttctcagactctttcttcactacgtgttcacaggctgctaatattaaacctttcagtactcttattaggatacaagctgggaacttctaaacacttcattctttatatatggacagctttattttaaatgtggtttttgatgcctttttttaagtgggtttttatgaactgcatcaagacttcaatcctgattagtgtctccagtcaagctctgggtactgaattgcctgttcataaaacggtgctttctgtgaaagccttaagaagataaatgagcgcagcagagatggagaaatagactttgccttttacctgagactttcagttcgtttgtattctacctttgtaaaacagcctatagatgatgatgtgtttgggatactgcttattttatgatagtttgtcctgtgtccttagtgatgtgtgtgtgtctccatgcacatgcacgccgggattcctctgctgccatttgaattagaagaaaataatttatatgcatgcacaggaagatattggtggccggtggttttgtgctttaaaaatgcaatatctgaccaagattcgccaatctcatacaagccatttactttgcaagtgagatagcttccccaccagctttattttttaacatgaaagctgatgccaaggccaaaagaagtttaaagcatctgtaaatttggactgttttccttcaaccaccattttttttgtggttattatttttgtcacggaaagcatcctctccaaagttggagcttctattgccatgaaccatgcttacaaagaaagcacttcttattgaagtgaattcctgcatttgatagcaatgtaagtgcctataaccatgttctatattctttattctcagtaacttttaaaagggaagttatttatattttgtgtataatgtgctttatttgcaaatcacccactcctttacaaccatactttatatatgtacatacattcatactgtagaaaccagctcatgtgtacctcatatcccatccttaagagaagaaatgttataaagtagaactaaatataaattttcagaattaatgcattcaaagtaatatatcaaatccaggactttgttaacttcaggtaaaaacttcattagggtaatatcatctcaattttttcaaatgaaaggattctctaattagaaatttatatgtcagagctgttataaatttatcaactgtcaaatatgttctggacagctaaatcatttgagatttttggttttttgatttctattccctaacttgtgaagacaatgaaaaatcaggcagaaatatttagtatctagtcagtatctgtagctacactgtataactgttcttcaataaaatggttcatattttatagatgccttgttatctcaagaaatctgatttacataaacttatacttctttaatgctt

SEQ ID NO: 61854 - DNA, 1697 bp, Homo sapiens
gtggaggttgcagtgagctgagatcgtgtcactgcactccagcctgggcaaaagagcgaaactccatctcaaataaacaaacaaataaataacaaaaaacaaaaatgttgcattaaacttagttcttgtctctcctttccactcttattcttaaatctgaagctcatcgactaagtgaaatatttaaagaatatgataggccagcaagaagaagtattatgtagtaccatagttagtaaattcgtaaaaccttggaagccattatttggtcccacttgcaatttagtgtttttgaagtgtgtagcttcattcagatagctctttaaataattaaaatataaaagcaaacaacccaaactacctgactataaacaggaaaagttaaccctcaaagagagttcttgtgaattctctttatgctggcaaatagctctaggattaaaggcacattagggtttccttcagtttgtttattctaagcttttactgtgctttttactgaacaagtttctgatgtataaaacttgcatctgatttctttggaaatattttcacaaaagttattttaatcagtatttttacattgcctttccagtgtccagaagtgtttctaaacttagaaagtgacctatagttttttaaaattatgttttcctagaacgtgccaaattttgatttactctaacaatcagtacttttcttcagatgctttgttctgtttagaacaaaaatgcactatagtttttaaagaatcatgcatctttgggttggcccaggatcaaatttgatattgaataatttattccagggcagctttcataaacatacttcatagatgttgttttgaaatgtttctaaatatctaaaatcatttcaacagcagaaatgatttttattttaacaaaagattatgatagcccttgtagtgtttaaaagtggtcatatttattactgactttgagtcaggtgttaaaatagcagtgccacagctcgtctcttgccttagtgtgctgctgtgagagtcacagtggaaactgcagggaggaggtgtgttcctaagaaccaaaatccagcacagcatcctgtgaagccacgtgtaatgatggtcccataaggaaagtatgtgaatatggctcttgtaaaggattaactattgtaattttagcttatgctctgtattctgttttctatggaattatttaagcccttttagtgacctttgtcctggcccatttaaaaactaaaatgtagtatatattgtataaaatggaaatatcattattgcttcattaggggaaactgtacataggcattgaaagaagggtaaaagcaagcagttttatcaggcagttgtaaaacaccaaaaatatagattcgtctttgacgtgtaacacactaaatgtattttgtacagcatctggtttaaaaggtgccttaagagtttaccattacttgctttgttctatatacagattatgtccaatgtatcattttgaagtaaataaccttattttagtatactttagtgatgtgttttgtgatgctacactcagacggtattgtgcatcagaagtcatctgttgagatttttgtaatgattaagttagtgtatatacatatgttcctgagatgtacacttcaactaccagaaacccagtatggagcacaggtaggtacacgcttgccctgtggagata

SEQ ID NO: 61855 - DNA, 1060 bp, Homo sapiens
ccaacctgcttggtctctattagtcagtaatgaagacgacagcctggccaaccaagggaaaggaaattagtatctttagtttcagtcattccttgtaggatatggtttagctgtgcccccacctaaaatatcatcttgaattgtaatccctataatccccacatcaagggagagatcaggtggaggtaattggatcttgggggcggttcccccatgctgttcttgtgatagttctcacgagatctgatgattttataagtttgatagttcctcctgtgttcattctccttcctgccaccttgtgaagatgccttggttcctcttcactgtctgccatgattgtaagtttcctgaggcctccccagccatgtggaacagtgagtcaattaaacctctttcctttataaattatccagtcttgggcaattcttgatagcagtgtgaaaatggactaatacacttgtgtttatctgtaatttaaatttcatgtctttttctccttgccttacatagggtaaagaccaagaaatgccaaacgtgaactaaaatatgtagggccttcaacttttttacttcctccagtatcttaggaccatcgtaattcttgttagcatctctaaccaggaggcagctgagggaggagggaaagaagactgtaaaaatccccctcactaatgatcaactttggaataaagtgatgcccttcaaatctctgcctcatttacttctggagggcaaaaataattggtagagtaggtaaaaaaaacatgggacaacgtgaaactatgtgggtaaatgtgactgattattccaggccctgttatgtagaatgatttccgtttattctatataaaacacttggaagtttccacactaggcaaagatactaatactggactagacagtacagctcatagctgcaattattcctgtaatataccagcatatggttttcaaaaaagttcagatcctatagcaaactggcctgagaaaacagtcatctagctatcagaaacaaggttttttttggtattaagtactcaaaatttgttgaatatag

SEQ ID NO: 61856 - DNA, 1007 bp, Homo sapiens
acggccctggagcaggcctcggagcccccgcggccggcagagcacctggagcccagccacgacgcgggccgcgaggaggccgccaccaccgccctggccgggctggcgcgggagctccagagcctgagcaacgacgtcaagaatgtcgggcggtgctgcgaggccgaggccggggccggggccgcctccctcaacgcctcccttcacggcctccacaacgcactcttcgccactcagcgcagcttggagcagcaccagcggctcttccacagcctctttgggaacttccaagggctcatggaagccaacgtcagcctggacctggggaagctgcagaccatgctgagcaggaaagggaagaagcagcagaaagacctggaagctccccggaagagggacaagaaggaagcggagcctttggtggacatacgggtcacagggcctgtgccaggtgccttgggcgcggcgctctgggaggcaggtgagttcctgggctggggagactggacgagcctaggaggccagggccggctgccggcagctcttctgcctccaagagggccaggaagaaagagaacaggatggccatccgtcacccctactaggtccaccttccccttggcccacctgcttctcaggggtgtgggtctctcaagctacctggcttatggggagacagaagtcacaagaaccacctgctagtgccagagcccgtgagcggcatagcctggaggccacaggcacaatagtgccgcctactgctcctgctacagagagggcatcgcctcctgccctgccagggcagccttcaagtccccccatctcatctcttcacctcacccccttcattcccatgtgcgtttaagccactgtatctaggaagaatgtggatagggactgtggccacttgcagccccacttagttctgtttcattttccatgattttagttttttttttgttttttttttctttttcttttctttttttttttttttttaagatggg

SEQ ID NO: 61857 - DNA, 1856 bp, Homo sapiens
tggtgaagggccaggatggaagggctacctatcaggtgtgcgggatgctgagtgtgacccccaaccaccttgcatgaccttgatgcggtggccatcccagagaggacactgctccacccagctgcttacctttccttaggacaactgtttgaaagtccctttctagaatggtcctaatgggcatggccagggagctggtccctcatgtaagtagcaactgggcaggctgccagggcagctggaatggggcagtggagctgtgttcacagaacgcttgtcaggagccaggcacctggtgcttctctgcccacttaaaggagggcattacgatcgccattgtatagatggggaaagagaagctccctaagtgcctcactcagggtcacacagccagaaagtgtgagggattcgaacccaggattctccagccccagctgcacgttggtagcaggagaaacagcgagagctttctggctctgtggctaacctcaccaaagggaatccatgcagacagctgcagtgcacacggtgttttccccacactctggctgttagttttgttggctaaaacaatcatcaccctggagctgcttttcacagttctagattgtggtgggtttctcagcctctctgctggctcggggaggcttcgggaaggtggtggagcaggtgccctctttgcaggtagggattgtgaaacatttgctctggagcccagggatgaataatgcggaaggctctcttctcaggataatggattccagaatcccagcactgctccggcaggaggcgaggaccggtggctctgcactggcaccccctgttgacctgggtgtggctcagcagccttctcctctggcttgttttccagtaactggtgcccctacccaatgtccaagctggtcaccttactagctctttgcaaaacagagaaattcctcatccactcgcagcagccgtgtccgcagggagctccagactgccagaaagtcaaagtcatgtgagtaggggagggtgggccatttgcccaggcctggagcgggccctccctggaatcactgagccagcccttctcctcttccaggtaccgcatggcccacaagccagtgtaccaggtcaagcagaaggtgctgacctctttggcctggaggtgctgccctggctacacgggccccaactgcgagcaccacggtagggctccctgcggcccccttccccccttgacctctgatccccaaggtcaagcagctcctctgaccactggggtcaataactaatgctttcttctgcagattccatggcaatccctgagcctgcagatcctggtgacagccaccaggaacctcaggatggaccagtcagcttcaaacctggtgtgttgctttccggaaggggaaggcaggcaggctggtggggcccatgtagccagctggccctttttcctgtgatacagcagtgccatttcagggaaaccttgcctccagaatcagcaaggcctgctctgtggcctgtaccacctcccaccttgaaggccaggctcacagggcccccagcggcctactggccaagcacacacacccttttccttcaccccatcttctgggaaggactggttcatctggcactttccttgccccgctgaaccacacaagcccttgtgcctggaaaaagcattctcaccctttcccacagccctaaccagagccaggaagtcatgctgtccttggtcttggagtcagcacaggaaacccaccaagagacaccatttgcagcagggccctttaaggctgggcccaagattgagaaagtaaatgagtttcattatgtggtgaagtatttattgacaagggctgcca

SEQ ID NO: 61858 - DNA, 1001 bp, Homo sapiens
acctcagccatctgaggagctgggactacaggtgtacatcaccacacctggctaattttttaatttttttgtggagattgagatcttgccatgttgctcaggctggtctcgaactcctgagctcaagtgatcctcctgcctcaacctcccaaaatactgggattacaggcatgagccaccatgcccggcctgattttttttcattgatgattttctccatctgttctctctttctgaaatttgtactacttggatgttacatttgcaagactggtcgtctatttttcttttctctttccaattttcatctctctgtttgctcttttagggaaatttctttaactttaccctctaacgtttccattaaatttattttcatttttactgttacgtttttaatttccaagagttcctttttgttttctgaatgctcacgcttcctctcccatctccccctcatttgtttttttcatagcttcctggtcttgtttcttgggtgcagtaatttcttttatcaacctggaaatcttagtacaaatgtttgagtggttctcttctccttacacagtcttagtttttgtccaggttgacatttttttgtttgcccacttcaacctctttttttttttttttttttgagatagggttttgctgtgcacccaggctgaagtgtagtggcataatcatggctcactgcagcctcaaacttctgggctcaagcaatcctcctacctcagcctcctgaatagctgggactacaggcatgcgccaccacacctggctaattttttgtagggatgaggtctcactacgttgcacaggctggactcaaactcctgggctccaaggatcctcccacctcagcctcccaaagtgctggggttacaggcgtgcgccactgtacctggccctcttttggaatacagtgtttcttgggtaaatcttggatgtctgctcacttaagaggagaaagactgagaaactgactggaagctggggtg

SEQ ID NO: 61859 - DNA, 1090 bp, Homo sapiens
catgggaaggggaggcagactgggttctgctagcaggggtggtgacaccaacaccatcacaaggaggctcggctgccagggccaggcattctgccctgcctttgccacttacatctgtttccagagccccagggctaggctgggcccaggatgcaggccccaataagaccctttgcaaggagaagcttgaatagaaccactacgtcctcagacttccctgaggtggagaagcgaaggggttaactgcttcttaggttgccagggaccccgaggggcccagcccagggagccagcagcctgagcattaggactccgggaggaagaggctgtttctgtgccctggcttggggatgtctagaatgtgggtgcctcagacccaggatttgctgtcccagtggaactcagtctgcggtagggaccgtgctgagccccaggcaaggtgtcccatctatcacattgctatgatagcttggaggggtggggacgcctcccagggccacagagctcctaagtgacagtgagagcccaggcccacccaggctgtcctgtccccccaagagggtggccgtgtaggggatgctgctgccagcaggctggttggccccagtcaccagcctcaggcttctcctgacccttacacaaagagcactgagattttcccagctgggagcttgtggcccagaggagtccagcatatgactggaggtcacacaggagcagggcagagcacaggccgccttctctgggccacgatgcaccttttgcacttgttcctcccccatcctcacccccacccccgacccctgccgggcacagagcccttggtatgaacagggaagaacccccactggccagagctgaagcttccagaaccacgctcaggggttcttagctctgggctgatccctgagagcctcaggcttctctgccaaggcccttttctgactcaaggacaaaatcctgtgagtttctcccctggaatggtcaagttaatggctggcttcagggcctcagaaaacaaggctgctgagaacacgccttccttcccaaggaagacttgagggcccctgggagggcgtttcctggctgg

SEQ ID NO: 61860 - DNA, 1051 bp, Homo sapiens
gagcctcactttccttgtctatgagatgggctcccaagtcccccgaaggggtggttgtggtgattccagacccgaatgcaggtcgaacagcaagcatggaccccaccccatgccggcgctcagtgggtactgaaactgaagccagccgcagccccccgtgttgtttcctggggtgtggagtggagtgatgccgcctccgcccagcagcctttctgggcccaggagaggactgggcaggtctgagggccggggctcaccttgcgcaccaccccggaggtgaccgcgatgttctccgcctcctccacggtcttggtggccacagtgttgacgctgctcaccacagcctcgctcacggcgttggcctgctccttggtcttctcggccactatgggaggacactggctggcctccaccccagccccagccccaaggcaggcctgctggagtcaggctcgcagccccttcccaggagctcagagccctggccctgctgggaccctcccctgctccctctgactccagggcacctctgatgctggtgggggtaaggagacgcccaccctagtttagcctcatggtctgcaggggtctgtagggcttgggaccccagttgggggtaaggcaggactctaggtttgagccccagcactaggatgcaggagccccaggggtcctatcccccatgtgtcccctggccctggggcttctcacctgaggtcacgctctgtacaacattctccttggtcttggctcctggggaggaaatggagctgtcagcccagacctccctcgaggtgttgggggcggtcaggacaaacacaacagaacagctggacaaactgtggggtcggtgggggggtaaggatggtgtctgggggccggcggccccttcagagggcctcttcctgctgtgtctggaagaagtggatggatgggaaggggacaggacagaatgtgggggacaagagagagcaggcctgaggtagggacactggctagacccagggtccagcccctgcccgggtgtggccgggcctcagaagcagcaaca

SEQ ID NO: 61861 - DNA, 1086 bp, Homo sapiens
tggagcccagaactcacatggagggaagacccaggagcctatcttcacctcctgctgacagtgggttcctcagggactcagagcaggcaggcgggggctaccttgaggctgagctaagctatccccgtggatgggactgtgagtcctgtcgaatgtcttggggagccgaaggcagtgctgcctcctccatgttaaaggcaatgggtgggttgggggtgttcctgaaggctcacgcaggtcccatgaatgccctgtgtgtgtccctataggatacctggtcctatcaacaggctgaacccgttcctgttcctgggaggacctggggacccctcctcaagctacacagcacccagaggaagcatggcaggagtgggctcaagttttatttggaatcatttaaaaaaaaaattcacagcagcataagtggggtcagaaggaccagagggtgggtggggccgagggagggcagtgaggttggtgcagcagcacaggtggacaggccaagggtggccagggagacgagggcaggagcgtgggcagccgcatgtcactcaaggcgggcactccttgtgctaggaggggatggtgtccaaggcagaggagcgctcttcaggtcatccacgctggcctgtagccctctagtctcccccactctgggcctgggagagagaatgacctgcacacccagctccaggccccagccttaatgggccaccctgagtgggctgagaaaagttgtcttctgtgccccatgcctgaggggtcatccgtggggggacctcccactcaggttcagggttagccctgtacacagtccctgtaggggctgtggaaggtcaggaggcccctctgggccctgggagcccaggagggaagcagtgcgtctgtgggggatggggtccctaccaaggaaccccccatggtgcaccccaggagcccagctcctacctcctctgccacttcctctttctctttggatgcctcaccctcctgttggggggcagatggcctcaagtcctcctgtaggggacaaaagggggcatgagaccatgtggagaatgcagagacccctagctgccctgcaac

SEQ ID NO: 61862 - DNA, 1455 bp, Homo sapiens
ccagcctggccaacatggtgaaaccctgtctgtactaaaagtaccaaaattagctgggcgtggtggcgcacgcctgtagtccctgctacttgggaggctgaggcaggagaatcacttgaacctgggaggcagaggttgcagtgagcagagatcgcaccaccactccagcctggatgacagagtaagactccgtctcaaaaaaaaaaaaaaaagaaaattctagaaataaacaattcatgttttaaataactttcattacagtatattgttataattgttccgttttcttactggttattgttagtctattactgtgcctaatgtataaacttcatcatagggaggcacatgtgtacgtgtaggaagatacatatgtaggctttggtactatctggggttgcaggcagctggaaacatcttgagtgtatcctggtggataaggggagtcaaccgtgctcctgcagggaggtcagaagcagcctcacagggtgcagagcacatgaggtttcaaaggcaaagagcactgccagtgcccatggctgggaaggggctttctggtgatgtttgtcatttgagtccaggaacaagccctgagtgtatgtgagagggggttgtaggggggctgtggtaggggcagcagggacccctctgggctcctccagcagaggcagagggccctgaaacctggggcaggttgtcgctgggagccgggcataggtgccctctccctcacccccatcacctgaccagccttgctcctccttgctttctctcacagcccaggggactctcgggcacacccaggccccaggtggcctcctcctgggttcatacaggcctgcttaatgtgtacatgtctgggctggggagcaggaacagccctgactggcctgagctgcttccagacccttcatgcctgcccatggcagtgcttggggatgtggagaccagcagccccctgctccgttctgcctcctcagtggatgcccatggccagacaacagatacagcctggctccgctgtgtctgactgggctcccagcctcctgggctgcccttgaatccactgcagaggctggatggggaggcggtgtggacagggcagtgtctgaagtcacatgtggacggactcaagctctggctccaacacccaggcctgaaggcctggggcaaggcactgagatgctttgagcccaaaccatctgagtatcaaaggggaagccaggatccccagggaaccctggtctgaacaagcccgcccggcatgcaaggctttaaaacaacccaggacacgctggccagtggcctacatgatgggtggtttgcgtcgtgcccggcaggcttgttcagagtgggctgggcaaacagcctttcatgtaggccactggccagcaagccctgggttgttttgaaactttgggttgggggcaatccactgtaagcaccttggggtcc

SEQ ID NO: 61863 - DNA, 2080 bp, Homo sapiens
attacaggcgcccacccccacacccggttaattttttgtatttttaatagagatggggtttcaccatattggtcaggctggtctcgaactcctgacctcaagtgatccacctgcctcagcctcccaaagtgctgggattacaggtgtgagcaaccgcacccctgcctaatttttgtatttttagtagagacagggttttaccatgttggcaagtccggtcttgaactcctgagctcaagtgatctgcctacgtcggcctcccaaagtgctgggattacaggcgtgagccaccgcacccagccaccccattgttaagtccagagaattaggccctcctgcctagaggttctgctgctagagtagtttgtctttggctgcccaagtcctgccttgaaacaatgagagggtaacttggaccaggcctgtctgggccttgtgtgtttatggcctggccacttgagtcaggatcatcttcactgcattttctctttcatttcagcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaaaacttacgtttcttttctgtgtttttacatgtggtagtttctcttttcataagttataatactgcaattggatttctgaaatgtttatagcgaccacctgtataacatttccttccactttattgtgagctgcccagattttattcttgaattgttttttttttttttgttcggtgctttacacgttcagagaaactt

SEQ ID NO: 61864 - DNA, 2116 bp, Homo sapiens
gatggagtctcaccctattgcccaggctggagtgcagtctcggctcactgcaacctccacctcccaggttcaagtgattctcctacctcattctcccaagtagctgggattacaggcacggaccccatgcctaatttttgtatttttagtagagacggggtttcaccatgttggccatggctgatctcgaactcctgacctcaagtgatccacctgcctcagcctcccaaagtgctggaattacaagcgtgagccaccatgcccgctcatcacattcttaaacagagaattttattgttgaagagaaaccagttagtacattgtttcttttggcaaaagaattttgagaattgcttctaaataaacagagtatggatttacattggtcaaaatatgactcttgctgtctataccaggactttaatttttgtgttatgggtaattgttcttcacagggatttggtaatgtgggcctacactctatgagatatttacatcgttttggtgctaaatgtattgctgttggtgagtctgatgggagtatatggaatccagatggtattgacccaaaggaactggaagacttcaaattggtattaatacatttttatagcatagacactaaatataaatatttaaaactctggtgcagctattaattgtgattttcaatcaatggcagcaacatgggtccattctgggcttccccaaggcaaagccctatgaaggaagcatcttggaggccgactgtgacatactgatcccagctgccagtgagaagcagttgaccaaatccaacgcacccagagtcaaagccaaggtgacaacattatagaaaccagaaccaacattatcaatgtgaatgacgttaggggggtcatagaagagtctgattgagttttctctttctttttagcagctttattggcacatactgcacataccatacagttcccccatttaaggtacataatttaatggcttttagctaccggcacagagttgtgcaaccattaccaaaacaaacgcatctgcctgacactcctgtaaaaaaaaaaaacaagcaaacaaaaaaaaaacctagataaatagaaaagtgaaaggtagttttatacacttggcagagaaaaataacctctatttaactttaactgaaactgtgcttctccccacagccccttgttcatatatgcacatctcttgccctcagtggaggggatttgacggtggtgttcgcatttctctatgttcctgactctcttgcagatcattgctgaaggtgccaatgggccaacaactccagaagctgacaagatcttcctggagagaaacattatggttattccagtaagtcatctatatttattaggctttatatgtacttagaatcataatagtcttttgcaaggaatttggaggaagagaggaattattagtctccaagctctagtgaattcatctttttcacttttgagaaaatatagtagaagcatggttaattctaagcctgttaattttcactttgatcgaaacatttattccaatttcaggctctttactgaatgtctttagccttctaagagtctggttatataaatgtgtactgtgttagaaacactattctaactaaagctcttaagattttctatatgattcctaaccttatgcatttcaagtgccctttccagctttactcagaaaactaatatgaggaacacgtgctcaggttttttagcaagtaaaaatgagtctacaccaaaaagttactagaaattaatgtgggcttggaatatattttaaagaaccccctttgctgaaagcacttaagacatttaatgtaactgaaatgggctacccttaggtaataggagaaagaatcctgtcttctgagaggccctgtggacagtccagtccaactggttggtgggcaagccatttagtctgagaactaacttctggtagagaagaggctccaaccaaagattattaactttccttgattaataagccaaaaaatgattttttttttttcctaaatagaaaaagccttagatggaattgggtgggatgggaaggagtgttaattaagtgtgaaattcctgatactggctaaaat

SEQ ID NO: 61865 - DNA, 1003 bp, Homo sapiens
tctcaggtcaccgcaacctccgcctcccgggttcaagcaattctcctgcctcagcctcccaagtagctgggattacaggtgcctgccaccatgcccagctaatttttttgtatttttagtagagacggtgtttcaccatgttgaccaggctggactcaggtgaagcaactatactggtgaacagttttccctctttaagtgataagaaatctaaaatcaagccctaaaggaaggacacagttgtttttgttactcatttctagatgtgaactgaaacgtgccgccctctttgtcctagccccacctagaagtgcagtgtaggtgggagaatgtattcttctctgggctttcaggaccattacgtatgctggggagcctggcagttggcgccaggcctgaccccagacagtatttccttcagctccagcatttgcattctcactgtttaaaagcatttggcactcggtttgcatttctgtattcataagtgttaattattcatgaaagcaaactgtgggaaaactactaattctattaatcactctactagactgagtttttcttccttgctttcatcctttttgttggtaattacacaaataatataattctaagttctctgtgtaaaaatatttaaacaatacagataaagaacagatcactttttaattcagccagctggaatgttagggatatgttgggagttaggggtttggtgtgaagtagggcattttattttgtttacatggaaagcaaattgcttcaacaaatttattattttatacttttgccactgacttaaaattttatatgaattttcattttatattgattgcctatacaaaataagactgtctctagtttctcctgctccaccgatgagtttactctgcagtgttctcgtggccgtgcttatagtatagttgatgtcttggaagggaagccctacttagcccaattcttcttttttctaattacacctgtttctgtttctgaacaagaa

SEQ ID NO: 61866 - DNA, 1041 bp, Homo sapiens
cctttccaccaagtccaggagccagaggaccaggagaggagcattgcacatgtgaggcacatgacagagagactcagcaaaactggattggatatatgtggaattaaggaaagggaccaggctgagtcacagagaaccaggagaacctgagtctggggactgagcagaggtagtaccacagaactgaacatgagaggaaacttaactcctgtccctgaaaggggtgcaaccttaaaaaatgaaacatttcaggagtaggaagagaaacagagtcaaaaaatacatttatgcctactacatgcagggccatgtgtaagcaaggtattcactacaattgggataaattgctagaagttgttttgaagctatgaaaaagaatcacaggcccatccagtcctttcagtcctttcaaggtaaggtcagaaaaagcctcctaggagataaaaccttctggtctgcacttagacgggtgtgtggacatggactagggtaggggtagtggcaagtgtttggaacagaaggaattacctgagggaaggttctgaagttcagaagctgggtgaacttgggaggataaggactgactactgtggccagagttgagaaagagaaaggtgggataagaaaggccagtagaaaaaagggtcaggccaggttactgcttggtaggtgaccatgagaactttggtctttgtcctgaaaacacagggaaacagcaaagagctggtttcaagcaggtgtgactcagctaagtgtgcatttgaagacttgagggcaggagactactacaggggcccggactgcaaggggatatgaagagggaagcagggcatgaaatatagcctccaactaagaaaaatggcaccggagagaagcagaaagaagacagcttgaaaagtggctgttacccagagaaaaaggttttttttgtcttttggcatgtttattggctgtaagacacagatttaccggtgcaagagatagacaatgctgaagagatgcaggctggtagaggtagtgaagtcccccaggggaatgaag

SEQ ID NO: 61867 - DNA, 1942 bp, Homo sapiens
ctttttaatggctgtttagtactttgcataggtataccatatttcatttaattggcatacaagataattaggttgtttttatttttactgtgtttgagaggagtatttctgcacctttacagatttgagtgagcatcacttaacatgtttttatcagagatcttactgtagccgtcagtagtagtatagtcagtgattcctgttattgcctgtaagctaatttattagcctaaacctttaatttcctatgatctgaggaactgaaagctaaggcctaaaaccttatatgtgctgaatgtcgaataataggtcacagccacattcttccacaagtaaaaataatatggggcttaacacaattgctttagcaatatgaccttctcccctttttctctacttgataaggagggcttatacccccactaagcagcatgttactctgctatctcatacatgtcaactccctaaccataataatcctgcttatatagaacacaatggtactgttatctctaattgcatgttagtgaaatgaggtcaagagaggctaaactgattaacctctggtcgcacactcagaaatcctatggagtggcttatatctgttgtgcatagctaacttccaaacatacagcaagtaaatgccagagggagaaattattatgtaatgttgtatgtgtctgcattttatagtgaaacatttaatgaatatttctatgactttgattagctacctaaatgagatctaaagttttctagccatggtaacttggttattacagagacttacaaggatctttgtgttcgagaagaatttttcttaaaaactggtgcactcctctttccctgtgcccccgcaggtcctggcattgatgtgcctgctccagacatgagcacaggtgagcgggagatgtcctggatcgctgatacctatgccagcaccatagggcactatgtgagtacccactggaagccccgaggcttctgcatttgctgtctacaagaattaacagtttgactgattatatcaaaagttgagaatccctgggtttttctctcattcaatcataatcttgatgtgcatattattttatgtctacttgtctattcttaaatcgtaatgaacacagattgagctttacttatatgctgccctatacttgtcactggaacaggaccagggcagcccactgtgctaagacactagaacgtacatcaagaagcatccaattctgatttttccctcagagggcttccatttaaagaggaactaaggtgcataagcagataaggtatggaaataatgtaatacaacagtggagattatgaattctgaaataagactttctagaggagatatttgggctagaccttgaaaatgggtagaatatgaacatttagagatttggaggataagaggaagagaaacaatagcgttcagtttgtctgaaggtaaggcatatttataaaggtaatagaaagtaagagtgagggctggatgcagtggctcattcccataattccagcactttgggtggccaaggcaggtggatcacttgagcccaggagttcgagaccagcctggacaacatggggaaaccctgtctttccaaaaaatacaaaaattagccaagcgtggtggtatacacctataatcccagctacctgggaggcatgcttgagcccaggaggttgaggctgcagtgagctgtggttgcaccacagcactccagcctgggcaatagagtgagaccctgtctcaaaacaaaaaaaaagtaagaatgaagaggtaaatgaaccaggacaaaaacaccaagccccagtgtttgtgttttacatggtagtcagtggagaaattttgctgatccttcctggggaagaataggctggcagcagtgtccagctgtgctggcgccaggagagaacctcctatggtgtcagt

SEQ ID NO: 61868 - DNA, 1173 bp, Homo sapiens
ttttttgttttttaaatgtattgtttaatcaagacaggatctcactatgttgcccaggcttgtctcaaattcctggactcaagccatcctcctgcctcggcctcccaaagtgctgggattacaggcataagccactgccccggcctagttggaattgttgtttgaggtaacaagcttatttaatcctaaagcaagcataatccttttgtagttacctctagaaagattcaggaccaatttgtcatttgtacattgggagaaaaggagtggttaaacaaagttgtgctgacctccagcagaggtatgtcactaaaggaatggaaagtgagcaaataggagctggagagcgccagagagcccttttgtcagtggatgaggctagaatatggcattaatctttccaagtgcagtggggattagacttcacaagattttgttgttgttgttgttgttgttgtcgtcattgacttcatgagatttttaaggtgactaagggaagggtgctaagacatagagttacagattaggtgggaggtggagagggtcagggtataaaaagcgatccttgaccatttcaaagttatcttatactagccctgtatccattacatcacagcttgttcaaaaaagtttattatttaggccttgggcccctgagttatagaaaaacattacaatatactgattctgttgactaaaaagtaaaatttataggaataattgggtacagcccttagaactttaattattttatggggagacataatagtttaatagtttaactttttttttttttttttttgaaacagagtcttactctgtcgcccaggctagagtgcactggcgcgatcttggctcactgcaacaccccccacctccattcaagcgattctcctgcctcagcctccggagtagctgggattacagacatgtgccaccacgcccggctaatttttgtatttttagtaaaggcagggtttcaccatgttggtcaggctggtctcaaactcctgacctcgtgatccgccctcctcagcctcccaaggtgctgggattacaggcatgcgccactgtgctcagcctaatagtttaaccattttttaagttgcgtttttcgttttgtaaaaacgagtttgtattttacagttgaaataatatagaaagttataaact

SEQ ID NO: 61869 - DNA, 1722 bp, Homo sapiens
tttttaaaaggtctttcctcttcccctaaatctcaaacacattttatagtcttgaatggtttcagactttattcagtcatatttgtcacccatatctgcaatatctccagcttaattttatcagacttgacaagtacctaataattccaaaggtcaaaaagtgattcattggaatactgaaagaaaacacagcttaaactctagtaatttgatttatttgcttaatgtgcaaaagcctcattgacccaggatgcagttaaattgacgtcttggcccagaaagctttgaagcctaggaggtaggcaaagggagttttttctctcactcctcggcaaaccttcaaatttgatgttatttatctgttatttcctgactgcccattccacagagagtgtcagattgaggctcagacctgagcctgaaccctgatcctgtcacatgtgtgtttagcatcagcttgtaaatttctgcaaaacaaaagaaaaaaagaggctgggatttttataggaatttcattgaatctgtacactaatttgtggagtattgccatcttccccaccctccccaaaaaggttttgtcctttcacccaggctggagtaccagacagcagtcactgcaaccttgacctcctgggctcaagcaatcctctcacctcaccctcccaagtagctagaaccacaggggtgtgcaactgtgcctagctaattttttaattttttgtggagacacggtctcatcacgtatcccagactggtctcaaactcctgagctcaagcagtcttcccacctcagcttcccaaaattctgggattataggcatgagccactgcacctgaccagtattgccatcttaaccatattaagccttccaatgctgaatatgagatgtctttccatttatttaggtctcttgatttctttcaatgatgttttgtagttctcattgtagaagtcttacatagaagtcttacaactaaatattttactccttttaatgctattgtaagtgacattggtctatagttttcttatgatgtctttgtctagtctttgtatcaggacaattctagcctcatggaatgagttgaggagtgttccttcctcttctgcttttggaaaagcttttgaaaggtcaatgttcattctcttgtgtgagtgtaaatatcacctaagttctgcaggaccctgatgtctccacccttctcatccccttatatctctgtgtaccaaaattaccctttcatctcctactctatagtcacatgctgttagaaaagttgcttttttaaaaaagattaacttctgcctcatacctgttctctatataagaatttatctgttaggccaagcatggtggctcatgcctgtaatcccagcactttgggaggctgaggcgggtggatcacctgaggtcaggagttcgagaccagcctggccaacatggtaaaaccccgtctctactaaaaataaaaaaaaattagccaggcaggtacctgtaatcccagctactcaggaggctgaggcaggagaattgcttgaacctggaaggcggaggttgcagtgagccgagatcatgccattgtactccagcctgggcagcaagagtgtaactccttctcaaaacataaaaattaaaaaaaaacaaaaagaatatatctgttattcaggaactacttgttttttgtttttgtttttgttttgagacagagtcttgctgtgtc

SEQ ID NO: 61870 - DNA, 1049 bp, Homo sapiens
actctgtctcaaaaagaaaaaagtattactgtgatctgaagtttttatgtcaggatctgattctagtgacacatatcttaactaagactataaaaaccttactttttatccagtcagttccaagttaattcaaactgattgtcacaatgctttacataatactaaattatctatatacaaacataaatgcatgatttttattctctttaaaattcaccatttaaatggaatataattatatttaaattaatcttaattaagatttagtgtatttttcagtggggaattaatagaatgggaatttgagccctagttctactatcttgtttttataacctacttttttgatcccttattttgtcacctttaaaatggcaatgcctactttatgagttgttctaaggattacatgagaagacatatgaaaatgtactataaatagaaaataagatgctagctataatctcaagcgatttttatatcaattttttcttttgtttttgttttcttattttacaggataatgaattggaaaagatcacaaggaggttcaccatggagctagcaaaaaagggctttattggtatgtgtagccacatagtttttggtataaagtgggaacatctaaaaatttttttttttttttgagacggagtctcactctgttgcccagactagagtgcagtggtgcgatctcgtccgcctcctgggttcaagcaattctcttgtctcagcctcccaagtagctgagattacaggcatgtgccaccacacccagctgatttttgtatttttactggagatggggctttgccatgttggtcaggctgggcttgaactcctgacatcaggtgatccacccatctcggactcccaaactgctggtattacagataggagccactgtgcccggcctcctactatttgttataggagcttttgccaaacatacaacatttctgaagatattaatctttgtttgcttgatgtttttgtatcttactattatctgtgtttatattttctttgtgcacaatctgaatattctt

SEQ ID NO: 61871 - DNA, 1108 bp, Homo sapiens
atttgtaaataatgagaaataagggcttgtgacagtaaatatatttggtctctttgcctggttcccaacacagagctcctgaatgtcgcaaattcctgagtgataggagcatcttttgttctaactaggacactcttaatgggcttctgggtagcttcaaggtggggactagtcaccaaaaagaccaagccataattagaaatttggaactttcagtcccaccctttgacctctggagattggaaaggggctgaagattgagtttaatcagcaatcagtcatgccctcataatggaacctctatacaaaccctaactgatggctggagtatggggagagttcagagagcttccaggttggtgaatgcatccatgtatgggtagggtggtaccctccaaattccaggggaacagaagctcctgcagtggggacattccagacatggccctgtgtacctcttcatgttgctgttgatttgtatcctttacataagtaacgtttccctgagtcctgtgagcctttataacattattgaacctgaggagggggccatgggaaccccctggttggtagccaagttggacagaagtgtgggtgccctgggcacccaagacttggaactggcatctgaagtagggaacagtcttgtgcgactgagcccttgagctgtggggtctgtgctaaccctggtagtcagtgtcataactgaattgcaggacacccagtttgtatctgcagagaactggagaactgcttagtgtggaaaacccacacatttggtgtcagaaatgtgtgagaaaaaacaattttttcctttttttttttttttttttctttgagacggagtctcgctgtctcccaggctggagtgcagtggcgcgatcttggcttactgcaagctccgcctcctgggttgatgccattctcctgcctcagcctcctgagtagctgggactacaggcgcccaccgccacgctggctaatttttttttttttttgtatttttagtggagacggggtttcaccatgttagccaggatggtcttgatctcctgacctcatgatccgcccgcctcggcctcccaaagtgctgggattacaggcgtga

SEQ ID NO: 61872 - DNA, 1044 bp, Homo sapiens
ttgcagagaatgtgcattgtaagagagacaggtcttctttcttaaagcttttttaacgtctaagaaattgttaacctttgtagtcccactctagtcttagaaacacagaatatattaggtgattgagatttttttaaatgctttggataatccctatgaaattctgtctttccctcttaaacatattttaacacgttcttcttacctctccccactaacctgtcttctctcccattggttctttgccaaaaaaaaaaacctcatctgcctctctccacccttttaccaaccttcagctttctgtatctcattttccctcaagaacaaccttatccctgagttttctaaattaaaattcttgaggttgaagcaaagcaacaatctagcaataatctctaagggaaacagatggttataagacttggtggctgatgtgtactttttccaagtaaatatttaataatacacactgtttttgtgcttttcttttcccagttactacatgtacctgaggccgttagatttgtctgtgttaaggatttgaaagggtaagctaaaggatctgaagggaagtttaagtgaggccttaaaaatatttccagcaaaggggcatagtgtgagaatatgcgactgatttgagaagactggttcaaaagttctggtgggtttggaaatattatcaaagattgttctattaactttcccagagtaaattatctgtatttcatttgctatggttctgcctgagaccagtctacctttttagaaggaagtttattgttttaaagtcagtttggagggaaagtacagattgataatagcaatttattgatggtaggagtcaattaactttctcttccagtctgcccccccccagttgtcttgatattaaaactattaaaattccctatcactgatgctactatcataaaattttctaaaattatcataatttacatatagttgatggaccgtagatggagttctctcatacattgaccctaagtcttttaattacaaatattagtacccaaaaaagtgtac

SEQ ID NO: 61873 - DNA, 2546 bp, Homo sapiens
cgcccccgacgccccgccggcgcgcgctgccgccagcgaggcccggggaggccgcggcggaggcggaggcccggcgccctgggcggcgccctgtccccgaagtccgtcctccccgttaggtggcgagcgcccgaggggaggggacagccgggcaagcaggaagctgcggcttaaaagggcaacccgcgcgggacccttcctccctagtcgcggggagtctgagaaagcgcgcctgtttcgcgaccatcacgcacctcccctccgcttgtggccatgtaccgctacctgggcgaagcgctgttgctgtcccgggccgggcccgctgccctgggctcggcgtccgccgactcggccgcgttgctgggctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtgagcgtcggccgggccccgtcccgccctccctgcctcccctgcggccctcccctccggcctcctgccggtgcggggccgctgctcagcccagcccagcccagctggagcgggccgggtccccgcccgggtcaccccgcctcggatgtggccggctctgtggatggtgatttttccgccttaaaatcatcatgcgattggcctgccccctcccccgcgccgtcaccccgggcctctgtatatgctgatcttgcatgcagagtagacgctgcaccggtctccttttggtcccggtgtctgtgtcacacacggcgggtcctgccgaaatgcacttctaggaaagggaatgacctgcccgtgtgataatgcctcgtcagtgttcttgggcttttgtgagtctcccctaaatgcaagctgtcaaattattttctggtatttgttcactcctgttccaatagtgacagatgatatccgaacatagaaaatgacttggcttctaagtttgaaatctagacagttttattaaccaaaggaatttactaatcacgcgttaatcgtttcaattaagtaattttcccattctgacaagttctgttttataccaaaaaaaaggaaaaacacaaaaaaatcacaagcaatgtaatatctctgacaaataaacacctggcgtcctgacagtaaatttacaggttgtaggctgcggatggccagccagccaatggaatgaaatagctctgggggtgtgtactggtcctggctagccctgaatttgagcttcaggaaaaatatagtacgtgaagaaaggggtcagataatgtttggtagtcactgggttatcctgtggtttaaatcatttaatgtctgtagatttggcctctgtagtcagattgctttcttcgagcaaataagagcttttttccccccaatacattgcatcatacctctttagtaacataaaatggaaaggacaaaccacttttgtctactgtaaaaaagaaaaattatatggaataaagagcccagggaggcgaggagtcttgttggaggtggattggctgagaagcacagaggatgttgggctagacccatgtctcagtaaacctggttctgtggtctttcagttatgcccgctgacttatgaggatttttagaaatcctctctgtaccggaaaaaacttgagcggtgctggtgttcccagcaggggggacaaaggttgtttttaaagatttactaaatttgcattgaccccgcccacttctaggacttaactttggagcttaattatcccctagctctggttgcctcagccaaaaccaatgtttgaaccactttgacctctgatttcctttctagcttcaaaattgtataaaatgtacacaccgtcagtctcctacatttgcctgccttcttcctaccactcccttattatccaaaccaggaaaacaagttcagactccaaagaaaggcaaataaggatgttggaggaagttcaggcaatgtttagcaaatattgagttgcatcgttttcttaaaacggacatcaagtttattttttactatcttgctggcagcatttgccagtcctttaaaaggtgtacagataaatcagtgtatgtggttttctgcaggatgatttggtctctgaaatcctttttcttcgattcttcagatgcccagctctctcctgtttttataagtcgcagctccgcaaactcactgaagcaactcgtttaccatagtttgtgagtcctctttctcttgttgccacagcagttttaatgccaaaatattgaacctagcaacaaattgggtcagccataccaaagc

SEQ ID NO: 61874 - DNA, 1049 bp, Homo sapiens
tttctctcttaaaaatattttagaagaagattgttaggatttagaaaaacatagcatataaattcttgaaccattcatttttaaaaataatttaatttgaaaggtaaaaatatactttctactttctgtctcactaaatcagtctattctggacttttcctataaaagatgtatgtggccctttgtgaccgtcttctttcacttggcagagtattttaaaggtttatgcgtgtagcatgtatcaggtacttcatttcttgttatggctacatagtttttgttgtatgactgtaccacattttaaaaatctattcatcattgatggacacttggattatttccactttttgactattctgaatgatgctgcggtgaacttttgtgtgtgcatatgttttcagttctcttgggtgcgtttatacctaggaatggtacttccatatttaaatttttgaggtactgccaaacttttccacagtggctacaccattttaattcttaccagcagtgaatgaaggttccaatttctctacttcttcaccaacacttgttatgtgtgttttttattataatcatcctagtgggtatgaagtatttatttgcagttccttgatgactaataaaatttagcatctttcatgtgcttatggaccatttttatgtcttatttggagaaatgtctattcagatcctttgcccatttttaagtcaggttgtcttttattattgatttgtaagagtttttttttaatatgttctagatgtaagttccttaccagatttgaaaatgttttcatccattctttaggttatattttcccatttttcatagtgactttgaagcacaaaagtttttaattttgatgaagtccaatttataaatgttttctttcgatacttatgcttttggtatcatatgtaagaaatcattgtctaattggacttcatgaagatttactcctttgttttcttctaagagtttcataggtttagcttttacatttaggtttttatccattttgtgttactttttccgagaaaaggatcca

SEQ ID NO: 61875 - DNA, 1051 bp, Homo sapiens
ctgtgccaggccgattactctagctttgtagtaaattttgaaattgggaaatgtgagtcttccaaattttttttttccaagattggttattctatctccatatgaattaggatcatgtttccaatttctgcaaagaagtcagctggaattttgatagggattatgttgaatctgtagatcaatttgggaattagtgtcattttaacaatattacatcttctgattcattaacatgggatatctttctgtatatgtaggtcttttaaaacttctctcaggactgttttatcactgtcagaggataagttttgcacttcttaaaaccaagtaagctaagttagcaattcccaaaaattatatgagatggtaactcccgaaattctgtggcataacaagattatttccttaatggcaagcatattctggccccagaataatttagaatcaagtatagaattcaagagaatcaaggctgcagcagtaatactttgagtctatacccttgtgtatatttggcttaaatgttttaggagaattggcctttgaaaatttaagatatttgttatttcaaaataaaatgtgtaatcaactaatacaaagcaagttttgtactttttgttgaatttattactaagtattctttttgatgcaattgtaagtagaaatatttatttattaagagatagggtcttactgtgtggcccagtatggccttgaactcctgggcttaagacatcctcctgctgcagcctcctgagtaactgagattacaggtgtgcaccacctcgcctggctcagaatggttttcttaacttcatttttagattgttcactgtgaatatatcgaattacaatagtttaggctgggcatggtggctcacgcctgtaatcctagcacttggggaggctgaggtgggtggataacttgaggccaggagtttcagatcagcctggccatcacagagaaaccttgtctttaccaaaatcacaacaaattaattagctggttgtggtggtgcatgcttgcaatcccagctactggggaggctga

SEQ ID NO: 61876 - DNA, 1045 bp, Homo sapiens
cacctgctaccatggctgactaattttttgtatttttagtagagacggggtttcaccatgttggccaggctggtcttgaactcctgatctcaggtgatccacccgcctcagcctcccaaagtgttgggattataggcatgagccactgttcccggccagaaggaataattgttagacaactcacagtgtctgccatatttgccacagaaaataactgacttgctctctgctgtcttactgtgataatatatttttttaacgcaatttacaaaagggggggaacattcttaaatttgaaactaggaattatgatatttgcagtttcatattgtatacagtaaacagtcttcaaattctagttctccttgagatcttatacaatgataacagttttaaaattatgccttctgttttttgaacagctttttactattgacagcttttaaggaagtagttttcatgttgtcgtgtttactctcttactagacaggaagacagaacagaaatccatcctcaacttctggggataatctgaggattataatgaaatatcagatgcttaaatgatttcaacagacttttagatgaagttgccattagcaccttgttatcatcaatgtaacacataggcaagtggattaaaataagagggctaaactggcctttatgttgaaattagaagtttcgttgtcctacaggcagaaatgacagtttcattggattctctatgttatagtaatatatcagaaggatagcttgagatgagactattttgaagatacatggggtggatattcaaagtgccttttacatagttactgtcctccacagtttccccattaaatgtggaatccttgtgattgcattcttggagggccatcgaaaactagtgaagcacagagagactattttttttctatagatattaatctaaagcaataattggcaaaaaaaaaaaaaagagatttaaaatgtaggataaaggccaggtgcagtggctcatgcctgtattcccagcactttgggaggctgaggcaggtggatc

SEQ ID NO: 61877 - DNA, 1924 bp, Homo sapiens
agcactttgggaggccaaggcaggtagatcatctgaggttaggagttcgagaccagcctggccaacatggtgaaaccccttatctactaaaaatacaaagattagccaggcatggtcgtgggtgcctgtaatcccagctactcaggagattgaggcaggagaatcacttgaactcgggaggtggaggttgcagtgagccgagattgcgccactgcactccagcctgggcgacagagcaagactcagtctcaaaaaaacaaaaacaaacaaacaaaaaaccagtcagtactctagggaagaaataacaatagctatattatgacatagtagtgagttgaagataactgaatagccaaaatatattttggagatagtttgatatgagaggtgaggaaaagtaagtagtcatgtgtggctctttgtttctggctttaataactccagtagttctggaagagacttagtgggaaacattttggataaactgagtttgtccaaatggggttgccaagtggagagttgagtaaatgaagctagagctcaggaaagatgtggaccagagttataagtcatatttatttatttatttattttgagacagagtcgtgctctgtcgcccaggctggagtgcagtggtgcgatcttggctcactgcaacctccgcctccggggtcaagtgattctcctacctcagcctccagagtagctggtattacaggcacgggccaccatgcccagctaatttttgtatttttagtagagacgggggtttcaccatgctggccaggctggtctcgaactcccgaccttaggtgatcctcctgcctcggcctcccaaagtgtttggattacaggtgtgagctactgagcccagcataagtcatatttaaaacaatgggaatgggtaggaacacctagagatagagtgtgggaaatagaatagggtccagtatacagctgtgccaaatttcacatgtacaggttagatagtggagtgggtcagttctgttgggaatgccctgaaagtttgaataatgataagcacgtccttttaacatcatgaggtagtggtgacgttgtaagaggagtttcagtgtagtgggttgtcatgggttaaaacgttcagattgtcatgggttaaaacgtgaattggatatgaggaagtggagtgcacaaagatagttttctgaaagttttacttggaagaggacaaaaaattgagacgacagtttgaggaggatgaaaggtcaagaattctaagctagtgataaaaatttcgtcaacatcaatgaataggtaatgtaaacacattaatcctgggatggatgtgagaagagcaaagaaaggaatcctgggggaatatcagctctaaaggttgagtagagaaggaaggagtgatctgagaggtggaaggaggagtaggaattatcatagaaactttaagcttcttgagggcttgtgactgtgtcatgttcatcattttatctgaagttcttatcaacaaagtagctttcagtaaatatttattaaatgaagataaaaattttaagagccatctgcaatgtcaaatgtagcccacagttgaatgaatatgaggacagggaagtgtcccttgattttggtgttaagcagctgattgccaccttctgtagaacagcttcagtggagtctccataatagaaataaatgccaggttgctgaggactaagcgtggatatttgttgagagtggagacagtaagtgcaaacattcttttcagaaagctttgctctttttgaagctttgctcatagggagatacaagatagtaggtagaggggcaggctgtgtttagatgagagagacttcagcatgtttatatgctaaatggaaaaaggaaaaaggaagggagaagttgaagatgtagaataaaggaggtgtgtgtg

SEQ ID NO: 61878 - DNA, 1051 bp, Homo sapiens
gaaaacctacttcatttcttgaaacttgtttcttcctctaaaaagatgaggataatatcttgcagggtggctatgaaaattaagacagttcatacagtatctggcacatggaaagttctcaatgttaattacccatttttttctgtttaaggaaatagtctcaatcctataccatgaatgaattatgaaaatagttggaaaggaaacaacagttttaaatgtaaactgtctcagtcttatgctgacatcagctacatttctggtaaagtgatggtgtcatgatacaggttatattaagagttaaaaccagtttccttctggctttccaactgacataataagcaaaacctgcctgggcaaacatagacctatttattggctcacttattattaatgttaaactagctttggtgctgacttctgttcttgttttaaaatttcactgttgtcatttaaaatctgacagaccttcagaagcttcatagaatgcttaatggtttaaatcgtctctagaacatgtgaagtatcttttccaaagtggttttctccatctgtcagtatgttcaaaatcatgtgtatagggccgggcgccggtggctcacgcctgtaatcccagcactttggaggctgaggcgggtggatcacgagatcaagagatcgagaccatcctggctaacatggagaaaccccgtctctactaaaaatataaaaattagctagccatggtggcgcgcacctgtagtcccaactactcgggtagtcccaactactcggaaggctgaggcaggagaatcacttgaacccgggaggcggaggttgcagtgagccaagatcgcgccactgcactccagcctgggcaacagtgcaagactctgtctcaaaaaaaaaaaaaaaaatcatgtatataggacagaattgcttatattttcacaattactactggatgcctgtttggttttcatagcaatcaacttttggagtttatgggcagtacttaacatatataacctaagtgtggataattatttaaaataaggctactggaagaaaa

SEQ ID NO: 61879 - DNA, 1124 bp, Homo sapiens
cttagaaatagtctgagtgatgtgtgaccaaaatatgatttctaggaggaatgattgttacatccgtggaatagctgcgtacactttattgttcttggtgcttaaactttagttgtcctgctaagataaaggaagacattctttcagttggaaatcataatgtatttctccattgaaacagtatggtttgaacagtgctatatattcttactcattattattccttaaatgaatattttaagctcctgatagaaggcaggtactgtgttatatgctgttggtgttaccagaatacaaagatgaagagaacaaagtattacacaattcctaatctcacataaatgctattttttttactagctgtggggagcacaaaataagtggttgaaagtcatctgacacagttacatttattcctttccttttccatggctcttaggaataaattgttctactctatggattaaattgccctttgtttattgcctgggatcccaactttatttcataattttatttctttgaggaaacgtttcacaagttttataacaaagtataactcaatttggagagcacaatctgtgcataagttggaggctacctattgtgaaatggaaaaatgcttgtcctagcattactaagttaatgtatagctggtagaaagttttcacttttaattgctaacttgcctagtgagagtgaaagattgattacggcaactaaaaagtataaaaactactgagtagtttttaggtacagtcagttcttcagtagaacaagaatctttagaaataactttcactaattctttactagttgtttttcctatttctcttggatatggatcatcagaatgttttttgtccctcttacccgcccccccccaccccgtctgccaccccccgcctcccacttttttgttgggaggcttatgtgagagcattagaggccttgaatgtttgggtagacaaggtaagtattcaaataaacatttcaagatcattgtgacagtgaaattatttgatatgaaaaaggatctcagttattagaaaaaacacaactgtgttaatactgacagccagcgttgctataagtgttttatgtgcattatctcacttaagctt

SEQ ID NO: 61880 - DNA, 1296 bp, Homo sapiens
tgcgcccggcctaaagtgagtctttaggtgaaaaatttttgtgaatattgtgatttctccttaataatttcttgtgtatttatgaattttatataattaaatggcatatcaaaaaaatcacctatgttaattatgtttttgactcagttatattttcttttggtacattattaagttaatatccatatgcaaaaatatgctgacaatatattaattttggatttttcatttttatcagaaatcatgagtggaggatctcaagtccacattttttggggtgctccaattgctccactgaaaatcacagtatcagaagacacagcttctttaatgtctgttgctgacccctggaaaaaaattcagcttttatacagtcaacattctttatatctgaaggatgaaaaacagcacaaaaatcttgaaaactataaagtcccagaatctattggttctccagatcttagtggtcatttcttagcaaactgtatgaatagacatgttcatgtgaaagatgactttgtacgttctgtttctgaaacacagaatatagaatcccagaagattcactcctctagactgagtgatataactagctctaatatgcaaatatgtggatttaaaagcacagttccgcatttcaccgaagaagaaaagtatcaaaagcttctcagtgaaaataaaattagagatgaacagcctaaacatcagccagatatatgtggtaagaactttaacacaaatttgtttcagttgggccataaatgtgcagctgtgttggatttggtttgtagtactgaaaaaattaatatagggcctgaagtggtacaaagagagtgtgtgccaacagaatatcatgaaatacaaaaccagtgtttgggattattttcctcgaacgcagtagataagtcaaggtctgaagcagcagttaggaaggtctcagaccttaaaatatcaactgatacagaatttctcagtataattacctccagccaggttgcttttttagctcaaaagaaagataaaaggcggagtcctgtaaataaagggaatgtaaacatggagactgaaccaaaggcaagttacggggagataagaatacctgaagagaattcgattcagcttgatggttttacagaagcatatgaaagtggacaaaaccaagcatattcccttgaactttttagtcctgtttgtcctaaaacagaaaatagccgcattcacataaactctgataaaggtcttgaagaacatacaggatctcaagaacttttcagttctgaagatgaactgccacca

SEQ ID NO: 61881 - DNA, 1024 bp, Homo sapiens
ctgctgtagaaatggatcggagaaatgtgtctgaatttaagagtattaaaaaaacatcattaataaaaaactgtgattctaaaagccagaagtataattgtttagtcatggtgctatctccatgccatgtgaaggaaataaacataaaattcggaccaaattctggctctaaagtgcctttagcaacagttacagtaattgatcaatcagaaactaagaagaaggtttttctgtggaggactgcagcattttgggcatttacagtgtttcttggagatataattttactcacaggtgaggtcattatggtatagtggtagcttattttataaagctaagttttgtttgtttttgtttttctcccacttagtctttgaagactctttagtcatttgcctcttctgagcgcagcataattgatccctttatcgcatctgcattgttctcctttccattgtccactctcctgcccattgccacttctgggcctctgttctatccttctcagctctgtcccttctttccacttatcccctcctttaataagccttccctagtcaggtggagtgggtcacacttgtaatcccagcactttgggaggctgaggcaggaagattgcttgaggccaggaatttgagaccagccttggcaacacagaacccgtctctacaaaaaataaattaaggtttgcgtgcctgtagtcccagctacccaggaggctgacgcgagaggattgcttgagcccaggaggttgaggctgcagtgagctttgattgggccactgcactccagcccgagcaacagagttagacctttctgcttctttacctaatgtctaataatgctgtgcacattgtatttttactgtgggaacagttattgatttctattgccttattatcaaaattatattaattacacttggaaatatggaaaggaaaaaactggtattataccaacttcatataaccaccaatagagttctagagtgttgccttccagttattttctctgttctccttaa

SEQ ID NO: 61882 - DNA, 1056 bp, Homo sapiens
cagtttatggagtctgctttctaaaaagtacttaagtgtttattgccaatatcttattttggtcagcaatcaatcacgtactcaagcatacttgtcttaccttcagagaaattaaaatttaatcagcaaaactcatcagcctgtacatttaaaatatatgcatgttattgtacagaaactataccttaataaaaagtgagaaaaaaaatgagacaggaaagagaaaaacatttaaaggacatagtaactgaagaattaaataaccaatccaacacttgaaaaatattacaatgtagcacgtgctcaaaagctctctgagctcagggaacaaagcagcactgtgaatctatagtggtaatcattctatgtggtattgggtaggacaagacagccttgcagctggaaattggtgaggacggaggcctcgctgtggaaagagtaaggcacactcagggagagaaccagtgaggtggctctgagcctgtttcagaaggggcttgaggaagaacggcagaggataggatagttgggaaagcaggatcaaatcagactccagggactggggaaccaattggctgttacagggtggtggagtcaaaaaagaacagaaattttctgtttggttaattgatagaaaatgatattattaacaaagtaaagaagtatgggaacagcacaagttttttggggatagtaaataattccatttccattgattaaaaatatcaagtttgtttttacatctaaactgattcaagacttagctattgtacatgttttagagaaagcaaaactatattttatatctaatcatactttacaacataaaatacagttctaaaaaatattatttgtgaagaaaaatataatgttgccatcttttgtctgtctgtatgttttttttcccttagattccagtgtagttagtgaagttgtacttcaagacttactggcatatgtgtcctcaaaacattcctacctcagagatcttcctccgaggcagcctcagagggtgaacagtatagactttgtagaattggagcaccttcaacctga

SEQ ID NO: 61883 - DNA, 1042 bp, Homo sapiens
tgaaaaaagtaacttgaaattgtgattgtgaaatatgtgattattatttttattttcatttctaaaaataatttataaaacagtttaatatatttttatattagtatctgaaatttaaaaatggatatagaataaataaaatgtagtaatttatcatttgaagctcttggggaaaaaaaaaaacctttttttccttctaggatgtcacagaacatcctagagttgttttaggcattcaaattaatcctgcataaaaaccaagtgctttttggaattatttttcatttaagcatttcttttatctgaaaatctttttgaaggtcgtgtgttgtttactcttttgtaggccagcgttaatgactgccattgatggaagacatgatgtttgtatccgtgtagaatcaaagctgatagagaagattcttctcaacatttctgcagactgcctcaacagagtgataggtaatatatcagtgtgccatcaagaagttgttttattcaggagtataaatggtatatcggaacagaaagagcactgtactttaaattaagagcttttctgtccatatgaaaaccgaaggataatttagcttaagtgaaatataagcctatgtaagttagaaggttgacttgctttacacctgttagtacatgaacagcgggaggcacctaatttcttcttaacctacatttcctgttggtaagcaaaaactattttacttaactctagttttataagagtgaagtcaatgagtgtgtgacataatatatatgaagatagtccactgtcagtggaatggatttgcaagatcttcaaccgtgatgtcttagttgtcagtggctaagaataaagcaaagataatatatttgtcaggtattcaaactccattcctgttctcattagcctcagatcctctaagctgatgagctaatctggttccgtgattgctttatctttcaatagtagattgtttttcgtgtatttttttagttgggggtgtctagtaattttgggttgaatgctgaacattgcatatattaa

SEQ ID NO: 61884 - DNA, 1021 bp, Homo sapiens
ggttcaagcaaatctcctgcctcagcttcccgagtagctgggattacaggcatgtgccaccactcccggctaatttttgtatttttagtagagacagggttttactgtgttggccaggcatgtctcgcactcctgacctcaagtaatccggctgcctccgtctcccagagtgctgggattacaggtgtgagccaccgctactggacgggaggagaaatttaaaatgggtttgagacttgaggaaccaaaagaaacaatgaaaccattcaatgtgtgtgctcctgtcaagctagcagcgatcttgggagctctgtgtttttgtcttttgcagttccttcctcagagatcacctatgggatggtcgtggcagacctgttccactccttgttggcagtcagcgcagaaccttgtgtattaaagattcagagcctttttgtgttagatgaaaacagctatccattacaacaagatttctccctcctggatttttatcctgacattgtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagatatataaattaaaacttttttctaagaaaatcctgtgaggtttaaaaagattgtttttgtcttttggtttcttactttctcctggagaaatgatctaccagtcaaggcaatatgtagcagatccctgggaattaaaggtttgcccatttgttcactgtatttagtccctgctacattccaggcattgtactaagtatggggaaccacagagaagacattccctcagaaactgctgcagtgctttcgcttatccctacctaaaaaaccgtcaatgtgaaatcatttccttgattataactataatgataatggattagtttatataaacctatgtttagacaagttcaagacaagcgtg

SEQ ID NO: 61885 - DNA, 1006 bp, Homo sapiens
atagaactgtgcttttcactgaatatttttttcttattgcacgttcatttcagatgaaaaacctgagaaatgtggtcttcgcctttgcgttggaaaagaattgatgccttatttaagaaacaatcagctaggtgtggtggttcacacctatgatcccagcactttgggaggccgaggtgagagcatcacttggggccaggagttcaagaccagcttgggcaacaagctaagaccccgtttctacaaaaaaaaactttaaaatgagttgggcatggtggtgcactcctgtggtcctagttacttgggaggcctacgtgggaagagtgcttgagcccaggaggtcgaggctgcagtgagccatgatcacaccactgtattccagcctgggtgacagagcgagctcctgtatctttaaacaaaaacaaggaaaaaaatatcatttaaaaaaaattttgtgggattttacatgtgcttttgccaaattgcatgttgctgaagagtgttactaagcactgacaacagagtcttcctcagtcattatgttgaaatactatgtttcttcccacaaataagaactgatttgattttaaattattattattttttttccaagacagattcttgctctgtcacccgggctagagtgcagtgacgtgatcttggctcactgtgaccactgccccctgggtcaagtgattcttctgccttgggcttctgagtagcttggactacagtcatgtgccaccacacccagctagtttttttgtatatttgatagagatgggattttactaggttggcccacctgttctcaaactcttggcctcaagagatctgcccatggcctccctaagtgctgggattacttgattttaaatgattttaatcagcaatggtttgaaagtaaatttaagtgactaagaagtgactaagttcctaaattatttactctactcctcataaacaagtattttcttataaaaggcattaaggtttttccaagtaa

SEQ ID NO: 61886 - DNA, 1035 bp, Homo sapiens
aataattactacttgacaaatctctgggagccatggacgaaaggcaacaaagccccagcaagcattagttttacaagtttcacctgctcctcctgatgatttcatttgagcgcatgtcacacggttctatacttagtgatgccaaagagagggctggatgccttgaatggaaggtcaagaatgacgttggagataagctctgtaacaaaggcagaccatttcctagtgactctattttccttgcaaatatcactcccagtgccacatggaaatagaataaggcccaggattcccgcagaagtaattacttttggaagctgtggggttctaaaaacctgtgttaaagtgtttttgtgggtttcagagtgctaaaaaaggacacagcaaaaagaattattttgccaataaaacttgtgtgtttggtacatgcgacaatcttcaacaatcttcatcaatctctctcacttttgcacaaaatgtctgcagggtgagtggctttctctctctggttatccaaggctcatttctcaccattagctccctgggaatgtttatcgagtccccctaataacctaaaggtatagaatcactgaaaatattgtcaaagacacaagtcatgccaccattctccttggcttctaagaaattctaaaattctgagttccatctgccagcatgcattgtaaggcatgatgaaaaaaatacaggcatacctgagaaacattgcaggttcagttccagactactgcaataaagtgaatattgtaataaacggagtcacacaaattttttggtttcccagtgcattttaaaagttatgtttacactatactgtagtctatgaagtgtgcaatggcattatgtctttaaaatgtaatattatctaaactttttttttttttgagaaagggtctcactcctatagcccaggttggagtgcactgatacaatcacagctcactgcagcctcgacttcccaggctcaggtgatcctcccacctcagcctcctgagtagctggtactacaggtgtgca

SEQ ID NO: 61887 - DNA, 1020 bp, Homo sapiens
tgagaatactttcaaatactagcttttgtgcttttaaaataggtaacagtgaatgttagtattgggtgtgggatgcatcagggacacaggtttgtaaaccatgacaattcagttgtaaaactaaagccaagtgcacctgtagtcccagctgctggggaggatcacttgagcctaggaggtgaaaattgcagtgaactgatattgtgccattgcactccagactgggtgacatagtgagaccctgtctctacaaaaaaaaaaaaaaaaaaccctaaagccaaaacattgaaataagttactgacatgcaaatttggaactgaaactagaacacagtggtgtatatctcactgttctgaaaatacacagtttccagaaattcaaagaatggccaagataactcaaataggggattggctatatccagtaaaacaaaatcacttgcagtcatgtctaagggagatgagggtcatctgttaggccatagtcatagacttacaaagaataccagttaggattctgtttgtagcaaccaactctagctaacctaagcaataaagaatttatttgaaggatataagatcaaacggaagctaaagaaccagactcaggatagaaacttagctcccgaagatttttttaagcagaaattgctcaataatcttgcttttattcatcatggattaaattaactccagctgcttaaaatgcccattcaagatttaaatgcctggacgtgagtgtgcaaacctaggtcagaaatcacccctggcagtcttggagctttgagaggactctacaggaactacttcggcttaaatggtttgaggcaaagcagctgggtttactgattcatcaagactaaatgtgaaaggagaggtaatttattcaaaggaaattgtgggaaagactgttagacaaacaaaatctgacaaatgaccaggtggttacttgaagccctgacattgaaatatgttgggtgttgggtatatactaaatgaagggcaatattataacaagtg

SEQ ID NO: 61888 - DNA, 2921 bp, Homo sapiens
attttataattttatatttcagtatgaaaaatctggatggacttgggttataactttttcctgaatgtttttccctgaatatctgtaaattacaagggagccataatattctggactttgtttctcattgaagtagggaggatttggattagttgatttttactgatagtgaagaattttactctcaatttgtaaaaagcaaaacatgcatgtaagtatatacctagaaatgctactttttaattacagttttcatgggaataacgtgattttttaaattggaattatattcccatttcaataaaccatataacattttttaccttatggtaatattgtgtacttatagatgtgaagtctttgtagctattttagcttcctacttcttagcactcagtgcttttaaaaaattccttatgatttctctatgtgtagataattcctggaagcatttacatgaagctgttcattgtggttgtctttggggtcttgaatggtaaagagatttcatttttatacccttttctacagttgaaaacaaaattttttttttaccacatgcatctcttttaaatcttggtaaaatattttagggaggcatattctaaagttatttgagtatttgatggttttgtttgcattttagccatgacgaagatgaaattcggcctgttcaacagcaggacctgcatcgggcaattgaaaagatgaagaaatcaaaggatgcagcatttcagaatgttttaacacatgtttgtttagattaagagtaaagatcatttgtacagttcagtgatctagtttggtgtgtcctcttatcagttagtggaaatagaacggaaagagtgctctttaaacaatgagggagctcagtgtttatggttttatactctgaattctaagttattgagatatagttgttacataggtggtattactgttggtcaaaaatcatgaggaggaacagttgaatccagcctgaacgtgggtgcttgtgtttgaccttttcagccatatattgtacagccttatagaatctaagctggtcttaaagtcataaatgattcattgggtcattagtgagaaacggggatgtggttaggtgctggttcctagacatgtgagtatgcgtttgtgtgtgtgcgtgtatgtatgtgtatattaaatgtatatatccacacattttatattgacattctgtagatatgtttgaatatagaaactttttttaccccaactactgaatccaggagtaccaaataatatatagtaaaactaagatttaaggttgtgtcaaaaaggtacagtgattcagccatttccatttgtcatttgtttcaaccttttttaagttgagtgtttttatttctgcagttattagttggatcctccacatcttgcatatatacatgggctcaattattatgtttgtcaggataatcaaatgaaaatactagttcagtgatcagcattgaatggttgttaggcagccatgtgctcaacactgatttcacctcttgagtataaactttttaaatttaaattggtttacatgaaagtggattaaaaggcctttcaaaagaatgggtttgaaaaacctcagtaccctttaatacatgtacatttctttccttttttcatttaatgtaacatgtctgttgtaactatgtttcttaaatattattttaaggttatgtgttctttaattatggtcaaatataatttggtcaccaaaaatgaaataatagtttaaaacaagtagctgttactaagtgtgctaaaaatactcattttataattaattttagttttcttagtatattattataaattgtgccctaagtcaggtacaaatgtacacatcaaaatgcccatattgtatctatctgtagtcgtttaatgtgaattatatgtgaatttttttcaaaattttactaaccagaattctgttataggcacctaaccacgcagcatgaggaaaacggcacaacacaatcttgaggtgccttctgaatcatcagattaaattatgcttcatatgtttttgcttttactgtatttctttaaaaactctaaatctttattcatgtgtcactggattaatttatctgataatgtgtctcacaagaatctgttagatcgtttattcttcagttgtactttgaatggtggggtggaagtttcaggtgaacaatggataacaaaaagcaagttatggaagattgtgaagaggatggaaaaactgaatacaagataccaaaaatgaaaaaaagtgtcccatttttaataactatattctattattttataaatgtgtaataaaggggtccctctttattggttgttctccacttaatctttggtctttttcagtaattttaagttttctgggattttttttggtttataaaacttgtgtttagactttatcttgctatggagttttcacacttctatagcacatatcctagtatctagtcatttctgttttaatatgaatttcagtaatttaattttaatctggtgacatattaatcgaaaataaggagtaatgtatacctccacatgtcctttctttttgtcttctcttaaattcacaatatccagtaggagtggttattcaatttcttcgtggttttaatcatcaaatgaagttagagaagtatactaatcccagcaactatgactcatctaggcatgttaagaccataaagtaattcaggaaactattttcctgatttttaaataacttttagtgttatgtaacatctatccttctgttttagacatgcatttcacatatagttgaattctagattctaagataattcattttgggtaatacttcagagtactggatctagaatcaggcttcctgaatttaaactcaggctccccattaactgtgtgtctgtgagccc

SEQ ID NO: 61889 - DNA, 1012 bp, Homo sapiens
attacccaggctaaagtgctgtgatatgatcatagtgcactgcaaccttgatctcctgggctcaagtgatcctcccacctcagtctcccaagtagttaggactgcaggcatgcttcaccacgcacagctagttgttttttgttttttaaaaatcttcttgtagagaaagggtctcgctctgttatccaggcaggttttgaactcctgacctcgaggtatcctcctgccctggactcccaaagtgctaggattataggcatgaaccaccattcttgacctattgccttaaaacatatcaaaataacatatagtgtatgcaaaagcttaaagaacctagcaaattacaaagattaggatcagtggttatgaatcattttggggggagcatgtcatagagccctttaagaatgagataaaagtagtcttttctaagaaagctacgtatgtacatgaaatatgtacagtttcagagaaattcctaaaattctccatgttttttaggtaaggaactttggtcctagataagaaatcagtaaattatattttgcctttttttttttttttttttttttttgtgacagagtctcgctctgtcgcccaggctggagtgcagtggcatgatcttggctcactgcaactttcacctcctgggttcaagcgattctcctgcctcagccacctaagtagctgggattataggcgcgcgccaccacacccggcttatatatatatatatttttttttttttagtagagacggggtttcaccatgttgatcaggctggtctcggactcctgacctcatgatccgcccgcctcagcctcctaaagtgctgggattacaggcatgagccaccgtgcccggttgacttttaattgaatttttgataactgctttcaaaaaaacattgtgtaatcctggcactttgggaggccaaggcaggcagatcacctgaggtcaggagttcgaaaccagcctggccaacatggtgaaaccctgtctctactaaaaa

SEQ ID NO: 61890 - DNA, 1882 bp, Homo sapiens
aattatagttttggtttagcatagaatagaattggagaaatttggcttgaagaattgttctattcagaaggcctgccatgaacaacaacagggatttatttgattgagtattggcagatgtagtcagtgcttccctgataggattaatgattccagtagatatcatagtttaccttaagaatgcaaacgcttagatggtgttaaaccagttctgccttctttctagcattttttgttagttaaaaagtacccctctagtagatgattatgacttaccagtacactataattttggcacagatcttcaaatcttgaattctgtctgccttcagactgcaaaggaaagaaaaaacaggttttactagtagaaaatatgttccatacaatcagcatgttacatgtgttgccatttagaggaacttactctaattccatttataatctggctaaaaatcatttgtcccatttatattctgtaatttatcagattggtttttggtagtaaacatgatctctgaaagattgatggttatggactctataaaattactctgatcaactctttactatagctacaactgtaataaagtggttaagtgtgtgcacatccttagaaaatttacccaatgaatcaatgaaaagatttttaaacttaatttaggagactataaaatttatttagtatgactgattttttttttttctttgagacagagtcttgcctgtcacccaggctggagtgcagtgacgcgatcttggctcactgcaatctctgcttcccaggttaaagcgagcccgcctcagcctcccaataagttgggattacaggcgcccaccaccatgccctgctaatttttgtattattagtagagacggggtttcaccatgttggccaggctggtctcgaactcctgacctcagatgatatgcctgcctcagcctccaaaagtgggattacaggcatgagtcactgcacccagcctagtatgactaatatttattgagcattaatatgtgtcacagacctgctaggatctggtggatgggacatgggcctggtccttgaagaattctgttttggagaggcagacacagaaataaataatgtaaaatatgctttatgaaggtatgtttaaagagctatgagagcctgagatgttgatgaaaactaatattctgtcagggaagtccatggaatttacagaatccagctggaccttgaaggatgataggaatttgacaggcaaatgagacaaggaagggctttcctgccagaatgaacaaagtcaagaatttgtggaagcactgtttaatggtgagttctgagggtagtttggtgagcgcagcaccaaggaatatagatggagaggaggctgaaaaggtagactgcttctgggtttaggtgaactttatatgctttgcacaagagttttgattttgtaagcaagacatcagaacacttttttaaaaatttgtttacctaattggttctgaagataatttatagaatctctatcactaatccaatagttagtacaatggacaattaagggttttttaaattttattctttttttaaagacagagtcttgctctgtcagccgtacaattataaattatagcccactgcagccttgactcttgggctcaaacagtctttccacctgagcctcctgagtagttaggactataggcatgcaccaccacgtttggctaatttttgaatttttttacagacgggtctcactatgttgcccaggctagtctcaactcctggcctcaagggaccctcctacctttgcctcccaaagtgttaggattactggcatgagccactgtggctggccagctatggtttttgatgtacagtacaatagaacat

SEQ ID NO: 61891 - DNA, 1105 bp, Homo sapiens
ataattgcacatatttatggggtacagagtgacatttcaatgatcactatagtatatagtgatcagaccagggtaattagaatacccatcatctaaaacgttttatcatttcagtatgttaggaacatttgaaattacataaagagtaaataaaataaggctaggcatggtggctcatgcctgtaatcccagcactttgagaggccaaggcaggagaatcacttgaggccaggagttcaagaccagccttgacaacatagtcaacctgtctctacagaaaataaaaaaaaaattagctccgcatggtggcacatacctgtggtcctagctactcgagaggctgaggcaggaggatcacttaagcctgggagttcgaggttgcaatgtgctgtaattgcgccattgcaccccagcctgggcaacagagtgagaccctgtctcaaaaaaaagggtaaataattaattcttaatttctaaggttaaggaccttttacttctagactcctttctacgaaaccgttcaagttctgaccatgaagctacagccatgatgaaagctcagtttatgagtctctgggatggattggatactgatcacagctgccaggtatttgaataaaatctgccctcaacttgtgttggtttttttgttcttaatagaaaatttgctgggctacttactatgcttttgtacaaacttttttttcataattatttacacttatgactaagtgataaggatccaaaagaatatggtttgtataaactttatccaatttgaggacttcgtgtttaccaaaacattagtagattgcctaaatgcctgaaacagacacagcagaagagaaaacaccagagtaaagcctgtccttggaattttcagaacctacagtgctaaggagaggaagtgactagtgtccgtgggtattgtgtacatttttttaaaaaactgttctttctgttttcctcggttcttacttttgactttcaccataattccttatactgtcaattcttagtcacttccctgattttcatttgacagagttcattagtagctgaaactgacaacactttctcacttcctgtcacctatgcctatctt

SEQ ID NO: 61892 - DNA, 1025 bp, Homo sapiens
atgattttgtttttcaactgttgataaagtggtatgaatttggatgtcaaggtgagcatttaaactgaaccttttcatgaagggagagggcacaggatgctgtaatccccaaatacatgctcttaactgacactgagcttagaacatggcatcttcctttcttctatcttacctactataaacaagattaaataaaagcagaattgaatattgggaaagttttttgtggaaggaattactattctattgattatcatataaattgaagcaaatatccccttaaaggtaataaataacatattcatttccaggtgttcttctctatgggcctccaggctgtggtaaaacgttgattgccaaggccacagccaaagaagcaggctgtcgatttattaaccttcagccttcgacactgaccgataagtggtatggagaatctcagaaattggctgctgctgtcttctcccttgccataaagctacaaccatccatcatctttatagatgaaataggtatgctatgttttctatatgagtatttttaaaggccatttttagagatatttagataaccagatttagtttttaacatttattaggccatgttaataaaacaaagaacataaccaacatcataatatgctatgtataatttctgtgttgtagaatgaaccatagactatatactcccctacttgatagataggtttttctgtcttttctctgttacaaacagtatgcagtagatatccatgtacatgttttctcatgtatatatgtttgcccgggaaagatacctagaagttgaatcatttggttgtgtgatatatctatcttcaacctcactaggattaccagttctttagttattatacctatttatgttttcctgcttggtagtaaacttgggcatcttttagcatgttgattagccatttgggttttcttatttgtgaattgtcaatatttctttggagttatttgtagttttcttttgttgatgtttattatgattacacctatttt

SEQ ID NO: 61893 - DNA, 1048 bp, Homo sapiens
tttattgtttcatatgagccatccaaaagaaaaatgtcagtagaagattcaaattataactgacttaaccaaattttaagcacctaagtgaacttaattaaaatttgcagaatgcttgaaaatacaattaacatgtattggtaaagcttatggatttaaatttaaaagtcagctttagaaaagtttagtttcatatgattaaacttagattagttgctgttagaacttgaatcttcaagaattataaagaccagtagaaaattctatgtatgcttgaggaagagcttgaacattattttgaagtgtttgatgtgaaaaataaaattgctagagttatggaatcaggtgcagatttctttttttttttaaattgagatatttttgggaattttcatacaaaattatttttcctctcattttgaattttatttttattatatataagaaaattttggactcctccagatcccttccagttcaccctagcatgccatctatatagatggcattttaaaaaatactgtttcataggaaaagttgagctttgaattaaacaaatattttgagaggtctgcctattacagtttttgttagggctgtctgtagatggtttattttaataaccatcttagtactaagtttaggtgccagatcatgtagtactgagtttagtaatttggtaaaattataattttagtattatatatttagtattattatatatttaatattattaaatttagaaaatgctatctcattttagttgagaaacagttggtggtggttcccaaaatgttcaagatcccaacctctagatcccttgtattaaaagtgttaccttaaattgtatttagcagcaaaatgctgttaatggagaccataggttaataatatagttttattctttggaaattaaaacaggagtgactgataatttctgtttcttttaggaaaagattgtttggaaaaaggcacatgtcctttggctaaaacttaatctgtgagcaacagcaaaacagtgtttgccacaatctgttttgaagttgtt

SEQ ID NO: 61894 - DNA, 1089 bp, Homo sapiens
tggtccataggtttacttttgatggataaaattcagaagctatgttttgtaagaccttatttctaaaattaatttctgtgatgcttgacaacatcctgtataaaataggtacattcctgatgagctctttcccatcagccagtgctaaattatgtctcagctggttctcagtattcttgcagcagagtattttctccttacaagtggaatgaatttagcttattagacccttgcagatttttgagtacctgacttacagatttttaatagtagatagttgactattaaattcctttttccagtttcatagcagtttatttcattactgcttggaaaagtctttacttatgttaatatatgattttaacttatttatgtataatcatcagattaacatttgtaattttgggagcgttctttttactttagtgagtgtacatttgtagtaaaattcatgttgaccttaacttttgccaggttacttggagtgatatagcaggtttagatgatgtcattacggatctgaaagacacagtcatcttacctatcaaaaagaaacatttgtttgagaattccaggcttctgcagcctccaaaaggtatggtaaaggtatatattcgcctaaagcattaaaatcctagaaaacattgaaactttctgccattgtagaactagtttttgtgaaatcagattctcaagaggatgctgagatctatgtgaacagtttcttaaaataattgctcattcttcagcttctgaaattgagataaactttttcctgtatttacatgttaaaatacttgttaaaataatctccttcaatttcttttctcttacttccaagtaaattaaaatttggaaaatcaagattaaagaaagattcaaagtcataatacaagttttttgttttgttttgttttgttttcaagccaagacatttttttcttgtttcacagctccaacgatcttatttttagaatgtaatgattctttttcaggaaatatttatctgcagatgaactagaaattaaatatttaactttgatggagatgtttgcttattcaaaatcactttgaaagtcttggaac

SEQ ID NO: 61895 - DNA, 1299 bp, Homo sapiens
catctattgtagatacctggattaatttgaaggaagttggacatctgtttcagatactcagtttaaagaaacttcacttatacatttcttgccctccttaactcctctgtctttcctcttgagatttcacctttgccagtcatgatagtcctgttaggaatgagaaactaagctgtatcctagagtctcattgaaacaatgggagcccctcttggaagtgtaagatctcttcagtcacataccctattttctcatttcctgaaaggtggttaaatttccctgatttcagtggattagagcctcaaatcgttacctgagggctcacaatggagaaggctaagatcaaggggcctagaatatccttggaaatttcttgtatatctatctgttcattgctctttagacttcacatatatctatttcgaagtgccagtatctaaatatcaaatcaaagcaggttgtttgttcttttcattctaggcagaaaaactaatgaagcaaattggagtgaaaaatgtgaagctctcagaatatgaaatgagtattgctgctcatcttgtagaccctcttaatatgcatgtatgtatctttaatcttatttaagatttttttagaggtgggggtgggttctagcattttgtgtcaggggtcttaaagatcacggccgggttctttgattctctaggctgaatcataagactcggcatatagttgtattcctgtatatgatttattacactgaaaagatacaaagcaaaatcagcaaagggaagggggcatgggatgaagtctgaaggaagccaggcgcaagattccaagtggagtcacacagtgcttaattagtgcatcaagttgtgacaacacatgtgcagtgttgtcaccaggaaagctcacgggagactcagtccccaacatatttattgggggctggttatatagctttcctcttcccttaaatgtaccaaaattctagactcccagaaggaaaatggatgtttcaccataaaccatattgtttgcacaaacagtttaggcacagtgagctgttcttgtcaagaaattgtggcactcttctgaaatctaagttcccacatgccagccaagggccaatcttgcaaatatgcctttctaaggacaacagtctcaggcctactttgttaactcttttctgtacgcatttgtttagtaaaacttttatgtatttgcctttgtggtgtataaagcgtactgctttaagtcatgtggatttttgttttatagagtttaaacctaaattttcataatatggtatgataacac

SEQ ID NO: 61896 - DNA, 1050 bp, Homo sapiens
gatcagaggttgtccttgtttctaacttaagtttaattcgttcatctctgatttttcactcttgttaatgacatgtccaactttctaaactgattcttccaaaaggacaattttatgaatctttagaacctgaatgaaatgagtgttagctcataagtattttctttgctgctgcttgtccccatttctgccttccctactccaggcaaaaatattagtttaatatttcctattccacttcttaatctttttgaaaaaataatactttgcatggagaaaaaagtgaaatagcatgaaagggtaaaaaatagtgtgaaagggtagaaaatcatttggaacagtcaaaaaaatatgggtatacagtaaaaagtaagttttcctccttcttttggcccccacacactccccatccaactcattttccctccacagaaacaacaaccacttggagagacctactttaaaaaaaaaaaaaacaagcaaaccatggtgatcagaaaatataactttcattaagctgtaaacaagaaagtatgcataaacataagccatttttacagtagtccaatcataattttgtttttctgcttatctagtggctcacttaaaagtgtcaaaactaggcaattgtataacttcttcctgggacacagtttgtttggtggcagttttggtgtgttttttggtgtgttccatttatttgccagccatgttctgctctcccaaatgaagagtattagtgtttcagcaaaatatgggattcgaaattagacaaatcagtatttgagctctgttaatgtcacttcctagctgtataatcctgacatttcttttaatttctctgacctgtaaattcctcatctaaataataaggataataatagttacttctcaggttaattttaagggttgattataaattacctagcacagtgctagatatggtaggtgctcaataaaaccattagttccttttcccttttcttttaatgatatattgtgaatacaatctgaagagattgttaaagtgggactgctgttgcaggaaag

SEQ ID NO: 61897 - DNA, 1629 bp, Homo sapiens
ctgctgagccatacaaattctgttttttttcatgtttatgtaagtacaaatatatattctctttttcttatatatcccatagcattcagcacactcctgtgctgagagtataatggcagtatttgaagctaagatcctatctcccaaaatgtgatagtcatatcatccctaacaagcttattcttccgggtagttattgccattgacagaggagtgtatgtcttctgtaagcctagctttgattgatgtagctgttcagggatatatgcaaaaataggcacatttatctcattttttttctctttagcttgggtgagtgctgtattcttgtagtagttgtctcagttcaagatttttccaagttctattgcttcctacttagcccggttgttgggaacaatagtgtggctcaaaaaagttaataccacttattactgaggaaatggcatgtttaaatttaagcaggccttgaaaacctttaaaagtatgtatgaggaaaaagtgagtcagttcacaatttgaatttcactcaaaaattacctggtatatgatacagttaatagaagaaattcttaccgtcacattagtattgttgggctgcctttcttcagttggattagtgttatagttgatactttcctagactctgaaatagttctttaaagctgttttgagtaaataccttaagatatttactgtatttttcaaataaaatgattaattctactaccaaataaatcttaatttctagtctacttctagtttgcaagaggagctttaaatgtatttgtttacttaacatttaaaaatccatttctccttaaaatgaaacactttttttaaggtaggtaatattttaatttgactagaagttagtttttctttcttagtttaagctactttgttagtcttacaattttaataagtatagttattacctagtgacatttctgtttgtttttttaaggttaacattcaagatggtacatgctgaagccttttctcgtcctttgagtcggaatgaagttgttggtttaattttccgtttgacaatatttggtgcagtgacatactttactatcaaatggatggtagatgcaattgatccaaccagaaagcaaaaagtagaagctcagaaacaggtatgattgaaatgtttgaagatcatttttcttgtggctaacaagtattttcccctcaaactaaaaatttggtagagttcacaaattaatgagaaattctataagacccacatgaaaatgtattggtactcatagttttattactcttacaaagtactagtttattatgacattatttcaagtcattttttactatataaacaacttatcagaagaaaaatgaataaacaataaaatattgtgaacatcttcattagaatatttttgtcagctttggaggtaggatctagataaaagtttttaggctaacccaaaatatttatcttcagtaatgatatgccttttgctgtgtatgacatctgaaatgtggataatactgaaacgctctcagtcttaaacttataagctacactaaaatctaattaatgaattgctgtaaaagttgttgattattaatataagctgtagtttttaactttttatctgc

SEQ ID NO: 61898 - DNA, 1017 bp, Homo sapiens
aacaaataactctaggttatagtgttttaggatgtttcttagttgcatacagcactatcatcgtatatgtacatatttgtgtattcattttgttgaacctaatgtttatacaggattgaaatacgctccctgctgttgtatgcgcatgcagcttttattgtatgttcgctggtgatggtattgctgctgtaacagccttacattttaggtatatcaataccaaatgaatgatacatgagtgtacaataaagtatatatagttacagtctacaaaacaagtttcagtttcattgaaggattttgaagtaatttaaaaaggtagactactattttacaagtggccttagtagacctaagtctttattacattaaaaatttcagaattgggaaggatataaacgggttttgtgtgttgaccttttatgggattaaaagttgttactatcttgatgactgggatgtgttcataacagccctaatttgttcatgtagttcaatgaatatccagtagatgacttggttggtagttttatcactaccaactctaaaacgaaaacgttttactggaatgccaccgcttttcacagattaggttaataaaacccttatcttgtctaaattattttcctctgtgagtataccccacgtagtgatataacacgtttcaactgcattttcaactttgtggaataaagactagaaaagtcagttttttacttcctatgagaagtgaaatattgtgtaacccgttttttttggaatccatgctgatggaagatagcacactttggtttgttccatgaagagagatttcagttaggtgccttctcctttttggcttcttttgctttctttataattaatataatagccggacagtgtgttctttgaatgaagtggtgatatcttaacaattattgtatatccaatatatagtgggcgtcatatatagatgttcagtaaatgcaaattgaatgaattaaatcatttaccatccctaggccaaagtttcttcct

SEQ ID NO: 61899 - DNA, 1920 bp, Homo sapiens
agacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggctggcacatccagggacccgggccggttttaaacctcccgtgcgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctgtatccatttctgcggctgctcctctttacctttctgtcactctcttagaacgtgggagtagacggatgcgaaaatgtccgtagtttgggtgactataacatttaaccctggtcaggttgctaggtcatatattttgtgtttcctttctgtgtattcaacctagggtgtgtttggctagacggaactcttgcctggttgcaagtgtcaagccaccgattgctttcttaggctatctatatggtctcttcctgagggctattgtccgttaatacagaatacagtacactgttagtggattagcgagctcggtaatccggtctcctaaatgaacaaaaaagtagacgctttttgaggttgagcatatttcgattaaatcttggcttaggccctagatcaagggtttagatcagaataaaatgaaaattagtgttgcacgtacgcatattgcatcagaatcttgcagtgattgttttagtttcctgagttgcattgatagattcttttaaaatatgactgatttgcataactttagaagcagaatcattttcagtatatatggtgcacattgagggcaaaaagtagttttgttaatgtttaaacttaagttacctacaactttgaactgtatgtagaagttttgtagtttgaagtcaatagtgccataatataccttataaggcgttcttactagatctttgttatatttacctttttctctccctatggggtgatgtaggatagtgcttgaaatttgcacttcagtagcatttaatgttcagtgctcttgtcataaacatagaatggatattgagtagtttctgatcccagatggtaatgtgtaggttcaagggtattgtgtgtagcaagtgaagattgcagaaataaaacttcagttcatgcttgaaatttaagtattgttgtgatgccagaattgctgctcaccgtttttaggtttcaggtcctctgacaccttttggtatcgttaattttactgatttgtgtagaatgtcagttgtattttaccagctaatatctagaaatgctggcaagaggggtttactccagctttagattgtaggtatgt

SEQ ID NO: 61900 - DNA, 1062 bp, Homo sapiens
ttatgttagctgcatataaatgtgcacagttaattttgcccaagtttttgttttgaaatgaatgtaaaacttactgaagaagtagcttcccaaaatttagttttctgttaagccaaaaatattattttaaaagagtatttgcaaattttgaagttgacattaattgagaatgttactaaggctaaactggacccgcttgcccagaagataattatggaaaaattcttttgtgacttccaaagcagtctactattagcatgaattactgacagtcatccaaatatataggaacaaaaaattaaatgtttatgtaactttgaaaaaaaagcctttgaagaaaataattgaatgctgtctgggagacagatttctttcagcacttaaagtacataacacactacttttacttttcccacttgattttaaattatcagggttattaagaccttaaaattattttaccaggtttttacatgtgagctgtgacatgactggcattttctttgatttcagcgtatgttggtctctacacatgaaatttgtgtgacttaaaactttctctaaaactgtacttttagttatgatatgcatagaaagcagtatcaaatattgcgtcaaatgactaataacacttaatttctagagttgtggttttattgagccaaaagttgatatgaaaaaaagtcagtaaggaaagtcagtgaagtgcttgcttttttgataattgcactcccaataattttgatattccaacgtacttggtttgcttgttttcacgttaatgttttctgtttattggagtgggaaggcattaaaattgtcattgaagactttgtctttgacatgttgtagtatttatttcagtaactaacctgtgaaaagttaaattcctttatgaaagtagtgattggagtatttttatctgataaagaaagattaataatgaagccatttctccgaggaaaattgaggacaataattcagttttaaaatattatcgcaaaattaaattattctaaaaatttgttagtagggttatatgcttaatattagtctgaaata

SEQ ID NO: 61901 - DNA, 1724 bp, Homo sapiens
aaaggagtaatgtacagtttatatgaggaaaaaggaattttattgctgccagtgtaaaagtttgcacagcagtatagtcatcaatgcagatttacattgcttataatatactaagtaaatactaaatgattaaagataataaaatatggtgaggtataaccaccttcattttaaacttagttttagaagatagtaaagaaagattcctttattacctttttagaattttatttttaataacatgggaaaggcaactggtgatattttaatttttgtatggaacagtgcatctgctttctcatagccacataaaatacataaacttcttagtgttatgaaatggcttactttttggaagtgaagaagtcttcaattcttattttctaatgttattttgaaatttgcctccatttgctgtttgttcatttggtgatagcgcaacacttaaaaaaatattttaagccgcttctgaagtaatcacttcagtgacttttaatggaggagtatttgttatgggaaattcacttcacaaagttttaacattaattcacttgaagtaaacgtgctatttttaaattttcatctcaatcttttaagtaagacgaaagcttaggaaatcacttttattattgatattgtgtgtgacttcagagtttgtaaagagaattgtagaagtgttgcatgcatatgacaattttctgcttaattgaaatgtgaggcctctgccatactacaaggatttagcttccagaaaatgtaatattaacatagcttaagaaatgtatttttttttttctgtagaaaccgttgggttaaacaaacagttcagaagttttattacatggaacccattagttcttaatcttgttacctttttcttcattttttctgttaaacttgattttcacagtcagcattgaagaattcatcttgtggcctgaattcattaagaaaagatgttaggatttgttctgaagatagtgacttaggaaatttgtgagactggggtcagtcagttctgttttacaattgctttctatttggtagctttgaaattaatttagttgcttatcagagagaataatgttgaggttagactaaccttaaattggtaaggctttgctgagcaaactgataactgtaagtcttttatagggtgcattactgccacatatacgttcttccataggtggttaaaagtatattggtctgtgtttggtgattctctttgtacatattgagtatatgcattcactaatgtaaaataatttgccaagaaaggtgaaattagtatattgtacttgactattcacctttcccttagttttttgaatttttttcattggttgcagaggaagtattagcaatttaattcttttaaaataatttgcactggaataaataagtatcggcaaatataagaagagtaacataatttaagggtgaattaattttatttgggaagttttagttctgtatagttaaggcagattcttcatttgcaacagttgacattgggacatgtgtgaacatcttcaaggtattaggacatcttcaaggcattactttttggcagtgttgagaatttttttttttttttttttttttttgagatggaatctcgctctatcgcccagtctggggtgcagtggcaggatctcggctcactggaacctctgcctcccaggttcaggcgattctcctgcctgaacctcccaagcagc

SEQ ID NO: 61902 - DNA, 1977 bp, Homo sapiens
attttgctggttcatcacaaatgggaaataaatctctgctaactcaaactgttgaccaaagtaaaattaattatgccaatcaaaaactatttgctttaaaatataaaaggcaaaaacttcctattagcataatgaagtagaatttttaaactttgttataatcttaaattttctttagtgttgaagataggtcaacttaactatcatacatttttattcacataaagtaaactctgcctcaaatgtaataaacttaatatgagttatgtaaactttggtcaatagaggtatattttttagcatttccttttgaaaatttcagccttttgagggagtcttgcaactgaatgtcaagttacatttattacaataaaatggacacttaatataatctgtaatgcattaacataatatgggaacttttaaagtattcagtctctgtattattgagtcctatttccacatttggccaggattctcaatatgatttaggcccaagacgtgggaagaaagaagtaaagaactaaaggatttttttcttcatttttttaattgaatatggggaaagatggaataagcttatctgtccagtaaaggccattatgtgtacatagggattattatttttcccccccttgggctgtactgatttcccagatgtaccacagcactcttagtagtgaagcacttgacttctagtgagtggattttttgtgtgtgtgttttatattgcagagtgaatacactctgtctgatactatgtgactttctgattatgtgatttttatgcattttatgtgttttgtaaactagctgtatttttggtccatgtctaggttgtagaattgaattgtgcattttggcatctgagcacagctgagttttctaaatcaatctctctccttgcacctagtttttgctttagatcactacctaagacttactgttgatttaatattagagcacttaagcatagctttgacttttatttcctttgatttttgtagattttcaggctgaagtacaataaggttctctgttctttactagtaattgcaaagattgtattctgtgaattttatttgtttaatacttttgatcttttgaagaggatgtaattatttaaggtattatgaaatgcattgtgatttgaattagatactctttggagatggagttttgctgttgttgcccaggctggagtgcaatggtgtgatctcggctcaccacagcctccgcctcctgggttcaagcaattctcttgccgcagcctcccaagtagctggaattacaggcatgcgccaccacgcccggctaattttatattttttttttcagtagagatggggggtttctccatgttggtcaggctggcctcgaactcttgacctcaggtaatctgcctgtctcagcctgctaaagtgctgagattacaggcatgagccactgcgcccggcctcagatactcttttaattagatgcgtttaaaaatttaacccaccattgctggcatgaatagatgtatttttagagtgattcataaatatcgtatacatgtttaaagttacaaactttttgcttatttcaaaatgcaggattcttttccatttaaaattccctctctttgtgagacttctttttgagtattctggttactctaaactgattggagatgaaattagatagaattgaaaactgtacttttaaaatgaaattttggggatgtcattaagcttgattttttaggttttttttttagtgtgtattataaattattttacactgattgtcagcgataaaatggaatgcctgggattttttaaaatttattttattcatttttataaggtaaaaacagtgttttgctaggcttaatttgaccatgttgtaaaatttattgtataccttgaaagaatcatttatgaaagatactgaattagctaatatatactctgtcttatgtagtttttgattaac

SEQ ID NO: 61903 - DNA, 1434 bp, Homo sapiens
ttttttaatcagaaggagtatgggcttataatgatgttactgttccctgaagcatattttgaatgatacggtttatatttgcacagttgcccaggtaatcattgtgatattaattgatcaatttgctatttatttgcgttttaaatcagtactagtatttgtgcttaaaaattttgcatatgttttatcagatttaatttttaagtgtcagatactaaaacaaataaccttaactttattaaattataattttttatcatgaggtggtattcatttattcatatagttagaacaaaaaatatttaaaatattgaggtagaaacaaattagtctctttttaattaaaagccagattacttgttagagtaacattttcccaaatgaggtaaaattgttgcgactgttaaacttaaggaaattttgatctaggtgtggtatataccttcttgtggggtgctaatgaaaacagggatggcaaaaatattttgtttgtgagtgtatgcatttatgctttttgacaacctaagaaacactcttacatctgagtatctttcatggactagctgtaggaaatctatataaaatagcttagtatactgaaagtatgacatagttttacatatctagattgtggttgtgattatatataatactataaaatatgctaacgtgctgcttaataatactatttggattttttttaatactgaaaaggtcacacagattgtgattattgtgtagtgtccaagaactaaggcctaccatctgttactcaaatgtatgaaaaagttaagataatttagtgatataagtggttttgacaccactgtttttggaataatctaattatgatttttataaagactaatatcaaattttaaacgtttgcaaaaatgaaacctaatagttatactgttatttatatttttctattacaatacagatactggctgagaactaaagattgtgtaataaacgcctggccttcagtcatttggttttttttttccctcgattgtttggatagttaactggacatcatgttttaacttgagaaattaagttatacaagattttgatattttaaactagttttcctaactggttgagatatataagaatttagtattacaggactcaatcagggaactgatttaataagaatttcttaaaaatttgtttaaatatttttcaagttcttttcttcatcttctacaacttaattcttgtctgtatgcaaatgagcttccccatttaaaattttgctgttgcattttaggccactatagaagttgtttctttaattttcactcacaagaatttggtcttaccaaattgtgtaaatctttaaaattgtgtatttggcttaatattatagaatctgattgatttaatctaccttgtttcatttagtatgttgacattttcttgaga

SEQ ID NO: 61904 - DNA, 1009 bp, Homo sapiens
cttttttgctgtaaaaattagtggccttatgtctttctgcataattatagagtagccaaaacctgttttaggttaatcacctctggcaaaataaatgataaaagcatagcttttgtaagcagaatgatattacagaagttaacttataaatctaagtgtattaaagacacttaggaaatttatgataatgctgggtcagcattacagttttaactttttacagtttttcatatgctttttttgtgattttgctgtagaaaattaacagttggcatttggcttagttcaagtataatgctgttgacaagtatatctgacacgtcattgaactaataatatttttgaaagctgataggtaagttatatctattttgtttcattcgtcattagtgatcggtcttagatgtttttagcgagagcaaaactgtagaggaatgtgtgtctgtgtgtgtatatgtgtgtgtgtgtgtgtgtattttaacagcaggagagttctgaaacaggaaaccagtcttatcatattcatccagagacctaggaagaaggtaattgtttggtatactcgttaaaaccagttggttgggcaacttaaatttttagaggatcacagatgtaggcttgagcagttgtagatagatgatttctttttttttctttcttttttcttttttttttgagatagagtctctctctgtcatccaggctggagtgcggtggcgcgatcttggcttactgcaacctctgcctcccaggttcaggcgtttctcctgtctcagcctcctgagtagctgggattacaggcgcatgctgccatgcccggctaattttttgtattttagtagagacggggtttcaccgtgttccccaggctggtctcgaactcctgagctcaggcaatctacccacctcggcctcccaaagtgctgggattacaggcgtgagccaccgtgtctggcgatagattatttcataattaacacctgctatgaagaaaaattgattaaaatag

SEQ ID NO: 61905 - DNA, 1023 bp, Homo sapiens
acacaactagttagagacatagccagctcttaaatctgacttccagattttcactgtgtcttcttttttctgtaacgtgttgccttttttagccatgaaaaattagaagttgaactcttgtcttttcaggcaggtgtcaattttggggttttgttttgatttttggtttttgacataaagtactttagttctgtgatgtataaaccgtgagtttctgtttttctcatatacctgaatactgtccatgtggaagttaccttttatctttaccagtattaacacataaatggttatacataaatacattgaccaccttttattactccagctatagtggggaaaactttcttttcataactagctaatgttttaaaaagtattcttttagtttgattgctgcatatttcagatatttctttccttaactaaagtactcagatatttatccaaacattattgctatgggatttcctgcagaaagacttgaaggcgtatacaggaacaatattgatgatgtagtaaggtaagaatgctttgattttctatttcaaatattgatgtttatattcatgttgtgttttcatttagaaaagatttctaagccacagaaaaagatactttgtgatgtaaactattattgtagtgctctataatcattttttggcttaccgtacctaatggacttcagggggatacagttcatttgataagaactgaccttatacattacataatcaggtacttatgtgatatcatttcctggactccataaaatgctggtcaccaggtttaatacctggattccattacagtgtgatttttgtcttatttcatagttggggattaggcttaaaatcctagagtggatttattcagttaaatttattcacactaagatgtagatgactaatactgtatatttttatgtagaccaaattttaaggtaccactgtgcatatgtataccaactacctgaagaagtatttggttggtacaagagatatagaaaggaatcgctgggtg

SEQ ID NO: 61906 - DNA, 1105 bp, Homo sapiens
tcaaatttttgtacctacaaaaactacaaaaaatccccctagtttttatagtttctattaaaattatagctggtacatagggatgccagaaggactgtttaagaagctgaaaatagagaaatgaatttatcttctcatagttaggcagggcacagtagaaggatgcttaacattgcaagctgatgggaacagcaggttgatatagcttgtgataacacttctaaagaaaaagcaatgagccatagaaaaaagaaaaagatacattttgaattaaggaagatggtgaatctgggaagtgagcagtacagtcaccagacgtgtatcctctcctatggtacagaagtgtttattgggtctctttatggcctgcatgatatatcccacaagatgacctacttcacattattttaattctgtattcaactaagcactaattcaacccagccagattagtactcataccaaaaaagagtgaatactctgaatagagggcaggttttctgattatggtgagaatatctttgtggtaaattaatctggtgtgctagtttttacgttggtctcttctcagtgtcgttagtcactgaggctgattgatcatcttttaggttactgataaagttcctgtacagctgattttcagaccttagattgcaataacttcaccaagaaaatacttcattgggaagcattttggtccttccatttgattcataactcttacctttatgcctctgaaggaaaagatttatacattcagcttgtaattagtaatcaagactgaggtttagtctatctagcttcacaatctatctagtttgttttgtctagccatatgatttcttcaaatatgccatttcttaaaaaaaaatgttttatgtatcccgattaatatttagccagtggttcttttagccgatggatcttgtcacctcttatgatactattaatagcatgtcaacatgaagaattatctgctgaatataatagctatgctgtccttgtttccttttgtctcattcttttttgattgggggataattggccaataaagctttgatagcctctattgcccaggcccctcctcttcttttatgagagaaag

SEQ ID NO: 61907 - DNA, 1093 bp, Homo sapiens
aaacggaaaatactctgcagagattagactttgttattgttgtactacatcattgctttgactaaaataaactcagattgcaaataccttcaagcttacattgctcagtatttttttttttttttttttttgagacggagtctcactcttgtcgcccaggctggagtgcagtggtgccatctcagctcactgcaacctctgcctcctgggttcaagcgattctcctgcctcagcctgcggagcagctgggattatagatgcccgcccccacgcccagctgatttttgtatttgtagtagagatggggttttaccttgttggccagtctggtctcaaactcctgacctcgggtgatccatctgtctcggcctctggaattacaggtgtgagccgccacgcctggctaaattgatcagtattatttaactttgagggatatgatttgttatggaatgcgaagttttatacttgaggtactcagagtccttttgagacaaatatttaacttctccttttgaggttaccgcctacgattgggaattaatgtaaaaaataagccaaaagaaagtgagggaaaagtgaaccaagctgtaatttttttactcttttttattgttgttgttattgttgctgttttttactatcttgattgcaacagtttggcttatatatatagcatttggaattgacagtaagaaagccacatctcatagaagctaactattcccaaattgtttttttcttcttttcctcttactactgctgttttcctcctttcttgctgctaagctcttgtcctgacatgctggtaatatgaaacagtgttttattcagataattgattattctgtaatatgtatgttaatcttttttattacactttaagtaatagggtacatatgcacaacttacagattcgttacatatgtatacatgtgccgtgttggtttgctgcacccattaactcgtcatttacattaggtatttctcctaatgttatccctctcccaaccccccaccccaggacaggccccggtgtgtgatgttccccgccctgtgtccaagtgttctcgttgttcagttgccacctgtg

SEQ ID NO: 61908 - DNA, 1043 bp, Homo sapiens
gccccgccctgcttcagctcaccctccgtgggctgcacccactttccaaccagtcccagtgagaagaaccaggtacctcagttggaaatgcagaaatcacctgtcttccgcgtggatcatgctgggagctgcagacaggagctgttcctatttgaccatcttggaatgccacctttttttttttttttttttttttaaggcagtttcttgctctgtcacccaggctggggtgcagaggcatgatcacggctcactgcaacctctgccttctgggctcaagtgatcctcccacctcagcctcccaagttgctgggaccacagccacgcatcaccaggcctggctaatttttgtgttttttgtagagatagggtttcgctgtgtttcccaggctggtctcaaactcctgcgctcaagcgatccgcctgcctcagcctcccaaagtgctgggattacaggcatgagccactgcacccggccaatatgtatgttaatctcatccctcaagctgatactgaagtttttcaatttatgttatttggtgtaaatctaggcagtctttaacaaaattggtgcttcatgtgtttaagaggcataacttaagaattgtttgtttcttataaatcaggagaatggaggtttaatagaggtgaactgtctttctcactgcagaacctttaatatgccactatgcattgtaaatctcccaagagtgagattctagtatgatgcttttcttttccttttctgttctttccctttccctctacctcctttttcttttctttgttggtggcatgagtcctatattataaggaaatgcttttagagtacagtcttctgatatatagtgatttttgaaaaagatttatttattgtcttgttcactgtgagctttttcccccatgtataagcagctgtgtaatagattcaagagcaccccctcgcccctttttttttgagacagagtctcgctcggtcactcaggctggagtacggtggtgctgtgatcatggttcacctcgacttctgggctccagcgatc

SEQ ID NO: 61909 - DNA, 1087 bp, Homo sapiens
aaaagggaatttaagagttcctgcctttttccttgtctttagcattatatagctgtttaatgtgtgggagtctaatttcttttttctttcttgagacaaagtctcactctgttgcccaggctggagtgcagtggcacagtcttggctcactgcaacctctgcctcccaggttcaagcaattctcctgccttagcctcctgagtagctgggactacaggcatgtgccaccatgcccggctaatttttgtatttttagtagatatgggacttcaccatgttggccaggctggtcttgaactcctgacctctagtgatctgcctgctttggcctcccaaagtgctgggattacaggcatgagccactgcacctggcctaatttttttattgttctttttggtgtgaacattctcccctcctccaagccttttgtttttactattttcatgttcctttatatgtgctgctgttttgtttcatctgtaattatctctcatccccttttttggctattataatatatatatgtacgttttgaatctgagctttgaaggtaaattcactgcagctgtgttggttgattttagataatttgtgtatttcctcctttgtcttttttaaactggagtcatttgtagttgtttatacagaattttagtttttaaaaccacaagtctttcattataggttgagttatgaattcatagcctgttatttaaatgaagcttttgaaatctgttttactgatctgtatcatatctaactacgccagtatttccttccttgtctgacgtgaactctaaaattatgtgaacactttctccctgtttcctggcatttccactcaaacttgttcctcattcttagttagaaatatatccagaattgtagtttctttctaatctaatgacagaagcaaattaatcaagcatggcaagaatttattggaaaactgcatgtagttgaaaatatgtttagtatatattttgacagctgtgaagtctctaatttttactgtaccttttctctgttccaattttatgctctattctaaggatgtacccatttctactacctgactagggagca

SEQ ID NO: 61910 - DNA, 1538 bp, Homo sapiens
ttttggtcttattttcatctgttttgccaggtactcatgcaactttccagtttgaaaactcacatccttcacttttgagtatttttcttgagttatgtcttcggtttcttctcagtgttctctgtttctggaactcctaaaatatatttaacatcctgaactcttagtttttgtttagtcttctgattttcatttgtctttttattctgtatattctgttaattcctcggcttcatggtcttctagcccttcttttgcctatcttatggggttgaggattaaacagtttatatacctgaggtgcttaggatatgtctgtcatatagtaagtgcttgtgttagctgtaattgttgtttactttcataactgtcttgagggaaaggtctttggtcttgattctttgacttcttggctgtacatgaccttggacgagttatgtaatctctttgagacctacctccctcttctgtatagtgttaataagctctagctctcagatgtttgtgagggtcgaatggagtatatatgtgaaaatgtttaatacctttgtacagaattaatagttagtacgtggatctttcaaatatcaaaagttttcagtttgatgggaaaatgatgtctgaattttcagggttatttttaagagtacttgattatgactgtcttgtaaatctctatgagctaggtatacttgcactaaatgctaatgctttttaaagaagttatgtcttaatattcagtctcattatgttaggttgaagatagaagattatgaaaatattctctgaaaagctctggttttacttcagattgtataaatctgtgtaatgtaataattatttaagaatgacatgattactactctaaacccatagaaggggtatttgttggattatttattttcacttaaatggtatttgagattaggaaaaagaaaatctgtcttttggtttttcttgatagtattaatgtaatttcaaatgttagctcatttttgttaatggtggctttttgtttgtttgttttgttttaaggtttttggattcaaagcataaaaaccattacaagatatacaatctgtaagtatgttttcttatttgtatgcttgcaaatatcttctaaaacaactattaagtgaaagttatctgcttgttagagtgaggtagagttaaagatacattttaacagaattgtattcctaaaccgattaagtcaagaagtccaagagcattgttagatcatttagaaagtgtagtgatgaggtaaaacattgttggcacagattcatgttacttgatctgctttaaatgacttggcatctagcccatatttgagcccataaccgtgtggtaatttgaagtgtaattcacagtagagcttctgttaaagcactaatagcatcttccatggaggtatacttcagagtgaatataattttgtttatcctgtgtctctagagctattgactgaaaaagctgttagggcattctctaactgtacatcacctaagttatttaaaattgctgaattaggtggc

SEQ ID NO: 61911 - DNA, 1258 bp, Homo sapiens
aaacgtcagaagtactgagagtggagtggacattgatattgttactctcagtaagttttcactgatttttctcagagtcatgaaggaacaaacgtttgttaagtccttatcacttattagataacacaaaacatgttgggggggtgtgtacagaggtgagtaagatgtagctcccattctcaagtcgcttacattctaatgtaaaaggtagacaaagcattacagaagaagtaactctgctatagaaggttgcaatgaagagaacattggaaacactaattttaccttataaagaaggtttcataaaggaaggcaagtttgagctggggtgaaaaggaccagtaagggttgactttcaagccaaggagaggaggggaagtgatgttacaggccaaaggaatggcattgtaagaagcttgttggcataaaagtgtttagaatatggcagcgaattcattatcatcagattgtggtgtctgtatgttgggggtgggagagaattgtggtggcaataggcaacaagataaaagaaagtaaaaggtgttatggaaacttaatgggtccagcttacaaatgatctatgcatttaggggtctttctcttttcctgataaacctctcctacaaagagccttgttgcggataccatagtgtttctttggaggaaaataaaaactacaaagctttgtattttttgcacaactggattcagaatataagtaataaaaaaggacaagaactttcaaaagctagaagccattaaactgagtcacttcagggttagactatcagaactggggatttagaaagtctcagaatggaaatcgaaggacaccaaagacaaattcggcctttttcaaaattttattctagtttaacatattcaaagaaagggaaggaaattcttttcattcctgtgtgtagtgacttcctgctttaagaacttaggacttcagctgtactatcagtattgtaggccacttaacattattatggttaaagttggcattggagagagcctaggaacctaactgcctgtttgtttttatatttccaaccattggattcccaagttaatgaagtctgtttattagttgagggtagctcttaatgcatatattttaatgccccttccccacatggaatcataagctttcagaactggagagtacctgaaagagatcatttagtccaaccttctcattttacagatggggaatctgaggcctagagaagttaagtgagttgaacaaggtcac

SEQ ID NO: 61912 - DNA, 3334 bp, Homo sapiens
gttactgcttttgtatttaaaactttttttttattataagtagaattatggaacagtagtagaaaaagtttgacttttgtaatcagagatactgagcttgagttctggctctttcatttgtatactgttatttggggcaagttttttaatgctcttaagtcttagctttctcatatataaaatggagataataacagttatcacgtgattgtgaggatgaaacaaaaaaaagtggaaactctttgtaaggtgtgttcatctggttgacacttagtagtcattacttccactttccgtccatatagtcctcttaacagtaatatttgagaggcatttttattaaagcagtcttaaggagtgttcgtcaaaccacatgttctgggatcctgagaaagtaggggaagtttagagaactgaagctgcacaaaactaatgtttattttctgttgtgttgtcctgagaccagcttcttagattgtgtttcctagtcctacatctctgattccttataaaatattccattatgaattcttcactattgacaatttctccccttttatcttaaaagtaccaaagaaagtgtaaaatgtgactgtcttgtcagtcctctttttcctgtttttcatgtcagtgggtatgaaattactagcaaggatgcatatatgtgcatatgtcattactaaatgcattttctttctagaaaaactcaatatactaaattgtactaaaaaggaaaagcttgttttgttttgagtggtagtatgaaagttgttttattttaggtctgaccagttagaaaccaatggattgtagtttatttataattagttaaaccttcatgtgaatttggttttgaattacctttaaggtagagaagaaactatatagatgtttttcagggtttctaaatgtacaatacaggttcacaatcacttatttgaaactcttggggccaagtatgtttccattttcagaaattttagttttcaaaaggtagcacagataaatatacttttacataaacaccccagtggggtgtgggtcagtacctgaaatgaaatgttttactcttcgctctaagtgtattaaatattatgtacaatcttattacttcagatcaggatttgctgtagttgagtttgccataaaacttaagagaaaattttagatgttttgaacttttgggatattgaaattgcaggttaaggagctatggacctttatttgttttaaaatgctaagagtttattttaagtaatttttaaaaaatttgttttgcatagtagttggagttaccagggtactgctaaccacactgatatgtaagatctctttctgagccttttattgtttgtaaacatggcctgttaatcattagaaagccagtacatactaacatatcactgctattaagacaaatattagcatactctagtaatgacaagtcagcattttactattctgtattgattttacttattctttcattactctcatactgtaattaaaacttgcaatctgagagactgttgaaaaaggtgatcgttggcttttcaacagggagtaaggtctggtttaaaaaaaaattagtaagcatttggccaagtagattaacaacattcagtttttctttactgtccttatgcttttactatttttaacatatatctttttgaagaatagtttgagaattatgtatgcttaactatgagatacagatactattgaaactagtcagttgtttataggtacttgtaaaattaaaaatatattccaatagcatgcagatttttcatagaggaaatttgaaagcatggaagcacctgaatttacagtactctgtattagtggcatcacaagtttttaagcaaatgtattagctctaattgcatacacttaatcttttaagctttggttttattattataatatgggggtgataacagtatctacttaatagaattcttgttattacatgaaataattaatgttaaacacagcataatatgtgtcacattataaagattcaggcaatgtttgttagtattagtacttttttttcttcctaagtgcaaaagataactttatatcacttttaaacttttcttttagttgtgctgaaagacattatgacaccgccaaatttaattgcagaggtaggtatgaatgtactgtactatgttgtataacttaaacccgatagactgtatcttactgtcataacaataatgagtcatccagattatcgagtgagatacatatttaagaattatctttaaaaatttcaaaaattttaattttactgttgtgttttaggaaaaagtattgcataaagctattaatattgtcaggaagactaaagtgcagcatagactaagaattaggaaaattcctagactaaaaatagtataaggagagggtttacctactatttgaggcagttggtctaatagtaagcaatcacagggagaaagcagaactacttaactcttctgtgttgaggaatgacataaaaggtaggaaaggatataacaaatgttgataagaggagtctgatggatgagaggagggaactgctttaaatgagtttctacttcagacataagttaattctcagagcccacaaaaactttcacttttatttgtgaaatacaactcagttctcatggcttaacactttaaaccatgagaaaactgaagagttgagaagcttggcagatgctgctgtgatagtcaaaaagaaagtgggtgccatgagctactattgatgtatttgccattgatccctcctgaaaatctagaatggactttcagacaaatggtttgaaaattctaaatcactaatgattgagatttagtataggtttactaagaacgggttttttttgtttttgtttttggtggatttaggctgttgcttactaagcaaagcaggctttagttgaggtttatcttgctttaaacagatatttaacagattttcctggaggtttttgtgtaccactgggaaaatgaagttaggcagatgactaagtgaaagctgtcctgctgactccttataatgatagtcattgtctaccagaagatctctcctgtcacaccaaaggataattgattatatcctgtaccatattatgagtcacctgattggagatataagacatacttctcacatatttagatgacacaggttagtacattgaatatcagccagggtttttaaggatcttaatagagtggaactaaggtagaaactattaagagcaattaatagtgatatatctatagtcctgtttctaaacaagtttttttaaaaacctcaactctgactata

SEQ ID NO: 61913 - DNA, 5225 bp, Homo sapiens
tattagtaatctattctgtctttggaatatgttttgtgatgatgaaataaatactataaatagtattattccttttgcattgagagtcctgacgaaatgtccatgtgacagttcattttgggtttagctctacctctaatatgtgacctatgctaccagtccgtatagcgtaaattcccagaatatatcctcctgaataaaatgggggaaaataatacctggcttccttaatgattatatttaagacttatcaagagactattttctatttaacaattagaaagttaagcaatacattatttttctctggaatccagtgtttcttttaaatacctgttaagtttgtatgcaacatttctaaagttacctacttgttaattaaaaattcaagagtttttttttcttattctgaggttatctttttaccacagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaaggtaagttattttttgatgtttttcctttcctcttcctggatctgagaatttattggaaaacagattttgggtttctttttttccttcagttttattgaggtgtaattgacaagtaaaaattatatataaatacaatgtataatatgatgttttgatgtatgtgtatatacattgtgaaatgattactacagtcaaactacttaacatattcatcacctcacataattattattctccccccagggtgaaagcatttaagatctacaagctacaattttcaattatacaatgttattattaactatagtcactatgctgtccagtagagcttcagatcttgttcatcttgtgttcctccctccccaccctcagtccctggaaaacaggttttaaagatagttgctaatccttatttcttctaaatttttaaatcagttgctgcctcaatttctatatgagaaatgactgattgatttcatttttctgttcacgctaccattttcatatcatactagcacatgttacccattaactgtattgcagatttggtctcacaaaattcttctaaaataacatttttaaaaagcatattaatcaaaaataagctttatatttctgaagcttgtttgagcatagaatgcctttggataaaataccattacctagtaaagtgtgaacttttataatccataaaaattattcttttataagaatattcataaatgtagttagattaatagaagattctcgattctttgatcagaaaactaaggactatattgaaaaatcagtgacaaatttaattcttatagtacatctgaaagaaaaaagaaaactcttgggagaacttttacagtgatttaattttgctgttgatatatttctttgggtggtaagtatggcaaaacatgttaaaatttaatgcaaagagattttgtacatttttccatctctaagaaggacaaagcctaagcccctccagatagatagaaaaactcatttagagagttctccttcatgttaatctaatttcttcttaattcagctgtaaaacagaaatagaatgatcgtattaatcatttaaagctgtgtaattgcatagattccttgttcctttaccccctcttatatcttgtttcctatcctttgtgactttttttgcattatatataaggatgccgaaatactgtttattgttgatagtttacaaaattgaatcttacattagtgcataattttggtgaatgttgaagattatggtagattgccttacatttctgcatattgtttgcaccttggaatgatagcactggcatgaattatagagctgaggatctaaagatttttactttgatttatcccattatcatctgcagggaaacaattgcttttactgattaaaaatgcaggctgggcacagcggctcacgcctgtaatcccagtactttgggaggccgaggcgggcggatcacaaggtcaagagatcgagaccatcctggccaaccaacatggtgaaacctcatctctactaaaaatacaaaaattagctgggtgtggtggcgcgtgcctgtaatcccagctactcaggatgctgaggcaggagaatcgcttgaacccgggaggtggaggttgcagtgagccgagactgtgccactgcactccagcctggtgatagagggagactccatctcaaaaaaaaaaaaaaatgcagtagcaaaagcgatggtagaaatttaaaacagagttgatgagcagcatatattttggtagtggaaaaaaaggtaaaaaattttttgtaataaaatagaaaaattttgtaatgtggaggcgcagaacactagatttaagccagggggtcttaaattgtgttacattccttttaaagtctgatggaaggtataaatgttctcccctcaaaaaatgtgcatagtgtacataaaattttgcagtttttattacattgaaatatattcttttagacagaatgtaaaagaaccttcatgaaaactatgtcacttttttatgcaaaaaccagtggctactacatgagagcaatgaataaatctaagtggtacaaattaaccaaaattaagctttagttctgttcaatactaaattttaatgaaaagactgctatttaacttttaaaataacaagttgaaactatgctctttgactttgactttgcaacttttatatgatctttgatatccaatcagtgttgactttggtaaaaagtgctgaaaatgctattttacaaaagaaagaagagtaaatggaatctgtagattctattgcctgatgaaagtagacgtgtcaagaaataagaattctccaaggctcttcagataaattcatgtttcatcattttctttgccttcaagttactgagatcatttttggcaagatctgtatcattaatgctgtgttaggaaagaaaagattatgactccacattttactttcaaggttgaagagttaaactgtttaaaaagagtgtatgttatcctgtaaacagcagtatcaggctgtagaatttgtcttctgaaagcagggaacttatatatagcaaagaacttcatagtgctcccatttcttgacaaaacctctcgagaagctcttgattgaaagtcttggctttcatgaatctggcagctttcacaatagtggatttttcatgacaaatcatcttacacagggaattattcaagggttggcacttgaaacagtagaatactttcacaacaagagataagatttctttcaggattgatgacagtcttgcaccctagcgcatactgatgaagagagcagtgggtgaccatgacatggagagcttctgtctttaccagtgccccaatatcagatgtgttgtctggcagtaaggtgtactgtctgcctacagaatactgaggtttcttcaggagaagttttttggtaaagaaactttaccattttgaaagtgttaatgttttctgaagcttccaaaaagattccaaaatgggaatgtttccttgattgtgtcaccatgcttgcatttgatgaaaacttgtagccggctatactgagaaatcatatctgaagaaaggtggtacttccaatctttttgtgacctactttattattgtttttttaatgtcagggttttttttggaatggagaaaagtatttgatagaggtattgcaacagtcttattcttcttcatgctacaagtatatttgactctttctaagatacttgccttcactgttcaactgtgtgactttttgtttgtttagcattacaatcaatatcctagtaggatgatttaatcaatgatttttaattggaacaaatagtttttgtaatggtctaggcttttccaacttaactgtgctctcacatgtggtctctttttctccctctttcctccttcttatacactctcacccacacacatatgcatacataccctgtctgatgtatctgcttcttcagaatagttggctgtgctctgctgatgatgagaacttgccatttaagaaggacttgggatagtccatgtcatcatgttcagggataaaagtaaaacccaagggcatttaaactttattgtattttattttctgtttccagtccaaattaaatccaagagaaggctccataatcaaaaagtaaggacatattttaaatttgccaatgggaagatattctagtcattacagtctggtaatactatcaattctgtttctcttcagaggtgaggggagactatttgatgaaatcgtaagtcctgtagggtgttgtgaaatagggccagaatgaaagatagcaagaatagtgttatgaaaataaaatgcaaagtttataatatcatgtggtaaaatgtaatagtatttacttcatcagtagaactgctctagtagctgtatattctccatccttgcataggttggaatatcccccaagtgaaaagagattgatgggctaatagttaatagaaaatggagatctgtacatacagtgttaagaatgtagatattaaaattgttatatttagctgttacataatattaagactcagagttaagtaatttcactgaaattgattgctttttgtgtcttggagtcaaaataaataactgaaatctactatacttggctcatgcttaattaatatacttagaccatatttcggatgaattattcacagaatctaaaggagtatcctcgtgttcttaccttctttatccctgtgtttatttaaaaaggcaaaaaaaatggagcagatgctgttggttgaccatattttactgaacagtagcatttgtgtttaggttgaaacagcattagaaaactagatacggattaaagtcagtggtaggtttttttttttttttcttccaggaatgtttcttatagatgatcaaacaggcacaggaaggggaagtgttgtgatcaatattatccagttaatattagcattcagaggaaaatttgagtcctctgatacactgttaaatttctttctatactatcaagtccacaaatcctggaactgcaaaagaattttga

SEQ ID NO: 61914 - DNA, 1530 bp, Homo sapiens
taattaatctctgtataggctcaggctttcctgcaaggttatgaaatgctgataaaattggtcttattttgaaaggctcctcagcttatacctttccttacaaatgcttccttacaaatgctaaagcatttaatgactcctgacttaaagggaatttggacagattgaggttgttggtcttggaaatataatactgcaggcttctgtaaaatacttgaaatgtaattgttttaaaactttcaaagataccacttgtttgcctgttggttagaatactggtgaaataatttttaatcttttatgaataactaatttcatcataagaaaacttagctaagcatggtaaagctgttgttatacaactgtggaattcttcctgaggagtaactatcttataataaatgtagttgattatctaaagtagttttattcttggaatatctcataataggtttattctcttcttgtcagtatttccttgtagattgagcctgtggatttgcatttttgtaattgtgaatcaccattataggagatacatgcattttatctacttttcagtttgtatggggttaactttattagaattatctttaatgttattttgcttatatccttaattttaattatagacaaacattaagaagctggagaaaattatgttctagtgacatttatatagaagaagaatcttttttccccctttcttttttgaagggagatgaggcagtcatattttggtaaagaatttgtagactttgcagaggtctcttcaaaataatctggctcagagtcttgacatatcctcagcagacatggtgcaaattagatggcagagtggtgggtacaagttgaccataaaataacgcattaggttagtaatgcccaaataatactttgggttttcagtgttgcagagaagtcagacaactgatagttattataaagaaaaatgttctgagagtgaggtaaccgcttaagggaaggaagcctccttctgtcttattcactaatttacaagaagataattgtgttacacttccttaggagtcattcatttgtatatttgacacttttgctttatgaacatgtgaagattattcaaaagtaagctgttggtgatttttttcttccaagaaagcatgccacagggcaacttctagggttggttctcatctagtcctgtgctccacactatctgcatctgcacttaagtttcaatattagataactcacatgtttaaactatgaagaaagagttaaaacatcctgagaatgctagtaagtatgtatttttgaaaggacttccaaaatttgagtttaaagaggtaaactccttttacatgacaaagttacttagaaacactactgctgtttccctctcccttgccttctccctgtcccatgcatacccccagctgtgttccagaatgatggcacataaagtaaacattcatatttatttccctttttttgttttttttttttttttttttttttgcttgtttgttttgtttttttgtttgagac
